United States Patent 9,328,346 (POLYCOMB-ASSOCIATED NON-CODING RNAS) - sequence listing, part 122

SEQ ID NO: 191261 - RNA, 178366 nt, Homo sapiens
aacaagaaccuguuuuauuuuuuccaaauacagauacagaagucugcguguuuugcaaauauugcuucaaagcaacauuucuauauacagcgccuucuguucuaauagcgcguaaacauagauauguauccacagugcaauguuggcucaucaaggauccaccuugcauacacuuaccacuuaaagaaacaaaaugauuagucaaaccggaacuauuuuugucaagguaauuuuuuauagguggauaguuuuucuaaagacaaaacuuagguagugcacauauuucuuucuuuucuuuuauuuuuauuuuuuugagauggagucuugcaguugucgcccgagcuggagugcaauagcgcaaucucggcucacuucaaccuccgccucccagguuccagcaccucuccugcuucagccucccaaguagcugagauuacaggcguccgccaccacgcccagcuaauuuuuguacuuuuaguagagacgggguuucacccuguuggccaggcuggucucgaacuccugaccucaggugauccaccugccucggccucccaaagugcugggauuacagacgugagccacugcacccagcugauagugcacauauuucuaaaugguaacagcaauguuugcaaauaacgguuuccagugcuccaacauaggguuaauucaccuugacccaggaauugggaauggagccccucaacauggcuuuaaauuagggaagcacaaugagguuauaagaacuuggggagucuucucugcuucccuaagaacaaaagucacaaugaaugaaaggagauuacuuccuuuaccaaaaauuuaaacaauaaucccaauaauggccaguuggcaaaauuagggcaauucaguuucugcuuacaucguugaacaagacaugaaauugacuaccuuaaaaguuacagcuuccacagaugugauuaaaacucaaauguauuuucagaaaagaaaaaucaguaaucuaauaauacaacaaucaucacgccucacagguguggcuacagaaagccauccuguuucuucccuuuucagacugcaugacagaacucuuacaaugcagcugucugaacgugcaugccaugcacgccugugcauuucuucccacgccagaaacaccaacguuagcagugagaaacagccucuuguagaggaaucgucguuuuguuauagauguuauagccacguguauucucucugauggacagcuauagcagaucagcuuauacuuguccuauaauucauuauauaucaaauggugagcaaaucacuagacagaacauucccugaaauagauuuuaguacagaggccugaauucauguccacaaugaccugugcuuaacuauuccaaaggucgcuaaagauacuguuacuacuauugagauauuauuggcuacuucacguuuacauaguaaauguuugcagcauauaacauuacagacucauaaacccauaauuaacuuauaaguguuaauggacaacugugcuuugauuuuugccuuuagugauaagaaaacaaaguagugaaaugggucacuccucaaagcauggaacauuuuaacuuugccuaguaaggaaaaacaaaacaaaauauagcaauuacauguggaaccguaaccugcaaaaguaacacaaauauugucucaaaagguacaaauagguuguaccuggaccuuaagcagcaugaucaccuugcucucacaaaauaauacaaacaggaaauguaaaauguuaaaguauaguaacaaaacaauucugaaaacgcugacuacuaaacacccuucaggaaggagaaaagucgcacauguagaauuugaaguuuguuuacaacaauauaaaauaagguaauuccccaaaccacauucuuuguaacaaaucuuuacagugaaagaguuugaaauuuugggaaacauuuuuggacauuaaauagaacggggaagcugucaauauuaagaaguggguagaaaaugcuguccuuuggguuccagacccugccugcuucgguuuggaauuccuccuagauucuuauuacugugagugagauucuaguucuuccauaggcuguaugggcucugcuacaaaagccauaacccagccagcucuggggugaaggcauacaaacuuguccccaguaccaugaagucaugcaagagauguggugagaaaagugaagaguccuaaggagaaagcagggcagccaagacucugcucuuucccaaccuccacagcauggugagcucacaauauuccuaugaagcuagaaaaggaaaaugaugccugcugcccaaacaccaugccaggaagaaaccagggaguuggcaugugccccaacgugauagaaaagucaauuaaauaaacuccaaauugaauuuacaacugucuccaacuaaacuuuuuuggcucucauuccguuuaucaucaguggcacaauuucaagugaaguuugugcaaaaagacucucuucauucaacgaugugcacagaagaggggaaucccaagagucuauuugcuaccuuuauggcaggcuucgagaucagaguguccucccgcagccaaaauggccucuuuguccaauguccaccacacuccuggcccagaucccugaagucagucggugucacgugcauucagcaugcuagguuuauuuauuuaaauaugcgaagcuccuccugcaggugccccaggauugugcccccaugaguuuugggugcccaguuucauguugagcagcagagggcgaucugcugcaccuugcccagguccaucagcagcugcuugauacaaugcuugagcugcggaagccuggccagcggcucagggggcuccaguuccccaguguaguccagccagcucuccaacacugucggcagaagagagagaugagaccuagugaacucccaacacuugauuugcaagaacaucagcaagcauuucagcaccuuauuccaucagacauggggcaagggaggaagggccauuucagccuccauggggcaagggaggaagggccauuucagccagcacugugucaacaccugcucuacaaagugguacucccaggacaaaacacaaaugcuuuagagcagcacaguccaaaagaacuuucugcgaugaucaaugguccaagucugugucauccaauacaguagccacuagccuuaugcagcuauugagcgcuggaaacauggcuaaugcaacugaggaacugaauuuuaaauuuuauucaguuuugguuaaacagccacacauugccagaggcuacuguuaccagagucuagaagucuuggaaggaagcaccuuucugaguguuaccacucacucuuuaaaaagcuuucccagccgggcgcgguggcacaugccuauaaucccagcacuuugggaggucgaggcgggcagaucacaaggucaagagaucaagaccauccuggccaacauggugaaaccccaucuccacuaaaaauacaaaaauuagccaggcaugguggugcccgucuguagucccagcuacucaggaagcugaggcaggagaauugcuugaacccgggaggcggaggucgcagugagccgagaucgugccacugcacuccagccuggcgacaaagcgagacuccaucucaaaaaauaaaauaaauaaaauaauaaaauaaaauaaaauaaaauaaauaaaauaaaauaaaauaaaauaaaauaaaaaauaaaaagcuuucccauguugaaaaucagagagccugguguuuuagcauccugucaagaaaaaugaaaaucuauagggucuugaaaaggucuauuuguauaucauaaacucugauuugcuucauauuaauuccugauugauacgcaaucaucaguggcacagaauacucuguuauuauuuucucccuuuauuuauuuacuuauuuauuuauuuuuuugagauggagucucacugugucgcccaggcuggagugcaguggcgccaucucagcucacuguaaucucugccuccuagguucaagcgauucuccugccucagccuccaaaguagcugggauuacaggcaugugccaccacgcccggcgaauuuuuguauuuuggucucaaacuccugaccucaggugauccacccaccucggccucccaaacugcuaggauuacaggcaugagccacugggccuggccuuuuuuuuucuuuugagacagaguuucgcucuuguugccugggcuggaguacaauggcaaugaucucgacucacugcaaccuccgccucccggguacaggcgauucuccugccucagccuccugaggagaugguauuacaggcacacaccaccacgccuggcuaauuuuuguuauuuuuaguagagaugggguuucaucauguuggccaggcuggccucgaacuccugaccucaggugauccaccugccuuggccacuuugaaagugcuaggauuacaggcaugaaccaccaugcaggaccccuuuaaauauuuaauguaagauuucagguauuaauuaacauuaucaucauugguucaauaucuagaaagcugucuugcuugugagaacaaguauuucucuacagaaagauguuuguucuucccuaagcuacccccuaaagcucuggcauuuggggagagaccaucugggaacccugcaccuuugacaagaaccacccccugcagguagccccugugcuaucccagccugccuguagccuuucuaguccaugcaccaaccuguacugagcaccuucuggacccuggagugcagcaaaagaaaggcccacccaguaccucuucaucaagcagccugcaaccuacugcgcaauccucuccuguccucagaugcagcccuaccuuccucuccaccuuucuaaauccucuguuucuugugagcuauucuuuagggaagccuuccccaacccuauacccugaaucugguccuuguguuacaggugcuaugauaucacauguucuccuuugagcauuuacuaugguuugucauuacagguaaugggaugauuuguuuaauauaugucucucccacuagaucaaguuccacgagggcaaaggcugagucugccuugcuugccacuauaucccuaacacucaccugugucugaaauguggcaagccugcaacaaacacagcgagagaaggaaugugugguccagcaaagcgcccuacccauugcucugggcccuauguaguuuauccuccuccaucauauuucuuguugguauuuggggguuccaagaaggaggaacccucucucuuccuaauuccagcaaguacaaggacuuggaaauaagaaaaauaagaccaccuccucagacuuaagcuugaaaaccauuaguaaaagaucagucaugugagaggaacuaguggccugcugagcaagaaaacuggauagugaccaguuucaaaacaccaguaagucuuuaaaaaaaacuagaaggagacaggggacuguucagcaaacaggcagaagaauaaauggagaggccggacgugcacgccuguaaucccaacaccuugggaggucaagggagguggaucaccugaggucagaaauucaagacaagccuggccaacauggugaaaccccaucucuauuaaaaauacaaaaucagccaggugugguggcaggcaucugccugcuacuugggaggcugaggaaggaagagucgcuuaaaccugggaggcagaggcuucaguaagccgagaucaugccacuguacuccagccugggcgagaaagagcaagacuccgucuuaaaaaaauaaaauaaaauaaaaauaaauaaauggacaaaaggcagucaggacuggaugggucacuccaacagcaaagagagucagucaaucuuuugcaagaugauccuacaguugcugagaggccccucuuaaggucacccuaacuaccuuggaucuaguuccaggcucaccaaagacaucccgauacuacgguggcccaggaggcaugcacagugugaaagcgcaccaacgcucagacuggaagagucuaagccacucaguagugccugagcuugguuaacaggaguguguggaguuccugagauggaagcugucugucuaggucuguuaggcugaagaacaaagccaggacugugggaagucaacagcaucuccucuggaccccagcauccagcaggccacccucuccauaccaugugcugcaccaucccaagugucucuuuuaaagaugcagaacagcuuccaacuagcauagugguugcuagcaagacagaagguuacagaggaaaaaauucuguucaaauacacuaagaucauguguauagagaccacugcucaccaaggcaacauuuuuuauuuaagaaaauaaucucucuaaugccaaaagacuuuuuuacuuuucauggucauuaaauauccuuugucuuuuaguuuuaaaguacuguucaggcugggugcaguggcucacaccuguaaucccagcacuuugggagcccgaggcaggcagaucaugaggucaggagaucgagaccagccuggccaacauagugaaaccccgucucuauuaaaaauacaaaaauuagccaggcauggcggugugcaccuauaaucccagcuacucgggaggcugaagcaggagaauugcuugaagccaggagguggagguuguggugagccgagaucgugccacugcacuccagccugggcaacagaccgagacuccgucucaaaaauaaauaaauaaauaaauaaauaaaguacuauucauauaacuacauaaauaauuaaauaauggccaauuguaaaacaauggcauauauauauauauauuucauauaauagcuuacuaggcuuuuuuuuuuuuuuuuuuaaagaaauggggucuugcucugucacccaggcuggaguacagugacacgaucauagcucacuguaaccuugaacuccuuggccucccaaagcacugggauuacaagugugagccaccacgccaggucagcuuuuaaauuuuuuuaaauuuuuuauuuucagacugagucucacucuguugcccagucuggagugcagugauaugaucucagcucacugcaaccuccgccuccuagauucugcugcuucagccucccaaguagcuaggauuauacgugugcaccaccacacccagcuaagcaggccggcuuuuuaaaaaaggaauguuacauccaaauuccuauuuuaaaacuugguuaugaaagcuuaguuuagggcuggguacgguggcucacgucuauaaucccagcacuuugggaggccaaggugggcggaucaugaggucaggagaucgagaccauccuggcuaacacagugaaacccugucucuacuaaaaauauaaaaaauuagccgggccugguggcgggcaccuguagucccagcuacgcgggaggcugaggcaggagaauggcgugaacccgggaggcggagcuugcagugagcugagauggcaccacugcacuccagcccgggcaacagagcgagacuccaucucaaaaaaaaaagaaagaaagaaagcuuaguuuaucuugguguuuaaauaaagaguugauuccauaaaaagggauuuugauuaaucuuaaauacuaugcaaaagucuguuuaccuaaauaaaaucuuuaagcuuuaucauuuauuuuaaugcuuucuuguuaucucucucagggccuagagucuuagaaauguacagaauauguggcucugaauuagcaagacacacaagaggucaucugugaggccaaagaaggggguucaggccuaccauccuugccacacugcccauucggcagggcuagagaggccaaaccuggcugaagagaggauuaaggaaguaagaugugaguagacuuuaacuucucccucagggaaggucccuguggcaacaaccgaacauucacccuguuuccauggugcuaauccucuuuucagggacuacagagccacuccuacugccauucucucaagagcuacacuuuuuugucuaacauuauauccuccuucagcucucuaauaauauguuuuucacagacaguggcaucaguuacaaucccuuuuuuuuaguuuauuuuuuuagagacagggucuguguuacacaggcuggaguaccgugacauaaucacagcucacugcagccuccaacuccugggcucaagcaguccucccgccucagccucccaaguagcugggacuacaccccuacacuuggcuaguuuuuuauuuuuuuguagagacugugaugcccaggcuggccucaagcaauccucccaccuugaccucccaaaguacugggauuauaggugugagccaccacacccagccuaggucuugcugucucucucacuguccuccaacagggcaacucuuuuuccagucuagccagaucauccacccugaguccucuccaguaggaaacaccaucacucuccuuaaagcucaacuucagucucaggaguuuuaggaagcccuccuauuagcacucuccuccucugcauugacaucagccacaugugucccggccacaccucauggcaucacuuguauaacagauggcauuuucuccugaguuauuucauguauguuuuauauucccaguuacaguaaaaaaucauagccagacuguacccagaauccucaaacaacauuucuuuuuuaacugggcuccauuuucaacaugaaaacaaauaauuagggaauauuucaacaaccaaaaccgucaacuuccuggagagagacugaacuugaucauguucaucaucaccgguuugauccuccaggccuguccguaaccaccaauaucuggaaggaauacucagggcuauacaaaugacucaggcaaauucucaaaucucuacuggcuuacgaggagaaagcuucauuuuagauuuuaucaaagauuggaauaagagguuuuucagauuaaauccucagauauccuaaaacucaagucaaaauuuuaauuucucacagaacuuguuuguaaagauuggcuuagaucacauauuuccugcaagcaggacugccaguugcccucucucugcauacucaacuuuacagaagggaucagacaagugaggcaggacccaacaucaugcagaucuugcaccugauaaauacuaaaaguaaggcucauccauccugaggggagaauggagguggggagaggcugaaaagaagagaagcaaagaguacagcggucccuguaaacucagacugggggguucagaaagcagcucgucugggggugcucgacugcaugccaaugcacagggggccaaugaaggagcccuaccauccaacuccuucucaauggaguccauccugugcguaacuucauccugaagagauuccacaugggucagcagguuaaacugccacuggugcugggagcucagcagccccucuccaccucuguccagcagcuuccgagcaggggcuucuucugguagggccuuuuuggagacauauuccuucaccuggggaugcaauggcauggaaauuacugaauggagauagccccuggcccauuuuucaaccagccagcauuuccagccaccugaaauacuagcugcaguuucaauacuccaaaucccuaccucccuuuccuauuucccacuuaggaacugggcaggagcuugcccacuguaccaauuccaacuaccucaggguagcacucuagcucaggggacccacagcugcuuccuacugacugggccaauguccuagccuaaaguaagccucacagaauggcuuccagagcccugagaggugauuagagcagggcuagugcagacaaggguuaguacacgggagucacaccaacgcguuucaagucucagcuccaucuccugcgaaugugcgagucuggauggacuacuucaugucucugagccucugcuuucucggugggaggauggggguacuaaaaccuauuuggaagguucaugaggaugaaauaggguaaggcacauaaaagcaaggccagcuuacagucagcuuaccaucaauggaaaagacuguuagcccugguugcuuugcugaggcccaguauuuccuggcuuuguuuuaugugccagauaccucuaggaaaccugccugauccacaggaccacaaaccuuuucuaggauuugguaacucaaccuuucauucauccauuugaaaugaaauagauucuagccaauauuuauuuaguacuuacuaugugcaaaacugagggauuuuacugagggauuuucacaaauauguuccacaguaacugagggggcuucacuggccccauucuacaggcgagaaaacaggucugaucaggaaagugaaguaacccgcucagaaucacacaguaaggggcugagcucagaauugaaacugcgucugucucaaaagacuguguucuuaccaccuugcccaacaccguuuagacauagucaagggcacaaggaugcaugagauacaauccccucccuugaggggcuuguaaucuaggauccccuuggcaccaugcagcaauguauuuaacacuggugacaccaaccugcaggagaaagucugggaaguaaggaugaugagacagagaaacucucaaaucauacaaagccucacugacaacugaggacagggcacaaugagccuagugagcaguuagagaugaaaacaccggcaacgaggugauacaaggggguucuagaagagaaugacuugaauaacaaaaaaccaaaaguggcucuugggaaaacugaugaaaccagcaauauuuugacaaaguguaccauuuuuaccacagggcuucaaaguuaaaagucaaaauaaagcuaucauacaacuggauugaaaaaauucugccuaacaaaacauuugacucauuguuugcucaugcuaagaauuaacaucuaggugcaauuauaaugcaaacugccuuaaagaaaagaugaguuuugcuaauccauaucuccuugcuacuucccaccucucccucccucugcacccgcgccccccaccccacgugccacacuugacuaugccauuuugugggugcuuccuggaaccaaggaucuuuggcuuaagugggcucuccugacuuugcacccauuuuggcaaaccaaaacauaucuaugguaagcaaauuuaaauacaguuuuauuaauaaauaucuuccauagagcauucaaacuaggaggauaacuugcaagcauucacgcaaugaaugaagaacaaguacaaggcagccacauaccuuuggggagccggguuuggggucacugucccccuugcuccugucuuggucuagaggccagcccaggcgcggggaaagggaaucaucgccguucucauggaggggguugaccgcaucgucgagggcagagccccucgucuccaccaccagcuucugcuccacggcaggguaauaggcgcggggcuucugguagcaaugcucacuggugauauaggauuccuccacagaacgcggcaggggcagggccaggggccugggcuucuccacugccccguucaaaguucuauagcuuggagcuuccuccuugcuccuggugucagugacagggauguuucugaaaugagaucuccccuccccugagugcuguuuccaaggcuggcaccacagcggcagaucaggaugcucccggcuucuguugagaggacaaagaggacaugggcuuuggaguaacuggcaccauugcagggguucucaauuccuaaauacucucccaguagggacagcagcuccaccugggccaucugaccacacacuaccauuugcuaaacaagagcgaaugugaauccguggucuccuaggagaccacuccuuagugagcucccacuguggucacacacagugagugggacuggacucucagucagaagaccugacuggauuucaacucugggacaacucacucaaccagcaucauuccuacuuccuccucugugaaacugggcuaauuaucugucugaucugucugcuauuguaaaccaaaaauaaaauucuaagccccucaaccaaccugaauggaccccuccucuuggccaagagcauuccaacauuaaacugaaacacuaguucaggccaugaugggaagggagucagacaagccacauuauacccuucucccuuuggaauucaugcacaacugaccagcauuaacauuaaaacgggccgggggcgguggcucacaccuguaaucccagcacuuugggaggccgaggcaggaggaucacgaggucaggagaucgagaccauccuggcuaacacggugaaaccccgccucuacuaaaauacaaaaaaaauuagcuggacgugguggcgggugccuguugucccagcuacuugggaggcugaggcaggagaaugccgugaacccaggaggcagagcuugcagugagccaagauugcgccacugcacuccagccugggcgacagcaagacuccgucucaaaaaacaaaacaaaacaaaacaacaacaacaacaaaacauuaaaauagagacccucagacugacaaaacagacuguagcaauuaagauaccaacauaacagauagcagguacugaaagaaaucaaaguauuuuaccccaaaauauauuucuuugacauauuuugaacuagcccuggaagcugucucuuguggggaaaucuacauucuauagagaaccuccuuuccuuuccagguccuuuccugauccaggagaaaauuaaggaagagucuggcaccuuuuuaggucugauaagaaacauuuacaaucuauucucucugaagccugcuaccuggaggcuucaucuacaugguaagaaccuuggucuccacaaccccuuauuuuaacccagacacuccuuucuuucuuucuuuuuuuuuuuuuugagacggaguuucgcucuuguugcccaggcuggagugcaauggugcgaucucggcucaccacaaccuccaccucccagguucaagcgauucucccuccucagccucccaaguggcugggauuacaggcaugcgucaccaugcccagcuaauuuuguauuuuuaguagagauggaguuucuacauguuggucaggcuggucucgaacucccaaccucaggugauccgcccaccucgaccucccaaagugcugggagcccaaaggcgugagccaccaagccuggcgacuggccuuuagauaauaacuugacucuuuagauaauaacuuaacucuuucaaccaauugccaaucagaaaaucuuugaaucuaccuaugaccuggaagcccacccaccccucaaguuggucugccuuucuggacccagccaauguacuucuuauauguauugaugucuuaugucucccuaaaaugugugagaccaagcuguauguagccugaccaccuugggcucauguucucaggacuuccugagggugucucacaagucaagguccucauauuuggcucagaauaaauaucuucaaguauuuuacagaauuugacucuuuuugccaacaccaucaaacacugaguuucauaacaauuaagugaauuaauggugguaaagugcucuucaaaugugacuuacuaaaaauaaccuuaacuuauuaauaaacagucacaaugaucccagcauguaauggcauuugauuacaaaaaugcaaugauuacccagggguuaaaaaaauaaaaucaacuguccuuuauguauaggucauuaaugauaaagcuucuaaaaauuauucugaaaauuuauucgcaccauuccaaagaaaaaaguuuguuauuaaagaaaagaacagggauucuuauccuuuuuagggccagacuccugugagcaucuacugaaagcugugccuccauguaugugcacauaaaaugcuguggaugccuuccuguaccuuccugugaaaguggaaguggucauauacaugaaggcauagagcgauguuacagaacuaaaauucugcucccaagggccugcaacuaucccgucucagcucucccacuccagcaaucccauaccacugcuagccacuaaggaagaggggaaacaauuggcaucaauuguuugggauaccuccagacaggguaucagccugucccaggagccuacccaggacccagacacaccacuaaaacugcucaggggaaaugggagucauuguuaacuuucagguccacuaccuguuaacauggaacacacgaaccauaguacagaccugcucuuuauuaaaaaaaccauuaaagucucugcuuccucccaccuacaauuuucauccuuccaacugcgaucugaaggugcuacuucucgcaagcaugacccugccauuuccuuguaagcccugucagucaugaagaagguaagcacagccauccaggccauguuuuuuaugaugacagaugcucugaaguuacucccaguuuuauuguuugucuucgaaaauaaauucaccaggucacuggggaacaauauuucugagaauaaagacccagagcccaugacaacagagaccauccaugaauacagagacauacuggggccaccuuccccuuucccaggaucuuuucuccauuuguaagaaguaccaagaucuuccuaugcccucuucugaauugcuagaagacagauuuaauucuacuacaaacaaaguaauuucucuaaagauggaggaucuagaugaggauucagaagggacaaggggcuaggcacaguggcucaugccuguaaucccagcacuuuaggaggccgaggcagacaaagcacuugagcccaggaguucgagaccacccugggcaacauggcaaaacccagucucuacuaaaaauaugaaaacuagccaggugcggugguacaugccugcaaucccagcuacuggggaggcugaggcauaagaaucgcuugaacucgggaggcagaaguuguagugagccgcgaucauaccacugcacuccagccugggugacagagugagacccuugucucaaaaacauaaaaaaagaaagggcaaggcuucagaauaugggccagggccaggaacacuggcauuucuguaagaaaaaagagaacagcaucugacagaacccucaaaugaaaagaaaugcaggcgccuauagucccagcuacucaggaggcugaggugggaggauaacaauuauuauuuuuaaaaaguucagcccuauuaagacugucgagaagaaaauaauaaaaauaaaagaaauaugagccagacacaguggcuuacaccuauaaccccagcacuuugggagggcaaggcagguagaucacuugaccagccugggcaacacagaaagacuccaucucuuaaaaaaaaaaaauuuuuuuuuaaagaaauauagcuaaguuuacaaucaggagcagccccugagguuucccaggcacucacguggaccaccauccaccuacuucauuuaauugcugccaucucauuaaaaacaaauucauuugguuuacaugggguuacguuuuccuguuuuaugaaaugugaggaaauagcuagucucugacauccuauccagggccgucauuugguucaguucaccucaacagauucugccacagcaacugcuaauugccccagcauccaaccucuccuccuuuuauccccacccccaccccuacuucuaaguauaagcagggccuguggccaccugcccagccugcccugccauuaggccuguccaugaaacuauuugcccucccucuucuuucucucuuuucccccuccuggggacugggguagagcugaaaugcaggugaaacugcuucaaccaugcaaaugggggguaucccaagagaaugccagagcaauaagacaaaaggaaccuaagaccaugcagauaaggggaacccuaagagaaugcuggagccguaagacagaaggaaacaaaguucccaacccaacggauggaauccuggagaaaggucuccuaccuagccuagaucccugccuagccuugaaccauucauuuauaugagaaagaaacuucuguuuuguuugagccucuaugugggggguccuuguuauagcaccucagcuuuuacccaaaccaacgcagacccaauguucccuccuccaccaccuuugucacgcagaucuugaagccaggccucugugugccagagagcacaagaggaagcagauucccaucucaccaucucaggguccugauacuccacucugccugacaccaggccuccucuaggccugaucagcacaaaggaaauccuauccaggagcagccuaucaagucuuaacucacucaucgcacuagucugccacuguuuacaacuuaaauaaaagcagucccugacacagacuauacuaaaaccaaaagaaagcucacaaggucaugcaguaucacauagagagacaguucgaaaaguaccugacagagccaggauuuggauucuaguccaggcuccacccauggaaaccauggaagaggccuaccccacucaaggcccuguugcuguauuugguaaaguaggguagguuauaacagccaagagaccgaccgggcacaguggcccacgccuguuaucacagcacuuugggaggccgagaugggcagaucaguugaggccaggagcucgagaccagccuggccaacauggugaaaccccaucucuacuaaaaauacaaaaauuaggccaggcgcaguggcucaugccuguaaucucagcacuuugggaggcugaggcagguggaucgcaaggucaguagaucgagaccauccuggcuaacacggugaaacacuguaucuacuaaaaauacaaaaaaauuagccgggcgugguggcaggcgccuguagucccagcuacucgggaggcugaggcaggagaauggcgugaacccaggaggcagagcuugcaguaagccaagaucaugccacuggacuccagccugggugacagagcgagacucggucucaaaaaaaaaaaaaaauuauccaggugugguggcaugugccuguaauccuagcaacucaggaguuuaaggcaggagaaucgcuugaacccaggagguggagguagcagugagccaagaucacgccacugcacuccagccugggugacagagcgaggcucugucucagaaaaaaaaaaaaaagaaugagcugaguugcuugagcccaggagcuugaggcugcagugcuugaugaucgcaccugugaguagccacugcacuucagccugggaaauaaagcaagacuccaucucuuguuaaaaaaaaaaaaaaggaauauuuagcaugaaagggauaaacaaaauguggcauacacauaaaacaaguuauuacucagccuuaaaaagggaggaaauucuuacauaugcuauaacacggaugaacuuugaggacacuaugcuaagugaaauaagccagucacaaaaagacaaacacuauaugacuccacuuacaugaggucucuagagaagucaaauucagagaggcagaaaguagaauacugguugucaggggcuuuggggaaagggaaauggagagcuguugguaaaggguauagaacuucaguuucacaaggguuuuagagacugguuguaaaacaacaugaaugacaacugugcagagcuguacacuuaaaaaugguuaagauggggccgggugcaguggcucacaccuguaaucccagaaauuucggaggccgagguggguggaucaccugaggucaggaguuuaaggccagccuggccaacauggugaaacccugucucuacuaaaaauacaaaaauuagccgggugugguggcgugcgccuguauucccagcuacucaggaggcugaggcaggagaaucacuugaaucugggaggcagaaguugcagugagccgagaucacaccacugcacuccagccugggcgacagagcgagacucugucucaaaaaaaaaaaaaaaaaaaaugguuaagaugguaaauuuuauauuauguauaucuuacagcaauuaaaaacaaauaacucagccagguacaguggcucgugccuguaaucccagcacuuugggagcccgagguggguggaucacuugaggucaggaguucaagaccagccuggccaacaugguaaaacccuauaucuacagaaaacacaaaaaauuagccaggcaugguggcaugcgccuguagucccaacuacuugggaggcugaagugggagaaucgcuugaacccaggagguggaggcugcagugagccaugaucucaccacugcacuccagccugggugacagagugagacuccaucucaaaaaaaaaaaaaaacacucagaacuguaugccaaaacaaaaaacaaaccaaaauacacacaccauguauugauucuggugguggcuucacggcugcauacaaugucaaaauucaaugaacucuuuuuuuuuuugagacggaguuucgcucuuauugcccaggcuggagugcaauggcacgaucucagcucaccacaaccuccgccucccggguucaagcgaugcucccgccucagccucccaaguagcugagauuacaggcgcacaccagcacgccuagcuaauuuuuguaauuucaguagagacaggguuucaccauguuggucaggcuggucucgaacuccuuaccucaugauccgccuaccucggccucccaaagugcugggauuacaggcaugagccaccaugcccggccucaaugaacucuuaaaguggaugaaccuaauuauauguaagauauuacucaauaaaguuuuuuuuuuuuuaaagaauguuuauccugaaacugauaauuuuuaguaaaggucucaaacucaguuuuaugauuugauugcuuugguagcuuuccaauuucucagauuuacucagcccccagaccaugccaaacagacugcucccagcacugcaggugccacacuuacugcaagaugcucaucuugagcugcaggccaugcagaaccucaaucacucucugcacaucaccaagaagcugguggguggccacgaucuucuuggcauucugaugggaguaguucucuucuagaaaugccaggccaugcauauguccccugcucagccacuccuugucauaccaguacuugaagccaggccucugaccuacagcagugacaacaagaggguuaaaacaaggccugaaggaaacccaggccauuucaucacucucacacaauuaucauaccaacuacuggaagaacagauuaguauacucauuuuguucauuuauucauccaguguacauuuucuuggcaccuaccauaugcugggcucucuauuagguaguggggauaagguagugaauaaggcauguacuuccucauuuccuggaacuggccagaggugagcugggcaccuagauuaucuccaaauuuauaucauaauauucucuccccuacuuaaaaccuuccacugccuccuacugcucaaaggagaauacccaaagccccaacucucuaacucuggcuuacugaggcccacaggacccaguuccuuccugucuuccccuccauaccuuuacacuggccucauuucaguuucugaaacacaucaaacucuuuccagccucaagaccuucacuugcgcaucccuucugucugcagcacuauucccuaagccuuugcaggguuggcuccuuaccaccuccucagaaaggcuuuuauuuuuuuccugcuuuguuggcagggucucacucuguugcccaggcuacagugcaguggcaugaucauggcucacugcagccucagccucccugggcucaggugauccucccaccucagccucccgaguaucugggacuacaggugugcaccaccaugccuggcuaauuuuucuuucuuucuuucauuuuuuuuugaugggguuuugccauguugcccaggaguggggccuucugcuacuucccaaaguugagagcaucaucagugccucaagucgucuuaucaauuuucccgucacggcauucaucacuaccuuacacagucuuguuuacuuaacuuguuuuaacuucuguuucuggcucccaacccaauuaagagccgaaagaguaggaacuaucuuguucaugguuguauccccagugccuggcaaaaggcaucuugaauggacuuaucaaaugaauggaaagaugccucaagucccccugcaaauguaccuucuaccaccuaacucaacagaugaucaggccccuucccuucucuguaccuguuauccauucauuagaacaacauaggaacuggauggcuucagccauccuauuuguuacagggcuccuuaggaaggacugaaaacaaaagcacaugugacuuaucaacaugaccugcuccaaagucccagggaaaagcuuucuaccagacuguuguucgacugucaauaucuauaaaaaccuugaaacacccaggugauuccuauuaaggucuuugagcuacuucuggcuuuacuaauacacaugguggggauacaccuugauucuguuaaaacuauuuuuaaguagccuuuaaaaaacgaaucuguuaaacuuuugguccagcccucugcagagucagucuauaaagguagacccuguggcagacaugcugugcucaguucaaggaagagucuauucacaguauuggcgauuaaagucguagaaguucaguaagugcacaggauuugaugaagauggugugugugacuucuaaagaaggaaaaguagagagaaagacacaguagggaaaaaaagauuuuuaaaagguaugcuaaggagccuucaggaauauaugggggaaccccagaggcagcugcugcaggcagugccuagagcagcaggauucagagcugcacuaccuguuuuacaaggcaaagguaugagacaacugguucucaucgccugucuggcauuagcugguggcgugaucuugggccagucaugucccuucuggacuuguguuuguucaccugucaaaucuucugacuauucuuuccuugggauaaagggacaaguggaggcagaugcuucuaguacaaggagacagugucacaacagaggccuucaggcccagaggggaccugcaugcuguuaaaugaacugguggccagucccucccuagacaaccaacaaaaucaagagaucuggcucugcaaaccaguucuaauuccaauuugcuuuaugaggaaagucaacuguauccucaaggaucaauuucuuccucauaagcaaaacugggaguaggagaaccaggcccaccuuaucggacagaaaggaguaacggaagcagaggcucucaagcacugucuagcucuaaaggaaucaggggacuagagcugagggagaaccuuacaagugguaaugggagacaaugucaccaucccauggaaaccaagacaaugaacugcauauuuacaauccaccccuucuagaaaggagcaaucaagagccacaggugaccccuauagccauggaacuaacugauccugcuaaggaauuaagucacugcucaggguggcaacaggcucuacccaaccaugccuuccuccuuccccucaagggcauuucucccuucaggauggcagugaugugaugaagggcagauguugccacagggggcaaaggcaaguuucuaacccuccaauagcccccaaaagccaaagacagagcccacacgcccauccucaugaguccucaagaaaaggaaaaggugccacuucggcagcacauacacuaaaacaggaacaauacagagaagauuagcauggccccuacacaaggaugacacucaaacuugugaaguuucuacauuuuucuacacagcuucaaucaggcaggaugaaaguucuggagaucugcuguacgacauugugcuuauaguuauuaacaacaauacuguauuguugaggguagaucucaugcuuuuuuuuuuuuuuuuuuuuuuuugagacgaaguuucgcucuuguugcccuggcuggagugcacuggcaugaucucggcucacugcaaccuccgccaccuggguucaagugauucuccugccucagccucccaaguagcugggguuacaggcgccugucaccaugcccagcuaauuuuuguauuuuuaguagagauggaguuucaccacauuggccaggcuggucucgaacuccugaucucaguugauucacccgccuuggccucccaaagugcugggauuacaggcgugagccacugcgcccggccucaugcauuuuuuuuaaaccauaauuaaagaaaaggaaaaguucuagcucaaggccaggccuuccacuaggugggccccuucacacgugugcucuuauugcuacguucaggauagcuggccacaaggcaggauagcaacagaggcgaggaggagcuggagucuagccgaugcugaagaaaugagucucaagaccgcagacauuuagaaugugucacagccagcugugccaaggaaaaggcuacauacuguuauaucccugacuccagaaaucucuaccuggagggucuuggcaaacauaacagguguauuucucgggcacauuuucuuccaguaaucccaugcagaccccaugcugccagcacuggcacucuucacacuguuagaauuaaagaagcaacaaaaauuaaacucagaagguguucuccauccaaaaguaagacccaccugcugaggggaggggcaugggaggauagaaggagaggggaggaaggagcacucccuccugacuaacguggaacugagcugcugccacacaucuggaacugcacuguccaguaugguagccacuagccacauguggcucuacauugaaauuaacaagguaagcuaaaaauucaguuccucagucccacgagugacaucuuaaagcugaguuugaauuauggcucagacacucauuagcugugugacuuugcacagguuaguucuccugggcuuuauuuuccccaucugcaaaaugggauacacaauuccuacccuccuccuggggcuguuugugaagauucaaugggucauauguaaaagcuccuauuacagagcccagcacauagcuuuauguaauaagcuacuauuaauacuauuaaccacuaaugagcaaaccaauucacuaagaccccugcuggaguaaucauggguuaguacuuugcauuuauucucucuaaaccuuaccaaagaucacauagcuauugaaaggcaaagguggauaagaacauaaccugacucguugcuaaaccaguucuuucaacccaaggcuccacuuccuucccugaguauugaggggacagggggagagggccagaaggcagagagggaaaggagggaguugacaaugaggguugcacugggagacauguggacagccugaggauaguaggucugagagcuaaggguccagaggagggaaugaaaaggaaaggcgaacucccgaggagauacuagggcacuucaagcaauuccaaaccaggacccuaaaccuuuaacuacccaaccaaacaaauuagcccuagaagguggacagugagcuuccugacaugaccuugaugguggcccaccagccuggccacaagggacuagaaauccagagcucagaugguccucaaccacugggagucacauagguccuggcaucaagagggcuucccugagcagauauaaggccucuaggaaguuaaucacaucagaaucaaugugggcagagcgggaagacaggcuuuagauaucuguuuuagauucuucaauuuacagaugaggaaacuaaggcucagagaagauauguaaagugacaaaaaggcggucaguagcagaaaacagacuaacaauuaaaaaugaaagucugucggccgggcgcgguggcucacgcuuguaaucccagcacuuugggaggccgaggcgggcggaucacgaggucaggagaucgagaccauccuggcuaacacagugaaaccccgucucuacuaaaaauacaaaaaaaauuagccgggcgugguggcgggcgccuguagucccagcuacucgggaggcugaggcaggagaauggcgugaaccugggaggcggagcuugcagugagccgagauugcgccacugcacucccaccugggccacagagcgagacuccgucucaaaaaaaaaaaaaaaaaaaaaaaaaugaaagucugucucaccaaugacuucauguuuugaaaaccaggauucaccaaaaaugaaucaaauacaguucaguuucaaaaugguaacuuuuuuuuuuuuuuuuuuuugagauggagucucacucugucacccaggcuggagugcagugggacaaucucggcucacugcaaccucugccucccagguucaagccauucuccugccucagccuccugaguagcugggacuauaggcacaugccaccaugcccagcuaauuuuuuguauuuuuaguagagaugggguuuuaccguguuagccagaauggucucgaucucauaaccucaugauccgccugccucggccucccaaagugcugggauuauaggcaugagccaccgcgccuggccaaugauaacuuuuuccaugugcguguagcuaaaacacauuauuccuuuaaauuaagaaaugaaugagaauaauaaacaaacuaaaagauaaaauaccuaagaauaaccauaagcauguauugccucucuaaaaaaaaaaaaaauguaaauacuauuugaagaacacacacagagacuuaagucaauguacagugcacccuguuccuggacagcaagaguuaacauauggauaucaauuauccuuggguuaauuuauaaaaagaauguagucccggccaagcacaguggcucaugccuguaaucccagccagcacuuugggaggccgaggcggggggaucacuuaaggucagaaguucaagaucagccuggccaacauguuugaaaccccaucuccacuaaaaauacaaaaauuagggaggcaugguggcaggcgccuguaaucucagcuacuugggaggcugaagcagguucaaaauugcuugaaccuaggaggcggagguugcagugagccaagaucacgcuacuacacuccagccugggcaacagagcgagauuccauaucagaaaaaaaaaaaaaaagucucaauaaaauaauaaauuaauagcuucagaacuagaaaaaauucuaaaauuaacagcugggaaaugugugaaaaagaaagagcaauauggagacacuagccauaccagauauuuuaaaaauauuauaaagguacaauaauuaaaauagaauuguacgagcaaauauacagacagaugaaucgcugaaagagagaaccagaaaaggauucaaaugcauuuagaaaugaaguaaauaaagguggcauuucaaacagugagguaugguauuaguacaauggggagccauaguucucacuauauaccuggcaaaauuucagguggaucaaauauuuauauagcuuaaaaaaaagaaaaaugggccaggcgcaguggcucuugucuauaauccccgcacuuugggaggccgaggcgggaggauauccugaagucaggaguuggucaccugaggucagccuggccaacauggugagaccucaucucuacuaacaauacaaaaaauuagccagguguggugguacacaccuguagucccagcuacucaggaggcugaggcaggaggaucacuugaacccaggagaggaagguugcagugaaccaagaucaugccacugcacuccagccugggugacagagcgaaucuccgucaaaaaaauaaaauaaaauaaaguaaaauaaaaugugauccaaccauuaugcagaaaauaaaaugguuuuuaauuuacauauugcuaaaugaaaaaagauguuaaaaauacuauacaugcggccaggcacagugguuuaugccuguaauuccagaacuuugggaggccgaggugggcggaucaccugaggucgggaauucaagaccagccugaccaacauggagaaacccugccucuacuaaaaauacaaaauuagccaagcgugguggugcaugccuguaaucccagcuacucgggaggcugaggcaggagaaucacuugaaccugggagguggagguuguagugagccgagaucacaccauugcacuaccccagccugggcgacaagagcaaaacuccaucgcaaaaaaaaaaaaaaaagaaaagaaaagaaaagaaaauacuauacauaaaaugcaaacauuugcauuuagacaaagagaugguugcaaagcaaugugaauguacuuaacaucacugacuugcauacuuaaaaaugguuauaaugguaacuuuuaggcagggcaggguggcucacaccuguaauccuagcacuuugggaggcugaggaggaagggucauuugaggccaggaguuugagaccagccugaaaaacauagcaagauuccaucucuacaaaaaaaaauuaaagaaauuagcaaggugugauguugugugcauguagucucagcuacuuagaaggcugagguggaacaaucacuugagcccaggagcuggaggcugccaugagcugugauugugccucuguacuccauccugggugacaaagcaagauccugucucaaaauaggaaaauauaaaaauaaaaaggguaacuuuuaauguuauguguauuuuaccaaaaaauuuuuaaaaggaaacaauacauuugcuauuguuuguuuagccauagaauguuucuggaaggauauacaagaaacugauaagggcugacucuacggaauggguaguuggggauaagguggggauaagguauuucucugugugcuuucuggacuuugaauuaugucagugcauuagguaccaacaaauaauaugaauuuuaaaauaaccaaaacuuucaaaugggcuucuuuguuuaaauuuuuauuuacuuaauuuuuauuuaauuucuuguagaaacggggucucucuauguugcccaagcugguuuugaacuccuggacucaagugauccuuccgcuucagccuuccaaagugcuaggauuacgggugugagccacagugcuaggccauuaaaaugggcuucuuuuuaaaacugcuauaaaaucuuuacuggaguuggacacuuaauacauauuaauacuuguuguuguagggcaaaggucagcaaacuacagcccaugugccaaugccagcuugacuuguuuuguaaauaaaguauuaugugaacacagccauacgcauuuguuuagggguuuuuguuuguuuguuuuuugagacagggucucacucuauugaacagguuguagugcagugguacaaucucaucucccugcagccuugacugcccaggcuuaagugauccacccaccucagccuccugagaagcugggacuacaagugugcaccaucacaauuaacuaauuuuuguauuuuuuguagagacaggguuugccacguugcccaggcuggucuugaacuccuggccuaaagugaucugcccaccucagccucccaaagugcuaguauuacagaugugagccacugcagccaaccauacaggugaaaauuuguuuuacauauugccuacagcugcucaaagaagaauccaguaggugcaacaaggccauauggcccucaaaaccuaaaaauuuauuaucuagccauuuaagaaaaagcuuaacaaaacaugcucuacagcgauuaaaauaauuuaaauaucaaauguauuuccuguucauuuuuaugugguagccagauuucucaaauaccguauuuauuaaguaggauuuuaaccuuccagugauuuaaauuagcacugguaaauaagauaaaauagugauauacaugaacaauguugauacuacucauauaaugacaaugauccaaaaaguuauuucucuauaguaauacaugcacuucuagaaaacacacucuaaauguauucuaggguuauucaaaauaucaauuuaagguaaagauuuaagaaaaauuuauuccugucuuccuaauuagauggugaauacauuuuaaaaguuuaaacuguauuuguucuagcuagcucccucuaaacuuaugccuuuugauaaaguuauugaguagaaaagguacguugcucacagugacaggacagucagaaaccgucccuccuuaacacaaagccaggugggcacucuugguucagguggacagcacagaaaaguccucuggaacaaaagccaagaagcucugaagugagcuugagacacaaggucuuguggagccugggaagcaggagaucaaguuggcuccugacucugccaugcucaugguggccccaauugccccgaaauuaguuucuucauauagcacauaauggcauauuaaccucuacccucaaacacaccaagauccuugcuacuuauagaaaagucaauagagaaaguaccagaguggaucagaaauggguuacauacuguuagacagaauagcccugccaggagggacauucauuacucacccacugaagauuuuaacaggcagauaaagggcaaaucugucagacuaacaaggccuggaacugagcauaugcucaaggaugacagaguagaaacuaaagaucuucaacauccuuuuaaaaacaaacuuaaaaaaaaucuacuaaaaaaugauagucuucauguuauauaacauuuuuuuucuuuucuuuuuuuugggggggaggguggggacagggucucauucugucacccaggcuggagugcaacagaauaaccagggcucgcugcagccuugaacucccaggcucaagugaucauccuacuucagucucuggaguaguugggucugcuggcaugcaucaccaugcccagcuaauuuuuuaauuuuuuuguagagguaggaucuugcuauguuuccagggcuggucucgaacuccugggcucaagcaauccucccgccucugccucccaaaauucugggauuacagcaugcccaaccaacaauuaucuaauaguaguccacagggcuucagagagucugcaaaauguguguguuuuuaagguaggacaauuaaaaaaaaaaagaugcacacucaaacauguuccaagccauauguuaagacaaugaagcccgccaccacacauaauuuuguauugcuaggauagcucaguauuauguugaccucaaaacggagcuuguccucccaucucugauuaaucaaaguaacuacacagcaugcuguucaggaaaagucacccugacaauggccaugugcaucacgcuugucucacuguuguauaaccaaauagagaaaaacaaaugagccacugaagugcuccaagucagcaacugucugucacucauaauucugacagcauauuagaaucaugggaauaugcccaccauucacauguccgaccucacaaguaaagauuauccauuuugaacuuucaaaacuauugcuguuaccuguuacacauuuugggguucuaugaaacaguccauuaggaaaagggguucugauauucaaaaauguuugaaaaccacugaaccaagguuuaauaaaggucuuaaauaucagguacccuugaaucccagagguuacuaugaaggcuauucaaaaagacaagacucucccucagccuaaaguguggguauguauguguguauguacaugcgcauguccacugguggugcuggggaaggguuggucagccaggcuagaugguacuauuauguuucaaaaacaaauuuuucuuguuucacuucucaacuguaaauguaaauccccguagcuaaggccgcauagggaaagagcacuugacugggugcccuggguucaaaucauaaucugaugacuuauuuaaugguucuacaacaaugaaagaaaucauaucuucguaauuuuguuuucccaaauaagugacuugagaucgccuuguuagaggugagaugguauuucugaaaacacuccagaaacuuuaaaucacuacucagcuguacccaguuaccuuagcuccauagaguugcuuuaguucuauuaacaaaaagagcacgacugugguacauccauagcauggaauacuaccggacaauaagaauaaaugacuacugaaacacacaacaacauggaugaaucucaaggauauuauacagaguaaaaaaggccucucucaaaaagauacauaccacgugauuccauuaaccaagaaucauaaauuacauaauuauagacaguugaaacaguuuaguguuuccaggguuagggauaaguauggcuacaaaguauggguaccaggagggaaucucauggucuuaguauaccucaguaccuugauugcgggagugauuacacaaggcuguacuuguaaugaaagcacacagagcuauaugcacacacaaaugaguauguguauaucacugauaaaaucugaauaagcucuagugauuaugccaaugucaaaugguuuuguaguuuugauauccuacuguggguuuaugggcuuuugccaugggaggaagaccagcagaggaauucaugggacucuccuguacaccucuuuacaaucuccugugaaucuauaauuauuucaaaauaaaaguguuuucuaaaagcccugggaaaauaaaaggcaaaaaagcaaauacaucuacucaucucuaguuguucugaaaguuuaaagagcuacggaaaagucccaauguuucaagaaauaaaaggaaaggggauuguugaguauaaagacaacaaauucaaagaugagaggaaaaaauguaacuguauauuaagucaagauccaaaagugaauuucaaaaauccaugccaugcagaucacaaggucaagaguucaagaccagccuagccaauauggugaaacaccgucucuacuaaaaauacaaaaauuagccgggcaugguggcaggcgccuauagucccagcuacucagggggcugaggcaggagaaucgcuugaacccgggaggcagagguugcagugagccgagauugcgccauugcacuccagccugggugacagagggagacuccgucucaaaaaaaaaaaaaaaaaaaaauuaccauaacaaaaauauuuugccaggcgcgguggcucacgccuguaaucccaauacuuugggaggccaaggcagguggaucaccugaggucgggaguuccagacaagccugaccaacauggagaaaccgcuucucuacugaaaauacaaaaauuagccgggcgugguagcacaugccuguaaucccagcuacucgggcaguggaggcaggcgaaucgcuugaaccugggaggcagagggugguggugagccgaaaucgcgccauugcacuccagccugggaaacaagugcaaaacuccgucucaaaaagaaaaaaaaaaccaaacccaugccaugccaaccuacaguacugaaagggcaaggaaauaauauucuaucacagaaagcaagccaaaggggcugggccuguuucucauaaucucaauaggcuauacagauucuuauuggacaaugggcagccacccccuuuacugggaacaaucccugaacccccauuaacgcuauaauauaacacaggugggccccaggcagucuuuuugccccugucgauaaucuguaagcucuacuaccaccagaucagacaacuagaccaggggagagcauuugauccauaacaaaccucuuuccccucuggccacaggugacuguuccaaaaacuaauaucugaucuaaauuuggcuggaauuacuuacucagaaauuuagaacugggacuaagauucugaccuuggucuaccuagccucuugaacacaaaaauguaaaauuggggcgaggccaaagguggccauuuugcauuuuccaagaaaauaagcaaggaauaaaauaaaaaagaaccaaaaggacuccagagaagcaggaaacaaggcagaccaaggcccucaagauggaauuccagguucugagccugaaagcagcccugccucugagcccuaggacccagucuauuuucccaacaauauuuguacuugccccuaaaaaaaaauccuaaccaauauaaccaugacuuuuaaaaacucagcuucccaagccaguugggcagcugucaagacacccagggaacuugugacacccuuaggagccagccagccagcgccaccucucccagaacugcaauuuacagacaagggacagggcaggcaggugcuggccaggcaugguuuccccaagcagguaaggaggucccacccaccacaggcacaucucagagaugaagaugacagacucaaaugucaggaaaauaaagaaaaagaaacauagaaguuauaaagccagccugcaugacuuuggaucuuaaagaaaauuuaccucaaagagaagauaagaguccaugggaagauuaaacugccacuccaaagauuucagucccugcuguucaacuccucacuuugugaccacaggcaaggcccuucccauuugcgggucccagcugccucaagcagagcaugagagguuuagacucagugaucccuaaaguccucucuuacuccaucaauggacuauguauggcagccuggaacucugaggaagccaaacgaaaaagagaagcucagucugcugccguucgugcuguguuucuggggcucugcuaugacuugccauuguugcuggccucaaaauucccuccaaggaccaguuugugcuucucuagaccuguuuccuggaagcucugccuaccugaaucaugaagucauuuuccuccuggaccucacagaugcagcggaccaccucgaagucauagcggucauccccaucaaguuccucaucuggguugguggucacauccacaucuuggccauacucaucaucacuccagagaaagcucucagaagaggacucacucaaauuauccuccucuacgaggaaagggaaaacaacaguuacuauuuuagguuauaaaauuaaaaaaccuuugauugucaagaaugaaaaaugacauuauagucccauaccuccaaacaagaacauucauagggcaaggaaacgaggaugccaaucuguccuuggaucugucauuuaguaacagcccaaacgaagcaugcugccuggcagugaacucaacuccacuuccucauuucacugagagaaugaagcccaacggcaguggcuacucaagaucauagaacucaguggcagaggagcuacaacuccccaugaaccacacaggccaccaucccugacaacucuaacauguucuucagccucacuccauccagucaggaccuggcuuacagucugucuguauccagagcuaccuuuaaaacucuguaaacaaaggcugagcauggugguucaugccucuaauaccagcauuuugggaggccgaaggaggaggauugcuugcacucaagaguucaagucaagccugggcaacauggcaaaaccccaucuccacuaaaagaaaaaaaaaauuagcugggcacggugaugcacgucuacagucccagcuacugaggaggcugaggcaggaggaucccuugagccugcgaguuugaggcugcagugagcuaugaucacaccacugcacuccauccugggugacagcgugagacuuugucucaaaagacaaacaggcugggcacaguggcucacgccuguaaucccagcacuuuaggaggccaaggugggccgaucacuugagccuaggauuugagaccagccuggccaacguggugaaacccugucucuacuaaaaauacaaaaaaauuagcuaggugugguggugugcgccuguaaucccagcuauggggaggcugaggcaggagaaucacuugaacccaggaggcagagguugcagugagccaagaucacgccacugcacuccagccugggugacagagugagacuccgucucaaaaacaaaaaucaaaaacaaaaacucuauagacagugaggaaugaggaagaggaagauuccagggauaaucagaggcagaaucacuugaugccugauuaguuauaaucacagcuaacuuuuacuaagcgcuuguucugaagcagauacuguucuaagucaggcauaacuauuaauauuuuauugcacuucacagauauuguauauuauuuuacaaauugaagguguguggcagcaacccugaaagucuacugacaccauuauugcaaaagcaaauacuuugugucugucagcauuuuuaagcaauaaaauauuguuuuacuuuuuauuauuuuuauuuuauuuacuuauuuuugagacagggucucauucuuucucccagagugcaguggcaugaucacagcucacugcagccuugaccuccugggcugagguguuccucccaccugagccuccuaaguagcugagauuacaggugcaugccacaacaaccggcuaacuuuuuuuguauuuuuuguagaggcaagguuugccauguugcccaggcuggucuugaacuucuggggucaagcaauccacccgccucagccucccagaguguugggauuacaggugugggacauugcacccagcuuucauuuuuuaaauugucaguuaacauaaugaaauguauugcuaguucaaauuuuugaacauuacaucaaaacaagauugaucuaaugaacacauaugucacauuuuucaggacauauggaauaacuaaacuaauuuuauuucaaagaaaguuuuaagaaauguaacaguccaggcacgguggcucaugccuguaaucccagcacuuugggaggucgaaguggguggaucacaaggucaggaguucaagaccagccugaccaacauggugaaacccuguguauacuaaaaauacaaaaauuagccaggcgugguggcguacaccuguaaucccagcaacuugggagguugagacaggagaauugcuugaauccaggaggcagagguugcagugagccaagaucgcgccacugcacuccagccugggcaacagagugagacucugucucaaaaacaaaaacaaagcaaaacaaaacaaaacaaaacaaaauauauauauauauuuuaaaauauaaauuauauauauaaacccuuucucaagagggcucaaagauauguuuuaagagucgugugugugaacaaauaccaucauucaccugcacauccacuuacacuucaaugccuucauauguaccauccuguagcaggacacacuggccaaugcagcaagugagaaggcuuuucaaugccagcaggacuuuguaacaccugggugagugggugccucccuuccagggcccauauuagguugagcacauauauauauguguguaaguguguguauaucuauauauauauauauaaaacauuuuaccuuuuuuuuuacauauauacauauauauauguauauguauauauauaacauauuuuacuguuuuuuuuuuuuuuuugagacggagucuggcuuugucacccaggcuggagugaaguggcaugaucuuggcucgcugcaaccucugccucccagauucaaacgauucuccugccucaaccucccgaguagcugggauuacaaggcagacaccaccacgccuggcuaaguuuuuguauuuuugcagagauggguuucaccauguuggccaggcuggucucaaacuucugggcucaagugacccaccugccucaccucacaaaguguagggauuacaagugugagccaccgcgccuggccaccaauuuuuacauugaauaauuuuucuauugaguugaguucuuauauauuccagcuacuaaucucuuguugaugaauaguuuacaaauauuuucuuucauucaguagguuuucgguucauucuauuaaucguuuaguuugcugugcauaagcuuuucagcuugaugcaaucccacuuguccauuucuuuauuuauugucuaugcuuuugaggacuuacuccaaaaaacuugacauuucucaacacaacaauauuuuccaauuaagguauaugcauuguuuuagacauaugcuacugaacacuuaagagacuacaauauaguauaaacauaaguuuuguaaacacugggaaaauaaaaauuaugucugacuagcuuuauuuguuuuauuguaguggccuagaaccaaacccauaauaucucccagguaugcuuguauuuuccaauaaaugaucagcaaaugaucaggacagaagagccuccuuacccaaugcuuucacuuucccuuugugguguccagauucugggccaugaagcugcgggcucauauggaccccuggcuugugugaggacccacaccugguaacagcaaaugccuuggguggagaagguuccugggaggugucacugaucuccucacugcaggggcauucuggaagaacaggaucaggaaggaaugaauaacccuaguuaacacuggugcauucuagaaucaaucucauccaaccaacaagccuccuuuucaagcagcacaaaggcucagggacaauucaaccaaaaagagguguggagagcagaugaaggggcccaaacaccuccucuuaaguauugacccucuccucuuuuucugauaagauuguuuuucuaagcuagaagauacaccaagaauaaaacguggcauccuuuaagucccaagucagaauauauagauuuuucuaaacauuuuugugagggcuagacacaguuuuuaagaagggaauccuuucucaagagggcucaaagauguguuuuaagagucgugugugugaacaaauaccaucauucaccugcacaucugcuuacacuucgaugccuucaucuguaccauccugcagcagggcacacuggccaaggcagcaagugagaaggcuuuucaaugccagcaggacuuuguaacaccugggugaguggaugccuccccuuccagggcccauacuagguugagcccacaagcccugguaagagacuauugguccuuccucugcucagcgcaggcccagaggccauaaugggagaaagcaaccccuccccauucauaguaaggaaaccuaagugaaacccucaggaaaaaaaauuaccagguuugguuuucuuuuucuuuuucuuuuucuucuuuggcuucacucucacaaacuccuugaauuucuucucuuuauucuuuuccuugucuuuuguagcuagaauuaaacacaaauguuggcauuuuaacauuuuguuuucaaugcuggggugcuuauucuucuccuaagcaagcauguccgaugggucuggcucugccugggaagucuggagcagauugcuccagucuggaggcagagccacgccuccaucacuuagccuuucaguccagcucagcacacucuggcccauggcccgucauuguaaauggauuuuagugaaacaugccauguucauugguuacgugucuuucacacuucaacagcagagcugaaaagugaggacagagaccuuucaaccccaagguugaaaaguauuuauuaucuggcccuuuacagacaaguuugcaaaacucuacuuagaucacugcuccucaacccuggcuacauacuggaaucaccuggggaucugauuuuuguuguuuucaucgccaugucacccaggcuggagugcaguggcgcgaucucagcucacugcaaccuccgccucccggguucaagcgauucuccugccucagccuccagaguagcugggacuacagacacacgccaccacaccuggcuaaauuuuguauuuuuaguagagaugggguuucacuauuucggccaggcuggucuugaacuccugaccucaggugauccagccgccucagcuucccaaagugcugggauuauaggugugagccaccgcauccagccaggauucuguugcuuguuucauucuuuuucuaaaaauugagguaccauucauauaacauaaaauuauuuuuaaaugaacaguucaugccuucuaaauaccaaaacuuuauccucucuacucuacaacaaaacuccuuaagaugucaauccucccuguccaaacuucucccuucacaguuuuuccuaauuacauucuaaaaagcuucccaccuaccacucuacugagaucaguuuucaaaauuaauagcuucaccauugaaaaauccagucauugcugggugcgguggcucacgccuguaaucccagcacuuugggaggcccaggcgggcagaucacaaggucaggaguucaagaccagccugaccaacauggugaaaccccgucucucuaaaaauacaaaaauuagcugggucugguggugugugccuguaaucccagcuacucaggaggcugaggcaggagaaucgcuugaacacgggaggcggaggcugcagugagccgagaucaugucauugcacuccagccuggcgacagagcgagacuccaucucaaagaaaaaaaaaaaaaagaaagaaagaaaaauucagucguagccgggcacgguggcucaugccuguaaucccagcacuuugggaggccaaggcaggugaaucaccugaggucaggagcuugagaucagccuggcccacauggcaaaaccccgucucuacuaaaaauauaaaaauuagucaggcgugguggcagaugccuguaaucccagcuacuugggaggcugaggcagaagaauugcucgaaucggggaggcggagguugcagugagcccagaucgcaccauugcacuccagccugggugacagagugggaaucugucuccaaaacaaacaaacaaaaaaauccagucguuucuucuucucuuaccaaauauauuuauaggauuucaaguaauucaccaugccuuacuuuuuagauaucaacaagaguuuauacguacauauauccuaugaccuugccauccacuacaacauauucauucaagagaaagcaucacuuacguccacauagagacuuauacaugaagacucauagcaguuuuaguuguaaucgccccaaacugaaaacugcccaaauguccaucaagugaauguacaaauaauucaugauguauccacacaauggaagacuuuucagcaauaaagguaggaacagcaggccgggcgcaguggcucaugccgguaaucccagcacuuugggaggccaaggcgggcggaucacgaggucaggagauugagaccauccuggcuaacaugguaaaacccugucucuacuaaaaauacagaaaaaauuagccgggcgugguagcgggcgccuguagucccagcuacuggggaggcugaggcaggagaauggcgugaacccaggaggcggagcuugcagugagcugaggucuggccacugcacuccagccugggcgacagugcaagacuccgucucaaaaaauaaaaauagaaaaaaagguacgaacagcaacauaagugaaucucaaaguaugcugggugaaaggagccagacaaaacaagugcgcacugcaggauuccauuucuacaauagucugcaaaaugaaaacaaaccaucugggcaugcuggcucacucccagcacuuugggaggccaagguaggcagaucagcuggggucaggaguucaagaccagcaugaccaauacgauaaaaccccaucuguacuaaaaauacaaaaauuagcugggugugguggcucaugccuguaaucccagcuacuugggaggcugaggcaggagaaucgcuugagcccaggaggcagagguuguagugaguugagaucgugccacuucacuccagccugggcaacacagcgacuccaucucgggggggaagaaaaaagagagaaaacacaccacaaguaacaguaagcagaauagugguugccuggagcucagggggaggggagaggugggaaggaggaacuaaaaaggggcaugaggaaaguuugggagggaauggaauauguuuacuaucuugauuguggugauaguuggguauaaacauaugucaaaucucaccaauuauaccauuuaaauauguguaguucauuguacaauuaagucucgauacagcuguaaagaaaaacaaccaauucaguugcauuuaguacauucacaauguuguacgaccacuuugauauaguucuaagaacauuuccaucacuccaaaguaaaacccuuuaccauuaagcagcauuuccccuccccuaagcccuuccccucagccccaccaaccugcaucugacuccaugggcuuaucuacucuggauaucucauaaauauggaaccauacaauaugugaccuuuugugucugguuucuuucauuuagcaugauguuuucaaggauaucaggauuuuuaaaacuuuccaagugauucugauauggaaucaagauauccacaaagcaggugugaggcaggguagacaaucagauuccauuuuaacuaagcacuugugugcaaggaaaccacaaauaucucauuuaauccuuacaacaacuuguguguauaucauucccauuuuacaggccgggaaacugaagcucagagaggugaaaucacccaccugacaucacauagguauuuaaaagcaaauuggucugacucuccagcaccaugucuccucugcaacccaggccccucucccaaauuagcacuugguaaccaucagaaaggaagagugggcugugccuacuggcuggcaagccuggaaucuauaggcagaguugaucuacuggcuagagaacauaggacuuaaggguauuugagcuccuuaacuuuuaaaauacccugcaacuagaaagaaagucaacaaacaugaaagcuggagagaacuuagaccaauuuguaaaagcacucauuuuuaaaaccaaaaacccaaggcccaaagacagcagacuggcaaaacauggucagaugccuucugaauuucaaaaaagcuaucagucauuuuuacuuuucauugauccugagaacagggucuuccccaaacauaaaaacaaaacucauuuuuacacaguuugacuaccaccguauuauuagccaugguuucaauucauuuaggcaacagauaccaugcauauacuauguuccaggcacauucuagggaggagggauauugcaaugaacaaagacagauaacacccccugucccucacagagcuacauucuauucaguuggugcaaaagaauugcuguuuuugccacugaaagucacagcaaaaaccacaauuacuuuugcaccaaccuaaaaagcugauggggcagcaaacuaugaauaggagggaauuuccucaacuggauaaagaacuucuuugcagccaacuucauacuuaaugguaagaaauuggaugcuuuccccuuaagaucaggaacaaagcaaggugccucucucucuacuccuauucaacauuuuacuggaaaucuuagcgaguggaauaagccagaaaaggaaauaaaagcucuacagauugaaauggaagaaauaacacuaucuuuguuugcagaugaucugucuauguagaauaucccaaagaauugaucaaaacaaagacugccagaacagcacuuacagcaagguuacaagacacaaaguuaauauacaacaaucuauugcuuuucuauaugccagcaaugaauaacuggaauuugaaauaaagaaauagcaaggagaucuguauggcuccaauggaacugaaauuagaauuagguugaguaagggaaagaagcagauggaggcuagcagcagaacaugaugaagggcccugugaggaaguuggcuuuuacuaugagugauuuagggagccacuggaaggaucucagcaaaggagggauauuaucuguuguaccuucacccacacuccuccacaacacacacacagacugcucccugauccaguuuuuauuuguaaauucagguuuuagugaccuccaacuaaaguaauuauacccaucagcuuagugaaaugcuaacagaauuuaucuugucagcagcagaacugccugaagcagcaacauaaucuagguccuaaauccuugagacagagagggcaagauguagaggaaaacugcccaaugcuagggcauaccugguuaucuggcuaaagauaguggucauuuguaaacuccaguggcagaacuugcaggcccuagaaaagacacagagaauugcccagcaaggacugagcuaaggcaggugagucccugaggaacaggaguagacaaggugacaacaggcagaaauccccagacugccaggugcacaggaagucuccugcagggaggcacuccuaucucccacuccagggccugggacaggcacucuucccuggaaucauaaaagacagcagagccucaaagugagaguaugggcuucacaacagauucaaaucauggcuccaccaccugcuagagcuguaaauauugguucaaauuaauccaucucaucugcaccuuaguuucuaaucuauaaauuaggcauuauagaugccuaauaugccaacauuagagcauccaaauucuuaaaacaaguacuuccagaccuaaagaaagacuuagucacauaauuuuagugggggacuucaacaccccucugacacagcauuagaaagaucaucgaggcaaaaaacaaagaaauacuggacuuaaauccagcaaugacaaacuauacauuccacccaucugcaaauggcaaauaaucuaaaauugaccacaugcuuggccauaaaccaaguaucagugaauucaaaucauugaaaucauaucaaccacacucugagaccacaguggaauaacugcauaaauuaggcauaacagcacccaccucagaggguuuguucugauaacuaaauaagacaauacaaguaacgaacuuggaacagcgcccagcacaugaaguacucaaaugucagcuguuauuaucuugcuugcaauauucuuucccuggaaagcagugcuggucgcuggucugcugucaacucucucucuggacagcuuuaccaauuguuccaugacccacagagcauguacuggcuguggagcuuccucccggcugcccugacuagguuggacaaagagugacuuccugccaggcucuggaucagagagcagcuugucaccuaagcagggugaggcuuuccuccaggauggccacuuguccucuccccaagcugcagguguccaucaggagaaauaccagaggcccucuugcuccuccauacagcugacucuugaguauuccauccagucacugauuuaugagagcagagggacaacugucaucagaccgccgcuuccaggagggaaaagaauagcaucaccaccaccuaugggguaacugcuuguacaccacagagcucagccacgaggcugggacaagcacugaccagagcauguucugaucugcacaagggggugguagcucaagggcagacagaagcagauaugggcuuggagggguucucucugccuaucagagaagugguagucagggucugccacugucauuucaccaugucuaccuucccaaucucaucuccuaucaguccccuaccaugagucccacccagauaccaacccaggauggcccuccaauaaccccucccuccucaagcccugcauucuucuuagcucaugugguaaaggcugcagugcccuucccaacacuauuucuccacuucuuccauaggaagaguucauguuccauguucccuugagagagggguggcagauguucugccuaucggauacaagaagugauguguggcacuucuggguugugccuuaaaagaaaggagcauacuuucccuucacuucccuucccagcagcugaaagauaagcaaggcagggagccauuuuggacaccaaagaagagcagcaccuggggcaacaacggggagaaagcaaggcccaggaaccuucagagccugguggaacaacggggagaaagcaaggcccagggaccuucagauccugguggaaaaacggggagaaagcaaggcccagggaccuuuagagccugguggaacaauggggagaaagcaaggcccggggaccuucagagccugagcacagccaccauggguaacuugcaguucauccugagagggaaauaaacuucucugauuuuagccagcuauguuguucucucuguuauggcacuauaauccauauucuaauuaagcucacacugcucuuuuuguuuuaaggggaggaggacauguuccugcgauaaggccaguguagucccaugagaaaagguguggauggcaaugaagaggugcccacuccagugccccaaggcucacuuuggccuaaaacugagguuuacccagggugagagcacgacucaaacagauguagcaauaaguaauaauaagcacaggagaggcccucuuugacacuagaaaauucuuucugagccuaaccuguauucaggacugaacucaccuaaguagaaagaaacccaagggagccugagcuggcuacuggaagagaauuuauuaagugacucugguauacugagaaaccucauuuggaaaagcaaaucuaaacugaccuucuaaauucauuuugcaacuaaaggcuuggcugagagcagaagaaccauaugagugacaggauuacagaaggcuggcaucagaaggggcaccuuagggacagaugauugguuuauuccccuugaugccucugaacccuugcuaugccuauuccuggcacagggaugcuuuuccucuucccggcuucugguccaauuccuaucuagccucacuccuuaaggcguggguuagucugcucaggcuguuauaacaaaacauuauguuauauguggcuuaaacaacagauauuucuuucucacaguucuggagguuggaaacuacaagaucaaggugccagacuauuugguucccagugaggccccucuucccaguuugcagauggccaucuucuugcuacauccucacauggggggauagggggagcucugaucucuuccuauaaugccacuaaucccaucaugaaggccccaaccucaugacaucauuuaaacuuaauuauugccaaauaccaucacacugaggguuaggacuucaacagaugaauuuuagggaggaaggcaggacacaauucaauucacagcaaggccuaacucaaaugucaccuucuccucucaacaguccagcuccuacccuacaggcaaaaucugaaucuguguucccacagcacuuuacauguuccuaacacagaacuuagcuuucucacguuguuuaugagcuuuucuccccacaugaaagggccuggucucaugcauaccuagcucuacaucaucacuuuagaaaugaggagaucagccaggcacgguggcucaucucuguaaucccagcacuuugggaggccaaggcaggcagaucaucugaggucgggaguuugagaccagccugaccaacacggagaagcccagucucuacuaaaaauacaaaauuagccaggcaugguggugcacgccuguaaucccagcuacucgggaggcugaggcaggagaaucauuugaauccgggaggcggagguuguggugagccaagaucgcacuauugcacuccagccugggcaacaagagugaaacuucaucucaaacaaacaaaaaaaaagaaagagaaagaaagaaaagaaaggaaggaaggaaggaaggaaggaaggaaggaaggagaaaagaaaucagaucugugaagagaccugccugagaucacaaagggaacaguggcagguugcuacuaagaucagucuacggacucucagaccagaacuacuacuucugcccaaccuuaccaacccagauauugaggaguccaaagccaagaaaucucugcaggguacuuucgagucccagugguuuugcuggaagccccaggaaucuccaucagagaaauccaugagaacccaaguucgggaccacuugaggccaggaguucaagaccagccuggacaacauggcaaaaccccaucuguacuaaaaauacaaaaauuagcugggugugguggugaaugccuguaauaccagcuauuugggaggcugaggcaggagaauugcuugaaccccgaaggcagagguugcagugagccaagaucacgccacugcacuccaggcugggcaacagagugagauucugucucaaaaaaaaaaaaaaaaaaaaaaaaaucagagcauucagcauaaaggggguacuuuuuuacaguuacuauuaucacgcagcacaaauccuauaauauucuguuuuucacuuaagcagaaugucaaguucacacugccuguaaacuaaaacacaggcugccugguaucagagucccacugugaaacgucucccagugaaacgucuccccaacugaacuccccacacugucugaaauuccacccugauaagagcauucucagaagccugaggugaaaccacaauacuauuaaguugguucuauucuuucaaauuuuugguuaucagauuagucaaguauccaguaaaacccugacaaacuggggcaaggcuuugaugggagaaagguaaggggugaugccuggaacaggggugccuucuggagagcugcagcagaauaaggcagccacacuacagaaucuucagcauacacuacuauguucacucucauugauagccagcuacgugauaaacacugaacaugucuacugagccccauccacauaugauaauaccgaggcucuugcugguuaguggcacagucagggcugguggccaggcuuucaauuuuccaucuggaucacagcaagauggauggucuaguuccuucggucugguaacugcuaaacguaucagcaaugaggcaugggagauacauuuggguaaucgccauguugucuaggaggcuguguccacuugacauguggauggggguacauuccuuccuggcugcacaaauccugcccucacugagaggguacagaaaugaucagacugugcccucacugagaggguacagaaaugaucaaacagugggugaguggucuguguggcacauucugcugcuaaauugaucaauuuuacaaaggaccacuuuaaacaaauuaaaacauaaggacuuaaaaaaccuuuuggcaacaaguuaaagcauagggauuuaaaagacucuuguuucccuuaaagcauuuuauaauuguccaacccuacuagucuagugaguauacagcaggccuuauuuuuaaaaacugguaaacaaaaaucuccaauucaccaagaaauuuccaaaucccauugaaaaggauccuucaguauuaacagagagaauaaaaucccaggucaguauaaugcaugagacccaagagggagacaugaaaguagaaaaucaauuacucaaaaaaaaaaaaaaaaaagaaaggauaggaaaggaaaggaaaggaaacgaaaaucacucaaaaaaaaaaaaaaagaaaaaagaaaagaaaaucagucacucaggcuucuuaauuauaccaaaauggcaaugucuugucuauugguuuuguagcucaucagugguuggcugaguucagaacucagaucucugacugccuggguaaaugcuuucacugagauaaagagacuguguauucagaguuuauuauaggccagacauuuuacaaagcauuuccccuugggucauuuaguguaacaaaguuaugagguagguaguacuauuaucucuauuucacagaugggaaaauugaaguuucgcaaguucucugcccaagguccuggagcaagcaagcgguagagccuguauucaaacucaggugagcugacacauauuacucaacauaaaccaagucaugcaaguacaguuaaccaagaaucccaaagccaggugguagaucagcaucuggccaggaauaccugccccacgcucaggugcauuauacugagcaaagucccuccucagacaauuaccaugaacagggagaggcagaggcacuauguccuagcacagagagcacacaccacgauggucaggcaagcaggacuuccaugggucccucaauggccuccugccugucaagccuuagccuuuggaacaaccuaacucugguggcuuugugcugucugggguaggcugcacucuacuuccaguguuguacccucauccugcccagaugucaauccauuacgauauccagcaccugcuauuucuacuggcuccugacaccucaaugaccuccauuuacucaacauaaucuccaguccuucagugcugguuguuucuacagugcugcagagcccaugggauacuguagugacucaagaugacucaacauaauuccuccccaacagcacucagaauccagcuagagagcucacacaaauguacccaacucagccacauauggcuggaugagaaggaugaaauucuagaaagcaaggggaagaaggaaauccacuuccccacaccaggccuugaaacaggcuuauuaaaaagauuagcucacaaacuaaucacaagaacucagguuuacacaggcuuauuaaaaagauuagcucacaaacuaaucacaagaacucagguuuacacucagagacagugaggucuggagaccugaagagaguccaacagugacugaggcaacagaugggauucacaacccaugugcccagcuccaaaacuuaugcuuugcagaagcaucauucuguccuuacauauuauuuagcaagagagugauauaaucaggucuguacucuuaaagaucgauccgauggcaaaaugauggauaaccacagugaguaaagaaugaugggaggaaaacugauuaagaaaugaccacaacaaccagggcaagagaagaaaccuagauuagugccaugggacugaaaaggagauuaauuuggagguaagucagauaaaaggaaacaaacaaacauuaaaauccucucaauuacauucauuauuucaaguaaaaagcccaauccuuuaucuugguaucucucugcaguuucuuacauucuuacugcauuuuuaccauuuccaaguauauguuuuaagcacacuuuuuuuuuuuuuuuuuuuagacagaguuuugcucugucauccaagcuggagugcagugucacgaucuuggcucacugcaaccucuguuuccuagguucaagcgauucuccugccucagccuccugaguggcugggauuacaggcaccugccaccacgccuggcuaauuuuuguauuuuuaauagagacgggguuucaucauauuggccaggcuggucucgaacuccugaccucaggcgauccaccucccaaagugcugggauuucaggugugagccacuauguccgccuaagcaugcuuuuuauugaggcauaaaacauacacagaaaaguacacacaaauaaacacauaaaccaauacuuuuucauaaaugaacacaccuguauaaccaccaugcagaucaggaaacagaacauuucggagcccuagaagacucccuccugcccaguuuccaguccuacccaccuccucccaaagguaacuacuguccugaccucaaauaccauagauuauuuuucuuacucauuuuugaacuuuauauaagcagaaccauacaaucugcaugaguuuaugcuagcuuauuugguuguuguuuugagauggagucucacucagucgcccaggcuggagugcaguggcaugaucucgguucacugcaaccucugccuccuggguucaaacaauucuccugccucaaccuccagaguagcucggauuacaggcaugcaccaccaagcccggcuaauuuuuuuguauauuuaguagagacgggguuucaccauguuaaguaaggcuggucucgaacuccugaccucaggugauccuccugccuuggccucccaaagcacuggaauuauaggcaugagacacugugccuggccucacauuauauuuuuaauggauaauacagcacauacaaagucuugacagcauaaaugaagguugaccccucggagggucagaguucaccuuagucugcauggcucugccccuguccugaaaccugauuguauacucuacugggaacacugccagauguccuaggaguuccauauaccauuuaagaccuacacauuuuaauagaaaaccucuaagccaagaaguagguagugauauuacaauagcaaguaaaaagcugggaagauuauauaauuuauuggaaauccauuaauucuucugaaauuccccuggaaacauguaauuuuucaauuucuguaagcuuuagaagauauuuccuaaaagguucucuguaauaaguuauaaaaugagauuuuaugguaaccccuauuaugguuucuaugcaaaacaaacagugcuauuauaaauaucuucaguugcacuuaagaugaaacaggauucacauuuggacccagcaguagaaucacauaucaccuuuugguuaucgugcucuuuugugcugcuggcaaggaaaacgcacagguuugggagagugggacgauggcacccaugcugcucugagcacgaguucuccugcuggcuucugaauaaggucccuuugcuugacuguccccacucauacuggaagcagcaaggccuucagaggcuaagcgauuuuucaagguaauucucaguuagguguuccugcuuccuguaggaaggccacagcuccguggcacagcccagaggaucacuuaauauguucaguccugugggauucaacuggaacagacaaaccuaaugccugcuuugugugucagaaaacacaagcacuguggccaagcaacugagccauccaugacacaaugaagaaugaagauacuuacuuggggaacuggcagagacccgcuuccuggucagggucuccuggcugggcuugucugaagcugaagggccccugguuuggacaugccucuuucccgggcucucuucuggcuccagugacuucuccauuccauggaaauacuucaugugauagugcaacaguuuggcuuugcggaaaaauuuuaaacaguccacaacuuugcaucuaaacuuauggucuaggucgacagcuggugcauuagaugacccaaaaucaucuguuuucuuaaaaguauuuguuacugaaaaaaauaaaaacaaaagcaaagguuccuuguauuuaucccaguuauuacaaaacaugcauuaacacaugacaacugagggugaaagacuagcgugcaaauguagccugagacaucagacugccauuaccuccucaaauuacuguuuagagagaaugaaaacaacuucaggucaaauaagacucaauugugauucaucuuuaggaagaagaaaucaacauguuuauuuuaaacagucguacaaguuuucaggguuucauauacuuuaaggaaaaauccuuaaaaagauaaaaauaaaaauaaaaauaaaggaucucaggucaagcagagcagcucacacuuguaauccuaguacuuugggaggccaaggcagguggaucacucgagaucaggaguucaugaccagccugaccaacaugguaaaaccccaucuuuauuaaaaauacaaaagaaaugggcugggcauggugguucacaccuguaaucccagcacuuugggaggccaagggaggcagaucgccugaggucaggaguucgagaccagccuggccaauauggugaaacccugucucuacuaaaaauacaaaaauuagccaggcaugauggcaggugccuguaaucccagcuacuugggaggcugaggcaggagaauugcuugaacccgggaggcggagguugcaguaagucgagaucaugccauugcacuccagccugggagacaagagcaagacuuugacucaaacaaaaaacaaacaaacaaaaaaauuagccaggcaugguggagcacaucuguaauucuagcuauucgggaggcugaggcacgauaauugcuugaacccgaaggcagaaguugcagugagcugagaucaugccacugugcuccacccuggucaacagagccagacucugucucaaaaaaaauaaaaaauaaauaaaauaaauaaaaucaaggaucucaagcuagcacuuaugaguuggaucagacuuacauuuacuaccauccugguaccuaucuguguggacggaaauagggaacauuccucaguaucucucuaugaaaccuaagagauuuuacgucaguuuuugugcaaggaaaguguaacaguuacaaagguuuuaguauugagucuuugagauuucaacacguacuuuguuuuacaauauacuuugucugaucaaaaggauccagauuuggugggugcaguggcucacgccuguaaucucagcacuuugggaggccgaggugggcggaucaccugaggucaggaguucggaccagccuggacaacauggugaaaccccaucucuacuaaaaauacaaaaauuagcugggcaugguggcacaugccuguaaucccagcuacucgggagguugaggcagaagaaucgcuugaaccugggaggcggagguugcagugagccaagaucacaccaccgcacuacagccugggugacagagcaagacucugucucaaaaaacaaaacaaaacaaaaaaaaaacaccgggcgugguggcucacaccuguaaucccagcacuuuaggaggccgaggcaggcagaucacaaggucaggagauugagaccauccuggcuaacauggugaaacccugucucuacuaaaaauacaacaaaauuagucgggcguggugucgggcaccuguagucccagcuacccagaaggcugaaacaggagaauggcuugaacccaggaggcggaguuugcagugagccgagaucgcaccucugcacucgagccugggcgacagagcaagaccccgucucagaaaaaaaaaaaaaaaaaaaaaaagggauccagaauaggaggaauaaguucuagcauucuacagcacuaugggggaacuauaauuaauaacaauuuauuguauauuuucaaauagcuagaaaagcagauuuugaauguucugaacacaaagaaauaaaugcucaaggugacagauuugccaauuauccugauuuaaucauuauacaucguauacauguaaggaaauaucacuguaccacaugaauauguaaaauuauuacaugucaauuaaaaauaauaauaaaugaggccaaggcaagaggaucacuugaggccaggauccucaagaccaguguagacaacucagcaagaccccaucucuacaaaaaaaaaaauuuuguuaauuagccaggcaugauggcaugugccuauagucccagcuacccagaaagcucaggugggaggaucccuugagcccagcagguugaggcugcagugagccaugacuguaccacugcacuccagccugggcaacaaaguaagacccugucucaaaaauguaugaauaacaauaauaauaaaugcaaaacaaacaacaacaaaaaggacccagagacugcaagaaaaaccagcuaacuaaauggagguggaaggcauaaggaggacucauaggacucaaugaucaauuucaaagagacaauaaaagcaugacccuaaaagacaaauaagcagaaggcaauagucggucaggcaccaaugacaaaaaguaaacccaucacaaggacuuuuuuuuuuuuuuuuuuuugagacggagucuugcucuuuguccaggcuggagugcaauggugagaucucggcucacugcaaccuccaccuccccaguucaagcgauucuccagccucagccuccugaguagcugggauuacagaugcccaccaccacguccaguuuuuuuuuuuucauagcuuuaguagagacugguccagccuggucucgaacuccugacuucaagugauccgccugccucagccucccagagugcuggaauuacaggugugagccaccgcccccaggccacaagaaccucuuguguguuagaaaugcaguuuauugaggacucccuuuagaaugucuucccaccaacaaaaaaucacauuaagucauuccuaugcuacagauuuggucacccaagaauauauuauauuaaauggaucuuuuuuuaaaaaauuaggaauucgguaugcaaugaauggcccuuucuugaguuaaucagauuuuucguaaacacaaucacacaaucuccacuggaagcagguagccuguuaaaccuuugguaaguauuaugauuacuuuuucaagugucaucccauaaucagagguaauuuuaaaacucuuaaauuugaucuaaauuauacucuacacuucaaaauuagguuugguugucugaaggaugcuguuauagagccaauuuaaaccaacaaaaaccuauacacacacacacacacacacacacacacacacaucccaaagcauaaugccuuaaaaucacuuucuaccuauaacaagagauauaaaagaugccagaucaauuaguugcagguaagagaagaaaaaguuggccaggcgcgauggcucacgccuguaauccuagcacuuugggagaccaaggcaggcggaucauaugacgucgggaauuccagaccagccuggcuaacauggugaaaccccauuuccacuaaaaauauaaaaaauuagcugggcgugguggcaugcaucuauaaucccagcaacuccggaggcugaggcaggagaaucacuugaaccugggaggcgaagguugcaguagcugagaucgcgccauugcauucuggcuugggcaauaagagugaaacucugucucaaaaaaaaaaaaaaaaaaaaaaggagaagcaaaagugacacgaugugaaacagaauacacacuucucagacaaauaauuggacaggaaaaguaugucaguggagaaguucaaaacacaaaacuuuaauacauccaauucuuuccuaaaacaaaaaauaguuuauuuuggaauauccuucccuugaucuauauuagguuaaaucauauaaacuugccauuuuguaggcuaaaaaagacuaaggcuggaacccugugcaguggcucacgacuauaauuccagcacuuugggaaacugaggcgggcagaucacuugcagucaggaguucaagaccagccuggccaacauggcgaaaccccaucucuacuaaaauacaaaaauuagcggggcacgguggcucacaccuguaaucccagcacuuugagaggcugaggugggcagaucacuugaggucaagaguuugagaccagccuggccaacaugguaaaaccuugucucaaauaaaauuauaaaaauuagccaggcaugguggcacaugccuguagucccagcuacuugggaagcugagguggaagaauugcuugaacccaggaggcagagguugcagugggucaagaucacgccacuguaccccagccugggcgacagagcgagacuuugucucaaaaaaaaaagaagaagaaaaauuagcugggcauggugcgcgccuguagauccagcuuacucaggaggccgaggcaggagaaucacuugaaccaggaggucgagaucgcagugagccgagauugugccauugcacucuagccugggugacaagagugagacuccgucucaaaaacaaaaacaaaaacuugcacucuuguguauacacaauggucaucuacauaaaucaaacaguacaggggcuaaguguggguucugcagcuggacagccuauuucaaaaccgaguucuuccaccuacaccccuugccucaguuuccucaugugcaggauggagacgauaaugguaacaacuucgcugaguugugagaauuaaauaaauuacaugcaaagagcuuagaaagguguacggcacauaagugcucaauauuaucuacuaugacuauucaaugucauuuuaaauuucaggaauuaaccugaucauaagcagaagaggggaaguguccaccacccacagccucacugcaugcucaugccagaggcaguaugguauaguacaaaaagcacaacauuuaaucccaggucuaccuuucauuagcagcauaaauuagcugugcaagcuagucuaauuauccagauucuuaagggaagaauaccaccuauuucaaagauuuggagaaaagguuauggauaauguauguacuuggcacaaaguaggugaucaacacauggaagccauuaucauuucaaauauaaaauacaucauaagcaggcuuauguuauuucuggaacauggcuggagacagcuauuauaauuaucaaccaagugugaaacauuucuucaaccagucuucauaugcccuggcugggacgcauaucacccugaaagcacuucauuucgucuacguccuccugaaagugugaaauucaaaaccaaccacaagguuccuaguaugacuauucacauuucagugugauuauuaucuccaccuuuugggacaucuuuuacuaugacaccuaaagauuuucuuuuguaauacucuauacaaugcaggauaguaccaagcuuguuccaccaaaauacugaacauuguuuuaucuuuuuaaaacauaaauaacaguacauguuggcggggcacaguggcucaugccuguaaucccagcauuuugggaagccaaggcaggcagaucaccugaggucaggaguucaagaccagccuggccaacauggugaaaccccaucucuacuaaaaauacaaaaaauuagcugggcgugguggcaggugccuguaaucccagcuacucggggggcugaggcaggagaaucacuugaaccugcuagguggagguugaaaugagcugcgaucacaccauugcacugcagccugggcaacaagagccaaacucugucugaaaacaaaaaaagaaaaaagccauggccggcugggagugguggcucaugccuguaauccuaguacuuuaggagaccgaggugggugaaucacuugagguaaggaguucaagacaagccuggccaacauggcaaaaccccgucucuacuaaaaauacaaaaauuagcuagcugugguggcgugugccuguaaucccagcuaccugggaggcugaggcaggugaauugcuugaacccagguggcggagguugcaaugagccaagaucacaccauugaccugggugacaagagcgaaacuccaucucaaaaaaaaaaaaaagucauggccaaacuaucuguugaaagauagauaugacuggacuaauaaucagacuaauaaucugccaaucuaguaaaccuuucaaagcaagcgaguuuaguuuacagguuaaaaauucccccugcaaaagcaaaauccuugauuccucacagcuaagcaaaaguuaguacagcugaaacuccaaaggagcgccagcuuggcacucagguggaccagcugccucugacaggcaguacuaggaucagagaggcucaagugagcacggaugcuccucaggagggaagacacugccaggugccacuaucacaaagauccuggccaaaccaaaggcucuuuucaauuuggcaacacuaagacaaaguaguuucuguuuucucugauggaauaaacaucaaaagaagauuugagcauuacaaaucuuuaaccauggaaacucaggaaguaagauuucccagugaaaucagugaaguauaacucacugugauacaagcaagcucuucugauuauaagccaguugauaaucuacccugcacugcuggaaaaaacaaucaacacaagcaucagagugagaaaagcugcaaacaggguaugaaucaguaaugcauacuagccugugauaaaauaugauaaauuacacaauuugcuauaauuucagaaccacaaaucaaaaaguagauucuuccagaaguagagcucuaaagaaaaaaaaguagauaaaaauauuauauaugaauaaaauguuuauguuaacuuuuuaaugaugagaaaauguuuaggauauguuaaauuauaauauaacaaaaaaggccagacgugguggcucaugccuguaaucccaacacuucgggaggcugaggcagguggagcaccugaggucaggaguucgagaccugccugagcagcauggugaaaccccaucucuacuaaaaauacaaaauuggccgggugcgguggcucacgccuguaauccuagcacuuugggaggccaaggugggcagaucauuugaggucgggaguucaagaccagccugaccaacauggugaaaccccgucucuacuaaaaauacaaaaaaaaaaaaaaaaaaaaaaucagccaggcgugguggugcaugccuguagucccaucuacucgggaggcugaagcaggagaaucgcuugaaccugggaggcaaagguugcagugaaccaauaucacgccacuguacuugaaacugggcgaaagaacgagacugucccccgcuuaaaaaaaacaaaaaaacaaaaaaaaacaaaaaaaauuagcugggggugguggcggaugccuguaaucccagcuucucaggaggcugaggcaggugaaucgcuugaacccgguaggcggagguugcagugagccaagauugcccacugcacuccagccugggcaacacagugacaaacucugucucaaaaaguacauaaauaaauaaauaauauauaaaaaauagaauaacaaaaaagacacauaaacaccaagacuuaagcaaucgucccuuucucgugaagguuuugcaaauuggacuauuuuacuuuugaacccaaauauuuagagacaugaaaaauuauauuuucuagacuucacaaccuuauccuaauuuuugcacagccaaaaggagcccucuguaugcacaauaaaggcugccaguucagccagucuaggccaugugguucccucuauuuggcauguuguucccacaugcaaaccaagucuugcucauccuucaaauaccaccuccuugcacaaugccuucaccccggucucucagcagaaaagauucuguccugccucgaagaauuccuguaaguauuuuauggauccuguaguccuucccuuucuauuuguauaacaguugguuuuguuuauuccuuuuucuaaaauguugaaauacccaaugugcugccuuuuuuuuuuuuuuuuugacauagagucucucucugucgcccaggcuggagugcaguggcaugaucucagcucacugcaaccuccgccuccuggguucaagcgauucuucugccucagccucccaaguagcugggauuacaggcgccugccaucacgcccagcuaauuuuuguauuuuuaguacagaccggguuucgucauuuacgacaggcuggucucaaacuccugacugcaagugauccacccaccuuggccucccaaagugcugggauuacaggcaugagccacuguacccggccuggaaugugcugcauucuuuacuucucuuacuuauguuaguguacugucacaucaaacaugggagcuagccucuccaagacuguuuccucauuguuaaaugggaauaagaauacuuauuucacaacucuccuauauguuuccaugaggcaguuaaagacaaaacccaguuuuguuuaguuuuguuuuguuuuauuguuguuuguuuuguuuuugagacagagucucacucucucacccaggcugaaaugcaguggaacgaucucgggucacugcaaccuccaccuccggguucaagugauucuccuaccucagccucccgaguagcuaggauuagagaugugugccaccaugccuggcuaauuauuuuguauuuuuaguagagaugggguuucacucuguuggccaggcuggucucgaacuccugaccucaggugaucugcccacuucggcuuccugaaguguugggauuacaaggcgugaggcacugugccuggccacaaaacccaguauuaacagcaagagguuacuugaauauuauuugucauuauuguugucacugaccucacaguuguuugcucaaaacaaucaaaguuaugcauaauucuagccaagggaccaugugucacugguacaaucugcaaaauucuaacaucuaauugcccuccuuuauuaaucaaacaaugaaggauuagugauaauuaauaaaaucacaauaggaacauuaaaauuaugcauucagcaaaaauauccuacauuuuaaaauaggucagguguaguggcucgugccuguaauuccagcacuuugggaggccaagguggguggauaacuugagcccaggaguuuaagaccagccugagcaacauagugagacccccaucucuacgaaaaaauacaaaaaguagaugggugugguggcaugcacccauagucucggcuacucaggagacugaggcaggaggacaggcugaacccaggaggucgaugcugcagugagccaugauccuaccacugcacuccagcuugggcaacagugagacagaacugucucaaaaauaaauaaauagggccagggaugguggcucaugccuguaaucccagcacuuugggaggccaaguuggguggaucacuugaggucaggaguucaagaccagccuggacaacaugaggaaacccugucucuaccaaaaaauacaaaaauuagccaggcaugguggugcaugcuucuagucccagcuacuugggaggcuaaggugagagaaucacuugaaccuggggacagagguugcagugagacgagauugcaccacugagacuccagccuaagcaacagagugagacccugucucaaaaauaauuuuaaaauaauuaauuaauuaauuaagaaacagaauaugcaugguauaacuaugcgaaauaaaacucaaaauauggccaagcacaguggcucaugcguguaaucucagcacucuaggaggcugagaugggcagaucacuugaggucaggaguugaagaccagccuggccaacauggugaaacucuaucucuacuaaaaauccaaaaauuuauccgggcgugguggugcgugccuauugucccagcuacucgggaggcugaggcacaaaaauugcucgaacccaggagguggagguugcagugagcugagauugugccacugcacuccagccugggugacagagugagacucugucucaaaauaaaaauaaaaauaaaaaauaaaacccaaaauauuacgagcaaaauagaaaauuauguauagcaccaggcacgguggcucacgccuauaaucucagcacguugggaggacaaggugggcgaaucacaaagucaggaguucgagacuagccuggcuaacaugacaaaaccccgucucuacuaaaaauacaaaaguuagcugagcgugguggugugcaccuauaaucccagcuacucaggaggcugaggcaggagaaucgcuugagcccagaggcagagggugcaguaagccaagauugugccagugcacuccagccuaggugacacagcgagacuccauuucaaaaaaaaaaaaaaaaaaaaaaaaagaaacuaagagggccacugguugucaaaugggccugcugggccaaagucuacauaaaucccagucucacacacagguauguauuccccuaugggaggacaguucauuuagaacauacauggcagcagcuggugacaccacuaagugacaucauccacccuuagcauacuaauaugguucuugucaacaugagagcaguuacucagagacagagggcagaagacauguaaauuauuaauuaaaaaaaaaaaaaaaagagaugagggucucccuauguugcccaaggcugaucuccaacuccuuggcucaagugaucuuccugccucagccucccagagugcugggauuacaggcaugagccaccaugcccagaagaaaauauuguaaauuaaaucuuaaaguugcugguucaaaagugagggggaacucaauuacucuugggauaaggucaucuacugaaaccaguuuauuccucuuuuaaaagcaguaugaaaaucacuauuuccaaguaguuacugauauuaucauuuaccugcucuguccucucccuccuguuuaacaaauuauuguuaggaggaaucaagaaaaagcacagagcucucuccugggcauccaggcucaaaaucucaacagucacccuuugcucuuguuguuccuaaauuacuacuauacuuugguaugugcagagaaaaaugguccacaaauuuugcuuuuaauaaugguuacccuaggccaggcgugguggcucacaccuguaaucccaacacuuugagaggucaaggugggugggucaccugaggucgggaguuggagaccagccugaccaacauggagaaaccccauuucuacuaaaaaauacaaaauuagccgggcaugguggugcaagccuauaaucccagcuacucaggaggcugaagcaggagaauugcuugaaccagggaggcggagguugcggugggccgagaucgcaccauugcacuccagccugggcaacaagagcgaaacucugucucagaaaaaaaaaaaaaaaaaagguaacccuaagcaguguuuucuuuaucuauuuucgggggaggguguggaguuaaacccuaaaauguuuccuaauaaucccugccuccugguauucacgcccugauauaaucucuuccucuugagugugggcagaaccuguaacuucuucuuuuuuuuuuuuuuuuuuuuaauucagucuuuguagacaugucaaaaauugccauugccaaccuauguuguaaguugucacuuugguguauugggaaaauuuucaauuauuuuaauaaucaugccucagauaaaccucauuggcuaggauacugccacugggcaaagcuguaaccugucucuaacagaauauggcgaaggagacaguaugucacuuucaugauuguauuagguaagacuacagugucugucuuacuaggaaacacucuuccuugcugucuuagugaaacaagcugcuacauugugagcuacucuauaugaagcaaggaacugagugcaccagcaaaaaccaaggcccucagucugacagucuagaaggacugaaugccgccaaccaucagguaagccugaaacccuccccaguagagugcucagaugagaauacagccugagccaacccuuggauuguaagcuugcagaggaccaagcuaugcuugaacuccucacccacagaaacugugagaaaacaaauguguuguuucagcuacuguauuugugguaauacugucacacagcaauagauaauauagagggggaucagcagcccacucauuuucuauauauacuugaguaauguuuuauacuuuuccuuuuauaguaagcauacacuauguuuauacuuuaaaaaaaguuuguaaauuguuuucugaaauuuggcuuagaaauaaauauccuauuuaauauuuuguguacccauugccaguaucagaugaccucacaacuggaugacuaugauuagauuaugaugauggugauauuccgucuggcuggcaaugcucagucuggcauucaaggcccacgucacuccaauaguggcaucuugcuuccaaacgcaccucccauucauccauaaggaggccucagcuccugcuccagcaacugcuucaugcucucgcaguucacaccccugcuuggccugugcccucuuccugccauuccucccuggcucagccaagucuucacuuccauccagacccagcucacuccacaaacagaaagacauccagauggcccuggcucucagggaccacaugccaucaauuccugccacaaaugacuaucugcucuaccucaucaucagcacuuaacaucugcuccuggauccuguuauuugucacuucuccagccaggggaaaagagccacuucucauugucauguguucccucaggaccaaggcccaacacaguugcuauucuugucggcaaucacgccauguggcccagcaguuugauaccuuuuugauauauauuucacauaauauaaugaauaaaauauuuuucaugucuaugaaggaauaauuuuuucagcuugaagcaucaaaaagcaaucaaagauuagcgaaggccaggcacaguggcucacaccuguaaucccaacacuuugggagggugaggcaggcggaucacuugaggucaagaguucaagaccagccuggaccagucucuacuaaagcuacaaaaaaaaagcugggcaugguggugggcaccuguaaucccagcuauuugggaggcugaggcaggagaaucacuugaacccaggaggcggagguugcagugagcugagaucucaucagugcacuccagccugggcaacagagugagacucugucucaaaaaaaaaaaaaaaaaguauuuacugacauaaucucaagauuauaauuuuuuggcauuaaaauaaauaaugauagaaacagauuauaacccauagaacgacauaagaauccaugagcccaugcagauaaacaaacaaggaaaggaaggaaagaagugagauuaaaccccccuaaggcagaauauaaacuaauacauguugaaagaaugaugaaaguuagauaucaccauuuggcagccaucacaguaaaaauuguuucaggcaagaaauaccaguagaugcuaaaauaaugggugaaaguuugaugaggaaauaagauauuuacauagucucaauguuucucucacaagaaauguauucauuauaaaggggguaauaacagcuuuauaguagaaaaagcugguagauacuaccuuagguaagugauaaaaguuaaugucaccaguaaaugggacaaacagguuuucaugugcuuccugauagaaugcaccugaaaaggucacaacaucacuuacgugguauuucuguggaaagugaauaacccaaaucaaauuaugaggauacaucagaaaaacccaaauugagggauaucauauucagaaauguaaugucaaggucauaaaagacaaaaacugaagaucucauuuuuaaaaaguaaaaaaaaaaaaaaaaaaaaaaaaaaaaaaaaagcuuauuccccugucccccacuccaguaaaaaaaguagaagacugaaggucuguuucagauuaaagaagacaaaagaaauaugacagcugaauucaacguguguaucuggauuggaucuugaccagaaauaaaaaaaauuuacccccauuuuuuccacaaagaacauuauuagaacaaauggcaaaguuuuuaaaagguguugauuuugauuauauugugggaaugaaagaggauguccuuguuuucaggaaauacacacugaaauauucagggcuaaaggucugcaauuuauuuucaaacaauucaaaaacuacauuaaaaaaucugggagagggcugggcaugguggcucaugccuguaaucccaguacuuugggaggccaagguggguagaucacuugaggucaggaguucgagaccagcuugaccaacauggugaaacuccaucucuacuaaaaguacaaaaaaaauuagccaggcgugguggcgugugccuguaauuccagcuacucgggaggcagagacaggagaauugcuugaacccaggagguggagguugcagugagccaagaucucaucacugcacuccagcuugggcgaaagagugagaauccaucucaaaaaaugaaauaaaauaaaaucugggagagaauaauaaagcuaacaugguaaauugcuagcaauuggggaaucuauauuuuccaacauagggaaagguauaagggaaaucuuuuugcuauuuuugcaacuuuuuuauaaaucugaaauuauuuuuugucauucuuuuaacccaugcuacauagauguauaagucuaaauuauuucaaaauaaaaacuuccuaaaaauauauucaggaaaaaauaugcaucuacauacguaggaaaaauacuuugaagccacaaauacucaaguggaaggaaaggaaccacaccgacauauaguccuggugaacauuucaaggcuagccccuggaaugcagaucucugcacucagcccccacagaaaucacugagcacucauuccacaagguggcagagcugccccaaaugccagaguuagguuggaacagcuagcccuagacuagauguguugcccucccagcuccuccuccuccugcugcccaugagccuccuucacaccaauuucucagauugugacuccaucucgguuuaaaaacgcaagacuauggcaccgacucaggaaagcaacacuaaacagugacuaacgcagcaucccagcuuccagggaccuggcuggaugcuucugaagauggucauggucccgcccuauuuccgcuuacuuacguuaauacauuccuggugaaugaguucucaacaaccucccuuucccccagcaaucuuucuggaucguccuguacucacaccacuaaaccuauguuuccaaagaaacaccagaaacaccauucaguuuccagaucaagacauuuuccacaacucaaagaauucaaaaggcaccacccaguccuggaguacugacaucacuuguaccacacaccacccuccaaaucuagccacccuacuaagccucuuacucugaguguacacacugcuuuaaugagugccccgagagcagaaguuugcaucacauacugugcaaugccccuaaaggcagggacucuguucauuucacuugauuuauauagcacccagcaucuuaucagauggaauuaggcacucagcaggaaaacaacaguuacagacucugggccagacacacuggcucacaccuguaauuccagcacuuugggaagccgaggcaaguggaucgguugagcucaggaguuugagaccagccugggcaaaauggcaaaacccugucucuacaaaaaauacaaaaauuagccaggagugacggcgagugccuguggucccaaugauuuaggaggcugaacaguggggaggaucacugaagcucuggaagucaacacugcagugagccgugacagcgccacugcauuccagccuggaugacagagugagacccugucucaaacaaaaauuuaauuuaauuuuaccaaccucuacaauacugaccauuaggaagugugccacucuagcuaacucacuccuucaugccaaauauuaggcucuuugucuguaaaacagggagaauuaauagggaaaaguuagaaagaacuuaaauaucuuucagcaggggcuagguaaauaaauuauggaacauccauacaaugaaauaaauuauacguaauuguuuuuguuuuuguuuuuccagagacagggucucacucuguugucaaggcuggagugcagugguaggaucauagcucacugcaacaccgaaugccugggcuuagagagauccucccaugucagccucccgaguagcugggacuacaggcgugugccacaaugccuagcuaauuauauucuuuuucuuuuuucuuuuuuuuuuuuuuuugagacagagugucguucugucacccaggcuggagugcaauaacgugaucuuggcucacugcaaccuccgccucccacgcucaagcaauucuccucucucagccuccugaguagcugggacuacaggcacacaccaccgcaccuggcuaaacuuuuguauuuuuaguagaaacaggguuuugccauguuguccaggcuggucuccaacuccugaccucaggugaucugccugccuuggccuccaaaagugcugggauuacagacuugagccacugugccuggccuaauuauauguaauugugaaagaagauagggcugggcauagugacucacaccuccaaucccaccacuuugggaggccaaggcggaggcccagaguucaagacuagcauggucaauauaucuagacccugucuccacaaaaaauuuaaaaauuagccaggcuuggugccacaugucuguaguccuagcuacucagcaggcugagguggaaagauggcuuaagcccaggagguugaggcugcagugagcuaugaucaugccauuacacuccagccuggaugacagagcaaaacccuucucaaacaaauaaaugaaugaauacauaaauaaauauuacccaucacauuacugauauguucccaauggaucuacuugcucuggcuggggauaaaaaguacucaauaaaagugugcuugaacaaggcccagagguaggaguguaacaauacauauaccauguaaccaccauggaauguaaauucagguuagacaagagaauuucacaaguguaauaacauucuaugguauauaaaaguuuggguacacugucuggccaaaccagcuugcucuuaagucauuaaucaaaaccauuauggguaauuuguucaguuuaauguuuacaauucuuauggaaaaaauaagcaaugaacacauuuaaaaaguguucauuuaccuuugcaugagugcuuaaaauaaauauuucuauuucaagaugacauuuaaaaauuauucuaauauaacagcagcaaaaauauaguuugcaauuacuaaagaacucaacuagaauccguaaguuaugccugcaggauagcaaggaggccauguggcugcagcagaaucaauaggaaggugaggcaacagguggccagaagaagcugggcccugcaggccaguguauggcccugaggcccucaugaccaaauacuaacaguagugggccaugggacuaugggagacaagaauguuaguugaauuauccuuguauauuucuggaguucuuuucaaauuuaugaauauuuuuucaauugcccaaaaaaagcauauagaauaaaaacaagaugacugccauaaauggggugaaaggcaaaaacugauaaagucugaagaagguccugauuuugaaaauuauacugugguaauguagaagaauguccuugucuuuaggaaauauggaauauuuuuuucuuuuucuuuuuuuuuuuuuuuuuagacagagucuugcucugucgcccaggcuggagugcaguggugcuaucucagcucacugcaaccuccaccuccuggguucaagcaauucgcccaccucagccucccaaguagcugggauuacaggcgcacaccaccaugcccagcuaauuaaauaugggauuuucuaaaaaguacuuagggaggccgggugcgguggcucacgccuauaaucccagcacuuugugaggccaagguggguggaucaccugaggucaggaguucaagacuagccuggccaacauggugaaacccagccucuacuaaaaauacaaaaauuagucgggcaugguagcacgugccuguaauccaagcuacucaggaggcugaggcaggagaaucucuuaaacccaggaggcgaagguugcagugagcagaaaucgcaccacuacacuccagccugggugacaagagcgagaaacuccgucucagaaaaaaaaaaaaaaaaaaaaaagguauuuagagauaaaggucuggaacuuauuuuuaaacaauucagaaaaaguacuuucuaaaaaaaaauuuuuaauuuuuguuuucuuugagacagagucucgcucugucauuuaggcuggaguacaguggcacaaucuuggcucacugcaaucuccgccucccgagcucaagagauucuccugccucagccucucgaguagcuaggacuacaagcaugugccaucacgccugacuaauuuuuuuauuuuuguagagaaaggguuucacuauguuggccaggcuggucucgaacuccugaccucaagugaucugcccgcgucagccucccaaagugcuggaauuacaggcaugagccaccgcaucccaucuagaaaaaguacuuuaaagaguagaauaauaaaguaaauaugguaaauugcuagcaauuggggaauuugguuaaagguauauucuuuguaccauuuuuuaacaacauuuuuaauaacaaauuauuucaaaauaaaaacuucuuuaaaauauaugcagaaaaaauaccuuauggccacaaaauagcuaaauggaaggaaagcaauccugccaacacaggcuaucucccuauccugaaaaugaagcauuuuucaguuucucaguaaauuccucaaagcaaccaaccucaguuuggcagcaacuuaccccaccuuaacccacuucaggaagucugcaauuaccucaaaacacauaccugacagucucagaaaucgcccuauggucaugcugugcuagcugcuuugccuccauuuucaaaugccuaacugcugcccauccuucagguucccgugcaaguaccgccuucuuccaucccugccgcuaaagcaccaaccuaaguaucaccucuccccaagaggcaaauagcaaauccaaauagcaguuaaugaacacuaaguccaagagugcccacucaucuuugcauacgcaacaguuagcaguccuaggcauaugguaaaggcucaguaagugaguugaagucaauuaauuucuuucucucucuccuuucucuuucucucuuucuuuccuucuuucacagggucucacucugucacagcucuggagcacaguguugccaugaucauggcuuauuauagcuuugaccuccugggcucaaucgauucucccaccucagccucacaaguagcugggauuacacgcacaugccaccacacccggcuaauuugguuuuuugggguuuuauucuguuuuguuuuggaggguuuuuuuuuuuuuuuuggagagaugggguuucaccauguugcccaggcuggucuugaagaggucaauuuguuuuuuuguuuuuuuuuugacauggcucacuuacuuuaauaauaauacauauaccauguaaccaccauggaauguaaauucagguuagacaggagaauuucacaaguguaauaacauucgaugguauauaaaaguuuggguacacugucuggccaaaccagcuugcucuuaggucauuaaucaaaacuacuguagguaauuuguucaguuuaauguuuacgauuguuacagaaaaaauaagcaaagcacacauuuaaacaguguucauuuaccuuugcaugagugcuuaaaauacauauuucuauuucaagaugacauucaaaaauuauucuaauauaacaacagcaaaaauauaauuugcaauuacuaaagaacuaaacuagaauccauaaguuauucucauguuuacaauugugauucuuuaauaaauacuaccauuaugcagcuguauuguaaguuuuccagauuugguuuaaauacaugcacauauauauauugucaguugugggaagcuuuacaaguuauaguccaugcacuuuuuggacagaguucuaaaagagccagccaguccacaaaacaggcaaaaaaaaaguuaaauuaacuagggcaaauaggacucuucuauaacauccaaaauaugugagauucugcagcaaacugggaguacuucaggguuggccuguuaucuuccuuagaacuaaguucaucuuaacaauuuaagaagguggacauucaacaccaucaagugcauuuaggugacauguuucuuuuaaguuaacuugacuuccuugaaugaccuaguuaguaaacuagucacuaguaauucagucaacaggcaaaucaagccugcaagaaaggaagccaauauucaaaaugccguguuaccaucuaaacccauacaaauuaguuuauuuucaacaauaauacguaacuucaauaaugagacgucuaacuaaaacaagcuccuccuacaagagcaagacagcgucucuucuucuaaggcuuagguuuugcccagaauucucgauacaugauauaacaacagucauugcuccuacaacaaagccuugggcugccacacccauguggaucagaugaagggacauuuuaguauuuccccugcucuucaauuuguauaauccauaugcaacaauugcugcaaaaccuucuauuccaacaaguacgaauggugccucuuuagcuuuuugaauaaguuuggaucccugaucuucaucauaugaauucagaaagggaaacaucuguguuugucgacauagugauugcuuaaacaaucucccuagagcaagaaaaucucgcacacgccaaccugaagagguccauuucuauguagcaggcacacauuuucacugucauucuucucucuauucucauaguuucauucuaaguuugucaugacaucaucuuacuuucuuguaucauagguaucugaagucucauccauucgucuggacagaaagaccuggaagggccuagaacagaugucgcauucaucucucuaacccccagaauaaugaauucucuaucaguuuccaucacaauacauacuugaugauaugaaaaaccauagacacacacaauuucccaaacuaaaauggcuguagaucuaugacucuccugcucaagaaaccauagagaacacaaauucauuaaagcuaaaauacuauaggcauuacacuaaaucuuaacugguuaauuuaaaaguaaauaauuugcaaaaacuauuauagucaucaugcuaaaucuuaacuaguuaauuuauaaguaaaucaucuguuaauuuuugauacuucagugacaauucauucguuuuauaacuaacaacaaacacagcaagauuucauggguuagaaucacugaucuggauccuguggcaaagugucccacuucuaccagguauuuaguaaaaagaacuuaacugaauggaccuguacuucuauuuguuuuucucucuuguuuauucugugcuucuuguagaguaucaaccaaugagacagcuuagaauagggucugaggcugaagcaggagaucacuugagaccaggaguuagaggcugcagugaccuaagaucauaccacuguacuacagcgugggcaaaagagugagacuccaccuucaaaaaaaaaaaaaagaaagugggaggcugagacaggagaaucacuugaaccugggaggcggagguugcagugagccgaaaucacaccacugcacuccagccuaggcaacacagugagacugucucaaaaauaaaaaauaaaaauaaaaaaagaaaaaaaagaaaagaaagaaaagaauagggucuggcauuggcacuuacuaggcacuugcuaaauauuugcagcagcccauuuucagauaauaauaugaccuccaaacuuuuuuuuuuuuuuugagauggagucucacucuuuuuuuuuuuuuuuuuuuuuuuugagauggagucucucaggcuggagagcaguggcacgaucucggcaaacugcaaccucuuccucccagguucaagcaauucuccugccucagccucccaaguauccaggauuacaggcgcccaccaccaugcccagcaaauuuuuguaucuuuuuuuuuuuuuuuuuuuuuuuugagacagagucucacucugucgcccaggcuggagugcaguggcaugaucuaggcucacugcaagcuccgccucccagguuuacgccauucuccugccucagccucccaaguagcugggacuacaggcgccagccaccacgcccggccaauuuuuuuguauuuuuaguagagacgggguuucaccguguuagacaggauggucuugaucuccugaccuugugauccgccugccucggccucccaaagugcugggauuacaggcaugagacacugcgcccggccaaauuuuuguaucuuuaguagagaugggguuucaccauguuggccaggcuggucucuaacuccugacgucaggugaucugcccgucuuggccucccaaagugcuagaauuacaggcgugagccaccacgcccagccugagaccucuaaacuucuaggggaauuacuaacuucuguuuuacugcauaaaugaaugcuugcccaauuacaacagucacaacugcauucgucucuggcuuuuuaauuuuuuuauuuuugagauagagucucgcucugucaccuaagcugggugcaggggcgcaaucucggcucacugcaaccuccaccucccagguucaagcaacucuccugccucagccucccgaguagcuaggauuacaggcgccugccaccauacccggcuaauuuuuguauuuuugguagagaugggguuucaccauguuggccaggcuggucucgaacuccugaccucaagugaucugcccaccucggccucccaaaguccugggauuacaggcaugagccaccaggcccggccaucucuucuggcuuuuaagucacuaaagcaaaaagcaaauaccucauucaaaaaaaaaaauacaguaauggguuccaugcuauauuuauuccucuuggcucaagcucaaaguaauuugaccuccacccuuacuauuaacccucuuggaaaauagauaagugcuucaaucaguugcaaugguuucaaaauuauucccuuagaaaggcuacugugagaccuuuguaaggaugcagacgacgacaugaaaucucaucaucauccuuuuccccuagacucaccugucccacccuuacuauacuugauucuguccucuccacaauccagaaacauaauuagguuagcuaacacaagacagaaauuauguauguguauauuuugggaaaaaguauagcccaagaccccauaaaauacguaaacuuuacaaaaggcacuggaguuagcuucuaaucuagucuccucacuuauaugcauggcguguuuccuagugguguaggaacaauuaacuacaaauuucaagugacgucuaacauaccacuacccuuaagacaacauaauuaaaagcuuagucugcugagucacaggggauguggcugucaucuagaguucucccugccaagacagacaacuaaauuccgagauuaaauuuccaccucauuuacauaugaacuuuaguaauuugccccacaugucagaagagcaggcugggaagaaaagagcccugacacuaagaggaggaguagcaaaaaaaggaagaucccuugccccgacaagcccucgaggcugaagcacaacacuauggacgaagcuagacagagaacuaagagaacagccgccgagaugagcuaggaaugaauacuucgguacucuuuuaauuuuuuuuuuuucuuuuuugagauggaaucucacucugucacccaggcuggagugcaguggugcgaucucaacucacugcaaccucugccuucuggguuuaagcaauucuccugucucaaucuccagaguagcugggacuacaggcgugcgccaccaagcccagcaaauuuuuguauuuuuaguagagacgggguuucaccauguuggccaggcuggucucgaauuccugaccucaaaugaucugcccgccuaggcauccgagagugcugggauuacaggcgugagccaccaccccuggccaauuuuuuaaaauauuuuaggagauagggucuuccucugucacccaggcuggcagugguacaaucacagcucaaggcagccucgaccucccugguucaagugauccucccaccuccgccucccaaguagcugggacuauaggcaugaaccaucaugccaggcuaauuuuuuuauuuuuugaagagggagggucucacuauguugaugcaaggccuucaauauagcgagucuugaacuccuggccucaagugacccuccagucucaaccucccagagugcugagauucacuauuuucaaacagcugcucuacuacauuuauguuaacuauauagcaucuggccaagaaaaaaaaaaacuauucaaaaaaaaauuuuuuaaguuauccaaauaaaaaguagacaauucuauagacacacagucuuauuuguuuguuuuuuaacuaaaaguugagaaaagaaaaaaaauuagcuggacaugguggcacacgccuguagucccagcuacucaagugacugagacaggaggaucacuugagcccaggagguccaggcugcucugagcugugauugugccacugcacuccagccugggaaacagagugagacucuaucuuuaaaaaaaaaaagucaaguuuuaacaaaaaccagaagaauuugucaucaggaaccuauaagaaaaucugaaggaaauucuucaugcugaaaagaaaucuucgaagaaauaaagaacauuggaaauaggcauguguaaauaugacugucgcuuuuugccuuaucgucuuuaacauacauaauuguguaaagcaaaacuuauaauacuacauuaugaaauuuauagcaggccaggugugguggcucacgccuauaaucacaguacuuugggaagucaaggcggguagaucacuugacgucaggaguuccagaccagcuugaccaacauggugaaaccccaucucuacuaaaaauacaaaaaaaauuuagccaggcgugguggcacaugccuguaaucccagcuacuugggaggcugaggcaggagaaucacuugaaucugggaaguggagguugcagugagccaagaucgugccauugcacuccaccugggcaacaagagugaaaugccaucucaaaaaaauauguaaauaaaaaauuuuuuaaaaaggaauuuauagcauauacagauauaauucaugugacaacuacaacaugggggagguuaauggaacauuuuuacauaaagugguuaaauauuaacucuaagugaacugugagaaguuaaggauguauaccauaauccauagaguaaccucuuucaaaaugcuagaaauacagcuaaaagcuaacagaugaauuaaaaugaaauucuuaaaaaaucaguuaaccuaaaaaacaagaaacaaaacaacaaaacacaaauaauauaaacagacaaccagccuggccaacauggugaaaccccgucucuacuaaaaaauacaaaaauuagccgauugugguggugggugccuauaaucccagcuacucaggaggcugaagcagaugaaucgcuucaacccgggaggcagacguugcagugagcagaaaucgcaccacugcacuccagccugggcgauagagcaagacucugucuuaaaaaaaaaaaaaaaaaaaacaaaaaaacagacaaaacacagccaaauguuagccuaaaaaccaaccauaucaacaauuacauuuaggccagaaauaguggcucacaccuguaauccuagcacuuugggaggccgaggugggcagaucaccuguggucaggaguucgaggccaaccuggucaacacggagagacccugucucuacuaaaaauacaaaaauuagcugggcgugguggcacacuccuguaaucccagcuacucgggaggcugagacaugagaguugcuugaacccaggaggcagagguugaagugaguggagaucaaccacugcacuccagccugugugacaaagcaagauucugucucaaaaaaaaaaaaaauuauaaauguguaugcaucuaaaagaucuucaaaauacacaaagcaaaaaugacaaaauuaaagggagaaaugaacaaauccacaauaacagagauuuuaacaaccuaacaaccuucucuuagaaauugacagaacuagaccaaaaggaaaaaaaccccacaaaaaucaauuuaucagagaaacaccaucaacuaccuugaucuaacugacagauacagaacaaacacaugacaacgguaaaauacacauucuuuucaagugcauaugaaacauucaccaggacagaucauaugcuggaccauaaauuaaaucgcaacaaauauaaaaagauugaaauccuacagaguauguucucugaccacaguaaaacuauauuagaaaucaauagcaauaagguaucuacaaaaacauaaaauacuucaaacugaaacaacauacuucuaaguaacccauggucaacaaauaaaucacaagauauauuaaauugaacaaaaauaaaaacacaacguaucaaaauguguaggaugcugcuaaagcaguucucagugggaaauguauaauuucauuauuuauuuauuuauuuagacugagucucgcucugcugcccaggcuggagugcaauggcaugaucuuggcucaccgcaaccuccgccuccuggguucaagcaauucuccugccucagcuucccgaguagcugggacuacaggugccugccaccaugcccagcuaauuuuuguauuuuuaguagagucgggguuucaccaugcuggccaggcuggucucgaacucuccaccucaggcaauccacccaccucggccucccaaagugcugggauuacaggcaugagccaucgcgcccagccagaaauuuauaacuuuaaauacucauauuaggaagaaagaucuuuucaccagguaaugaaaaaaaaaaggaagaaagaucuaaaaucaauuagguaaaguucuagaaaaaauugaaggaagaaagcaagaucaaaacagaaaucaauuauauuuuuaaaaauaaacaauagagaaaauugaaguaaaaaguuaguucuuugaaaacaaaauagauaaagcccuagucauacuaagagagggaacacaaauuaucaaaaucagaaaugaaaggagcauaacauuaaaaugauaagggaauauuaauaaaaggugaaaaacaacaacagaaaagucauuuuuuuuuuuuuaguucacaaagcauaagcaaaaguguauauaaaaagaggauuaauuuaacucuaaauaugaaccuuccacagucgaaaucucuuguaauuccacaaggggagaagucgguucuguuuucaucguguuuucucccauugaugggcaguucaacuccaagccugcagccccggauccauccccaaaggaguggcaagucagugcagaugagaccuggccagcuuccaaagcagacuucaacugaccuagaagaaaaaaagaaaguuugggggaaauauacauguauguaauucugaaaucaaaaguccuacaacagucuaagaaagccagggacuuuuuagaggaaggaauuaaucuaaaacauaaaagcauacauucacagguucccauacauacaggcuggcuugugagcuucucaaagaaagagguuaaagugaaaggaaaaauagcuggaaguauaaacacaaaggcacgaaugagauggcagcagagagagagaagcagggcucuucgaacaguguaccuccaggccaacacugaacgguagauaagcaaaaccaaccacaaaugcauccagaaaguaugucuauugaauaaaucaucagugaagagcaauacauuauaaaaacacugcagcacauucaauaguuugauuucaagacaauuuaauacuuguggaaggcagaacauaaugauuuacauugauucucacuaaauaggaaccagguuggcaagacaauuccugaacagacugacucaccuucuucagauuccuugguacuagacaacgugucuugcaaaggauccguaucaaccaaaucugauacaaccaagucaggaucuaggaucucaugggucccauuaguggacagccuggaggaacgucuccucgauaagucuuugucaguguuuuccgaguaguuuuuugacuuuuccugggcuauuaaaccauuaagagaguuguagucaagagaccaacaagaagaaauaacugugcuacuacagauuucagggcuggaugucucuaaaaggacuuuacagagagacuacuggaauguuagaguagugauaaaaggaaauacccuuuacuaguuuacaguuuuaaguaagggaaaagugucccugccaggauagaauuucacuucuuuaaggauucauggucugaaaacaugugcuaggucauguccgaaucuugacaacuauguucuauuuuggggcuucccaaauguacuaacuugcaaagucgacuuaaaaagguuuauaagagccuuacuuagagcuaucacaaauccuuuuuggagccaacaggauacuauuuuauuuuaaauuuauuuaaacauuugagccaacucacuccagaggguauuuuuuuaaaucaauaaauaguauuuuauuuuguauuuuuauuuuuuauaggacagagucucacucuaucacccaggcuggagggcaguggcacagucuuggcucacugcaaccucugccucccaaguucaaacaauucuccugccucagccucccaaguagcugggauuacaggcacccgccaccacacccggcuaauuuuuuuuuuuuuuuuuuuuuuuuuuuugagacggagucucgcucucucgcccaggcuggagugcaguggcgcgaucucggcucacugcuagcuccgccucccggguucaugccauucuucugccucagccuccugaauagcugggacuacaggugccugccacaacacccggcuaauuuuuuauauuuuuaguagagaugggguuucaccauguuagccaagauggucucaaucucccguccucaugaucugcccaccucagccucccaaagugcugggauuacaggcgugagcuaccgcgccuggccacacccggcuaauuuuuauauuuuuaguaaagauaggguuucaccauguuggccaggcuguucucaaacuccugaccucagaugauccacccaccucagccucccaaacugcugggauuacaggcaugagccacugcgccaggccaauaaguaguauuuuuaaaguuucacucugcauaugaaacccaucccuuccuaagccauuaaauuuccaguggcauccaaaucaaaugugauuuauggauauggagaugauaccacagaacccaacauuaguacaguuugugcuuugggauuuauuuuucuucuagcaaaaacuccuucugauccaacugcauccaacucacauuaccucaugugaccagagacaaacauuagagccuauagggaaugggggacaggaugaauauagaggaaguugacccaaacaacgucaaauucuagccacacauaaacaaacuguagacucacaugaauuuuugucaagccgaggacguuuuaaugggacuucacauccuuuugauauuuuccuucuucucaguuccaauguuauugguugcaaaguuugagaguuugaauccacagcuaccauguuuauaaaaccacacaaaaaaagauacauaauuucuuagugucugucauuuuuauauauaaauaaaacauauauacauauauauaugcagaaaucacugcauuauaaaugggccaucaaaagggcauucuuacuuaagauaaaagaaaaaaaguaaaaugagugagaaauuacuuccuuacaggagauggugauaccuugccaauugaccuccugaaucuuuucuaugauccagcuccaguuuucaaccucuacuugcuacauuaauuaucuuagcacugggccuaguuuugaggguacaagaaaaauguccaagagaauuuguggauuuuuuuuuuuugagauggagucucgcucugucacccaagcuggagugcagugccgcgaucucugcucacugcaaccuccgccucccaggugcaaacgauucuccugccucagccuccggaguaggugggauuacaggcacccgacaccacacccggcuaauuuuuguaauuuuaguagagucacgguuuccccauguuggucaggcuggucucaaauuccugaccucaagugauccagcugccucguccucccaaaguucugggauuacaagcaugagccaugagacccagccgagaauuuguauuuucuuaaacaaaauccuaaaaaaauucuugggagacuaugcuaguuaacagucaauguuucaggcaaggcugcugguccccagcaaacccagcucugacauaauuuagcaguacagacgcuaagccuuugaagaguacuuacuauuuagauuuuguuugcuugcuugcuugcuugcuugcuuguuuuuuugagaugaagucugggucuguugcccaggcuagagugcaguggcacgaucucggcucacugcuaccucugccuccuggguucaagugauuguccugccucagccuucccuguagcugggauuacaggcaccugccauaccuagcaaaauuuuuuuuuuuuuguauuuuuaauagagaugggguuucaccauguuggccaggcuggucuugaacuccugacaucaagugaucugcccgccucagccucccaaagugcugagauuacaggugugagccaccugcccagcauaguauuuacuauuaacuuuuuuuugagauagaguuuugcucucguugcccaggcuggacugcaauggugcgaucucagcucaccgcaagcucugccucccggguucaagugauucuccugccucagccucccaaguagcugggauuacaggcaugcgccaccacaccuggcuaauuuuguaucuuuaguagagacaggguuucuccauguuggucaggcuguucucgaacuccugaccucaggugaucugccugccuugaccucccaaagugcugagauuacaggcgugagccaccaugcccagcccuuacuauuuuguuuuaaaccuaccaccuaagaagcuuaccccaaaucagaaaagaugagaauugaaaaggcaggcagaagaaagaaacugggaaguugggcaggaaggcagagcuaaggggucucaggaagggugaaaggaggagagagaagaggaaggaggaaaggaagagggaagaagagaaguaaaugggaggaaaagaggaagggaagggagaaagaugagaagaggggaagagggacagaaaagacucaucuaagaccuguagcuucaggucggucaaauggcucaacaagacacggccugaagugugaggaagcaaaccagagaagacuguugaacucugaggcucuuccuguguuccaacuucccaaugggccaauauuauuuuguuccaacuggcagaacuuggaaaucccacacauuccaaguuaaacauaaauacaaacaggcugggugugguggcucacgccuguaaucccagcacuuugggaggcagagacaggcagaucacuugagcucaggaguucaagacuagcauagccaacauggugaaacccugucucuacuaaacauacaaaaaauuagccaggcaugguggcacaugccuguagucccagcuacuugggaggcugaggcacaagaaucacuugaacccaggaggcggugguuacaaugagccgagaucaugccacugcacuccagccugggagacagaguaagacuccaucucaaaaaaauaaaaauuaaaauauauauaaacaacccucucuaaauagcucagauccuguucccaaucaagucuauacaaucuagggugcucaaggaaggcucuacaaaucaaugaacuuauuccaaguaauguuuuaaggggaugugaacaauauaugggauacuuggcaagucuucuucccuuugauaccguauauaaauaggagcugacuguacagaacuugaguguuucccaaacucuucuuacaguauaagucaucugggaagcuuguuaacaauucauauucccagauucccauccagacagucugacuggaaaagaacugaggcauggcuggaaucuguuuucacaaaugccuugggcaaggauuaaccauaaacuuagaaaacaucccuucuauauuaaauuuauccuacucauuaugaaauccuacacuuauaaaaauauaaaaacugaauguccuuguucuuaucucaauggagucauguggcuucaaaggagcagucugcuuguugggguacaacuacuucuguacauaccuucuggaggguauaagccagggcaugaauaccuaaaggagaauuaguuucaaaacacucaauucucauacauacucuuuccuaaacugagcuaaggacaugucagauuucugccuaaggacaugucagauuucugccaguuuacauuuuccaccucuccuuguauaauaacugccuuuaacugcccuucucccacuuuacauaaaagggccugccucucacucaucccacaucuuaacauggugcucagccuggagguuuaaaacuuccagauuuucucaacugggguuccccaucugaacagagauauauuuucucuguuuuccuaagggugguauacagcuaguaccauucucaaugcacuaaggucaauccaucacagaucaaggaugccuuggguauuguggcuucucucccaaaacucaguugagaaagccagugaacauaaagucagugcuguccaacagaaauauacuaagagugcaagccacauguaauuuuauuuuauuuuauuauuuuuuguuuuuuugagauggagucucgcucugucacccaagcuggagagcaguggugcgauaucggcucacuguaaccucugccuccuggguucaagagauucuccugccucagccucccaaguaggugggauuacaggugcaugccaccacgcucaucuaauuuuuguguuguuaguagagauggggguuucaccauguuggccaggcuggucucgaacuccugaccucaggugacccacccauguuggucucccagaaugcugggauuacaggcaugaaccaccaugcccggccaauuuuuguauuuuuaguggagacgggauuucaccauguuggccagccuggucucaaauuccugagccaccacgccuggccaauuuugaauuuuuuacucaucacauaagaggguuugguuuuuaagugccaggcaugguggcucaugccuguaaucucagcacuuucagaggccaaggcaggauugcuugcuugaggcccagagauugagacaaaccugggcaacauagugaaacccugucucuacaagaaauaaauuagcugggcaugguggcaugugccuguagucccagcuacucaggaggcugagauaggagcaucgcuugagccuaggagguggagaauggagugagccacaaucacgccacugcacuccagccuagguaacagagugagacccugucaaaaaaaaaaaaaaaaaaaaaaaaacacaacuuaaaaaguuaauuuaaauacuauuuuauuuaauccaguacuuuaaaaaaaauuuuuuuuuuaaacugggcucagcaaccuuccugccucagacucuggaaucgcugggacuacaagcacgugccaccacucucagccaauuuuuucauuuuuuguagagaugaggucucacuauguugccaaggcuggucucgaacuucuggacucaagugauccucccucaucagccucccaaagugcuggcaugauuacagggaugaggcacugcacccagccucuaaaaacauuucaacauggaaucaauuuuuuuuuguuuugucgcccaagcuggaaugcaguggcccgaucucagcucacugcaaccuccgccuccuggguuucaagcaauucucuugccucagccuccugaguagcugggauuacaggcacccaccaccaagccuggcuaauuugucuuuauauuuuuucaguagagacgggguuucaccauguuggccaggcuggucucaaacuccuaaccucaaguaauccacccgccuggaccucccaaaccacugagauuacaggcccagccguaaucaguauuuuaaaaucgagguguguuacauucuuuuuuugaacuaaguauuugaaaucuagcauuuacuuacacuuacagcauaucucaauucagacuagcuacauuucaaguagucaauagccccaugcagcuaguggcuaccauacuagacagcagaggucuaggcccuauuuaggccuacagacaauugcagcacccucagcucuugagggcaaaacccaguuacaagcacuacagggaaagaucccuuauuucauauagagacaaaucaaccuauuauauaauuuccuaucuuacaaugaguacuaauacacuuaugugaaguaaguuaaauuuuuuuccacagaaauuaagucugauagucugauuugauaaggaagacuggcuuugcauucucuacaucguuagggaauaaugaaaagguuugcucuguaguuccacaguuuugaugaaaauauuuguguguguguguguguguguguguguguguguguguguguguguuuugagauggggugucacuacauuguccaggcugguuuggaauucuugggcucaagcaauccucccaccucagccuccugaguagcugggacaacaaacaugcaccaacgcacucagccuucauguuuuguauuuuaaauguauccacugcagcuauuuaaacuugugagaaaaagauaaauacugcuuuaaaacgugcuaggggauucacaguuuuucaacugaacacauaaagaaugcacaaucaagaaugucugaaggucacugcacauauuaaucaauggcaggcucaguccagagaaccgggggggccucuucaugccauugaauugauuuggagaacgaguguuuggcuuaggaagaaaucagggcuuguuucauucuugguuauucuagaagaauuccaaauuuuaaguuuuuuaauaacugcauucuucccuaaaucuauacccucuaaccuugacucuuaccaauuagccaucucggcuuuuuauuuagacugugaaaauuucuaaucaauaaucacucuccaaggagcucaauuucaaaaugcacccaugcuuuucuaguuucaauguuccuuuguccccaucuccuucagaagcccauaccuuuuuacuauuacuuuucuuucaugucugucucauuaaaacucuauuuccugauucuagauucuauuaagcugacuuaaacugagaucauuugaaaaagcauaagcaaaaggccucgguuuaucagguuuuaucauauaagcugaaguaucuagucaacaguuaaccacuacuuuagcaaacucaguuaugaacaugcuucccaacuuagauucacuuggauauguaccucacuuaaauucagcuucaugaacacaacuuguuuccagaucauaagacaauucaaaaucagucacaaaaauaaacgauugacguacacaaguuacaaagaaccacaaagggccacagaagaauacucuggcauugcccauugcagagcccacuuaaaaaacucaccaguaggagcuauggaagggggucugccucguuuucuuuuggguucccucaaguuuucuuguggacucuucacaaugucauuuucagguuucuuauccacuugggcaucuccagaauacucucugucauuuucggaaauguuuuccuugucuuccuucucguucuugggaagacuuuucucugacacuuuccccuuuucagaacagauuaacuuuccuucuuuaucaggcugcuugggucgcuuuucugucuuuaaggguuuaucuucuuugucuuucuucacauucacuguugcuuuucucuguucuuuaaacuucucucguuuaucaggagaugaugaaagacuuuugugaucuguuucuuuaggccuagcauuacccacaauauucuaaaaugagcaaaauagcgaugaaacacuucgugauuacuugcaaauacaaaauuaggaguuucuuacaaacuuaugaagacaaacaaagaaauuaaaacaagacauacgccagaucacauauacaaagcaccacugacaacagccaccuguacugaguugagaaccaauccuuaaacuuaaaacaauucaauuauuccggagacagugcaaucucccuuauuaugacgaauaagucacuagaaaauaaaauucuggguuuuuguuuguuuuuguuucugagacagagucucucucuguugcccaggcuggaaugcaguggcacaaucauggcucaugcagccucgaccucccaggcccaagcgauccucccaucucagccuucugaguagcugggaccacaggcauguuucaccacacccagcuaaguuuuuuauuguuauuuuuuguagcaauagggucucccuauguugcccaggcuggucucaaacuccugggcucaagcaauccuccugccucagccuccuaaaguauugggauuguaggcaugagucaccaugccuggccuuaaaauucuggaaagcaaucuuucugacaaagguguucgaagaaaaugccuucaugcucuguccuuauccccagcaugacuauacugacccagagcuuuucagaggccugguucaguuugccagcaaaugcugaugucuugucuauagaaaaacaaaaacugauaacuggaagcuuaacaggaaaacuauaaagauuauccaacccagaaccagggucucugcuuucucuaucagguaaaggcugugcucaguucaacaagccaccuacuauguuccugagcuacuuggaguuuuugucuauugguaggaaauaccgcuucuuaguuauguucucccuaaauuacauucuuuaaaauucacacuaaaaaucgaggguccucuauugugacuguuucauaauaaggccaggucugaaagcucuagagauuccaaaacuauaauuaaguuuauuuguguacauaucucucuucuaggaccucaaaagagcagagaccaccauacuauguucauaugggaugcccagcaccuagcacacacuaggcacauagguuuucacuggaagcaggaaggaguaccuaaauacucaacaaauaaaaguuuaauuuguucuacagggaaaaauaauaaacaaggaaauauuuuuucaagucccccaaacuauucugaaagcagccagguuugagaacaggcauucucgguaacagccagcagaaauauaaacugaaauugcccuucuuguugggaguucagggaggagauggcaauuugagucaaaacuaaaaagguuauaccuuugaacuagaauaaauuccuagaaauaaaauuagcuaaaauaauaaucagacuuguguaccuggauuuacaaauauccuuaaugaccauuugggaauugguuacacaaaguaguuacauacauauuacagaauacuacauagcuguuaaaaauuauauucucagaauauuaaggaacauggggaaauguuaguuaaaagagcaguacuauauuaauguaccacaacuccaauuuugaaaauaaauaaauacacacacguacguuuaauaaaaaacacagaaagauguauacaucaaauuguuaagucaaguuacacaccaaaacguuaagaacaaugauaucuguuugauggaauuauaguuuuuauuuucuuugugcuuuguacuuauauauuuuucuacaguaaacguauuauaacuucaaaaacauaaguguuacuaauauagagacuaucaaaacauuuauaaggcagugcaguccuacagaaaaaaaaaaaaaacucaaucuauuccaauaguauacgaaaaaccuuugaaauugcccaugacagauaacucuagccaaaccacuguacccucuuggaaaagaagccaaguccaggagccuugggccugugcuuaagggccuaccgggcuaaggucagacacucagaggccauugggaaaugagaaaugaagcauggcacccagaaauccucacuggguaaggcacccaccuccaagccaaagcacugugagugcuauccaucaauuuacugaguaucgcagaguaaacagaugaacaauuguuaucuagagcccuggacuuccacuugggaagguucuggauauaaccugccaauucuggacaaguuuauaauucuguccucuauauuaacucguucuacaaaccuaacacaaaaauugccaaauuuaaggccaaaauaauguuuuagaguacuguauggcuccuuacaugccagagagacaagugaacaaagaaaaagcaucaucagggccaaagcuuuauguaauaauuuuguuaauuuucugaaaaggaaaaccagcaaaaggcaaaaacauucuugagguuaccacuaaagguaucauguaucaaaauccuuugaaucggcugggcaugguggcucaugcccuguaaucucagcacuuugggaggccaagguaggcagaucacccgaggucaggacuucaagaccagccuggccaacauggugaaacccccaucucuauuaaaaauacaaaaauuagcugggcauaguggugcaugccuguagucccggcuacucaggaggcugaggaaggagaauugcuugaacccgggagguggaguuuacagugagccuagauugcaucacuguacuccagccuaggcuacagagugagacuccaucucaaaaaaaaaaaaaaaaaaaaauuucuuagaaacuuaugaauaggccagacaugguggcccacaccuguaaucccagcacuuuaggaguccaaggugggcggaucacuugaggucaggaguucaggaccacccuggccaacauggugaaaccccgucuacuaaaaauacaaaaauuagccaggcguaguggcacaugccuguaaucccagcaaaucagaaggcugagacgagaaucacuuuaacuugggaggcggaguuugcacugagcagagauugggccacugcacuucagucugggugacagacagagacucggucucaaaaaaaacacaacuuacaaauauacauacagaagaauucauuaaaaaucucugauaaguagaaucauuucaucaucacaaagacacaacagagggccaggcgcaauggcucaugccuguaauccuagcauuuugggaggccgaggugggcagauugccugaacucaggaguuugagaccagccuggacaacguggugaaacccugucucuaccaaaauacaaaaaaugagccgggcgugguggcacgcgccuagucucagcuacuugggaggcugaggcaggagaaucacuugaacuggggaggcggggaaguugcagugggccaagauugcgccacugcacaccagcccaggcaacagaacaagacucugucuccaaaaaaaaaaaaaccaaaaaccaaagacacaacagguuauagcaucaccaaauauugucacaucaacuacuauccaagcagaugaguagcaaguuaugaugccucagugauaaaaucuuuuacuaaauugcuaaauuagcugucucaacagcugaaauuaguaauaaucaggauuuuuaaaaagacuaauauccaaauuuugaucucuauuuuccccucaacuauuaaaacauaaacacgaaaaagacaaaaggggaaaaaucaugaagaaaguaggcaacacuucuagauggcccguaucuaugcaaaccauauuuccaguaccaaaacugaggccccaugcucaggcaaguacaugcauggugacuggaacaacaggauaccaaaaucacaaaccaggcacaucuagcacaaguggcugccaaaucugugccaaaugauagcucuguaaaccaccaaguaaugguccuaagcuaaaagacagagcuagauggacagaaaacauacuggaggucuccucaagcaauucaacaaguuuccuguauggcuaacagcucuuguggggcgcagggcacagagagaagaaaagaauaaccauuguugaaaaaagauuaggagaacagaauauaggcaaugguauccaagcauuuggcacuuuugaaaaaaaaucucuguuaaaaggaaacaguggccagacacaguggcucacaccuguaaucccagcaccuugggaggccaaggcagguggaucaccugaggucaggaguucgagaccagccugaccaauacggugaaaccccgucucuacuaaaaauacaaaaaaauuagccaggcaugguggcgugcgccuauaaucccagcaacucaggaggcugagacaggagaauugcuugaacccaggagguagagguugcagugagccaagaucgcaccauuguacuccagccugggcgacagagcgggacucuguuucuaaauaaacaaauaaauaaauaggaaacagcaaagagacaaauauuuacaacuucugaaaacuuguguauuauuuucuggugaaauugugucagauggaggaaauaaacacuugcuaucauaaacaaauguaaugucuuuauuugaggaaacaaaacuacaauguuagcauuauucauaacacaaagcacaaaaccacauuucucaccugaucuuuggaaaaagcuuugacaugaauauguuugacagucugaacuacuccaucauaaaauuucacaguguaaguaccuaaaauucaagaagauaucaugauuuuaacucacaauuucaugaaaagugguaacuuuucaaaguauaaacacaagggaucuccaaccacauaauaagcuuauaggaguuuaaaacuguuuaagaaucauauucagucuuacuuauguccaagauaacaguaugcuuaucuucauuucuuaguuaagauuaguuuucuaccuacguaaauugaaauccaucaaaaaaauaaacuuguuuuuagaugcuucauuaaaauaaaaaaaauuucacugaauuuaagugaagaacaaagagcaguaaaacaauuaagaaagugaguaaaaugcagacuuauuuauuccuuggugaauuuuucacuuuuauaauuuaaucuuuacguuccgggaucgggggcaguaauagcucucaaguuuuaaaaggaacaucauggcucacgccuguaaucccagcacuuugggaggccgaggcaggcggaugacaaggucaggaguucgagaccagccuggccaacauagugaaaccugucucuacuaaaaauacaaaaaauuagccgcgcuugguggcaggcaccuguaaucccagcuacucgggaggcugaggcaggagaaucacuugaacugaggaggcggagguugcagugagccaagauccugccaucgcacuccacuccaggcuaggcaacagagcaagacuccuucuccaaaaaaaaaacaaaaaaaaaaaaaaaaaaaaaaaaggaacaucauucagcuaaagguauuguguuucaagagauguguucuauuuccacaacucaaaauccauuugaauuauguucaugauacaauguucuaaaauagagacuuggucaaaacacaaaauguuugcugcuacauuguuaguuuuuuucugcuacacuguuaguuuuuucccauuagaaaaaaauuauucaauaaagauccgucccugcuaaaaaccuuaagcuggaaacccagauaaucuuaucuucccaaauaagguguccaacuacagaaguucucauuaguuguacccaaacaacacuuucaaauuuugcaucuuagagccaauucaugccccacccauuuuugccccagggauuuaaaauaaucacaauuaaucuugucaagauucaguaaaccauugguaaucacguaaugguuuccacuaguaaacagguuuuucucuuuuuagaaccaauucccccacccccugcaaaaaacccugaggccugggagccgaagaaugcaacaacaaaguuaagaccugguuuucuccuucugauacauucucuucccacaccccuccaccgccaguccucaacagggccuagucaauggcuaaucacggguaccaaaugaaguccaaaaguauucaaccuccaacacaaucugaccccaauaauuuuccaaaccuuauuucccauuaccaccauccaauacccaccaacucaaagugacaagcuacccacugaaacugccagcgacacuucuaacuccacaucuguauuaaaaguguuuuccuucugggaaugugccacucacugaucuuuaagugccuggcucaaauacccacaacaguucuguaaaagcuuccgggcuuuucagcuacuaaugauuacccccgaucugaacuucuuaggcucauuuggcaccagccuacagagcuucaaacuuaggucuaccuucauauaaguacagaucacaacucaaaagcaggcucuucaaggccagagaccauaacuuauaccacuuucuuccacacacaguaccugccucagaguaaaccagugcuucucaaaguguggucccacagcagcagcaugagcaacuccugggaacucauuagaaaugcaaguuaccagucccaccucagauacacugaaacagcaacugggaacagggcacaggaaugugcauuuuuaacaacuccuccaggugauucugauguacaccaaaguccaagaaccacugccauagacaauuaguaauuaccuacugaccuuuauuccugguaauuacaaaauaaaggugauuauuugucacaggugucaccaauacaugacgaaacuagcuagcaagacauagacaaacuuugauguucucaccuauuuguaggagcuaaaaauuaaaacaauugaacuuacggagauagagaguagagggaggguuaccagaggcuaggaaggguaguaggcaggggugggggaacgugucgaugguuaagggguacaaaaaaguuagaaagaaugaguaagaucuaguauuugcuagcacaacagggugacuauagucaaaaauaauuguacauuuuaaaauaacuuggccaggugugauggcucacgccuguaaucccagcacuuugggagaccgaggcgggugaaucacuugaggucaggaguucaagaccugucuggccaacauggugaaacccugucucuacugaaaaaaugcaaaaaacauuagccagguaugguggugggcaccugcaaucccagcuacucaggaggcugaggcaagagaaucgccugaacccaggaaguggagguugcagugagccaagaucacaccacugcacuccagacugggugacagaaugaaacucugccuaaaaaaaauaaaaaauaaaaauaaaauaacuacauaauuggauuguuuguaacaaaggauaaaugcuuggcgugauauauacccccauuuacccugaugugauuauuacacauugcauaccuguaucaagauaucucauguaacucauaaauacauacacccacuuauguacccacaaaaauuaaaaauuuuuaaaaaaauuaaaaauauaaaaaaaagaaacuggcuagcaaacaagauauaaagauacauaguuaugccugguuggguuaaaacaucagcaauuagaugacaacaacaauuagaugaacaggcuaugauaaaaggauaagaacauaaaaggauaagagcauaaacaauuaucuacacaggcagcucagcaaugacuuaugaguacuuacaacaaaggucuggguuccuguuuuuaccugccuauauugucaggguguuggcaagcaaagcaguuaugauaaacaaugcuauggaauucuaaacagaacccucucaagcaaccauggugcaacucuggcaagucuggggacggagauggggggaugggaguuuuaagacuccaguuaucuugaaaucuuaaauauuaugugugccaacaaaccacccaagacucuacuuucaacuauuuuaucaacaaaguuaguucaggaucaguuacaucaaaaugaaaacugccauuuuuacaggcauuuccaacauccaaaagucaauauugaguaauguuaccuaacaguccaacauuuucagcuacuuggaguuaauuuugaagcuuacuccugauggcagauuccagaaggaggacuuacauaaaaggaaccugaguuccaugauuaagucugagacagcuaucuuuggaauccaagccugucuacugaccuccaaccaauuuuuucccaccaccccgcacugccuauugcucaagcuccucagucuaauuccaaaccacagacccauuucagagugcugaaaugacccaaacuauggccaaaggugcuaagggaugaccguccuuagauauaucucggucuuugauccuuuuaacuuccaaaggacuacaaaggaucaucuugaaacuuucaugcuaaacacagccuaacuugggcuucaauaaaucagacagaauaauggacaacagagaggcccacauuuuacucagaugguuucauguauauuacuaaaagauugucuucacauggaauccucccguagguagcuaauaauagaguucuccuguggccacaaacacuaccuaacaaacaacauguaaaugaaggaacucaaaauaaguguauccuguuccaucuccucuaacgugacagaagggcuaccugccucagacucccucaaggaguuuuuguccuuagacuuuaagaugaaacaaagauuccuggucuugccccucugaggguuaaggacucagcauugcagacaaucuuauagcagucaguaacacuaaaaggguucuaagaacaaaacugagaugcauaacaagcucauguucucuaggaccaaagacauagggauaauacaugggugauuuuggauuggacagauuucuguugcucaugaaaucuaccacagccaauauuccagggccucuuuuuuucuuagaaacagggucuucaucggccgggcaugguggcucacgccuguaaucccagcacuuugggagguggaggcgggcggaucacuugaggucaggaguucaagaccagucuggccaauguggugaaaccccaucucuacaaaaauacaaaaauuagcugggcaugauggugagugccuguaaucccagcuacucgggaggcugaggcagaagaaucacucgaaccugggaggcagagguuguagugaucugacaucgcgccacugcacuccagccugggcaacagagcaagacuccaucucaaaaaaaaaaaaaaagaaagaaauagggucuucgucacccauccuggaguguagugguacgaaccuagcucacugcagccucaaacuccugggcucaagcaauccuacugucucugccucacaaguggcugggacuacaggcaugcaccaacauguccagccaauuuuuuauuuuuuaguuuuuuguagagauagcggggcauuggggucuauguuacccaggcuggucucaaacucccagccucaaacaauccugccuccucaacuuccaaaagcacuggaauuacagaugugugccauccugcccagcguccagggcuucuuuucuaucucauucacucuucggaagucagauuauuccagaaugccacagauggaaaacggaggguuuucaaacauguuuucucaggcuggucugaaaguagugaguuaucucaauugaugguucacaguuaguuacagaucgaacuuguuguucuacucuuuccuuucuucucacaacugcuuucaacuagucuuuucuuuuuuuuucuuucuuuuuuuuuuuuuuuugagacgagucuugcucuguugcccaggcuggagugcaguggcucgaccuuggcucacugcaaccuccgccuccuggauucaagugauucuccugccucagccucccgaguagcugagauuacaggugcgcgccaccaagcccagcuacuuuuuguauuuuuaguagagacggguuucaccauguuggacaggcuggucuugaacuccugaccucaggugauccaccugccucgaccuccaaaagugcugggauuacaggcgucagccaccacgccuggacuggcccuuuuuagaaaaaaaaaaaaaggaaaaaaagauuagucaggucgggcacgguggcucacgccuguaauuccaauacuuugggagaccgacgcggguggaucaugaggucaggaguucaagaccagccuaaccaacacggugaaaccccgucucuacuaaaaaugcaaauauuagccaggcgugguggcacacaccuguaaucccagcuacucgggaggcugacacaggagaaucacuugaacccaggaggcggagguugcagugagcugagaucgagccacugcacuccagcaugggcaacagagggagacuccgucucaaaaaaaaaaaaaaguuuucuugaaguccuuaggcuuccacagauugagggguggggaugugcauauguuugugggcaugccuuccccucccucuaaguauuuucuucuuagcaauuuuacauuuuggguuuagguucuguggccaauacaacacucaucuauucccacucccucuuugacuucuaacugcucaaaagaguccagagcaaaggcagugaaccgcccauaaucacugagcaggagcugggaccagacccugucucccaaccaugguucucaagacaacaccggcuccagaaagugcagaccacuacauccacucucgcauucuaucagugaacaccuggaccuaauugacaacaccugcccucuuaggaaaacccugcuccaaagaggcagccugguacugugggaacgacaguuuagggacucuguagaaccacagaccuccaugcagaucucagcucuaccauccaagcgcuuuauaaccucaagcaguuucccccugugagcuuaguuccucaucugcaaaauaagaaugggguuaauggcaauaaccuuuccauguuuguguaaagacuaaauacgauaagauauggaaacaaccuagcacagggccugucacagaccaagggaucaauaccaccaagucacccuaaaagggaagcacagcacauugacaucuuuuuuuuuuuuuuggagacggagucucgcucugucacccaggcuagagugcaguauggugcaaucucagcucacugcaacuucugccuccugaguucaagcgauucuucugucucagccucccgaguagcugggacuacaggcacaugcuaccacgccagguuaauuuuucuauuuuuaguagauacuagguuucaccaugcuggccaggcuggucuugaacuccugaccucagguaauccgcugccccggccccucaaagugcugggauuacaggcauaagccacugcgccuggccagacauugacaucguuaaaggcuaucuaggcaaaaaaaaaggggcgggguggggguugggggggaagcacaaucccucuucccccaauagaagaaaacagccaagcuagcaccugcacgugugggccuaaaucuuccuuuucucuuucuacaaagcuguucacacaguaucagccuccccacauuucaaauguagaaucaguuacagcaugaagaaaacaaaaaauaagagcugcuucagccagagacucuagaaacaagaucauuuccauagcaucuccuguuauaaaugcagacuucagucacugccccagagacugaacuggcaggguagguaggggacaugacccaaaaauaugcauauuuuuuaggaagaaggagcugauuuaccugcucauucaaguuaaagaaccacagaucaacagaaaggaccaauuccccauuuugucauaaaugcuaaccuacacaguaguuuccuuaaagaaaaucacuuacagagcagaguuguacacuacugggggcaaaaagcccugacagacaacugacucugcuaauccuugugugaaaaaaaggggagauucgggaggcugaggcggguggaucauuugaggucaggaguuccagaccagccuggccaauacagugaaacucugucucuccuacaaaugcaaaaauuaaagcagcagcuucauugcugcaguucuaucuucaccuucacgauguuucccuuggucaaaaacaaacucagucaucuccaaguucgaagcauucagcaaacaauggcaaggcagagccaccagaaacauacaccugauuuucauaacaaauaugguaauacuguauuagcuaguggacccacuuucuguauugcuauguggacauauauaacaacacaaauuggaauagaauggaacccauccccuguuggcagagucaccccccaaaauggagagaacaguaaucauaccagcugauguaauaaugaauuguuuaaaaaacagcucauagagacuccgucucaaaaaaaaaaaaaaaaaaaaaaaaaaaaacagcucauaauugaugccaaguuaaagcacuguguacccauuaagauauggcauuaaugaagaaauaaaguacauuugaaaccuuaaaaauauauauauauauauaaauuagccaggugugguguggcaugugccuguagucccagcugcucaggaggcugaggcaggagaauugcuugaacccaggagguggagguugcagugagcagagauugugccacugcacuccagccuggacaacagagcaagauucugucaccaaaaaaaaaaaaaaaaaaaaaaaaaaaaacggagggggaagcuaagcagccccagcaaagaggugaggucagcucaccagagauggcuuccaaacaaagauucccugaaaguagaaacccaucuuuuacugucuuuuguaacaacacagacugagggucuaacaaggcuaccaacugccgcugccuucguacuaaauaaugcuuaaucuccacugcugaagaaccacuccaggugaaaaaagcuaaauaauauggcauuauaugcccuauuuuccgagugcuaacagacuuccuuaagaaacuaaaguuguuauuuaguucugauucaaucaugccagacuccucagugccagcagcugccacuuccacacucuggcuacaguccccacccaccagccugcucaacacucagcuuuagcaaaacauccaaggagauuaagaguggcaagaaaaucagaccaagccuucuaaagauaaaucuacaaggcaugacuucacuauauccccugccuccuccuggcagcaccaacaagacauaagugacauuuacaggaaauaaaggggccgccuugccggcagagcuucuccucgcagggccauuaagcugguggccacugcuacgaaugaaccugaggcacagcagaaaauaccaaggaaagagugaaaagagagacuagcauugucgcucccaaucccacaaguaaucccacagugaaucgugaugaagcacaaacugaccaucagcucuaauccaaaccuaaucauuuuugaaaucauuauuucaaagaguuucugauccaucccacacacaaacacaaaaccuuauagagacaggugccuaccaugauuaaccugcaccauccugcccugccuccuccugguagcucuauuucagcaccuacuucauucuacuuugaagcaggucuucuuuuguuuuacuucaugaugccaagcucugggcucugcagguauuagaucuaaacaguagauuacuaagccuucauugccuccaccaagacaccuucccaccccucuuagaggcauuaauuaucuucaucucugaaucagacauagaucugagcuccuacaaaggcuagcuuuccuucacaaucuggguggccaauaguacuacccagccugccccacuaacuuucuguuucaggauugccccucucccauauccucuccucccucuuccaguuagucccaaaaaccagucaaugugucagcauaauacaggacuucagacccaagaaccucaggacaacagguuuuggcagaaauuuccauucauuuucauguccuucaauuaacuaaauuucacuggacagaauauggagcuucagaaacaagauauuagcguugcaaaugaccauuuuaggaacuaucauagccucgagacucucccuccuauaauuuuagcuuauggaggaagcacaacugaaaagacuuuuuuuuuuuuuuuuuaagagacagagucucguucugcugcccaggcuggaguacaaugacacuaucauagcuugcuguagccucaaacuccugggcucaagggaucuucccaccucagccaugcgaguagcuaggacuacaggaacaugucaccacacucaucuaauuuuuuuuucauagugagaugaggucucacuauguugcccaggcuggucucaaauuccuggccucaagugauccucccacgagagccucccaaacugcugggauuacaggcaagaaccaucguguuuggccugaaaaauacuuuucuaaaaaguugcggcugggcaugguggcucacgcuuauaaucccaaaacuuugggaggccgagguggguggaucacaugagaccagccuggccaacauagcgaaaccccgucucuacuaaaaauacaaaauuuagcugaccguggugcacguugguaaucccagcuacucgggaggcugaggcaggagaaucgcuugaacucaggagauggagguugcagugagcugagcuggcaccacugcacuccagccugggcaacagagcaagacucugucccaaaaaagaacaagaaaaaaaaaaucauucucagacaaaacuuggucagccugaggcccagcaguuagcagaguauuaauaaauaucugaauaacuucaucaaaugaaaagucaggcuggccuaauagucaacccuacaguggcaucaagaggccugacuucccuaaacacucacuucagagaucauggagaccacacacacccuaguggaaugugcuuacaaugguaucacugggacccagacucuauucuccaggugccaggauccugaccguacauauuauccucauaacucuuugucugcccuuuuacuagcaaaauugagccucuauuagucaaguuccccauccugucucuucacauguucaacucuggcaaaugaaacccaacucagugcucuaaauuccggcaucccaguuuccacuagcaacuccaauguuacagaccacccucagucaccuugcaucuagaaagcacauuuuuuaaaguuuguuaguguucauuuaauuucuaagcuauucacaaauauucaggacuaugucaucaauuauauuaggaacuccuagacagcaaguaccugcauacuuccaggcagagugacagaugaacugugacuguuuuagaaaacaaugacugaaauucaggggguaaaaagucaaacuaucuuuuuuguccaguuuucuuuacacuuauaauuucuacccaacuccugacauagugauuaacuugaauaaagcggauaccuaggcaguaaauaaauacugaaaauauacuaucaagcucugauauuacaaacauccccccccaccaccuaagucaugaguaaaaacaacuacaacucaaaugccuuaccauccuuguuaacagcagugacuuuggccggguaaaaacgacaaucagaccagcaagcaaggaccugcucauuuauuugaaauuccuaaaaaacauaaaaaaaaaaaaaagauccuguuaccaaccuaauuucacaggacauacaggacauaccagaucucauaaaagaagcugggauugauaagaaagugugaagggaaaguagcuguugagauggaggaagauauuucuguuguucaacacuaggaguugcuauaauuucggugucauuuguccucaccaaaaguaaacguuuucagugcagcaguguugaaaauggggccuaugagagguguuugggucaugguagcagaucccucaugaauagauuaaugcugucucacaggagugacuucucgcucuccugggaauggauucauucccaagaaagcaaguuguuacaaagcaagucuccuucuguuuggucccucucuucacacuugucucccuuuuugaccuuccaccauguaugacacagcaugaaagcugaugccagaagccaguaccaugcacuugaacuucccagccugcagaauugugagcuaaacaaaccucuuuucuuuauaaauuaccuagucucagguauucuauuauagcaacacagaaaagacuaagacaggagucaaaacaaaagggcugggacacaagaccucaauaagcccaagaggucugggcaggcacagaacagcacugaugauaauuccacccuaaccagcauacauucugaaaaugagucuaagaggccaggacuacuagaauacacauccaguauaggagucagaagauaugaggcuacuucauacucagggaagcagcauuuaaugccaucuacacuucuaaagggucuuuugccagggaaagcaaccauucaccuuuaauauuuuauacucuuuucccagcacacaguuugcacugauaaauuuuguacaaugggccaggugcaguggcucacaccuguaaucccagcacucugggaggucaaggugggcagaucaccugagaucagccuggccaacauggugaaaccccgucucuacuaaaaauacaaaaauuagccugugugguggcggccaccuguaaucccagcuucucgauggcugaggcaggagaaucacuugaacccaggagguggagguugcagugagccgagauugcgccauugcacuccaggcugggugauacagugagacucugucucaaaaaaaaaaaaaaauuuguagaaugaacacugaaaagucaaauggaacaauacugaauaauccuuaauugggaaaaagaaaaaaaaggccagcaauaguucaaguucccuaauaggguuaaaacagaaaauaagccggacacaguggcucgugccuguaaucccagcacuuugggaggcuggggaagguggaucaccugaggccaggagucuggccaacaugaugaacucccaccucuacuaaaaauacaaacauuagccaggugugguuggaugcgucuguaguccaagcuacucagaaagcuaagacucgagaaucacuugaacccgaaagacagguugcagugagucaagaucaugccacugcacuccagccucggccauacaguaagacugccucaaaaaaaaaaaaaaaaagaaagaaaaauagaaggcagggcugagucugagucagauccaaaagcagcaggaccauuauagaugucucaaugccuguuuaaaaaccuuaaaacuagccaggcacaagggcacacgccuauaaucccaggacuuugggagguacgaaggaucuuccuucuuuggcagaaagaucccuuaaggccaggaguucaagaccagccugggcaacauaauaagaccuugucucuacaaaaaaaauuuuuuaauuagucaggcacagugguacaugccuauagucccagguacucaggaggcugaggaaggaggauugcuugagcccaagaggucaaggcuacauuaagccaagacugcaccacugcacuucagacugggcgacagagcaagaaaacgucucuuuaaaaaaaaacaaaaaaagaugaguuaaugggugcagcacaccaacauggcacacguauacauauguaacaaaccugcacauugugcacauguacccuagaacuuaaaguauaauaaaaaaauuaauaaauaaaauuaaaaaaauaaaacaaacuguuauuacaggaacagaaaaaaaaaacaccauaaaugaagcuucaaaagauaugcuaauugaaguaagucagacccgaaauguuacauacaguaugauuuuauuucaaaugaaaaaccaaacaaaaauaggacuauaaacagaaaauagauagaucaguggcaagccaggguccagaacugguccaggacuggcuggugaagacugaaugaaaagcaauuugagggagagcuucuuuuugucauaaugaaaauauuguguaucauauggcaguggcuaucugacaauauaaauuugcaaaacuuauuaaacuauacaguuuaaaaugggugauuuuuauaucacaaauuuaaaugcuuauuaaauuuaagcuuauuacacaaaacuuaugaaaucauacacuuaaaauggguauagcuaauuuaaauaaaguuaguuaaaaaacaagagucuauagugccuucacccuuguuuuaauaugauaaaauuucuaaaaauauucuaaauuagggcuuaaucuguaaucuuaaaauaucauuauuuuaugauuucuuugcuucuuuucuaaaguugauaacccucuuuggacucgauaucuucuucuuaggaugaacuuuauauuuuauuguuucagccuguguguguguguguguguguguguguguguguguguguguguguguggugauggugaagaaaaaugggagauucucagggugggaauuuuauaaugacagagugaggagcuugacaaaucuuuggcaagaaagcaaaaauaaagcuggacaacauuaucaaaaaaaaaaaaaaccaaaaaaaaaaaaccggcugggcgcgguggcucacaccuguaaugccaggacuuugagaggccgaggcaggcggaucacgaggucaggaaaucgagaccaucauggcuaacacagugaaaccccaucuguacuaaaaauacaaaaaauuagccaggugugguggcacgcaccuguagucccagcuacucaggaggauaaggcaggggaaucgcuugaacccaggagauggagguugcagugaggugagaucgagccacugcacuccagccugagcaacagagcaagaccccgucucaaaaacaaaccaaaaaaacggcucuugagcuacuugcuugagcccgcucccacucuguggaguguacuuucauuucaauaaaucugugcuuucacugcuuaaaacaaaacaaaacaaaaaaaccuuaaaacuaauacuucauacugcauuuugaagucaguaaaagcuccaggcauagagauaaaauuuagaaaaauggaauacaguccaaucaauuccaaguucuuuaagggcuuauaaaagacucugcaggacgagcuuacaccuauaauccuagcacugugggagaccaaggcgggaggaucacuugagcccggaguucaagaccagccugggcaacaauacgagacacugucucuauaaaaaaauuuaaaaauuagccggguguggugggcccguggucccagcuacuugggaaguugaaguggaaagaucgcuugagccugggagauugaggcugcagugagccaugauugcaccacugcauucccgucugggcaacagagcaagacccugucucaaaagaagaagaccuugcauaugagacuuaguacaacguucuacauggaaugaucacuuuuuuuuuuuuuuuuuuuuuugagauggaauaucacucugucacccgggcuggaguggaguggcaugaucaucuuggcucacugcaaccuccgccuccuggguucaagcgauucuccugccucagccucccgaguagcugguauuacaggcgcccgccacuauauccagcuaauuuuuuguauuuuuaguagaggugggguuucaccauguuggccaggcuggucucaaacucccgaucuugugauuugccugucuccgccucccaaagugcugggauuacaggugugagccaccacgccuggccagaaugaucacuuaacaaaagaccagacagcuuaacaaaagaucagaagaucuacaaugugccaggcaguguucuagaaguuagggauacaaugccguaaaauuggucaggaguuugagaccagccuggccaagauggcaaaaccccaucucuacuaaaaauacaaaaauuagccagggugggcaccuguaaucccagcuacuagggaggcugaggcacgagaaucgcuugaacccgagagguggagacugcagugagcagagacugcaccacugcacuccagccugggcaacacagcgagacuccgucucaaaaaacaaacaaacaaaauugggauucuucaagagccccaggugucauagagaucucaggguuacaacuauaggccuaaauaagaacuggucuccagcugcuacuaacaucaaagauugaaacacaaacagcccaauggcugaccuugcauacuacagaacuucccagauuuguuacucacagaagauccauccucuucaugcaagcccucuuuccucagcuguauuuucucuaaagggcguaaauaaggacugucccagcagaaccacucaucauaacgaugguuccaacgcuugaaauggaugaguacuuuuccuuccucguagucaaugucuucuaugugagcuggauaccugagucagaaaaaaaaaaauuggcauuccuuuaauacccaccccaaauauccaaauauccauaaugguacauuuccaaaccucuucccaaaggagaagguuaccaggccuaccguuuagagacucuguguaguugggucaaaucacaaauuauggaggguaacagacuugagguccaaauccuaaccugcauauuccuuaguuuaugaacuauuuuauuuuauuuuauuuuugagacagagucucgcucugucacccaggcuggagugcaguggugugaucuuggcucaccgcaaccuccuggguucaagcaauucucccugccucagccucccgaguagcggggauuacagcgcccgccaccaugcccagcuaauuuuuguauuuuuaguagagaugggguuucgccauguuggccaggcuggucucgaacucccgaccuuaggugaucugcccgccucaaccucccagagugcugagauuacaagggugaaccacugugcccggccaguuuaugaaccauuaaauuaaacuuucagagccugaguucccucauguaaaguggaagaagcacacuggguuguaguguggauuaaacaagaugacauacacagaagacuugagcacacaagaggcaggaagaaaacauuaaggauuuaacaacuagauuagauuuuacaugugccaauaaaucagaaugaccaugcaacccagacuguaucagacagucucaauuuuaagcauuuauaagcaauauaauggaauacugugcaguuuuuuugguuguuguuuguuuguuuuuuugagacagggucucgcucugucgcuaugcuggagggcaguggcgcgaucucagcucucugcaaccuccaccucccugauucaagugauucuccugccucagcuuccugaguaucugggacuacagguacgugccaccacacccagcuaauuuuuguauuuuuaguagaaacgggauuucaccauguuggccaggauggucucgaucucuugaccucaugauccgcccaccucagccucccaaagugcuagcauuacaggcaugagccaccgugcccagccuuauacuacgcgguuauuaaaaagaacaagaugauuuuaucugucaagauauggaaagcucuucuaagauauacaguuauaugauucagaacacuguauaugcuaagcuauuguuucguuuuauuuugauugauugauugauugauugagacagggucucacucugucacccaggccgaaguacaguggcgugaucucggcucacugcaaccucccucuccccagcucgugucccuccagccucagccucccaaguaguugagacuacaggcacacaccaccauacagugcuaauuuuuguauuuuuuguagagauggaguucuguuacguugcccaggcuggucucaaacuccugggcucaagcuaucugcccaggauagcagauccuggcucagccuccccaaaugcuggaauuacaggcaugagcuaccacaccugacuuacuuuuuaaagaggagaaaaaaggauauguauucacauaugcuuauauaugcauaaaguaucuggaaggaugcccaagaaacaacaaagguuacuuguggaaaaguguggucaguucaguagaugguuucuuucaaccuccauucaaccuucuuucuagacugagaguuaggaaaaucaacaacuacauuucccugacuuccuuacaauugguggccaaggucauaaagacccuuggguuaguggccagguccaguacaaggccuaucaagcuuccacacacauguaaaucaucaagguauccuguugaaaugaagauucugauucaguaugccaagcuggggccuaagagcucucacaagcucccagauguugcugcugcugcugcugcugcuggucugcaauaagccagagccuaaugucuaaucaucaguuucaugcaugucaagcagcaguggugcagauggcagugccaguagugacuuccugaccagaucacagcuacgauugugggccuuucaagaugauacccuaagggcagccuccuugagucccacucuuccagcccuuccaacaacuuuaaaaguacccaauuccccacguuaaauccuuuugugguuaaaauacucgggcugguuucuguuuccagcauuuauuccugacacaagagagguaucuggauaagaggugggaaggggcaaaaauaggagggagacuuuuugcaguauaccuuauaauaccuuuuuauuucaacuauauaaagguauugcucauuccaaaaaauaaacgguuaaaaauaaagaaaaauauuguaugcaguuuuucucugaaaacacuuguauuaaucaaauagcuauucuagacugaaaaaguuuacauucuaucuguauuuucucccugcaaccugguuuguaccacuuccuuccuuucuuauauccagcaccuaguacagugcuguccuaauaaacacaugcuaccuaccuaaaugaacaggccugcuuucuugugucuguauacuguguacuuuucaacccacacuagcacccucuaaggcaguuugcuuggcauuaacuuauugcaguacuuugcacauacuagguacucaauaaauguuuagcaaaugaauuccacuccucuuauucuucccaaaggucauguauucugucaguuuuuaaauuccaacauucucagacuccagcaaccuauuccaauuucacuccucaaguucaggcccccaucacuucauguguguauuccucacagaggacuggaaggguauguuuuccauaauuccuaauugcuacuaugcauaccuuacuugcucaaaaauauuaacaaaagacauaaacagcccugaaacuagucuuccuacuccaauccaaaugacagcugcuauaaauacaagauaucuugacaacagacuggcuaauugucugaucugacaaaugaaauaguacaauuguaggagacaagagaggauucccuaaauccacuccucucuguaaaauggggagaaggacaucaauauggcaauuauauaucucuuacccucucauucauucagccuaccugaggcuaguaaaccucucuaaaauaacacaaucugucuuaacacauuccuauucaaaccacuuucuuuuuuuuuuuuuuuuuuuuugagauggaaucucguucugucacccaggauggagugcaguggcacgaucuuagcucacugcaagcuccgccuccuggguucaugccauucuccugccucagccucccaaguagcugggacuacaggcgcccgccaccacgcccggcuaauuuuuuuguauuuuuaguagacacgagguuucaccauguuagccaggauggucucgaucuccugaucucgugauccgccccccucggccucccaaagugcugguacuacaggugugagccacugcuccuggcuucaaaccacuuucuuuaaugguuuacuaucucuagcaacagcuuucucacacaggguccuuggacuaaggcaggaaauuuucuuuacacggaaaucacuuuuuuuuuuuuuuuuugagacagggucucgcucuguuucccaggcuggagugcaguggcaccaccauggcacacuacagcuuugaacuccugaccucaagugauccucccacgucagccaccagaguagcugggacuacaggcucauaccaccaugcccagcuaauuuauuggguuuuuuuuuuuguagagguggagucucacuauguugcccaggcuggucuugaacaccugggcucaaguauccuccugcgucagccucccaaagugcugagauuacaggcaugaaccaccacgucccgcuugaaaucgcauucuuucuaacuuuuaguauuuaaauauaccuucuaaguuaaaacgauaacaacuguuuuuaauacccuuccuaauaucacacagccuucaaaaagaauaaggcagcucuauguauugauuuuacuuuauuuuuuuaauguauugauuuuaaaagauuucuaagaaaugugggagguaaacucaaagaugucaaacaguauuugaaugcacuaccauuuaugugggggaagggagagagccaguacagucauaccuguuuuuaaaugcgugggcuaccucgggaaggaggaucaaguaacccgguuugccucccggaaggggaacuggauaguuuuaagcaacuggagaggaagcaugagacucauuuuauuugcuguauauccuuuuggacauuuugaaugcuguaccaugagcacauauuaacuauuaaaaguacauaauuacauacuuauuuuaaauguccuuauuuggcaaaauuaaaaguuggcaaccucagggaaaaccuuaaauucuuuuggauaugcacuggucggaagucaggauucauagaaucaagugugaacuccuaggccagcaacuccacucacucugaagggucuuuacguccucagcuaauguaaagcuucucccucauucaaaaaaaacuuuauugggcacacauauccaacucucugcagaccuaaacaaaccccuccaagaggcucaauaguagccaaggcgcaaaauuuuccaaagauuaagugguccuccccacuucccuaaagugugacaaagaugcaagucacuuacggcgguggggacccaauuacauuucagagaagagggaggcugcaaaaaccaucuuagagaucaaccugguaagauuuaguggaucacaacucugccugccuuggcgacagcuuagcuucaucagucaacaggaauuuauuaagugcuuuugaucugaccagccaauucuaagucuuggaagggauuauacaaacauguguucuggccccugcccuugaggagaacuagacacauaaauggauuaggcuuuaaaacuauuagguugaaccacauuuaauugcugauaaucaacugcuuuuuaccuaccaaaauagcaauuuuaucugguucaaccuaaauauauggacaaccauaaagcaggcugaagaugaugagacagaguuaacaaaagagaugugaauggaauuuguacaggcagaaaaggaagagagaauuucuagcuucccuguguaacuaagagccacugaugagacucuaguuuccaaacuaacauugcagcugggaguuacauuuccaaccagcgggaauacuggccagaaaggggcagauaaucaaacuaauaacaaaaauuagcucuuaggaggagauagggauuaggaauaaccaagagauuuuugcuuuagugugaauuuuuuuaaaaauuuaguuaaauauuacuuguauaaguaaaaaauaaguacuuuuugggguuuuguguuuuuuuuguuuuuguuuuuguuucuuguuuuguuuuugagacagggucuuacugugucacccaggaugggguacaguggugcaaucuccacucacugcagccucaaccuaccaggcucaggugauccaccucagccuccugaguagcugggacuacaggcucacgccaccaugcucggcuaagauacuuuuuugguauuuuuuguagaaacgggguuuugccauguugcucaggcuggucucaaauuccugggcucaagcgaucgcuggccuuggccucugaaagugcuaggauuacaggugugagccacugcacccagccaaaaaauaaauacuuuuaaauuaaaaguuuuuuuuuuuuuuuuugagacggagucucccugucacccaggcuggagugcaguggugugaucucggcucacugcaggcucugccccgccggggguucacgccauucucccgccucagccucccgaguagcugggacuacaggcaccugccaccuugcccggcuaauuuuuuguauuuuuaguagaaaugggguuucaccguguuagccaggauggucucgaucuccugaccucgugauccgcccgccucggccucccaaagugcugcgauuacaggcgugagccacugcgcccggcaaauuaaaaguuuaaaaaacuuuuuuaaagauaucaaccgauagcuucaugaauauuauguuuaugugcugcuauggcacacccacaaaauggcauauuauguagccacaagaaagaaugaagacacacucuaugaacugauacagaaagacuuccaugacacauuaaguuuuuaaaaaacaagcuacagaauagugcauaucuuaugauaccuuuuguguuauagaagaggaaaauaagaauauuggcugggcauaguggcucaugucuauaaucccagcacuuugggaggccaagaugagaguaucacuuugaagccaggaguuugagaccagccugaacaagacagcaagaccccaucucuaaaaaaaaaaaguuaaaaaaaaaauuugcuaugaguaguggugugugccuguugucccagcuacucagaagacugaggcaggaagaucacuugagccaaagaguucaaagcugcagugaacuauaauugugccacugcacucuacucuggggacagagugagacccccaucuaaaaaacagguaauaauaaauuuuuagaauuuucagccuuugucaagaagauuauaaaaguuuucucuuuuauuuuaucuuauuuuauuuguuuuuuugagaugaagucucaugcuguugcccaggcuggagugcaguggugugaucuuggcucacugcaaccucugccucccggguucaagugauucucccaccucagccuccccaguagcugggacuacagguacacgccaccacgccuggcuaauuuuuuguauuuuuaguagagacggguuucaucauguuggccaggcuggucucaaacuccugaccucaagugaucuacccaccucagcuucucaaagugcugggauuauaggcgugagccacugugcccggacucuuuuauucuguaaauauaaugaacugauagauuucuuaaauuuaaguuaucauuacucugcuagaauaaaucauauuugguuucaugcaucauucauuuaauaagucucuacuugguguuccaggauuuuauugacaagaauuguaccucuuauaaaugagaucuguccaaguguucuuguauuaugcccuuccugcccaguuucaguauuaggcuaugauaaucucauacaacaaacuaaaaugcuuuauuucauuuucuaugaaaccaccuacucugagggccuucucagaagguaguucuuuaucuaccuuucccaucacuucuaugguuacuagucugaucaaguuuccuaccucuucuuuuuuuuugagauggcaucucgcucugucgcccagacuggagugcaguggcguguucucagcucacugcaaccucugacucccagguuuaagcgauucuccugccucagccuccugaguagcuaggacuacaggcgcccgccaccacacccagcuaauuuuuauauuuuuaauagagacgggguuucagcauguuggccaggauggucucaaucucuugaccucgugauccgcccgccucagccucccaaagugcugggauuacaggcaugagccaccacacccggccuccuaccucuucuugagucaauuuuuccuaaacugauaagagaguuugaaaugauaaucagguacaacuuaaauguucaaaaaucaauaguuuuccucagaagaaagaguucaagagucaacaaaaauguuucaaacucaagucacaaacaagauuuuuaaauggcuaauauaaacacaaggcugcuaagcacuuuacagggcaggaacuaugcccuaugaacuucauuauucaacaaacauuccugaguuuguauuaugagacaaacaaacugcuagguccuggagacacagaauagaugaccaaucaucagagccccuaggguggcaagagcccaaagagaaguuuggugagcuccaugagauuucccacuccucuccacaagcaaaaagaucaggaacacucuggaucucaggaagaaaggagagaaaaagaagcauagcuggcugggcgcaguggcucacaccuguaaucccagcacuuugggaggcugaggcgggcggaucacccacgguugggaguucgagaccagucugaccaacauggagaaaccccgucucuacuaaaaauacaaaauuagcugggugugcuggcgcaugccuauaaucccagcuacucgagaggcugaggcaggagaauugcuuuaucugggagguggagguuguggugagccgagaucgcaccacugcacuccagacugggaaacaagagcgaaacuccgucucaaaaaaaaaaaaaaaaaaaaaaccauagcuguagaaugaaccagccugccuauaucccauaaccaggacuagacagaagagaggcauuaucucuccuccauguccagcccaggcuggacagucuggguuucugcugcucuucccugcccccuucuaaagcacuugaauaaacccucccgccuuuuuauuuauuuauuuauuuauuuauuuuugagacggaaucucacucugucgcccaggcuggaguacaguggcaugaucucggcucacugcaaccucugucucccggguucaagcaauuccccugccucagccuccagaguagcugggauuacaggugugcgccaccaugccuggccaauuuuuguauuuuuaguagagacgggguuucaccauguuggccaggcuggucuugaacuccugacuucgugaucugcccgccucagccucccaaagugcugggauuacaggcaugaaccgcugugccuggucuauuuuuuauuuuuuuuaacccuucauucuaaagcccacauuaaacuuuuucaucagagucccauuuuuucuaacuagaggguugggaaaggguucagagaagacuuagccuuuggaucaaaccuucagagaucaagagucugaaucucccccaggguauccugcauauauuagacauucaauaaagguucaccagauguaauuuuuaaaaagaucuggagccacaaaacagcaauagaaauauauaaacaaaccaagaugaaucaucaaaauaaaccagugauauucauguuguagaugucaagaggacaaacauaccccaguaugggaacucuuaauuuggaggggauauaugcacaugguggucaccaugacaaaauuagucacaaaacuguuuuccaaaggccaaaaagcaucaaaaacucucaucuaaaauucaaccuggaaaggacagauaagcaaaaauucauaauaaauaagguuaccguaauaagcuuaauuuaagcaagucagauaacuggucacuaagccaaccaagaagccacagaagaccaguauagccaaugucaaauggaaaaggacaaggagaaugaacagaaaucagcagaagaaaaauucauugaaccauaauuccacaaacauuuucugaguaccugcucugggccaggaaguauauuaggguuuagaaauacagaaucaaaucuacuuuuuuuuuuuuuuuuuuuuugagauggagucucacucugucacccaggcuggaguacaguggugugaucucagcucacuacagccuccaccucccagguucaaguguuucuccugccucaaccucccaaguagcugggacuacaggugcccaccaccacgcccagcuaacauuuuuuguauuuuuaguagagacaggguuucacuauguuggccaggcuggucucgaacuccugaccucgugauccaccugccuuggccucccaaagugcugggaauacaggcgugagccaccacaucuggccagaaccaaaucuauuaagaugcaugaucacagcaacuggcagaggaugacaggcccuacguuacaacacacaguagacuuucaauuccucaaacacaccacacaccuucccauaccgaguaugcucccguuaccugaaacaacaaucccugcccacucuucccaggcaacauccuuauccucccauagccucagaaucucugacuacacuaucucaaguagcccccauuucuuuccagucugugucaguuuccuauauguuuccuucauagcauuuacccuaaucugucauuauuucauuuguuuguguuuauggccugcuuccccaggagacaacaggcacugcuagaggcaucugucucuuacuuacuacaguauagucugggggaauaaaaguaucuaaguaugucuauagguacaaauaauuguaauaaaguauaccaggugcaacaacagaggacuccuuaagguagaguaagauacagaggugcaaaaggggagagggagaggaaggggaucgagugagaggagggcccaagacaacccuggggaagaggagacacuugaucuccauucugaaagaugaguaggcauuuuccagcugaucaaagaggcagugaagcuggggagaguuucugagagaagauguaauaggaguaaaucagcauaguacagaggaaagcaggcaaaaaagaggacaaggaaauucaaggggauagaggaaacaacaacuccguuugaggggccaggaggaucuuauggaugggcugcugagcccuaaaugaauguuugccaagagcaguccacggaccacugcguguuggugaacacagagcugcugguccacaaggucuccaugagggaugaagaauauuauauugugcuuuucuguaaucuggacccucuuuaccagagcuucccagcugagguaccacaaauggguuacaagugggcaaugacaugaagaacguugagauaccagaugaccaccauauaaucaagaacuacuagaaaauuuuaguguguaaggcugggcgcaguggcccauaccuguaaucccagugcuuucagaggccaaggcaggaggccaggaguucaagaccagccugggcagcauaggaagacuccgucucuacaaaaaguuuuaaaaauuagccaggccuguaguccuagcuacuuaagagguuggaguugggggaucacuugagcccaagaguuugaggcugcagugagcuaugaucacaacaccacugcacuccagccugggcaagaaagugagacccuauuucuaaaaaaauuuaaucagcccagcacaauggcucaugccuauaaucccagcacuuuggguggcugaaggaggauccccugagcccaggaguuugagaucaguaugggaaacauagggagaccccaucugucuguacaaaaaaaaauuuuuuuaauuagccagauguggugaugcaugccuguagucccaguuacucaagaggcugaggugagaggaucacuggagcccagaagguugaggcuguguugagucaugaucgcacuacugaacuccacccugggugauagagugagacccaaaauaaauaaaugagaaggaaaggagggagggagggaggaagagagggagggagggaaggaagaaagaaauaacuuuaguguguauauuuguaacuaaccuggcauuauaaaaucacucccacauaguagcugggacaacuuuauaugucugcagauuuggcacuuauuccuucaaaagguagauuuuaaucguuuuauccuugaauauggccucauuucuaacaaguagaauguggcaaaagugauggugugggacuuccaaagcuggguuauaaaaagcacugcagcaggacaggggagagagaauaucaggaagaagagcuaauggaugcugggcuuaauagcuaggugaugggaugaucugugcagcaaacuaccaugguacaaguuuaccuaugcaacaaaccugcaaaucuugcacauguaccccagaacuuaaaaaaaaaaaguugaagggaaaaaaaaagcaaacuucugaauuaauaaagugauggauuaucuaacuauaaaguugaugugaaaaagaaaaaaaagcacugcagcaauuccacuucuggguauauauccaaaaacacugaacacaaggacucaaacagaugucuguacuccagaauucacacagcauuacucacaacagucaaaagacaacccaguagucaaaaagccacccaagugucuaauacaugaauagauaaaaugugguauauccauacaauggaauauuauucagccuuaaaaaggaauaaaacucuaauacaugcuacaacacagaugaaccuugaggacuuaugcuaagugaaauaagccacuugaaggacaaauacugcaugauuccauucaucugaguuaucuagaguagccagauuaaugaaagcagaauagagguuaccaggagcuaaggggagaagggaugaggcaguugcugauuaauagauacaggguuucaguuuggagagaugaaaaaaucaggccgggcacgguggcucacaccuguaaucccagcacucugggaggccgaggcagguggacugccugaacucgggaguuugagaccagccugggcaacauggugaaaccccgucucuacuaaaauacaaaaaauuagccaggcauggcggcaugcgccuguagccccagcuacuugggaggcugaggcagcagaacugcuugaacccaggaggcagacguugcagugagcugagaucgcaccacugcacuccagccuaggugacagagcgaaacuccaucucaaaaaaaaaaagaaaaagaaaaaaucuugggcugggcgugguggcucacaccuauaaucccaauacuuugagaggccaaggcaggaagauugcuugaggccaggagagacaggguuuccacguuaccuaggcuggucucaaacuccugggcucaugcaauaugccugccucagccucccaaagugcugggauuauaggcaugagccauggcgcacggcuaaggccaggaguuugagaccaacauaaacaacauagugagauuuuaucucacuaugaaaaauuuuaggucaggcucaguggcucaugccuguaaucccagcacuuugggaggcugaggcagguggaucaccaaaggugaggaguuucagaccagccauggccaacauggugaaacaucaucucuacuaaaaauacaaaaauuagccaggcgugguggcacaagccuauaaucccagcuacucgggaggcugaggcaugagaaucaccgggaggcagaagcugcagugagcugagaucgcaccacugcacuccagccuggcaacagagugagaaucuaucaccaagaaaaaaagaaaaaagaaagaaagaaaauauuuuggagaaguaggcugguaaugguugcagaacagugugaauguauuuaacgcuacagaacuguacugcacaccuaaaaaugauuaaaauacuaaauuuuauguuguauguauuuuaccacaagcauauacacaaagcacugcugcuucugcccugcacucucucagauucccuguucuaggguaagucaggugcuacaucgugagaacauucuagaugucuauggagagguucacaugacaaggaacugaggccaccugucaggaaccagcaccaacuugccagcccugugagugagcccccuuggaugcagccuuuaugagauccugggccagaagcccccucaaccccccauuacgccgcuccugaauuccuggcccauagacaccuagagaauaauaaauguuuauuguuuuaggacacuaaauuuugagaaaauguguuacacagcacuaaguagcuaacaaaguugcauuuugcuagacugcuuugguaucuagaaauggagucuaucaauaguuuauagguuagaggugccaguccucauguuuucagguuugagaaacacugcucuaagcuacaagauaagccaacauguccuagggcuccaccaagggagagagagggcuguaagacaguaaagcacugccacugcuggcaugacuccaugugcacagccagaaggcagagaacaguacaggucuaauucagggaaacaguguugacaugccugcccuauaugaccuuaagccccaggaaggcuugccgcucagagucuugcugcaucuguguaaaauuaagcugccuaauacuacauaccgugcacgugcuuaaacuagagcagccagacagugcuuggcaggaaucuguuuuguuccccccuauauaccagaaauacuaacuaaagaaacaucauggggccggggagaaaaaaacagaaaggaugacaauuuccuuccgaauucccacuacaacucaucaguguucacccacauggcuauuaguaauuaaugaggcugggcgcgguggcucacaccuauaaucccagcacuuugagaagccaaggcgggcggaucaccugaagccuggaguucgagaccagccugacuaaaauggagaaacuccgucucuacuaaaaauacaaaauuagccugggcaugguggcacaugccuguaaucccagcuacucgggaggcugaggcaggagaauugcuugaacccaggaggcggagguuguggugggccgagaucaugccauugcacuccagccugggcaacaagagcgaaacucugucucagaaauaaauaaauaaauaaauaaauaaaacuaaugagugcagcuuacucuaggguuuguaaacuaucuuuaucuaagguaucucacuugaucaugccaugaagacuuaaggagucauuauuauuacugcccccuuuuuacauucauggaaauggagccucaaagagaaugacuaggaagaggcacaaucaagaucgauaucuacaucuaacucuaaacccggugaagagccuucugcuuuuuuuuuuuuuuuuuucugagauggagucucgcucuguugcccaggcuggagcgcaguggcgucaucuuggcucacugcaagcuccgccucccggguucacaccauucuccugccucagccucccgaguagcuggacuacaggcacccgccaccacgcccagccaauuuuuuguauuuuuaauagugacaggguuucaccguguuagccaggauggucucgaucuccugaccucaugauccacccaccucagccucccaaagugcugggauuacaggcgugagccaccgcacccggcuaugagccuucugcucuuaacuggacuccacauguaaacauuccugcagucaccacauccacaugggugucuuuugucuuagccauguaauagucuacuuaacugcguggcuagcccagaauuugacuuaacuuucccccagagguuaagcauucagacugcuuccagauucuuugcuauauaaacaguuugucugcaaacauacagcacucauuuuacuucaagaaucagaaaauuacccagacgugguggcgcaugccuguaaucccagcuacuugggaggcugaggcaggagaaucaccugaacccaggaggcagagguugcggugagccaaaaucguaccauugcacuccagccugggcgacaagagcgaaaaaaaaucagagcuugccucuauuccuggcucagggcacauaccagaagcaaaauacuucuaugcacaaaaggaacauucuaagccaucaccagccuuugcuggagaggagauggggauggaagauauauuuaguaaaaaacaaaaggcugacuauuaaacugcagaaaaacugcuauuuugaaugccuuaacucuuucccuaccccuucaccacuuccauuaaucaacaucugauauaagaaaggucuuaaauuuaucuuuccucucuaucucaaucauuucuuaccagcaacaacugaacagucaguauguacacaucaccccuaaaccccuucuaucaguacccagcagaaugccugauacagagccacucagcaaauaucuuaugacagaaugaacacugccaauuuucuguuacuaagaaggaucaaaacaugucucucuccugcuuaaauuuucacucuucaguucaaucucccaccacuccuguuaccucccuggauucucagaacacaccaaguucuuucaagcccugaauauuuuugcugauguuauuccuucugccuucucccccugccacucucuuccuggaaaucuucucauucuuuaauuucacuuccuugcauaugcccucaaauuacuggcgacucucuuccucaucacaacugccacccaacccugguuauuucagacuccacauucuccauuccuguacccagacagcuaaauguggcuagagaaaacacucaacaugcugaugggucucacuuuaaaugcaugucuaggccaggugcaguggcucacaccuguaaucccagcacuuugggaggccgacgcgggcagaucaccuggggucaagaguucgagcccggccuggccaacauggcgaaaccccaucuguacugaaaauacaaaaauuagucgagugugguggcgggcaccuguaaucccagcuacucaggaggcugaggcaggagaucacuugaacccaggaggcggagguugcaguaagccgagaacgugccacugccauccagccugggggacaagagcgaaacugucucaaacacacauacauacauauauaaaaugcauaucugcaaacagguauuaaacaguaauucucuuuggggguaggagagggacaaaaaagcuuccggagugcccauaaugguccauaucuugauuugggugguggcuauagaaguguauacauauguaaaaguucaucaagcuacacauuuaggguuuauacacucuacuauaaauuaaaacucaacaaaaaguauuuuuaaaauaaaaguguaagagcugggugcuauagugcaugccuauaaucccaacuacacaggaggcugaggcaagagagcugcuugagccaaagaauugaaggcuguaguguauuucauggcacucguaaauagccauuguacuccagccugggcaacaaagcaagacccucucucuaaaaauaauuaaccuaauuauagaguagcaauuuugcacucuucuuaauucaaugucuuauaccuuuaaggagccaggaaaauuaauaucaaaaaaguuuuuagccaggcaugguagcuuacaccuguaaccccagugcuuugggaggccgaggcaggaggauaacuugaggccaggaguuugaggccugucauuagcuacugaguaaaguggagccugaggagggagugcaaacuccuaaauauuucauaccuuaucuucuuuccucaaaccuaagcccucccuguccugaucucagucucagcugauaauuuuacuucuuauugaauguaaaaaauagcugggcacggugguaugcaccugcagucccaacuacccaggaggccugaggcaggacaaucacuugagcccaggaguuugaguccagucugggccaauaccaagacucccaucucuucaaaauaaaaacaaacaggauucccauugcuggugggaguguaaaauggugcagcuacuacgaaaagcaauuuagcaguuccucaaaagguuaaacagaauuaccauaugaucugacaauuccaucuuagguauauacccauaugauguaaaaucauauguccacacaaauguguacucacaauacccaaaaagaagaaacacuguaaauacccaacaacugaugaaugggaaaacaaaauaugguauacucauauaauggaauuauucauccacaaaaagcaguaacguacaacauagaugaaccuugaaaauagcaugcuaagugaaagcagcuagucaccuacuguaugacuccauaucuaugaaauguccagaacaggcauauauauagagggaaaguaaauucguguuugccuaggcugggaagggcagggaggaaauagggucugacugcuaauguguaugagguuucuuuuugggauaaugagaauucuggaauuagauaguggugacaauuguacaacuuuguaaauacacugaaaaccauugaauuauugaauuguaugcuuugaaaugguaaauuuuuuuuuuuuuuugagacagagucucacucugucaccaggcuggagugcaauggcgugaucuuggcucacugaaaccucugccucccggguucaagcgauucuacugccucagccucccgaguagcugggacuacaggcacaugccaccacacccagcuaauuuuuguauuuuuaguagagacaggguuucaccauguuggccaggaugaucucgaucucuugaccuugugauccgcccaccucagccucccaaagugcuuggauuacaggcgugagccaccacacccagccuaaaaggaugaauuuuauaacauguaaacuauaucucaauuuuuuaaaacaguuaauuaaaaaaaaaggagagaaaaaaaagaaucccaccaagugcugacaacaaugcagagcaacuggaauucucauacauuccugacauuccugguggaaaugcaaaaugguacagagacucugaaaaaguuuggcgguuucucaccugguuaaacauacacuuacaugacccagcaauccagcucgcugguauuuauccaagagaaaugauaacuuauauucucauaaaaaccuauauauaaauguuuauucauauuaacccaaaacuggaaacaauccauaugucuuugaacacauaaacagauaagcugugguauauccauccaauggaauacuuacuacuugguucuaaaagcaacaacccuuuauuuugcucaugcaaaaauacgggugagucucaaaugcauuacgcuaaguuuaagaagccaaauccaaaaggcuauguacugaauaauuccauuauaacacacuauggaaaaggcaaaacuguauagacaaaggacagaucagugggugacaggagcuggaggugccaggagaggcugauuacaaauggacaugaggaaauucuguggguaacagaagugcuuuauaucuuuuuuuuucuuucuucaccccuuuuuuuuuuuuuuuuuuuuuugagacagggucucgcucuaucacacaggcuggaguuggagugcagcgguacaaucacagcuugcugcagccuugaccuccugggcucaagcagucuuccucccaccccagccuccugaguagcuaaaacuauagacacacaccaccacacccagcuauuauuauuacuuuuauuaugguuuuuuuuuuuuuuuuuugagagacgaagucccauuauguugcuuaggcuugucuugaacuccugggcucaagcaauccucccacguuguccucccaaggugcugggauuauaggcaugagucaccauucccggcccauaucuugauugugguggggcuugcgugaacugucaaauuuggcaaaacucaacuguauucugaaaaagagcgaauuuuacuauggguugagcaucucaaauccaaacauccaaaauccgaaacuuuuugagcaucaaguugucuuuuuaugaauauuguacuuuuuuuguacuuuuguaacuuuuauggauuuugacaaauguauaauguacacauauggauuuugauaaauguguaacauacacauauacauuauacauuugucaaaauccauaaacaauacaacaccagcagcaaaccuuaaugcaaacuaugguccuugggugguacugaggugucaauauugguucaucaacuguaauaaauguaccacucuggugcaggauguugaaagugggggaggcuggagggagaacacaggaauaugggaacuugauacauucuuuuuuuuuuuuuuuuuuuuuuuuuuuagaagcagggucuugcucugugacccugugacccaagcugccaugcaguggcauaaucauggcucacuguagccucaaacuccugggcucaugcgauccucccaccucagccucccaaguagcuaggacuacaggugcaagccacccccuaccccagcuaauuuguuuuauuuuuuguagagacagggucuugcaaugguguccaggcuggucucaaacuccugggcucaagcaauccuuccaccucagccucccaaagugcugggauuacaggcauaaaccacugugcccagccagaacucuguacuuucugcucaauuuugcugugaaccuaaaacugcucuaaaauauagucuauuuuuuuaaucccauuuacucauuaccaacucccaaauuccuuuacuuuuuuucuuuuuuuuuuugaaacagggucuugcucuguuacccaagcacaaucauacaguauagcagcacaaucauagcucacugcagccuugaccucccuagcucaagugauccuccuaccucagccuccccaguagcugggaccacaagcucacaccaccaugcccagcuagguuucuugggguuuuuguguauauauguguuguaagacagagucucacuauguugcacagguuggucucgaucuugggauucaagcgaucuuccgucuuggccucccaaaguccugggauuacaggcgugagccaccgcacucagcccaacucccagaugucuaucucuaacccagggcucacacuugaacaucugacucuguuauucaacuauccauucaacaucuccacuuagucaucucaaaggaaucucauauauuuaacaugcccaaaaccaaacugcuuaucaucucccuagaaccuaguucuacugaagucuaccccauuucagcaugugguaauuccaucuacugguaccgagagaaaaagcccuuggagucauccuugacucuucucuaucucuuacaugucgucagcaaaucugucagcuguaccuucaaaaauuauacagacgcugaucacuucucaucaacucccccacugcuuuuuaguucaaacaacuaucaucuuucacauggacuaauacaaaagauccuugcucuucuuguuucugcccauggcugccuacagcauauucuacacacaauaaccacagcaacuuuauuuuuuugagacagggucuggcucugucaccugggauggagugaaguggcaccaucucagcucacugcaaccucugccccucagguucaagugauucucccacuucaaccucccaaguagcugggaccacggguacacaccaccaugccuggcuuuuuuuuuuuuuuuuguauuuuugguagagacagcguuuugcuauauugccuaggcucacagccccuuuuuuuuuuuugacagaguuucgcucuuguugccuagacuggaaugcaguggcacaaucucagcucacugcauccuccaccucccggguucaagcaauucuccugccucagcuuccugaguaacugggauuacaggcgcccaccaacacuccaggcuaauuuuuuguauuuuuaguacaugucagccaggcuggucucaaacuccuggccucaaaugauccacccaccucggccucccaaacugcugggauuacaggugcgagccacugcaccuggcccacagccacuuuuaauacuugaaaucagauaacauugauucccuguuuaagaccuuucaaugacuuacuaucacauuuagaauaaaguccaaacuccuuauuauggccgaucuggccccugcugaccuuucugggcucaccuccuaccucuggccucucacucucuacccucccagccacauguuccuaccuauuauugcuugaaugcccugcuugcuccuacgccagggcuucugccuuggcugccucugucugcaacccucucuccucuggauacuaacaugacucacucccucacuuacuuuaggacucuauuuaaaugucugucagagagaucuccucuguucacccucuauauaaaaaaagcaaaacacauacacacauagaggcacucuacccacuugaaaguacuuauucuggccaggugugauggcucacaccaguaaucccaacacuuugggaggcugaggcaggcagaucacgaggucaggagaucgagacuaaccuggcuaacacagugaaaccccaucucuacuaaaaaauacaaaaaauuagccgggcaugguggcaggcaccuguagucccagcuacuugggaggcugaggcaggagaauggugugaaccugggaggcggagcuugcagugagccaagaucaugccacugcacuccagccuggguggcagagugagacuccaucucacaaaaaaaaaaaaaaaaaaaguacuuauuccacuuucuagcauuuaucaccaccuaacauuaucuauauauaucagucugcugguuucuguucuauccaccuccacuggaaugucagcuucuaaagaucagggacuaugucuguccuaaucaccacuauuucuccagcaucuagcauugaaugaaugacuuggcaucaaaagucaucuuucugaagccuucugaaauucccacauaugaaauuaacuauucuccccuagggguuuuuguaaaugaacuuuguacagaguaaauaucuccucauaauauauuuaauuucagggacuuuauucuagguacugaacacaugcguggggaucaaagccacacccgaccaugcucagaagccaacuagcuagacucaaauccuaaauucaccauuuacagcuacauagcacuggaaaacuuaacugcuuucugcuucuauuuccucauauauaaaguagaauaaaaguacccccuucauagcaucuaaaggauuaaaggagguauaacauauaaagccuuuagauuugugccuggcacagaguaaaucacucaauaaaugugagucacuagcaaagacauaagcauuagaauacaugauuaacgacccuuggcuaucaauacuaaaaaccaaagccaaauacuugacucgucucugaacaucuugaaguacuuauuuuccuucauuucauagcaccuaguguaccaccugacucacagcauucaauacauguuuguggaaagcucagaaaagauugcuuaaaaacacacacacacacacacacacacacacagaugguguaaggaguaaagagguaugaaccagaaacucagaugagaucaguacaaauaacccuaaugaaaaagaaaccaaaaaugaucuaaggacauuaugaaacucagauuuuuaaaucuucuguacaagaaauggaagcgaacuaugaucaacuuaaauagaaacacaguaguggaaagguaccagagugucaggaaagcaacagaaggagcuuuuucguuguguuuggagcaagaacagggaaggccagccuacuucuuggaacagauggcacacuccugacagaugacaggaagaaggcgaaggcagcagagcaagcagauucuauucuauccaccaaguaucacuacuaggaaacugcagccucucagauuuuaguucaucuauaaaacgcaggaagcaaauagggaaggcagggcugggcacagugguucacgccuguaaucccagcacuuugggaggcugaggcgggcagaucaccugaggucaggaguucgagaccaggcuguucaacauggugaaaccaugucucuacuaaaaauacaaaaauuagcugggugugguggugcaugccuguaaucccagcuacacaggaggcugaagcaggagaaucgcuggaacccaggagauggaggcugcagugaaccgagauagggccacugcucuccagccugggcagcagagcaagacugucucaaaacaaaacaaaacaaaacaaaaacagggaaggcaggauuaccccuucuacagagaagaaaauggacaugcugaaaguucaccccaaagugguagauuaaaaauuagaauauaggccaggugcaguggcucaugccuguaaucccaacacuuugggaggccaagguaggaagaucacuugagcccuggaguuugagaccagccuaagcaacacagcgagacucagucucuauaacaaauacaaaaaugagccaggugcaguggcaugcaccuauagucccagccuacucaggaggcugaggugggaggaucacuugagcccaagaguaccaggcuacaguuaugaucacaccacugcacuccagccuuggugacagagcaaaacucugucucaaaaaugcuaggccaggcaccuguaaucccagcacuuugggaggaugaggugggugcacugcuugagcccagaaguuuaagaccagccugggcaacauggcaaaccccaccucuacaaaaaauacaaaacuuagccaaggguggcggcacaugccuguagucccagcuacucaggaggcugaaguaggaggaucauggcucacugcagccucaaccucucaggcucaagcaauccuuccaccucagcuaauuuuuuguuuuguuuuguuuuguuuuguuuuuugagacggagucuugcucugucacccaggcugaagugcagugucgcaauuucggcucacuacaaccuccaccuccuggguucaagcaagccucccaccucagccuccugaguagcuaggauuacaggcaugcgccuaauuuuuuuuguacuuuuaguagagacggaguuucaccauguuggccaggcuggucucgaacuccugaacucaaguaaucugcccaccuaggccuccuaaagugcugggauuacaggugugagccaccaugccuguaauuuaauuauaauuaaauuuauacuuuaauuauaaaaauauaauuuuuauauuuuuuuguagagaugggguuuugucauguugcccaggcuugucuugaacuccugggcucaagugaucugccuacuucagccucuaaacaugcuaggaucacaggcauaagccacaacaccuggccaaaaaauaauuuuauuuuuuaaauuuuuuugagacaggguaucacucugucacccaggauggaaugcaguggcacgaucugggcucacugcaaccuccgcuucccgggcucaaaggauucucuagccugucuccugaguagcugggacuacagccaggagcuaccaacacccagcuaacuuuuuuauuuuuuguagaaacagguuuuugccauguugcccccagcugucguugaacuccugagcucaaagcaauaugcccaccuuggccucccaaagugcugggauugcaggugugggacaccaugccuggccccaaaaauaauuuaaaugcagaaauaggucuggcgugguggcucacgccuguaaucccagcacuuugggaggccgaggcagguggaucaccugaggucgggagaucaagacuagccuggccaaccuagugaaaccccaucuuuacuaaaaauacaaaaauuagcugggcgccguggcaggggcccguaaucccuccuauuugggaggcugaggcaagagaaucucuugaacccaggaggcggagauugcagugagcugagaucacgccauugcacuccagccugggugacagaaugagacucugucucaaauaaauaaauaaauaaaugcggaaauaaaauuagacuguaggaguauuuaaaaaaaaaagaaagaacuguuaguucacauaacagauuaaaaaaaaacaacaacaacacuuauggccaggcgcaguggcucacgucuguaaucccagcacuuugggaggacaaggaggguggaucaugagaucaggaguucgagaccagccugaccaacauggugaaaccaugucucuacuaaaaauacaaaaaauuagccaggcguaguggugcacgccuguaaucccacuacucacgaggcugaggcaagagaaucgcuagaacccaggaggcagagguugcaguaagccgaaauugcaccacugcacucgagccugggcaacagagcaagacuccaucucaaagaagaagaaaaaaaaaaaacucauuuaauuuuggauuaaguuuaugacauaaaucggccgggcgcaguggcucacgccuauaauuccagcacuuucggaggcugaggcgggcgaaucauaaggucaggaguucaagaccagucuggccaacacagugaaacccgaacucuacuaaaauuacaaaauaaaauuagcugggugugguggcaggcaccuguauucccagcuacaugggaggcugaggcuggagaaucgcuugaaccccggaggcagagguugcagugaccggagauugcgccauugcacuccagccuggaugacaacagcaaaauuccgucucaaaaaaaaaaaaaacuuaaaaaaaguuuaugacauaaaucaaauauaauuuguccugaguaagauauacauuuuucaaaugucaaaaaauccuuaaaauucacucaguauacuuguuaauaguaauauugauauuguaacuuuaaaacuauuucacauauaacacagaauaaggcaaguagguuaaaguaugauuaggaacaaagauuuucgggccgggugcaguggcucacgccuguaaucccagaacuuugggaggcugagguaaguggaucacgaggucaagagaucgagaccauccuggccaacgugguaaaaccccaccuccacuaaaaauacaaaaaucggcugggcaugguggcgcgugccuguaguuccagcuacucaggagacugaggcaggagaaucacuugaaccccggagauggagguugcugugagcugagauccagccccugcagucuagucugggggacugagcgggucuccaucucaaaaauaaacaaauauauaaaugccuuuugucaauuauaucucaauaaagcuggagggggaauauauauguauuuccaaaacgauuuugcuuguuuguuuguuuuuuugagacagagucucaacugcaaucuuggcucacuacaacuucugccuucugggcucaggugauccucuuaccuaggccucccaaguagcuggaauuacaggcaugccaggcgcgguggcugacgccuguaaucccagcacuuugggaggcugaggcggguggaacacgaggucaggagaccgagaccauccuggcuaacacagugaaacccugccucuacuaaaaauacaaaaaauuagccaggcaugguggcaugcgccuguagucccagcuacucaggagacugaggcaggagaaucaccugaaccagggagguggagguugcagugagcugagaucacucgcgcuacacuccagccugggagacacacagcaagacucugccucaaaaaaaaaagaauaaaagaauuacaggcacaugccacaauguccagcuaauuuuuuguauuuuaaguagagacauggauucgucauaauggccaggcuggucuccaacuccugaccucaagugaucugcccaccucagccucucaaagugcccagauuacaagcaugagucaccgugucuggccauauuuugaguuucauuuagcauaguuacaccaugcauauucuauguuaguucuuuuuguuucaucuauuuauuuacuuauuuauuuauaauuuuucgggggacagagucucccucugucacccaggauggaguccagugucgcaaucucagcucacugcaaccucugccuccuuuggcucaagcaauuuuccugccucaaccucccgaguagcuggaauuacaggcaccugccaccacacccggcuaauuuuuguauuuuuaguagagacgggguuucaucauguuggccaguuuggucucaaacuccugaccucaggugauccgcccaccuuagccucccaaagugcugggaauacaggcuugagcuacuaugcauggccuauuuauuuauuuauuuauuuuauuuuuuuuuuuuuuuuuugagacggagucucgcucugucgcccaggcuggagugcaguggcgggaucucggcucauugcaagcuccgccucccggguucacgccauucuccugccucagccucccaaguagcugggacuacaggcacccgccacuacgccuggcuaauuuuuuguauuuuuaguagagacgggguuucaccguuuuagccgggauggucucgaucuccugaccucgugauccaccugccucggccucccaaagugcugggauuacaggcgugagccaccgcgcccggccuauuuauuuauuuuugagacagugucuuacucuguuacccaggccugauauuuccaacuuaaauuuaauauuauaggccgggcgcagcgguucacgccuguaaucccagcaccgugagaggccaaggcaggcggaucacuugaggucaggaguucgagaccagccuggccaagagggugaaaccccaucucuacuaaaaauacaaaauuagccaggcaugguggcaugcgccuguagucccagcuacuugggaggcugaggcaggagaauugcuugaacuagggaggcagagguugcagugagccgagaucguaccacugcacuccagccugggagacagaccaagacuaucucaaaaaaauaaauaaauaaauuggaaguaucaaagugaacucacauuuuuucaaaaaauagauuucuuacccccaucuacuaaaaaguuguuuaagacaaugacauccuagcagcaauaaacacacccagugcccagagcuaaauuucuuuuuuuaaaaaccaauguuuuauuuuauuuauuuauuuauuuauuuuauuuagagauagagucuuauucuuaucacccaagcaguggugugaucauagcuaacugcagccucaaccucagaggucaauuuccuuuuuuuuuuuuuuuuuuuuuuuucugagacggagucucacucugucacccaggcuggagugcaauggugugaucuuggcucacacacaggcuggagugcaauggugugaucuuggcucacacacaggcuggagugcaauggcgcuaucucggcucacugcaaccuccaccucccaggcucaaacaauucuccugccucagccuccugaguagcugagacuacaagugcgugccaccacgccuggcuaauuuuuguauuuuucguagagacaggguuucacuauguugaccaggcuugucuggaacuccugaccuucugauccaccugccuaggccucccaaagugcugggauuacaggcgugagccaccgugcccagcucagaggucaauuucuaaauacccuuuccuaauuaaagaaaccaagccuuggagaaccagcugcguccagggucugggauaagaaaaguagaaaguaaguuugggguuucuaguagugccagaaaacaagaaaaugcuaagggacuaacaggaauugucaaaagaacaaaggagcuaguuuaaacagcaucccacuggacaaauuugggauaauuuuagcacaaaauuaauaauaaugaauggaauugacuacaccaccacacucaauaaucuuauuccuaagugcacuuuaaaagaauaaaaaugggccgggcgcgguggcucaccgcgccuguaaucccagcacuuugggaggccgagaugggcagaucacgaggccaggagaucgagaccauccuggcuaacagggugaaacccagucucuacuaaaaaauacaaaaaaaauuagccgggcgugguggcgggcgccuguagucccagcucucgggaggccgaggcaggagaauggcgugaaccugagaggcagagcuugcagugagccaagaucgcaccacugugcuccagccugggcgacagagggagacucuguaucaaaaauaauaauaauaaaaaugaaagcuguucguacagaagaacaucaccuaauauaacagaaugacaaaacuagaauauuaccauuuuuccaucuccagaguaauaacugauucaggcagggauuaucaauggaugcuaaaucauuagguaaaugauguggggggauaauaggauauugacacguaccagaguauccccacagauuaucuacuacuugcacaaggaaaaauacaccuuuauaauggugagagauggaagucauuaccuuauccaagugauacacggaacagugggacgaccuagcuuuaugugucccccgaugugaugcaauaugaaacacacggcauuaccacugaaacacucugcaaaaaaaauguuuaaucugaagucuagaccucauuuccaguuuacgggaaauagaagagaauacaagaaacaaguuaaacucaccaugauaaaacaaugugacuaaaccagaaugugggacauucuaaaaaacaacuguucggaacucuuaaaaauuaaacaaauaauguugugaaggggaaaaauuuuuuuauuuuuuugagacggagucucgcucugucucccaggcuggagugcaguggcucgaucucugcucacugcaagcucugccucccgggaagaagaaagauuaucauggaaucaaagcaacuaaagagacauaaaaauaaaaaaguaauguggauccugucuggaaaaauacuauaagggacauuuuuggaacaacaagaacaucugaauaucucuggauauuagauauuauaaaauuauugcuaaauuaaauaaguauauaaaacaaauggguuaacaauuagugaauacagguggaagguauaauguccucucaacuuuucauuauguuagaaaauuuucuuaauaaaaagcaggggccgggcgcuguggcucaugccuguaaucccagcacuuugggaggcugaggcggguggaucacgaggucaggagaucgagaccauccuggcuaacacggugaaaccccgucucuauuaaaaaaauacaaaaaaauuagccgggcgugguggcgggugccuguagucccagcuacucgggaggcugaggcaggagaauggugggaacccgggaggcagagcuugcagugagcagagaucgagccacugcacuccagccugggagacagagcgagacuccgucucaaaaaaauuaaaaaauaaaaauaaauaaauaaauaaaaagcagggacugggccgggcacaguggcacaugccuauaaucccagcacuuugggaggccaaggcagguggaucaccugaggccaggaguucucaaccagccuaacauggugaaacccugucccuacuaaauacaaaaaaaauuagcugagcgugguggcgcaugcauguaauccgagcugcuugggagacugagacagaagaaucgcuuguaccagggaggcagagguugcagugagccgagauugugccauugcacuccagccuaggcaacaaaagcaaaacuccaucucaaaaaaaaaaaaaagcugggacuuaguuucuuuagggcccaaaaauaagaacaaauaauucaaggauucagaggcaagaagucacaaggacauaagcaauuaaaaagugggcccuagcccaacgugguggcucacgccuguaaugugagcacuuugggaggccgagguggacagaucaugaggucaagagaucaagaucaucuuggccaacauagugaaaccccaugucuacuaaaaauacaaaaauuagcugggcguggugacgcacaccuguagucccagcuacucgggaggcugaggcaggagaaucgcuugaacccuggaggcggagguugcagugagccgagaucacgccacugcacuccagccuggcgacagagcaagacucugucucaaaaaaaugaaaauaaaaaaaaaguggaaccuaauucccacacauuucauuucaauggacugaaaauacacacauacacacacagagagacacagacacacacaaaaaauaugguuguaccuugcagcaauacuaucuacuauaauguaagcaaaucacuuaccagggugaaaacauaaccacuuucagucuagagauaauaaaacaaacgcuccauuguuuuuggcaaagcauucaaagucaaagauuuuaccaaacaauuaaauguccaguacucuagauuaggaaaucaggugaacauaaucagaaugcauuuuccaguguuuuguuuuguuuuguuuuuugauuuaggagucaggaacauucagacacucuggagaaauuugguuauuacaaaaaugcuaugaacucagucuacuuugauucaaacccuaguccuaccacugugugaccuugggcaaauaacuucaucucucugagacuccuuuuucuuacugcuaaaaugaggcucauaagagcacccacaugaggguacucucccacuugaagacagguagucucccucucaguguggcagggcuuuuauggguucagaauggggaauguaugcugauugguuugugcauauaacaaaaaggcuaaaacaaaggcgucacucaaaggugggcaugacaguguaaaaaaccaaucagggaagaguaaauacauguaaaacaggugaaggguggggaucaaucagaggaaaccuugccgaacuggaagagagguucucaauccaguccguggauuuacccaggacuuguagcuuggcuuucaggcuuuaaacugucuuuggaggccaggcacaguggcucaugccuauaaucccagcacuuugggaggcggaggcgggcagaucaccugaggucacgaguuugagaccagccuggccaacauaaugaaaccccaucucuacuagaaauacaaaaauuagcugggugugguggcaccugccuguagucccagcuacuugggaggcugaagcagaagaaucgcuugaacucaggaggcggagguugcagugagcugagaucgcgccacugcacuccagccuaggcgacaagagcaaaacuccgucucaaaaaauaaauaaacaaacaaacaaacuguccuugguuugacagucagguuucaccagggaacugucccuaucugccuaggcauuugacugccaccugcggcuaucagcacaauugcagcucacugcaaccucaaacuccuaggcucaagcaguccuccugccucagccucccaaguagcugggacuucaggcauguaccaccaugcccagaauuuuuuuuuuuuuuuugagacagggucucauuauauuguccaggcuggucuugaaauccuugacucaaucaauccucccaccucacccucccaaagugcugggauuacaggcaugagucaccaugcccagcuggauuaucuuuuuuuuuuuuuuugagacaaagucuugcucugucacccaggcugaaguguaguggcacaaucucagcucacugcaaccucugccucccagguucaaacgauucuccugccucagccucccaaguagcuuggacuacaggcgcacaccaccaugucugacugauuuuuguacuuuuaguagagacaggguuucaccauguuggccaggcuggucucaaacugcugaccucaggugauccaccaggcuuggccucccaaaaugcugggauuccaggugugagccaccacaccaggcccagaauaucuuuuaaauguuaaguugaaacuuuguuuuuuuuuucuuccaagacagagcuuugcucugucgcccaggcuggaguacaauggcgucgugauguuggcucacugcaaccuccaccucccagguuuaagcaauucucuugccucagacucagggguagcugggauuauaggcaugugccaccacacccaacuaauuuauuuuguauuuuuaguagagacgggguuucaccaugcuggucuugaacuccugacuucaugauccacccgccuuggccucccaaagugcugggauuacgggcaugagccacugcaucuggccaaauguuaaguuuaaaauuuguuccuagaaauuuguacaagauggccauaacguuuuccucuuuuccauaaagacacgguuaagaaaaaaaaaaauuggggccaggugcgguggcucacgccuguaaucccagcacguugggaggccgaggcgagcagaucacgaggucaggagaucgagaccauccuggccaacauggugaagccccgucucuacuaaaaauagaaaaaauuagccaggcgugguggcgggcgccuguagucccagcuacucgggaggcugaggcaggagaauggcacgaacccaggagucagagcuugcagugagccaagaugcaccacugcacuccagccugggagacagggcgagacuccgucucaaaaaauaaaaauaaaaauaaauaaauaaaugaagauuaaaggggaaaauacgcauggccaguuaauuagaugcccaaaagcauuaaauucaacauuacucaggcugaaaaaaaaaaaacuuccagcaaacaaggaauaggcaugaacuucuuuaaucugacuaaacacaucuacuaugauccuaugauaaacaucauacuuaauggugaacucucggaugcguuccuguuaaagucaaacaacaaacuauggaaggcugcuaucaucacugucauuuaacaucuugcugcuaugauccuagucaaugaacacagaagggaaaacgggaaggaaagaaaaaaaguaaggaaggaagaaaggaaaagaaaugagaagcagaggauuggaaaggaagaggcaaaacaguuguuugcagauacaugauggucuauguagaaaauccaaaagaaccauuaagaugaacaugaaaauggagaaagguuucuguguaagaccagauacaagacucaauagcaauaaagacucauguacccauuacacauggccgcuuuugcuuccucuaucuucccacccuuuucccccuucauauuaucuccuuuuucuuccuacugcauauaauuacagaaucuucauauuaucuugaagcaaaucacaauguaucauuuuauucauaaauguagguauauaaucucuaagaaauaagaacucuuaaaaaacaaaauuacaauaucacuuccacaucuaaaauguuaacgauucuuuaauaucaaauaaccaaucaauguucaaacuuccaacaaucucauaaaugucauaaaucuuuuuuaagcagucugcuuuuguuuucaaacuauauaaaauccacauacugaauuugguuaacaauauuccuucaugccagcaauaaccaaagagaaaaaauauauauauaaagaucuggccaggugcaguggcucacgccuguuaucccagcacuuuaggaagccgaggugagcagaucaccugaggucaggaguucaagaccagccuggccaaaauggcaaaaccccgccucuacuaaaacauacaaaaauuccaggcaugguggcgggcaucuguaaucccagcuacucgggagucugaggcagggagaacugcuugagccugggaggcggagguugcagugagcccaaaucgcucuacugcacuuuagccugggugacagagcaagacuucaucucaaaaaaaaaaaaaaaaaaaagauccauucauagaagcaacaaaaacuagacaguacuuaggaauaaaucuaacagauaacaugcaaaaucuuuauggagguuauaaaacaucacuaaaguucauaaaguaaaacaugaauaaguauaaagauguauuuucaugaaugaaaacuuuuuaucaagauaccaauuaaauacaauuuacuucaaaacuccaaaaacacuuuucaagacacucaacaauacuacaaaaauucacauuaaagaguaaagguugaccgggugcaguggcucaugccuguaaucccagcacuuugggaggccaaggcgggcagaucacaaggucaggagaucgagaccauccuggcuaacacagugaaacuccgucucugcuaaaaauacaaaaaauuagccgggcgugguggcaggcaccuguagucccagcuacccgggaggcugaggcaggagaauggcgugaacccgggaggcggagcuugcaaugagccaagaucgugccacugcacuccagccugggcgacugagcaagauuccgucucaaaaaaaaaaaaaaaaaaaaaagaguaaaggucuaagaauacaacaaauaaaauaaaaccugucuuaccagauaucaagaguuauguuaaagcaauaucaauuaaauaauguguuauuacaagcacaggaguaaacauaaaucaauggaauagacuaaagaucugagaacaggccuauguaaauaugaggcuuaguacauacaagugguauugcaggucaauagggaaagaauggacuauucuaaacaugauauuggagcaacugguuauucauugaauuaaaaaauaauaauuagauacaaguucauacuacacauaaaaugaauuccagguggauuaaaaaccuaaauaugugccaggcauggugacucacgcuuguaaucccagcacuuugggaagccgaggcaggugaaacacuugaggucaggaguucaagaccagcuuggccaacauagugaaaccucaucuccacuaaaaauacaaaaaauuagccuagcaugaugguaugugcugguagucccaucugcucagaaggcugaggugagaggaucaccugagccuggaagucaaggcugcaaugaguuguaacugcaccacuacaccccagccuaggcaacagagugagacauaucaaaaaaaaaaaaaaaaaaaugccaggcaugguggcucacgcuuguaaucccagcacuuugggaagcugaggagggcagaucacaaggucaggaguuccagaccauccuggccaacacagugaaacccugucucuacuaaaaauacaaaaauuagcugggugugguggcgggcgccuguaaucccaguuacucaggaggcugaggcaggagaaucgcuugaacccaggaggagguggagguugcagugagccaagauugugccacugcacuccagacugggcgacagagcaagacucugucccaaacgaaaaaaaaaagaacugaaaaaaauaccagaguauaaugcauguauuaagguuaaauacuacuucauaaaauuuguguuucaguuaaauuuauauagaucagguauggugacuuaugccuguaaccccagcauuuugggaggccaaggcaggaggaucaccugagcccaggaauucgagaucagccuuggcaacauagugagaccucaucucuacuaaaaauuuaaaaauuaaucaggcguguggcugggcauaguggcucacaccuauaaucccagcacuuugggaagccaaggcgggcagaucacgagguaaaucuuggcuaacacagugaaaccccgucucuacuaaaauuacaaaaaauuagccgggaagcuaaggcaggagaauggcgugaacccgggaggcggagcuugcagugagccgagauugcgccacugcacuccagccugggcgacagagcaagacuccaucucaaaauaauaauaauaauaauaauaauaauaauaauaauaauaauaaaaaaucaggcgugguggcaugugccuguggucccagcugaagcaggaggacugcuuaagccaagggaggucaaagcugcaaugagcucuguucccaccacugcacuccaaccugagcaacagaaugagaccuugucuggaaaaauaaaaauaggccgggugccauggaucuggccuguggucccagcacucaggaggccgaguugggcagaucgccugaggccaggaguucaagaccagccuggccaacauggugaaacaccggcucuacuagaaauaaaaaaaaaauagccaggcaugguggcacacaccuauaaucccacauacucaggaggcugaggcacgagaaucgcuugaaccugggaggcggagauugcagugagccaagaucacgacccugcauuacagccuaggcaacaaagugagacgcugucucgacagcguuucaaaaaaauaauaauaaaaacaaaauaaaaauaaauuuuuauguacauaugguugaguaccacacuggauuuaaaauacauuucuuacuguagguuguggucaaaagccacugcccaaguaaaagucuguguaugugcacaaagagacauucacacagcacugugucucaggugaaaaacuggaauuuaagcacccauuuaaaaaaaaauacaauaaaaaauaauaaauaaauaaacgggccaggagcgguggcucacaccuguaaucccagcacuuugggaggccaagguggguggaucaccugaggucacaaauuugagaccagccuggccaaaauggcgaaaccccaucucuacuaaaaguacauaaauuaggcugggcgcgguggcucacgccuguaaucccagcacuuugggagaccgaggaggguggaucacgaggucaggagaucgcaaccauccuggcuaacaccgugaaaccccgucucuacuaaaaaaauacaaaaaaauuaguugggcaugguggugggugccuguagucccagcugcucgggaggcugaggcaggagaauggcgugaacccaggaggcagugcuugcagugaggagagaucgagccacugcacuccagccugggcgacugagcaagacuacgucucaaaaaaaaaaaaaaaaaaaaaacauacaguagcuuggcaaggugggcaccuguaaucccagcugaggcugaacugcuugaacccaggaggcggauguugcaaugagccaagauugugccaccacacuccagccugggugacagagcuagacuccaucauaaauaaauaaacaaacaaacaaacguccauuaguaggggacuagauaaacaaaaugugguauauucauacaauaaaacucuauacagaaguuaagauguagucccagauacauggagggcuaaggcaggaggaucacuugagcccaggaguuggaggccacagugaacuaugauugugccauuacacuccagccugagcaauagaguaagacccuauaucaggggugggcgaggagggugcggaguuaaguauggguaaaucacaaaaacauauugaauauaaaaaacaaagacacagaaaaaaaacaaguuguaugauacuacuuauauaauauauauacauacaauauauaauauauauacacacacgcaguauauuauauauauacacacacacacacacacacauauauauauacugaaaccaaaaaaggaacuaauuauagauaauacaaauagcccaaaaacaggcaggcuugguggcucacgccuguaaucccagcacuuugggaggccgaggcaggcagaucaucugaggucaggaguuggagaccagccuggccaacauggugaaacccugucucuacuaaaaauacaaaaaauuggccgggcaucguggugcaugccuguaaucucagcaacucagaaggcugaggcagaggaauugcuugaaccuaggaggcaaagacugcagugagccgagaucacgccacuacacuccagccugaaugaaagagcaagacucuugucuccaaaaaaaaaaaauagcccaaaaacaacuguguugaaaauguaccuaauuaccuaauuauuuuuucuuuuuucuuuuuuuuuuuuuuccgggacggagucucgcucagucacccaggcuggagugcaguggcgcgaucuuggcucaaugcagccuccaccucccagguucaagugauucuccugccucagccuccugaguagcuaggacuacaugcgugcaccaucaugcccggcuaauuuuuauauuuuuaguaaagacgggguuucauuauguuggccagacuggucuugaacuccugaccucgugauccgcccaccucagccucccaaagugcugggauuauaggcgugagccaccacaacuggccaaguguaccuaauucuuuuuuuuuuuuuuuuuucagaccgagucucacucuguugcccaggcuggagugcaguggugcaaucucggcucacugcaaccuccaccucccggguucaagcaauucuccuggcucagccucccgagaagcugggauuacaggcaugcaccaccaugcccggcuaauuuuuuguauuuuuaguagagacgggguuucgccacuuuagccaggcuggucucgaacuccagaccucaggugauccacccaccucggccucccaaagugcugggauuacaggcgugagccaccgcgcccagccaaguguaccuaauucuaauagcaaagacaguuuucuguaccagcugcuucuaugccucucuucuccugucuuaucuuccuacaccugaagagcugaucaaucuauuuugaaagaaucucaaaaaggguuaaacucuuccuucuuuagcucaaaaaggaauuagccaggcaugguggcacacaucugcaauaccagcuacucaggaggcugaggcacgagaacugcuugaaccugggaggcagagguugcagugagccaagaucugccugggugacagagcgaaucucugucuaaaaaaaaaaaacaaaaacccuuaaagagguauaaguucugaaaaccccacgcucaccuugagcaccaaaaaaugaccaaauucuaggaugcccucaaccacaacaaucacuucacagucuauaaggucuuuccuuacauauucuaucauuugauucucagaauaacccuaugaggucaauauuaccaauacccacauuuauagauaagccaaugcacaaagcagcuaauuaccagccagaggucacaagucaaugacacagcugggacuauaaccccucagcuucugaaccuaaucacccugacagugugcccuuacaugaugacuguauuucaacauacaagaucaugcccagaaaauaggaugggguguucacaacacaugagcugcuccaaucgaaccccuuuuucuucacuauuccaucccugaucuuuccucuuuuuucagacaggcagccaggagcaagagagcugccacuauuaacucuucccuucccuguagccauuccugcuucuuuuucccagaacucuuucagaugaacaggcaaaagggggaaacaaauauauacaggggguuacaggacagucacccugacacugggaucccugcaucaaagagaaaagacugacauuuccucacaucuuccaagagucaggaaguagaaaaacaccacaaaaaaagccuaagcuaccacucuaucagugcuggcaaaaauccuuuacugaagggcuuuaauuaacagaaaaauguaaaaguaccaguuuuuuaaacggucccgggcuuccaacugggcucccacuucaaagcugauuccucgucuguuagguggaugcuuugucauuuucagucaucaacggggcugccuuuauucuccugaaaaagccaauuaaauauuuaugaaacuuaggcaaaguccacccagaguguagcaucauucacuacacauaaaaaaacaggcauuauucaaaacacaaagcuccaugaaacccuguugguguccucauucuaacacaggugugucuuccacugguuccuauuccuccaucgugcagcuuccugugguuucuggaacuaagaagacccucccucaacacugcuuaccacucaccuacaagggccaagggccaccccucagaacuacaaaaaaacaacugcuuucacaguuaaauucagucaucugcugaugcauuauucaacaaauauuugcucagcgacuauuuaaggaaacaaucaagaccaaaagagacacagcuccugcccucaagaacccuucagucuaccggggaaacacaaaaauuuagccagcaaacugauaaauaacugcaaacuguaauugcaaugaaauuuaaagaguuacaaaggaagcaaacaaaugccaggcacaguaauguaugccuauagccccagcuacuuggaaggcagagccaaguuguuucuuugagcccaggaguucaagaccagccugagaaacauagcaaacgcucgucucuuaaaaacaaaaaaaauuaaaaacgaagcaaacaaaaguugagauauuaauacuuggugcuacuuuuggaaggcuguacgaggucuguuuauuuauuuauuuuuugagacagagucauacucuuuuacccaggcugagugcaguggugccaucucagcucaccguauccuccaccucccagguucaagcaauucuggagccuaggccuccugaguagcugggacuacaggcgcaugccaccacacccagcuaauuuuuguauuuugaguagagauuggguuucaccauguuggccaggcugguaucaaacaccugaccucaagugaucugcccacaucaaccucccaaagugcugguauuacaggcgugaaccacugcgcccagaauuguuuauacuuucuuugaucuauguauauuuccuacuucuuuuuuuguuuguugguuuguuuuuugaggagucucgcucuugucgcccaggcuggagugcaauggcaugaucucggcuuacugcaaccucugcuucucggguucaagugauucuccugccucagccucccaaguagcugggauugcaggcaccugccaccaugcccagcuauauuuccuacuucuugaguccauucugaucauuuguauuuuccuauaaguuuuacccagauuuuuuuuuaaucauagaacaauaaaacaguaaaaauauucacguuuaauuccuuuaauugccuuugaaucugaagucacaauuugaaucucuccuuucucaauccugucucguguacucgugcugcaaugaauaaaauuuauauuuaugaucagaaccaaacaguaaagccaauuuccuuuugauggaaaaaaaagguguacuggauuaggccauuuacaagaaaaguggcccccauaaaagaacacuuccggccgggugcggugacucaagccuguaaucccaacacuuugggaagccgaggcaggcggaucacaaggucaggaguuugagaccagccuggccaacauggugaaaccccaucucuacuaaaaauacaaaauuaguggggcgcggcggcaggcgccuguaaucccagcuacuugggaggcugaggcagaagaauagcuugaaccugggaggcggagguugcagugagccgagaucacgccacugcacuccagccugggugacagagcaagacuccaucuugaaaaagaaaaaaaaaaagaacacuucuugugaucacugagguaauuaaucuacuaaucugcaggguccuaaaugcuaucggaggagcuaguggugguucugauggacauguagccacucugaacucuaagggcacuugaacaggccacuuccuuacagcagacuuaccccagccuaacucuuuccucccacuaaacucuggacuuuuuaaaauuuuuuuuagacagggucucauucuguuguccaggcuggaaugcaguggcgcuaucauagcucacugcagccucagacuccugggcucaagcaauacuccugccucagccucccgaguagcuggaaucacaggcaugcgucagcacacccagcuuuuuuuuuuuuuuuuuuuuuuuuuuuugcagagagaguaucuauguuccuaggcugaucucaaacuccuggguucaagcaauccucccgccugggccucccaaagugcugggauuacaggauuacaagcacgagccacugcauccagccuuauacuuuggcucuugacagccuacacugcccaagcaaugccagagcacugccagagcaaugccugccuccuaccagaacacuuucuuugcaauaaaugaguauggaaaaaaaucacagaagugaguacaugucuaauguuuaauagcagcacauuuuaugaagaauuugcuugcaauauauuacauaaaaaggcaggaugcaaaauuguaccacauggagcucacauuaaaacucauacacagccagaugagguggcucaggcuuauaaucccagcuacugaaaaggcugaggcaggaggaucgcuugagcccaggagguugagacugcagugaguuaugauugugccacuguacuccagccugagugacagagcaagaaccugucucuuuaaaaaacaaaaacaaaaaaaaaaggccaggcaugguggcucaugccuauaaucccagaacuuugggaggccgaggcugccggaucaccugaggucaggaguuugagaccagccuaaccaacaugcagaaaccccgucucuacuaaaaauacaaaauuagccaggcaugguggcacaugccuguaauuccagcuaccugggaggcugaggcaggagaaucacuugaacccaggagguggagguuccagugagccaagaucgcaccauuacauucuagccugggcaacaagagugaaauucugucucaaaaaaaaaagaaaagaaaagaaaagaaaaaaacucauaugaauuuauuuuuuuggagacaaggucuugcucacucugucacucaggcuggucuacaguggcucaaaccuggaucacuguagccucgacuuccugggcucaugugauccuccuuacucagccucccaagcaccugggacuacaggugcaagccaccacacccagcuaauuuguuaucugguagagacagggucuugcuauguguuugucugggcuggucucaaacucccagguucaagugauccuccugacucagccucccaaagugcuggaauuagaggcaugagccaugguacccagccacugauucuuuuguaaagacaggaagaaaaaaauaaguuauagguuauuggugauuguuccuuucuucuuaaauacuuuccuaaauuuuaguuuuucacaaugaaaauuuuucacaaguguauaauguaaaggauuauacaugugaaggacaauaagcuaucuauuaaacaacccauuccaggcuaggcgcaguggcucaugccuguagucccagcacuuugggaggucgaggugggaggaucacaaggucaagagaucgagacaauccuagccaacauggugaaaccccgucucuacuaaaaauacaaaaauuagccgggcaugguggugggaaccuguaaucccagcuacucaggaggcugaggcaggagaaucacuugaacccaggaggcggagguugcagugaguugacaucgugccacugcaaaccagucugggugacagagcaagauuccaucucaaaaaaaaaaaaaagccaaaaaacaaaaacaaacaaaaaaaaccaccaaagaaguaauugucagcaggaauuaucuagaugauaaaauuuuauuuuauucugguggugggguugcuucuuuauguuucuucauauuuuuuucuuuuuuuuuuuuuugagacagggucucacucugucgcccagacuggagugcaguggcacgaucucagcucacuguaaccuccgccuccuaggcucaagcaauucucccaccucagucuccugaguagcugugauuacaggcauaugccacuacugcccagcuaauuuuugcauuuuuaguagagacagaguuucaccauguuggccaggcuggucuugaauuccugaccucaaaugaugcacccaccuuggccucccaaagugcugggauuacaggcaugagccaccacgcccggcccauuuuuuucuuuuaagguuauuuaaauaugcaaauuuuuggccagguacacuggcucaugccuauaaucccagcacuuugggaggcugaguauaggcccaugccuguaaucccagcauuuugggaggccaaggggcagguagcuugaaucuaagaguucaagaccagccugggcaacuuggugaaaugucaucucuacaaaaaauccaaaaaaaaaccugcaaauuuuuuaaaugcaagaauuuaauucuuacacuauuuuacuauuuacuggaucuucacaacugccagauuauauaauuaggacuaauguaauguuaccaugguauacaaguaaaauuaaguuacagggaggaaacugacaugcagaggugcuagccaauuucaagguccucugaggcaggagaaaucccucuuaucaaaaguaacaggauguacgcagaaguagacaaaguacuucucaaagguccuuccucuuucucugaccaaagucguugcuaugcuuauauucauaucuuuagauauaaacauaacuugaauacaggaagauaaagcaacuggaugcuuuucaaauguugugucaaaauuaucacaccauuauauaacaagcagaaauaccuaauuuuuuagaaaagacaaaaccuaacacugguccagcuguggggaaacagguacacuagaacaccuccugggguccugaccauggccaucuuuuuauaccuuaaucuagaagcaaagaacaaccuguggaacugcuuauacucuuggacucagccauuucaagcugaagaauacaguccaggauaaaaauaaaucauuugugaaaaugagaaaaaccaauagcucuuuacauaagauucugggcaaacuggauguaguucauccauuaaaaaacaagagaauauuuaaucaaaauucauuacaguaggacuacauuauaaacucaacaaauauguaauaaauuaaauaaagaaugcuauuaagcuacuacuaugauaaagauauaaacuaacuuuacagagaguagauguaaaauaaccuuauccaaacuaacaaaacccgcauaaaaaaaaaauguauagucugggugcgguggcucacgccugcaaucccagcacuuugggaggccaaggcgggcggaucaugaggucaagagaucaagaccacccagguaaacauagugaaaccccgucuccacuaaaaaauacaaaaauuagcugggcaugguggugcgcaccuguagucccagcuacucaggaggcugaggcagaacaaucacuucaacccugcagguggagguugcagugagcugagaucacacgacugcacuccagccugggcgacagagugagacugucucaaaaaaaaaauuuauaauaauuaaacuuacauauauuaaccaauuuaauccuuacaaaaaucacagaaguacuauauuaauccccauuauaaagaugaggaaaaagaaaguuaaggacacucacauaguaaggagcugagccagcaaucgaaccucaguccaguagcuccugaguucagauucuuaccccaaguuuauuuacaagcuacauuguugagcucuguuucuucacuuaugauauggggauaauggccccuaucgugggugcuaugagaauuaaaugagaaaggucugcaaaaccccuauuaaaauaucuaacacaaaguagguagucagcugggcgcaguggcucacaccuauaaucccaacacuuugggagggcaaagugggcagaucacuugaggucaggaguucgagaccagccuggccaauguggugaaacccugucucuacuaaaaaaauacagaaauuagccaggcaucauggcacacaccuauaaucccagcuacucaggagggugaggcagaagaauugcuugaaccaggggaugaagguugcaguaagccaagauggcaccacugcacucuagcccaggcaucagagugagauucgucucaaaaaaaaacaaguagguacucaauaaaugauagcagauuuuucuuccuuuuuuuuuuuuuuuuaagacagagucucgcucuguccccaggcuacagugcaauggugcaaucucagcucacugcaaccuccuccucccggguucaagcgauucuccugccucagccucccaaguagcugggauuacaggagcacaccaccacacccagcuaauuuuuguauuuuuaguagagacaggguauugccauguuggccaggcuggucucaaacucaugaccucaggugauuugcccaccucagccucccaaagugcugagauuacaggugugagccaccacgcccauauuuucugaauucauaucacauuuacaguuaauguacugacaaagacucuggguuuuauuuugggagaggcaaaagaguacugucgcuaugguaacuggaagucuugcccucagcaaucccuuugugcucagggaaaagagggacaacaaagaauuaaaagugauagauggguauggaacaagaccuuucagugaaucagcucugggacaggaguagagggaaauaaacucuggaacuuucgaggaaaaaagucucugggacucucaaggaauaaaaugccaaccaccagaaacuacagaacaggcuuugggauaaucuaauggugcucaccacaaggcugggauucaaccuccauuaaagggugacagugccuuuuaacucaauacaaccacuuuaaauugagggacacuucaggugaaagaccagcuuaaaucuuuaugccccccucauucaagaaauauucauugagagccugcugugugccagguacuggaaauagacaaugggaggacaaggcacccggacccuguucucuaguggggaaggcagcuaagaaacaagauaagcacauacauaagggucauuucuuuuuucuuuuuuuuuuuuuuuugagacagaguuuugcucuuguugcccaggcuggagugcaguggcacgaucucggcucacugcaaccuccaucucccagguucaagagauucuccugcuucagccuccugguagcuaggauuacagguaugugccaccacgccuggcuaauuuuuguauuuuuagcagagaagggguuucuccauauuggucaggcuggucucgaacuccugaccucaggcgauccacccaccucagccucccaaagugcuggggauuacaggugugagccaccgcgccuggccuuuuuuuuuuuuuuuuuuuuuugagacagagucccgcucuugucgcccagcccagcgugcaaggugcaaucucggcucucugcaaccuccgccucccagguucaagcaucuccugccucacccuccccaguagcugggauuacaggcgugcaccaccaugccuggcuaauuuuuguauuuuuaguagagacaguguuucgccauguuggccaggcuggucucgaacuccugaccuccagugauccaccaaccucagccucccaaagugcugcgauuacaggcaugagccacugcgccaugcgagcauauaaagaucauuucugacagagauaaguaauugugggaaaaacaacaaaauaaugugaaccagcgacauggaaaggacuauuuuagauacggcuguuagaaaggacucucaagacaggcacaauggcucacgccuguaaucccagcacuuugggaggccgaggcagguggaucaccugaggucaggaguucgagaccagccuggccaauauggugaaaccccgucucuacuaaaaauacaaaaauuagccaggcuuaguggugggcaccuguagucccaccuacuugggaggcugaggcaggagaauugcuugaacccaggagguggagguugcagugagccaagaucaugccacugcacuccagccugggugacagagcgagacucuugucucaaaaaaaaaaaaaaagaaaaagaaaggacucucugaggaacugaggucuaagcagagaacuaggugacaagaaggagaucuaaaggaagugacuucuaagcaaaggcaacuacuacaggcaaagaaucuccggcagaaaggagcuuuccccacacacagcuugaaccuagaagguugagacuucccacagcccaugcugcugucccaagaaagcauaaacaauuuuagccgguccagugauaccugggucucccaggaagaagccuccaagaggaccuuuugccaaaguucugccguggaggaaggccagggaaugccuagggaugggugcacagacagguuuuagacucagauucuaaccaauucuggcuccaggcauuguuggcugagcgacgacaagaaaaaucacugagccuguuugcccagcuauaagaugggaucaacagccccaauuuccuaggguuguugugaagaauaagugagcuaauggaugucaagugcuuagcauagcaaacucuaaaugguacuggugauggcaauggugguauacuagcaaaaaggacaucagacacaaagaauuauagucaauauuauuaaaaauuaacaaacaguauccaauauacuaaagugcauaaagagcguaucuuuagucguagggaagugacaaauugguucaaguaggaccucuucccaggucacacuagaagaaagggaauuagucccuuuuacuugacaagguagggaaggagggaggaaaggcagaagagguaaggaggaagaaaaagaaaggaaggaaggaagggcaggcaagaaugaaaagagggaagaagccaggcacgguggcucacgccuguaaucccaacacuuugggaggucgaggagggcggaucaccagaguucaguaguuugagaccagccuggccaacauggugaaaccccgucucuacuaaaaauacaaaaaauuagccgggcgugguggcaggugccuguaaucccaguuacucaagaggcugaggcaggagaauugcuugagcccagaagguggagguugcaaugagccaagaucgagccacugcacuccagccuggcgacagagcaagacucugucguaaaaaaaagaagagugaagaaagaaauaggccucaaaacuucacccacuuucuucccagauacuugaaaugcuuucugcaagagucaagcuuugccuuccauaauuaaaaugcaaagagacagcaaacaugaguugaguuuacucauuccaaacuacugagaaugagucgauuaaaucaguggauuuucccagaagcaguggaaagggccugugccaggguuggcccuaaaauguaucugcuguaugaccuuucgcauauuacucaauuucacugagcuaaucaucuuacccuuacaaguuccuucuccuuuuguccccaucaaauaagcccucaagauuggcaagugugccaaacuagaaacaugggcacuucccuuaccuccuucuccuucccucaccucccacacucggacaacauuuuguaggaccugcuucuaagucucagccauugccaaguggaugcccaguucagcccugcaucaguucuaaucuugauuacuccagcagcucuugacagagcuccaauccuccagcuauaccuuccccagauccaaaucaauacugucucaugagaugacaucuucucagugguuauuuuaugacaaauacuauucuaagauacauauauacacacaauucuaagauauauauauauauauauauauauacacuauucuaagauauauauguauauacuauucuaagauagauagauagauagauagauagauagauagauagauagauagauagauagauagauacuauucugguauauauauacauauauauaaaaacuauaucagcccauuuagugucuaccucuuagguuuguaaugaggauuauucccauuuuauggaugugaaaacugagguucacaaaguaaguuucccaaauaccaaggcuagucagguauugggacaaggaauugaaccgagguaaggcugacuccaguuaauuacacuguugccaaucuucaucacugcugcuacagugauauuucuaaaauguaaguaugaucauaagacuucuauuuuaaaacaguucaggccggacgcgguggcucacgccuguaaucccaacacuuugggaggcugaggcagguggaucacaaggucaggaguucaagaccagccuggccaacauggugaaaccucgccucuacuaaaaauacaaaaauuagccgggcaugguggcacacgccuguaauuccagcuacucaggaggcugagacaggagaaucgcucgaacccaggagguggagguugcagugagccaagaucgcgccacugcaguccagccugggcaacagagcaaggcucugucucaaaaaacaaaaacaaacaaacaaaaaaaacaguucagcggcuccccuacagaaccauauucaagguacucagcgcagcauuugggccauuagugaguuagccauuauaaccaagccaaaagaaacucucuuuuggagcuuaaaaggagagaagcaggcaagcuuuagcagaggggcugugggacacagcgguuaugagccagaacucuggaauaagagugccugaguuuggaccucagccccaccacuuuccagauaaacuugcacaagucauuuccucucugagcuucaggcuccccaucuguaaaaugaggauaucaccagcaccuacuucaaaccaucauauagguguugugaagauaaaaguuauuagcacaggucaggcccgguggcucacaccuguaaucccagcacuuugggaggcugaggcaggcggaucaccugaggucaggaguuugagaccagccuugucaacauggugaaaucccgccucuacuaaaaacacaagaauuagccaggcgugguggcaugcgccuguaaucccaccuacaggggaggcugaggaaggagaaucgcuugaacccaaaaggcagagguugcagugagccgggaucacaccauugcacuccagccgggaugacagagcgagacuccgucaaaaaaaaaaaaguuauuuagcagagccuggcacacaauaagcuugcaggguuacuacuguucuugcugggcaugguggcucaugcauguaauucuagcauuuuaggaggcagaggcgggcggaucaccugagaucagaaauucaagaccagccuggccaauguggugaaaacccaucucuacuaaacacaaaaaaaaaucagcuggggaugguggcagacgccuguaaucccagcuacucaggaggcugaggcaggagaauugccugaacccgggaggcggagguugcagugagcugagaucgagccacugcacuccggacuggggaacaagaguaaaacuguguauaaaaaaaaaggggggggggggggcgggggcugggcgccauggcucacgccugcaaucccaccacuuuguggggcacaggcaggcggaucaugaggucaggaguucgagaccagccuagccgacauggugaaacccugucuccacuaaaaauauaaaaaauuagccaggcaugguggugcacgccuguaguccuagcuacucaggaggcuaaggcaggagaauugcuugaacccggcagguggagguuacagugagccgagaucccgccacugcacuccagccuggaagacagagcaagacugcgucacaaaaaaagaaaaagaaaaagaaaaaaggguuauuacuguucuuaccacccauacuccugccacauccaaacacccugcaguuccgaccuccagggccuuuguauaaacaagcugcuuuuguuuuuuuuuuuuuuuugauggagucuugcacugucacccaggcuggagugcaauggcacaaucuuggcucacugcaaccucugucucccagauucaagcgacucuccugccucagccucccaaguagcuggaauuacaggagcaagccaccaugccaggcuaauuuuuguauuuuuacuagagacgggcuagucucuaguuucaccauguuggccaggguggucucgaacuccugaccaggugaucugcccccucccucacuaagccucccaaagugcugggguuaaaggcauaagccacugcaccuggccaaacaagcugcuuucucuuccugguccuucaugaccaggauuagccauuggaaccucccugaaggacuuccuucacaccugcauucucccauggcaaccuaaccuacccucugggccacagcauucaucacucuaugcugaaacugccuaucuaagcagaucucucccaagaggcaauuaacuccucauaggcauccccagcaucuaacaagcagugcccuuaacaugguggucaaauguuuguuaaaugauauaaccuggccaggcgugguggcucacgccaguaaucccagcacuuugggaggccaagguggguggaucgccugacgucaguucaagaacacccuggcuaaaauggcaaaaccccaucucuaguaaaaauacaaaaauuagccaggcguggugguguacaccgguaaucccagcuacucaggaggcugaggcaggagaaacgcuugaacaugggagguggagguugcagugagcagagaucaugccauugcacuccagccugggcaacagagcgagacuacgucucaaaaaaaaagagguaaccucagccuucucacuggcaaaauggaaauaaaaacagaaaagaggccaggugcaauugcucacaccuguaaucccaguacuuuggaaggccaaggugagaggaucacuugagugaggccaggaguuugaagccagccugggcaacauagugagaucucaacucuacaaaaaauaaaaaaaauaggccaggcacaguggcucacaccuguaaucccagcacuuugggaggccgaggaggguggaucacgagguuaggagaucgagaccauccuggcuaacaugaggaaacccugucucuacuaaaaacacaaaaaauuagccgggcgugguggcgggcgccuguagucccagcuacucaggaggcugaggcaggagaauggcaugaaccugggaggcggagcuugcagugagccgagaucgcgccacugcacuccagccugggcaacagagcaagacuccgucucaaaaaauaaauaaauaaacaaauaaauaaaaauauagagcugcgcuagguagcucacaccuguaaucccagcacuuugggaggccaaggcagguggaucacuuaaggccaggaguucaagaccagccuggccaaaauggugaaacccugacucuacuaaaaacacagaaauuagccggguguggugccaagggccuguaaucccagcuaccagggaggcugaggcaggagaaucacuugaacccaggcggagguugcagugagcaaagauugcgccacugcauuccagccagggagacagagcgaaacucugucucaaaaaguaaaaauaaaaauaaaaaaauaggcugggcgcgguggcucaugccuguaaucccagcacuuugagaggcagaggugggcacagagcgagaccagccugaccaacauggugaaaccucgucuagacuaaaaauacaaaauuaacuggcaugguggugcuucccuguaaucccagcuacuugggaggcugaggcaggagaaucgcuugaacccaggaggcggagauugcagugagcagagauugugccacugcacuccagccagggagacagagcgaaacucugucucaaaaaguaaaaauaaaaauaaaaaaauaggcugggcgcgguggcucacgccuguaaucccagcacuuugagagguggaggcgggcagaucaccugagaucgggaguuagagaccagccugaccaacauggugaaaccucgucuagacuaaaaauacaaaauuaacugggcaugguggugcaucccuguaaucccagcuacucaagaggcugaggcaggagaaucgcuugaaccugggaggcagagguugcagugagccgagaucacaucauugcacugcagccugggcaacaagagugaaacucugucugaaauaaauaaauaaauaaauaaauaaauaaauaaauaauuagccaggcacagugacacacaccugucguccuagcuacucaggaggcugaggcuggagaaucacuugagcccagggguucaaggcugcagugaacuaugauugcaccaccguacuccagcuugggcaacagagcaagagacccugucuccaaaaaaaaaaaaaaaaaacaggaaagagaucaauaucauccaccucaauggguauauagauucaagaagauaaucacauggagguucuuugaagaguguuauccacagguaaacgugggaacuauuauuacuccuugcgugcagaggaaggcaaagcaugcggaaugaagcaacugaagacugaucacaguuuuaucccuggggcuuaagaaaagcuguauccauuucuucaggcacugggggcuccaaucuaucaauacucuacacucucugagugauauagucuauagcucuggagugaguuuugagacggagucaagcucugucgccaagcuagagugcaguggcucaaucucggcucacugcaaccuccaccuccuugguucaagugauucuccugccucagccucccaaguaguugaaacuacaggcgugcaccaccaaacugggcuaauuuuuuguauuuuaguagagacaggguuucaccauguuggccagcauagucucgaucuccuggccuugugauccacccgccucggccucccaaacugcugggaugacaggcaugagccacugcucacagccuaggggaagucuuauuuauuuauuuauuuauugagacggagucgcgcugugucaccaggcuggaaugcaguggcgcgaucucggcucacuggaaccuccaacucucuaguucaagcgauucuccugccucagccuccugaguagcugcgauuacaggcacacgccaccacacccaacuaauuuuuuuuuguauuuuuaguagagacgggguuuuaccauguugaccaggauggucucgaucuccugaccucgugauccaccugccucggccucccaaagugcugggauuacaggcgugagccaccacgcccagcugggaagucuuuuuuuaaacacaccugaccagcuauccuuacaagauuuguuuuuuuuuuuguuuuuuuuuuuuuugagauggaguugcgcucugucgcccaggcuggggugcaguggugcaaucucagcucacugcaaccuccgccucccggguucaagcgauucuccugccucagccucccaaguagcugagaugacaggcaccugcaaccaugcccagcuaauuuuuuguauuuuuaguagagacgggauuucacuguguuggccaggcuggucucagccucccaaagugcugggauuacaagcgugagccaccacacccggccuauucuuacagaauuucuuaauugaaauaucaccauauuacaaaggaaaacaauuuggagaugaaaucauuacucaacagggccuugagagacauuuucaugccuauggaguuuuaaauaccuaagauauuuaugagacaauucauuaauucccuuaucuuggcagggugugguggcucacaccaguaaucccagcacauugggaggcugaggcgggaggaucaccugaggucaggaguucgagaccagccuggccaacguggugaaaccccaucucuacuaaaaauauaaaaauuagcccggcauggugguaggagcccguagcaccaccuacucgggaggcuaaggcaggagaaucgcuugaacccaggaggcagagguugcagugagccaagauugugccacugcacuccagccugggugacaagagcaaaacucugucucaaaaauaaauaaauaaauaaaaguccauuuuccuuuaaguaugaauuuuuauuccuagccuuuauuauuaauaccaggaaauauucaacauuuacugauuuaucaccacaugcuaaauccuugacaaacaucucauucccaacaaugcagagaagucagcaguauuuuacgaaggaguauaaacaauaaacaacuugcccaaagucaccuggcuagauagaagagcugggacuucagaagcaagaccuccuuccuccaaaacccacuacccucuuuuuuuuuuuuuaagacagggucuguuucuguggcccagguuggagugaagcggcaugauccuggcucacugcaaccuuugccucccaggcucaaaccauccuccccaccucagcucccccagugcugggacuacaggcacgugccaccaccccuuccucauuuuuguauuuuuuauagaggcgggguuuugccacauugccgaggcuagucucgaacuccucagcucaagugaucugcccaccuaagcuucccaaagugcuggaauuacaggugugagccaccgcacccggcccccacuaaccuuuauugcuuuuaaaaacaagggacugagugcaguggcucaugccuguaaucccaauacuuugggaugcugaggugggcagaucaccugaggucaggaguucaagaccagccuggccaacauggugaaacuccaucucuguuaacaacauaaaaauuagcugggcauaguggcacacgccuguauucccagcuacuuggcaggcugaggcaggagaaucucuugagcccggaaggcagagguugcaguaagcagagaucaugccaccacacuccagccugggagacacagugagacuccaucucaaaaaaaaaaaaaaaaaaaaagucuuugggauauuucaacauuaaaaauauuaagggauuacuguuaguuuugugugugugaaaaugaggggaaaaaaaauguggccgggugcaguggcucacgccuguaaucccagcauuuugggaggccgaggcaggcagaucacaaggucaggaguucaagaccagccuggcuaauauggugaaaccccaucucuacuaaaaauacaaaaauuagccgggcgugguggcaggcaccuguagucacagcuagucgggagguuaaggcaggagaaucgcuugaacccuggagguggagguugcagugaaccgagauugugccacugcacuccagccugggggacagagcgauacacugucucaaaaaaaaaaaaaacacacaaacaaacguaagggcgggacaguggcucaugccuauaaucccaguacuuugguuugguuuuguuuuaagacggaguuucacucuuguugcccaggcuagagugcaauggcacgaucucggcucaccacaaccuccgccuccuggguucaagcgauucuccugccucagccucccaagaguagcugagauuacaggcaugugccaccaugcccggcuaauuuuuuguauuuuuaguagagaugggguuucuccauguuggucaagcuggucucgaacuccugaccucaggugauccgcccaccucggccucccaaaaugcugggauuacaggagugaggcaccaugcccggccaaucccaguacuuuggaaggccgaggcaggagaaucacuugagcccaagaguuugagaucagccuaggcaacauagcaagaccucgucucuauaaauaauaaaaaaaaaaaaaaaauuagccaagcgcgguggcauacaccuguagucccaacuacucacgaggaugaggcaggaggaucccuugaacccaggagguugaagcugcaagacagcugugauugugccacugcacuccaaccugagcaacagagugagaguccaucauaaagaaaaaaaaaaaguaagagucuuuuucuuuggcauacacuacugauaaaguuauggaugaaauacaaacuaacaaggcccacugaagggcccauggaggaauuuuacacacauuuucugagaggaauaaaacaaaaguaauaaugguaacauauacucaacuccucauaaaucuucaagccaggaaaacucuauaaacuauguuuucuuuuucuuuucuuuuuuuuauuuuuaaacacaggcucucacugucacccacacuggaguacaguggcaggaucauagcucacugcagccuugaacuccuggguucaagcaauccuuccaccucagcuucccaaggagcugggacuacaaggcgugcaccaccaugccaaacuaauuuuuuuuuuuucuguguuauagagaugagguuucacucuguggccaggacuggucucaaacuccuggcuucaagcaguccuccugccuuggccucccagagugcugggauuacaggcaugagccacugugcccagccaaaccagguuucuuuaauuuccuuuacagauuaggaaauggagggaaaggguaacauuuacugauauuuccaaugacugaugucagacaguuaugauaauacuugggugaggaaacaggcucauauagguuaaguaacuugcuaggcuggaaaguucugccuccaaugugcauaacacaaugaaagguucaagagguuuaagccauaugcccaaauuacauuuggccccaagagaguggcaaauacaggcacucaaacucaggcauuccaccuccaaauccuacauccucaccaccacauaccaugcagccuggacaugaaaagugaccucuuggccaggcacaguggccuguaauccuagcacuuugggaggccgaggagaguggaucacuugaggucaggaguucaagacuagcuuggcgaauauggugaaaacccaucucuuccaaaaauacaaaaauuagccgggcaugguggcauccgccuguaauccuagcuacucgggaggcugaggcaggagaauugcuugaauccaggaggcagagguugcagucagcucugagaugaugucacugcauuccagccuggagaacagagugagaaugucucaaaaagagaagaaaaaaaaaagaaaaaaagaaaaaaaaaacaaaacaagaaaaagaaaaguggccucuuuaauuaccuugccuuuacaaguugcacaugucuaauuaucauauaggucacagcacgaccaauuuccuacucaucaaagcacauuacacagaauucaauacuccauggaaccaagggacagucaagcaacccaaaccagucaugcccaggagccucaaaaaaggcagaaaaguauucaaaaacauggagacagaaaguagaaugguagcugcuggggcugggaggagguucaugaaagagggagucaguguuuaauggguacagaguuauaauuuuuuuuuuuuuugagauggagucucgcucugucaccuaggcuggagugcagugcagcaauccuggcucagugcaaccuccacccgcccccgcguucaaacaguucuccugcuucaggcucccuaguggcugggaucacaggcaugugcuaccacgcccagcuaauuuuuguauuuuuaguagagaugggguuuugccaugauggccaggcuggccucgaacuccugaccucaagugaucuaccugccucagccucccgaagugcugggauuacaggcaugagccacuggacccggcccagaguuucaauuuugaggaguuacggagauggagaguggugaugguugcacaacauuauuuaauaccaguaagcuauauaacuuaaaaaugguuaaaauggcaaauuuuauauuauguguaucugaccacgacaacaacaacaacaaaaauugaagaagaaagaaaaauguagaaaggcagcuugaguugggagaacugggcuucuacaauuaaaggauguuuugcauggucaagaaugaaggccaggcacaguggcucacgccuguaaucccagcacuuugggaggcugaggcgggcggagaccaaccuggcuaauacggugaaacccgucucuaucaaaaauaugaaaauuagccggaugugguggugcaggccuauaaucccagcuacucaggaggcugaggcaugagaaucacuugaaccccagagaaggagguugcagugagccaagaucgugucacugcacuucagccugggugacagagcaagaauccaucucagaaaaaaaaaaaagaauaaaaucuugcucacgccuguaaucccagcacuuuaggccgagguggguggagcaccugaggucagggguucgagaccagacugaccaacaugguaaaacuccaucucuacuaacaacagaaaauuagccaggcguguuggcacaugccuguaaucccagcuacuugggaggcugagguaagagaaucacuugaacucgggaggcggagguugcagugagccaagaucgugccauugcacuccagccugggcuacaaggugaaacuccaucucaaaaaaaaaaaaaaaaaaaaaagggccaggcaccaguggcucaugucuguaaucccagcacuuugggaggccaaggcugguggaucaucugagaucaggaguucaagaccagccugggcaacauggugaaaccccgucucuacuaaaaauauaaaagauuagccggguguggugguguucgccuguaaucccagguacucaggaggcugaggcaggagaaucacuugaacccgggaggcggaggcugcagugagccaagaucaugccacugccuuccagccugggagacagagucagacucugucucaaaaaaaaaaaaagaaaagaaaaaaaagaaaaaagaaugagccaggcaugguggcucaugccuguaauccuagcacuuugggaggccgaggcggauggauuaugaggucagcagaucgagaccauccuggcuaacauggcgaaaccccugucucuacuaaaaauacaaaaaauuagccgggcaucguggagggcaucuguagucccagcuacucaggaggcugaggcaggagaauggcguaaacccgggaggcggagcuugcagugagcugagauugugccacugcacuccagccugggcaacaaugugagacuccgucccaaaaaaaaaaaaaaaaaaaaaagaaaucuggggugaggguggcaaagugccucagugcugguuuccaggcugccaccuguuugauuuguaguuaaaaugacuuacucaaauuucuaggggaaaaagcacguuagcuagagagagagggauguaagagcacugggacaggaggcaaagaaaccuggacuccaaucgaggcccugcuuauuagccaaaugaccuuggacaaauuacucaucucaguuuccuccucuguuaggacaggauaauaggucagauguaaggauucaaugacauuuaagacagugcuccaaaaaugcuagcuauaguuaucauuauuguaaaaugcccacauuuccagaccaaguuuccacaaccucgaaaucccaacaccugugcaccuguagaagcaagaaaggcauuggccgggcacaguggcucacgccuguaaucccagcaguuugggaggccgaggcggguggaucacuugaggucaggaguucaagacuagccuggcgaacauggugaaacuccaucucuacuaaaaauacaaaaaauuacccaggcaugguggcgggcaccuguaaucccagcuacucaggaggcugaggcaggagaauugcuugaacccaggagacagagguugcagugugccgagguugcaccacugcacuucugggcgacagagugagacuccgccucaacaaaaaaaaaaaaagaaagaaaggaaugucaauccaccagcuauggacuuuuuccauaugagaaagagaccucuugaaaaucaggucucuacuaggacagagacccccaaauauccuucuaagauaccuggaagucagccuuuaaaaucugagaauuauguuccugacauggaauaaacuaucacugaauaaaaaccuugguuuaggccaggcgcaguggcucacaccuguaaaccuagcacuuugggaggcccuggcaggcggaucaugaggucaggaguucgagaccagccuggccaauaugaugaaagccagucucuaccaaaaauauaaaagauuagcagggugagguggcacacaccuguaguaccagcuacuugggaggcugaagcaggagaaucacuugaauccgggaggcagagguugcagugagccgagauugcaccauuguacucuagccugggcaacgaagugagacuccaccucaaaaaaaaaacaaaaaacaaaacaaaacaaaaaaaaacccuuuguuuaaaucccaagccccuccucuugcuccuuccccaaaguucacugauucaggcuccaccacucuuuccuaaaacuguccuauuuacauuuagucacucauauuaggcuucuaaaauuguacaggauuucugccagcucauuaguuccauuauuuggcaaaagagaggaagguccagguaggaccuagcccaagaucuagcaaaguugucaaagcauuauuacaaauuaaggguucaauuuuuuuuuuuuuuuuuugagacacaguuucacucuuguugcccaggcugaagcgcagugguguaaucucggcucacugcaaccucugccucucggguucaagccauucuccugccucagccucccuaguagcugggaugacaggcaccugccaccacgccugacuaauuuuuuguauuuuuaguagagacggaguuucacuguguguuagccaggcuggucuugaacuccugacuucaggugauccauccgacuuggccucccaaagugcugggauuacaggcgugagccacagugccugucucaauuuucauuagguuacccuauagucaauagccuguaaggggcagucacuggcaaagauggauuagacaaagacaucacccuccuuuucucuaggcucauaauccaaucaaggaucuugacuaagcauacauuuugguuuaaagaauguuuaucaagaaaaaugucccagcuuaaccaacauagugaaaccuugucucuacuaaaacuacaaaaaauuaguugggcaugguggugcgcaccuauaaucccagcuacucaggaggcugaggcacaagaaucgcuugaauucaggaugcacagguugcaguaagccaagacugcgccacuacacuccagccuaggcaacagagcaagacccuuucucaaaauaaauaaauaaauaaaauuaauaaaaagacuuuaucaagaaaaauguaaacauccucccuauuauuucuuaggaagaugaugaaagaagaaaacuccagagguuaaauauaccuuuaaguccugacuuccaagcccccucagcaacugucuuugacaauaaucaggugcucucaaagaacuguugguuuuauucauuuguuaaguuauuugaaauacagauuucuuaucauuauccuuaacaauuccuuguucuggguuuuguggcuguguguuccuagaagagcacuuggaagcaauggggucucgugcugucacccagcuguagugcagugguacaauccuagcucacugcagacucugaacucccucgucagccucccaaggagcugggacuacaagcacgcaccaccaugccugacuacuuuuuuguuuuuggugggggaguagagacaggaaucucacuuuguugcccaggcuggucuugaacuccuggcuucaagcaauccucccacucuggccucccaaaguguugggauuacaggcguaagccacugcacccacccaaccacgaguaauugucaaaugguauuugcacuuaggauacacuuucaaacuucagaaaggaaguuuaagcaccuuuacaauccaggaagacauaccaggcaacugauucccacagauacaggagaucuuggggaaggggacuaaaaacauuacaucucauacuuuccccaaaucccagccaaaggcaaacaaccugcuugcuuccucuuuaaauuucaugccaccugcccugcuaauucaaaccaaaaaacaaagcugugguauggaggaaaugaagucccuuuuuaaguauacauuagauaagagaacugacaaguaaauacgggguauauaagguacagacuccuucuugguaaggcagagaagucacaaacauugaauggagaacucaggaagacuucuuugaggauuucagguaguucugaaugaaauacagcauggaacuggaagaagacauggaagcaagaagaacgcugaaguuggguugagaacaagcuggcugccucagcuagaaaaaaagauaauggcagaagugacuuggacaagggaauaacuggcaggcugcccaagggagcacaugaaagaaaucagaucugcugcaacaagcuaccacaggcaaugggguuucuaagcaagguagcgaccaagauucagccaggguggacauugcagaucaucagccccucauuuuacaaauggggagaagcaggcccauagcauuaagugacuugccugaggucucacaguaaauggaagagcuaggacuagagccaaauccagaucaaauccguuacugaauaggaucugacacucaugugaggaauagggguuggaggaggacagggacacaaaauagucuagucauucagguuuguccugauuagggcuggcaacaggaucacguggaagagggccagacaggugacagccagggaaauagguacagaugauccaacacacuuagaaaggaaaaacacuuucagagguagucuuugucuccaaaaaaauuuuuugaaaaaaggaaaaacccacuugagacuuagaauagauuagacauguggguacaaaaggagaaagaucaucauaaagcaugaucaccaucaaagaauaucaucuucuccccagcauuugucuuucuggagcacccauuuagagaaagccagaagcuuccauucgaggucggggaacauagcuuuauccuggcuuuuccuggcccauuuccagaacccagaaaaccaagaaggacucuuuggaaauuccaacaccugugacccacugauuugggguaucacagacucccuacucaugguaggaugaggaaccagacagacaagcuggcuaugcaguauuuauuagaaugauucuauaucaauaauuauguucacauucaaguaagaaauauguaaccauuuaaauuuggcaauagccaggcauggcagcucacaccuauaaucccaacacuuugggaagcuaagguggaggacugcuugagcccagaaguucaagaccaaccugggcaaaauggcaagaucucaucucuacaaaaaauuuaaaauuagccaggugugguggcacgugccaguggucccugaaacucaagaggcugaggggaggaucgcuugagcccagaagguugaggcugcaguaagccgugaucacaccacugcacuccagcuugggugacagaaugagacccuguccccacccaaaauauauauauauacacacagaaaccaaacuccuggagaaguuuuggccuuuuuuuuuuuuuuuuuuuuggagacagagucucacucuguggcccaggcuggagugcaguggugcaauuuuggcucacugcaaccuccgccucccggguucaagcaaguauucugccucagccucccauguagcugggauuacaggugccugccaccacacccagguaauuuuucuauuuuuaguagagacaggguuucacuguguuagccagacuggucucgaacuccugaccucgugaucugcccgccucagcucccaaagugcugggauuacaagcaugagccaccgugcccagccaguuuuggccaauauuuaaaaagcuaugugcuagaauaacuaauugaguauaacuaauaaaggggacuauggccuuguacaaacuuuuaagggaugugugucuggauaaagauaaaauaaaaaaauauaaggcuaaccaccaccuuccuauuuucacagagaaacuuugucuucguguaugaaaccucacuacuaaaaguguaguucaguaacaucagcaucaccugcaaaucagaaaugcauucaggucccauccuagaucuaccaaaucagaaucagcauuucaacaagaccccugggugacuuacaugcacauucaaguuugagaagcacugguguagaauacuuuaagggugcacuguacggcaguacacagauaaaguaucaagcagccaaagaaagagacaaaguaucuguucacuuucaguauacuauauuuuauuagguacugcucagacagaccuccagugauuuuuauaaauuugguacuuccuaauggccacaucaucuaacugugggaucuauuucauuucuggaaauaacacaacuuaguucuagggcuuucaugcacaugaaauauaaaacagcuuaguuguucugaaaacaugacaaugguuaauuuuauucaagucccaacacugaguucagagcacuucuccauaggccccauuaaucucuccagguuucugggaguaucauuaaaucccucggcauccuuaagaagcaggugcuuagcaaacauccaguuuccaaaugagagucagaggggcuugauccugaaaguguaguauuuuccugccuuguccuacugguauagcuucuuggaccuaaaaucucucuccugcugaggccucaugcagcugcacacucaaguacuucccaaaaggaagaaaggucagagguaucauuauccccaagcacuuggaauuccagcuguggagaaauuaaucugguuggggguucaggcugagaagcccugaauaagaucuguaaaggcagaaggaaacacaaaagaaagaacuauugaggcucuuaagagauaggaggucccagauauuugcagauuuuaaugugaggauuggggguaaagauugacaagagguuggccgggcuugguggcucacgccuguaaucccagcacuuugggaggcggaggcggguggaucacgaggucaggagaucgagaccacagugaaaccccgucucuacuaaaaacaaaaaaauuagacgggcgcgguguggugggugccuguagucccagcugcucgggaggcugaggcaggagaaugucgugaacccgggaggcggagcuugcacugagccgagaucgcgccacugcacuccagccugggcgacagagcgagacucugucucaaaaaaaaaaaaagaagauugacaagaggaugauugggagagaaaaauauccauuuccccaccgacaccccagggacaagaacaaaaagaguauccaagggauuccuccaaacgacaucuuuucuucauaaaagauaguaagaaagccaauauagggaagaaguuuaugggcuagaagcagugcuggaaaaaucugagaguuuuguuuguuuuuguuuuccagcacaaggagauaaagcaaaggagaaaacaguaugcaccuaaacagaaucuuaggucuucuagaaguaaaccaccaggaggauucagaguccugugauuaaccaaagaaaugguuuccacuuugaauccagcgcugggggcccaggcaguccuagacuugaggccaccuccagcacaaggaaaaucuuuauagccacuagguaaacagaacaauuccaaagaaagacagaaaccagaaaaauguuuggggauugggcaagccaagagagaagagauccugcuagcggaaagauaaaagauaggccuaucaaaaacaaugugcugguagcccuuuaggagaggaauccuucccugggaggagaggagaauucaggaggugugacucugggaagugugcucagaagaaaagcccgcagaagcacagagaaaagugccgugcugaacaaagauacgcacucgccagaggaagaggaaaugggugcacugaccagacuggggaaagcaccucaaggggaguguggcuccaaaaagggaaggaaacugaggaaugaaaaugucuuggaugacagaaaagcuaaacaggguaggaaggcaugcucaaaaccacagaccacucgccaccuggaaaugagaggacucacaaaaaggugugccccccaaauuuaagaagcaucuggaaaguggcugcacucugagaguuguauaacuaaaagggguucaccucguacauuuggggggcacaagaaacaaauauacucccagauaugaaaaugagucuccuucaggaaauaagguaguuugauuuggggaacacgugaaaaguguguaaccccaauaauacagucucgggagaaggcagugaauucccuuauuugugaaacuggaaauaaguacccauaaacuucaaaauuuggacauuguuuucggcccaaccucagguuugaagggcugaggaaaggaaguggccccuaaauguaagaaauuccagaaggcaugcugucagauuugggaccuggaaaaggggaauucuuccuuggaguagaggggauacaagaaaguaucccaaaacuuuagcuaauggaccccagaucugaggacccgauaacagggugaaccucuaaauuggaacggaaaugcagaaucaaauuggaggcccgaaaaaaggaaugugcucccacuuugggggcugacggaagaggguacgcccuaaauuugggggggggagggcuuuuagaaauuuagauaaaauuccagagcuagagcuuaagaaagggggugugccgcccaguuuucaaaacuauagagaaaagggacacucccauauuuggggucuugagaaaggaaugugcuccccagaauaggauaaaaaaagccaauuuuaaaaaacauauucccaaagcgcaaggcaauagcagaggcugcugaugaggcucuaggugcccacacagcucaggcucgggcccuagggcuuacccgcacccccaacacggcccgcuccgcgccccgggcccgcaccccacggcccagcccccucgggcggcgcugauuggcggcagccgccgccacucuugcggguagccccggggauugggcaccgcucgcacgcccgccacgcucucagcagcagucccagggccucccuccaggcugggcgagcggggccaggcggggagcggggccgggcaggggaccgaagcagcgguggcguccgucgccguccccgcccgcacggcgcgcgcgcagcgcgggcccggcccaacccggcccggccggccggcuucgccuggccgcgagcucaccucacggccccacuccggcugcgccgcuccaggaccaaccgacagaaggacucugcgugcucugcaccacgugaccccc

SEQ ID NO: 191262 - RNA, 20480 nt, Homo sapiens
ccgacggcccgccccgcggggggugggcgcagcucgucgcgcuccgcacaaaguuuguuuucucccuccgggcgggugggggagggcgcagagggcgcggggggaggagaggggaucugacgucaggccgcgaggugcuuuccagccgcgagcugucaggccgagugucaggccgggcagguacgcggcgcgcgcccccggcgccccccgcuccccgccgggacgccccgcgccgagccggaggccgcguggacccgaaagccgcugggaaaagucagugcagggagcagcagagggccagaugggggugggggcgcgcggacaacuuggaaaguuucuuuuucucggccggacggggagggggcgucguccuggcgcgugcgguagggggugugugagcucggggguguuugugagucccgacggcccccgggggguguuugugagucccgacggcgcugcgcuccgggggccggugggggacuguuccagcccccgggaggaagcccgcuuggggcccugguggggggcccagcuucauaggaucccaccccaggagagggccgauccugcaccggaccugagugagcgcgcggggggacggauuuguuugguuucaaaagugcacguugcuaaccgccagcagggcccccccgccgccgagccggacagggggcggccgagagugacagcugggggugggggccgcgggaagggcccggagcgggggggcccuggggagcccgcgcgaguuccccuuuccuuuggaacaaaggaaagucugucuccgaggcaucugucacucccaggcuggccaaggaagcggggcgcguggggccggcgccccggagaaaguuuguucgcgccgggacccucgggcaggccgaaggugauccaagccucccgcgggagaagcgcguagucuccggggcagggggcggccaacauggagucugggcgcagggcugggggggggggggcggcgcggaggugggagcccagcccccuccccucccuuccccuccccucccccuccgggcccaguucggagcacaaagccgagcgcgcacgcuccgccguccccgcgccccgaagagucggccagccccgaacugccggaguaggggugggaaccaaacuuuuuccugccccgggacagacacgugaguuuucuuucuuccagagcccccgucccaccgggauggcgggcccgcgcgggagcuggugcgcggagucggcccgggguguggggacuguggggugcaagcgccccgagcgccggacgauuccucgccgacccaggagccaugugcuccgacucggucugggccgcgggggagguugcgcgcuuugucugaacugcugggaaugcgggcgugagugcgcggcccgggggagugucgggaccagcuaggggaguugucagaaaguucgugcgggaguggcugcagguggcgucgugggagucuguaggaggguguacgggauguugugucgagggguugcugccacaggucacugaggguagaacugauuguuagugugaugacgccuggaguuuucccugucggagagaucggggguggccgggucgguuggaguucgugggugggcggguacagaaguugggcuaguugugugggucacaguuguucgugcuaggccuggggucuguaagcugugcgugugcgugcuguaugcgucggugaaaacccuaggguuuguaaggcuugagcgauggguccgggccaguuauccuagcgcuguugguuaauugccuggcgugagugugucugggugcgguguggggugcauaugugggaagccucccagacuacagauggcccuguguggcggaacaccgagguggagaaguuuguguagacugaggggucauuccccagggcccacccggggaacccugcagacagacuuggcuggcagccaggguggaauuuguacagauaaccuugaguacuucucacagccggccagggcugcaucacugagcccagaucccagcugcccuggccaccuagaaauggcugucugaccucagaaagcagccugcaguggugcucucugaggaguggcacgucuaaccagugccugucucaccuccagguggccugacugaaaggguagacccuucccucgaaagccuggccuagccagcccagagaucugggcucggguccaagaagaggaaacaaaaccugggagaugccagagucuguuggccggccugcuggggagcuguuaaaaggcugagaagggaggagccuugagauccuggcaucagccuggccuagaacuuuugcuuuuaaaaugaaaaucuggcugggcgggguggcucacaccuguaaucccagaucuuugggaggccgaggcgggcagaucaccugaggucaggaguucaagacuagccuggccaacauggcaaaacccugucucuacuaaaaaaaaaaaaauagcuagaugugguggcacacaccuguaaucccagcuguucgggaggcugaggcaggagaauugcuugaaccugggagauggagauugcagugagccaagauugcgccacugcacuccagccuaggcuacagagcgagacuccaucucaaaaaaaaaaaaagaaagaaagaaagaaagaaaaucuuuguugcacgugugaaacagaacuuuguccagggacugagcagcugaguuggguuaucuagggaaaauccuuccuucauuugacaggugaagaggggacucaagcccagaaaggggaggauccuuguccaaguuacagugccaaguggagggugggccuugcucauucaccuggauuuugagugguugagucuaggaccaggcuaaaggggccugacaaaggagaauguccaagaagcaaccaguagagagaugacucaccucucucacugcaagguacacaguaggugcuccuuaaauauuacuuggacugcugcaggaucauggugaucuguaguuuccagaguucucacuggcccuugggagaccuaggaggcaagacaguauacagcucacaagaggggguggggagaggccugguccaaauccgacuucacuauccuaaccugggggugggauuuuuuuccuuuacagcuuuauugagauauaacucacauaccaugcaauucacccauuaaaguauacucaucagcagguuugguauguuugcaaccaucacuauagucaauuuuaggacuuuuuugcggggggauagggggacagggucuugcucugccucucagaugggagggcaguagugugaucucaucucauugcaaccucugccuccgggcucaagcgauucuuccaccucagcccccagaguagcugggaccacagacaugcauuaccgugcucaacuaauuuuuguauuuuuuguagagaugggguuucaccguguugcccaggcuggucuugaacuacugagcucaagcgauccaccugccuuggccucccaaagugccaggaguauaggugugagccacagcacguggcauuuuuuuuuuauuauuuuauuuuugaaaacagguuuuuaauuaugucguccagguugacaugcacuggugcgaucauagcucacuacagccuugaacuccuggguucaagggauccucucaccucagccucucagaauagcugggacuacuggcacaccaucacacugggcuaauuuuuauuuuauuuuauuuuuuuauuuuuuucuuuuguugagacagggaaucacucugucacccaggcuggagugcaaugccaugaucucagcucacugcaaccucugccuucuagguucaagcaguucuccugccucagccucccaaguagcugggauuacaggugugugccaccacaccuagcuaauuuuuuuuuuuuuuugguauuuuuaguagagacgggguuuugccauguuggccaggcuggucucgaacuccugaccucaggugagccacccaccucggccucccaaagugcugggauuacgagcgugagccaccguguccggccuuuguuuguuuuuguuuuuuuuuuuuugagauggagucucgcugugucacuaggcuggagugcgguggcacgauuucggcucacugcaacguccaccucccagguucaagcaauucugccucagccucccgaguagcugggacuacaggcacgcgccaccaugcccagcuaauuuuuguauuuuuaguagaaacaggguuucacccuguuggccaggauggucucaaucucuugaccucgugaucugccugccucggccucccaaagugcuaggauuacaggcaugagccacugugcccggccuuuguuuuuugagaccuuuuuuauuuuguugucacccaggcugaagugcaguggcacaaacacaguucacuacagccuugaccuccugggcucaagcaauucugccucagucccacaaguaggugggcuuacaaaugcacagcaugacaccuggcuuauuuuuguauuuugugugugugugugugagccacugcgcaggccuugggcagcuuucuugaucucuguuaccucaucuauaaaaugaugauaauaauagcuucucccuuauuggggaauuguaaugauuaaaugagauaacauguaaaaugcucaguacaggccaggcaugguggcucacgcuugcaaucccagcacuuugggaggcugaggcugcuagaucucuugaggccagcaguuaagaccagccuggccaauauggugaaacccugugucuaccaaaaaauacagaaagucagccaggcaugguggugcaugccuguaaucccagcuacucagaggcugaggugggagaaucacuugaacccaggagacagaaguugaagugagccaagauggcgccacugcacucuagcaugggcuacagagugagagccucucucaaaaaaaaaaaaaaaagaaaagaaaaaaccaaaugcuuaguaccgaacauggaaaacaguagaccucaguagaagcuguaauuguuuccagccugaguccugcuugugaaugagcugccauucgguagucaccuaccuguuccaugaaguggaggaacuuuggacucaucccuucuagcuugcucggucuguguuacggccugagauucugaauugcaacuaccccauuucuggugucccaggcucaaguaaugcugagcauguuuggagacuaggaaaaggcgguacgugcuaaugauguucccauccccugugucccuugucccagguuuacccaagguccagccuagccccuaggcaccaugucggacagugaucuaggugaggacgaaggccuccucucccuggcgggcaaaaggaagcgcagggggaaccugcccaaggagucggugaagauccuccgggacuggcuguacuugcaccgcuacaacgccuaccccucagagcaggagaagcugagccuuucuggacagaccaaccugucagugcugcaaguaaggaggggaucuggauaaggggguggcaggaggaccuggguucuaguccuauuccagcugugucacugagucacuguggucuugggccacucacuuucacugucugggcuucgguuucuucuuggguuaggggagaacacccacucucccugucucaagggaagacaaugaaauagggucgcugcagucaauuucagacuuuagauaguccuuuuuuuuugagacggagucuugcacugucacccgggcuggagugcagugaugcgaucucggcucacugcaaccuccgccucccggguucgagugauucuccucccucagccucccgacuagcugggauuacaggcgcccgccaccacgcccagcuaauuuuuuguauuuuuaguagagacaggguuucaccauguuggccaggcuggucucgaacuccugaccuugugauucacccgccucagccucccaaagugcugggauuacaggcgugagccaccacgccuggcccagacuuuggauaguucugaagaggcaaggaauuuaauguugucaaagucuaggugucauccuuaacuuuggaggccaagggaagaugagaaggcaucgagcaucuaggauucagcccccagccccaacgcaguauuggacggcgacuugguugaaaggggcagcuguaauuugcagugugguuaagagauggggcaggaucacaguccaggaaagggcagaagucagagguucuguguucauaauccaguucugccucacgucuugauuuccuuaucuguaaaggggcaggggguacacagagucuuccccugccugguggaucuguugugacgaauagauucagaacuggaugugaaagugcuuugcaaaccaugcacaugaacacacucaaaagauagccuuauccccuuuuugucagagugcaaaguacuguccccuuugaaucgcgccuauugcugacccgcaggugucuuuguucugcuuuccuggagcagaggcgggggacccugaaccaccauugcuuugccuccaguuugccucuccccuuccuggagacacacaguaggcccuuagccuaauacaagaggcccagcccugcccugcuggcccccacugcucccuuccugagccagucaaaccucucccacaagcucuccuguuucucuuucccccucuguccuuucauagcuuauuacuccaaccuuugaugcugucucucccuccuucccuuaucccacucugaaccucccacgucuuccuagcuccuaucuuucuuccauguagagacaugguaaguauuuuagcccucagaacuccugucaccugacuuuauacucugggcaaugguuaauccaagucucuguaugagaaaggcucuaaaguuacagauccugacucagauuccaucuucuccacaagaggaaaccuggaccuuggccaggucacugccuucucugugagccucauuauucccucaucugaaaaaagggaggugauuguagcacuuucaugaguguagggagaaagggacgagaagaagaauucaaggcucacuggggcccuucacaguggcucacaccuguaaucccagcacuuuaggagaccaagguaggaggaucgcaugcgcccaggaguuugagaccagccugggcaacauagggagaccccaucuguacaaaacaaaaaaauuagcugggcauggugguacauaccuguagucucagcuacuuggggggcugaagugggaggaaggauuacuugagcccuggagguggaggcugcagugagcugugaucgcaccacugcacuccagacugggcgaaggagugagacauugucucaaaaaaaaaaaaaaaaaaaaaaaaaacaaggccaggcacgguggcucacacuuguaaucccagcacuuugggaggccaaggcggguggaucaccugaggucgggaguucaagaccagccuggccaacauggagaaaccccaucucuacuaaaaauacaaaaaaaauugccaggugugguggugcaugccuguaauccaagcuacucgggaggcugaggcaggagaauugcuugaaccugggaggcggagguugcggugagccgagaugguggcauugcacuccagccugggcaacaagaacaagacucggucucaaaaaaaacaccuacuggucaguguuuggcauacaguggguguuucuacuguuuucagcuucaucucugccuaaggcacaaagucuuuggcugauccugggugcccagcagugcguggcaucucacaguguaccuccucagcauggagcugugcagaguugggaucugagagaggcuccagacacauucuuacccucgaggagugucuggacagccucuuugcgggucucccugccuucagccuucagccuucagccuuguucauuuaauccauuauuuugaacacaaaagcccaaaucugauagggccaggcacuccuggacucuacugcccucaggauagaguccaaacugaucuacagccuagguuuggggcugcugcuuauauucccagugcaccucacccuguccugucaaaccacuugucacacucuauuggaauuacuuuuugucagggacacuuucucaaaccugagaaauauacuaacuccuuuuauuuauuuaucugugugugugugugugauggagucuugcucugucacccaggcuggaagugcaguggugcgaugucagcucacugcaaccucugccucccggguucaagugauucuccugccucagccuccugaguagcugggauuacaggugcaugccccuacgcccagcuaauuuuuguauuuuaaguagagacagggcuucacuaugcuagccaggcuggucuuguacuccuggccucaaguaauccguccaccucagccucccaaagugcugggauuacaggcgugagccaccaugccuggcccaucuuuuuaaagaaaacauuuuucggccgggaaugguggcucaugccuguaaucccaauacuuugcgaggccgaugcgggcggaucaccugaggucaggaguucaagaccagccugaccaacauggugaaaccccaucucuccuaaaaauacaaaguuagccagacgugguggcucaugccuguacucucagcuacucaggaggcugaggcaggagaaucacuuuugaacccgggaggcggagguugcggugagccaagaucaugccauuacacuccaccugggccacaagagcgaaacucggucucaaaaaauaaaaaaauaaagaaaacauuuuucauggacccaucuccccgcaagauguuaaccugaaucauuuuuaucauaucacuuagguaaaacauaaaacuggguauauauauaaaaaaaaaaccacuucuuuuugcuuuuguucuuauaccuaaccuuaaaaucaaacuguuuccaaaguagauaaauguaaaaaccgugacauuccaccugacuguguuaacugaaaaugguggguggugcuuugcugacugcacugcaggaugugguguggcaaaggcacagacucagcagaguagaucuggauggucuuaggccccgaugcuccuacuggugaugaaaauggaaacccaaagccaaacauccuucuagagaacuggcgaaccccucaaggugacacauccacaggucccaccuggagaaauguaaauguaaggaaaggaaacugggcauccccuggagggaggggacccgugguggccaccugcucuagagucaugccgagaguuaagagcaguggggaccacccagcccuccuugauggaaacugaccaugaaucccaugucagccccagcugcacaccugucugguaacuccucccaguuaguucauugcccucagcucauuuggucaauuaccagcuccuguacaaauaccccuuaaauauuucaggguuuuggcuucuuuccuacccucaucuaaaccaucauuaucugaucacaaucauuuaucacuccccaacuuaaaacccuucaggccaggcauggugguucgugccuguaauuccagcacuuugggaggcugaggcaggcaguucgcuugaggccaggccagguguuuugaggccagccugguuaacaugguuaacuucuucaauacuaaaaauacaaaaauagccgggcauggugguacaugccuguaaccccugcuacucaggaggcuaagguacaagagucacuugaaccaggaggacgagacugcagugagaucgcaccacugcacuccagccugggcaacagcaaaacugucucaaaaaaaaaaaacaaacaaacaaacaaaaaaaaccuucaguggucuggcaggguaacucauaccuguaaucccagcacuuugggaggcuaggaugggagacuuucuugagcccaggaguucaaggcuacagugagcuaugaucaugccacugcccuccagccuaggugacagagcaagacccuaucucuaaaaagaaaaaaaaaaaaaaggcugggcacuguggcuuaugccuguaaucccagcacuuugggaggccaaggcggguggauuaccugagguaaggaguuggagaccuaccuggccaacuuggugaaaccuuguccuacuaaaaauaaaaaaaauuaggcugggcgcaguggcucaugccuauaaucccagcacuuugggagguugaggcgggugggucaccugaggucaggaguuugaggccagccuggccaacauggcgaaaccccgucucuacuaaaaauacaaaaauuaaccagguguggugcugugugccuguaaucccagcuacuugggagacugaggcaggauaauugcuugaaccugggaaacggaaguuggaaugagccgagacugagccaccgcacuccagccggggcaacagacugagacucugucucaaaaaagaaaagaaaaaaaaacuagcugggcgugguugcagguaccuguaaucccagcuacuuaggaggcugaggcaagagaauugcuugaacucgggaggcagagguuguagugaguugugauugcaccauugcacuccugccugggcaacagagcaagaguccaucucaaaaaaaaagaaaaaaaaauucaauggcuuuugccagccuaaugacaucaccggcccgugucuacaucuugaaccucaacccugguccccuacauucccacuacauugauccaccuccccagaccauuuuccucccaccccugaccaggaggcucccagucccuaaaggagcuguaugcucucacagcagauagaugaggucacagcacugggacacuaaacuguaauugcuuuuagacugcaccaaauucuagagguguggagagcacugaccuaguguucacaguuacagcccuaguguagcauagugcuugguaucugguagguaggugcucaguaaauaauguugaaguggcagaaaagggcuauaaagugguggaagggucaacaggcaggaccucagaaguaaggaaauguaauggcuccuaaucaugaaaaauagccuaaagccugggagcaucauuuuuuccuguauuuauuaauuaauuuuuuuuuuuuuugagacggagucacucugucgcccaggcuggagugcaguggcgcaaucucaguucacugcaacuucugcugcccagguucaagcaauucuccugccccagccucccgaguagcugggauuacaggcaccugccaccaggcugagcuaauuuuuguaguuuuaguaaagacaggguuucaccauuuuggccaggcuggucucgaacucccgaccucagguggucucacuucagccucccaaagugcugggauuacaggcgugagccacugcucccggccuccuguauuuaauuuuuuaaauuucauuuuccauuaaggacauuuaagaauaucuauaaaagcugaacgcaggcugggcacaguggcucacaccuauaauuccagcacuuugggaggccgaggcaaacggaucaccugggguuggaaguuugggaccagccugaccaacacggagaaaccccaucucuacuaaaaaauagacaauuagcugggcaugguggcgcaugcuuguacucccagcuacucaggaggcugaggcaggagaaucacuuuugaaccuaggagguggagauugccgugagcgagauccugccauugcacuccagccugggcaacaagagugaaacuccaucucaaaaaaaaagagaaaaaagcuaggcacagugucucacgccuguaaucccaacacuuugggaggcugaagcggguguaucacuugaggccaggaguuguagaccagucugaccaauguggugaaaccccgucucuacuaaaaauagucccagcuauucgggaggcugaagcaggagaaucacuugaacccgggggugguggagguugcagggagccaagaucaugccacugcacuccagccuggucuacagaacgggacucugucuuuaaaaaaaaaaaaaaaaaaaaaaacuccacaaaaguaagagaauauaauaaucaaccaccagcaccagucacucggcuugaacaaguaucaacauuuugccaagcuuguuuuaucucucccuggggacaucucuuuugauugucuccuuuaacccucccaggagcgauucauuagcaagucaaugacucaacuaacugguuugcugguacuugccuggggcuaggcaguugggaggguuagggaaaaaaguaguuuguaaaggauuuucacaggucccuucgacauccucuaagcccaauuuauugguuggacuagaucuguggcuaccuggcaggguucugggccccaauccuuuacuguaacaaugguuggggauauaccacgugccaggcccgggacucugugcuggguauacagugguagaauggguaccuucccauuacuuccuggcugucaggacuccuuucauaugcaguuuccugagggaagccuucccaaagcccauaccggggcaggggcagcagucccccuggcgagggcuguugggugagaaaggaaccuggugcagaggcuguaguggucagcugugggggaggaguguccuggccuagcccccagggcagccagggauguaggagcugcucuccucuggcuccaaagcuagcugcccucugauuccucccacaggcaacuucuauuuuuccccaucucaaggccuuucaucuguguguauguuuuuugaacuucuguguaagcuuuuuggcuuaaauaaagggcuuggccugcaaggacaaguaaccaguaggcuaaaccauugguuccuaagccugggcggccagacuuucuggguagcuggucugaaaacacauugccaacuccaccccucacccccacuagaucaauaaagcagagggggaaaucacuaacaguuuuuaaaaaucucucccaggcugggugugguugcucugccuguaaucccagcacuuugggaggccaaagcgggcagaucacuugaggucaggaguuugagaccagccuggccaacacggugaaacccugucucuauuaaaaauacaaaaauuacuugggcauguugucgugugccuguaaucccagguacuugggaggcugaggcaggagaacugcuugaacccgagaggcggagguugcagugaacugagaucgcaccauugcacuccagccugggcaaagaagugagacuccauuuccccccccccaaaaaaaaaaaucuccccuaaggugauucuaauacagagagcugccuucaagagcaccuggauaugguagucucagugugaauggugguaccaugauguuugggaaaggcgccucagugccuuugcuuccuugacacaaaaaugagaggguuucugccugcauucauuagcugcugcucccagcaucacagccuuugucagccuccugguguuccucccacccccauuugccacagugauuccucccuuguuccucagcagccucucagauagagcccuguuuuaugguagagaccggcuuuccgguucccagccuguguuuugccauauacaucacagaguucacuuugaccuucuuccuaccaucuccccaaggaccuugaguggagacaagucacagguucuuuuccugacuuaggcacaggcugggcagcuggaagggcugcagaaggggcacuggcagccacucaguccccccgcguugccuugcccagccccucagcugugcauuuuucugggcuaagaagacaaaacagacagaugcuaggcugccaagugaucuggacaggacagucuugugggggaguguguggagggguguuuuucuguucuugaacccucagccaaagugggaagugccuuuaggggcuaggugcccacacagaugcugagaaaugcccagacugcccuccaugaggcugccugcucaacaacacuccuuacuuugcuugacccaggucacugugaccugcccauuuuuccccugcauccagggcugagguggagaggggcaguguacuccugcagcacagguaugggaggaggcagcugugggagggagggagagaaggacacaggcacugcuccugugcaaggaagacucccucucacucuucagcuggcagugggguggcugcccagaaccaggcugucuggaucaaacccagcuuuugcacuugugaccuucaacaaguuucugaaccucuccgaucuguuucuucaagggagaucaucauauaaccugugugauaggcugagauugaaugaauaauuagauaugaaaugugaauagugccugaggccaggcgugguggcucacaccuguaaucccaacacuuugggaggcugaggugagcagaucauuugaguucaggaguuugacaccagccuggccaacauggggaaaccccaucucuacaaaaaauaccaaaaaaaaaguaccugggcaugguggcacaugucuguggucccagcuacucgggaggcugaggugggagaauuaccuaaacccaggaggucaaggcuacagugaacugugauuccaccacugcacuccagccugggugacagagugagacccugucuuuaaaaaaaaaaaaaaaaagcacagcaaagcaguggaggcccuaaagccaggaggccugguuuuaaaucccagcucugcacugggaagaugugugacuggacaagagcuuucuucucauugagcucaguucucucuaguacuuuggggacacugcccucuacccuccaggcuuguaugcagauuaaacauaaugcaagugagguggcuggcaugauacugcuaucaaagguguuugaguaaguuuguucccuuccuucaucccaccuagcuguugagcccuuccuucuuuuuuuuuuuuuuuuuuuuuuuuuuuugagauggagucuugcuuugucgcgcaggcuggagugcaguggcgcaauuuugacucaccgcaaccucugccuuguggguucaagcaguucucucagccuccugaguagcugagacuacaggcacaugccaccacacccugcuaagcccuuccucucuuuaggguuuucccacagcucuagucaggauucagcucaaccagcguccacugaagccuguugguaugugugugcauuggagcaccauaguggugaagaggggcaaauaaggaccccagagccagggccccuccuggcuggaauggaaugggagagaagggccacagaagcuucuggcucugcccugccuaugagccuuccagcccgacagccuggugcugucuuugagucaccuguggaauagaugcagcugcaguuagcuagguuaggagaaaagacaggaccagaagaaggaccuagagugugaaauuucagucaagccaccguuuagaccacuuaaugguuuuccauggugcucuggccugguugucagcccuguccaccucugagcucaucagcuaccauucaccgguuccuuaagccaacccuuuccugccucaguucaguugcauuggaggaccauagaggugaaggagggcagaugagaaccccacggccagggccuuuccuuggaauugucuagaacauucuuagcuuucuguauggcuagcucuucuaauccuuaugucucagccuuccagaacccuuagcuaugggaguuucucuuaucuuuauaaugcccccuuuauucuuguuucuguugggggcuuguuggugguuauucaccuaaugguuaauagucagucuccaugacuaggugcacuauaagcuccacaggguggagugcaugucuguuuaauucacaaaggcaucccagcacugagaacugggcccaauauaccaggcacucaaauaauauuugaaugagcaagaagccuugaagagcagcaggaaggugagaagcucuaacuugacuuuuuuuuuuuuuuuuaagacggagucucacucuguuacccacgcuggagugcaauggcguggucauggcucacugcaaccucugccucccggguucaagcaguucuccugccucagccccccaaguagcugggacuacaggcgcgugccaccacacccggcuaauuuuuguauuuuuaguagagacgggguuucacuauguuggccaggcuggucucaaacuccugaccucgugaucugcccaccucggccucccaaaaugcugggauuacaggcgugagccaccacgcucgaccgacuuuuuuuuucuuugagacaaggucucacgcugucacccaggcuggaguacaguggcacagucacagcucacugcagccucaaacuccugggcucaauugauccuaucaccucagccucgcaaguagccgagacuacagacacgcaccaccauacccagcuaauuuuuguacuuuuuguagacacaggguuuugccauguugaccaggcuggucuggaacuccugagcgaaagccauccgcccaccuuggccuccuaaaguacugggacugcaggcgugagcugcagcacccagccugacucuccaggcuggagugcacuggcauuaucacggcucacugcagucucugccucccuggccucaggugauccucccaccucagccuccuggguagcuggggcuauagggcacaugccaucacaacagcugauuuuuuuguauuuuuguagagaugugguuucaccauguugcccaggcuggucucgaaucccugggcucaagugaucugcccaccucggccucccaaagugcuggaauuacaggugugagccaccgugcccagccgggggagggucuucauguccgggcucuggagucuggacuugauccuguaggcaguaggagacaaauggcaguuugcaaccuccuccucccagguucaagcaaguuuccugccucagccuccuaaguagcugggauuguaggugccugccaccaugcccagcuaauuuuuguauuuuuaguagagacaggguuucacuauguuggccagguugguguguguucuuauuuaacucugucuucccacuaugaaccucuguguuuucuuccauguucugggguccugagacauaguaagugcuucauagcuguuuguuuugguuuguuuugaaacaguaucuuguucuauugccuagacuggaauccaguggugcgaucauagcucauugcaggcuccaccucuugggcuccagcuaucuuccgaucucaggcucccaaguaguugggaccacaggggugcaccacuacaccuggcuaacuucuuuuguagaaacagggucucccuguguugcccaggcuggucuugaacuccugggcuuaagcaauccucccgccuuggccacccaaaguguugggauuacaggugugagccacugugcccagcccauagcuguuuuagauuaagcaaauugaucggucuuguauauucauuccagauauguaacugguucaucaaugcccggcggcggcuucucccagacaugcuucggaaggauggcaaagacccuaaucaguuuaccauuucccgccgcggggguaaggccucagauguggcccucccccguggcagcagccccucagugcuggcugugucugucccagcccccaccaaugugcucucccugucugugugcuccaugccgcuucacucaggccagggggaaaagccagcagccccuuucccacguggggagcuggagucucccaagccccuggugaccccugguagcacacuuacucugcugaccagggcugaggcuggaagccccacagguggacucuucaacacgccaccacccacacccccagagcaggacaaagaggacuucagcagcuuccagcugcugguggagguggcgcuacagagggcugcugagauggagcuucagaagcagcaggacccaucacucccauuacugcacacucccaucccuuuagucucugaaaauccccaguaggcaucugccaagaagggugcugaaggcuccagccagcuguccuggguuuccguuuugguucccuuucauacagaggguuuucuauggaucacugccaaacauugggaucaucuccucuguccagaggucuucaacaggaagaugccagcuggcaccacugcacugugaugggggcccucuccucugcugacucugccguuucuccaggccuccgcucagugaugagaccaagagaucggagacaagcauggugcugcugcuucugcugcuucuccagaaaaucccugggacaccuuuguuccagccugguuuccugggcugggcucaggaaagcugccaaauucaguccuauguuggguccaagcugccccugugcuguuucugucaagccagguguggacauuccaaguucauaugcgugaacaaaagaaaagaggaacccaguggauguaacagaaccgacuccaguugaauguuuagauuuuugcuaaacuguuuucuuuuucccuuuuuugcugugguuugcauucacggcaguaguuagcccagguguggggaacgagagugcacugcaugauagcguucuggugagcugggaaggacccaccacugccacugaggauuguuuuggaagaaaggaauauuuuuaucuuggggaccagcuaagucucugcaguagugugaaauuccaaaugguuguuuuaucauugguuugguuuaccaaaaaaaaggcagggaaaaaaaaaaaaaacaaccguaugagcgcauuggcuugucugccgcaggcacagaaggguagaaagccacagcagggggcaguccagcagacucugacucaacuuucuaggcaccuagcagagaaagauaagaucaaaagguguuugguuuuucuuuuaauuuuuauuguaguuuuuuugggugggugggggaaguaaacuagacugaagcgauggauuuuuuuuuucuuuuuuuucuuuaguguuuuucccuuuguucuugaacacuuuugcccugcagccucaguuuugaauucuuuuagcaacuuggauuagaggggcccauaugucagaagcucccagcaccuccuacuugggagaaaagugagccaucugcuggucaggaaguccuccagagaggcagcuuuucccacaaugguggcaggaaacuuuggggaaagcaggaaugguguccacugcugcggaggaacugccuucagagaagguggggcuggaaaaggguuagaagccuccuagcugggauugucuuuguuucaccuuucuuuaaauuagaauuacagaagccccugcccagugaacagauaacgauuggucuuaugcuccucccuuucccccauuuuuucuuuugcuguuuuguuuuuuguuuuuuguuuguuuguuuguuuuuuugagacagagucaugcucugucacccgggcuggagugcaguggugcgaucucagcucacuguaaccuccgccucccggguucaagcaauuauuugccucagccucccgaguagcugggauuauaggcacccgccaccaugucuggcuuuuaguagagacgggguuucaccaucuuggccaggcuggucuuggaacuccugaccucgugagccaccacgcccagccucuuuugcuguuucauugcugacaguguucaacaauaugccccaucuuuauauauccuaagaaacacuaauccuagguuauugcuagccaaaauauuuuuguccugaguagugucacugggccaaaagauagaucaggacgacagccuuuaguuuuccugaaaucaccaggucaggcacaaggagaaaagguuccuggauacugacuaacuuggguggguggaucuagccaggagaaagacaguaacauguguucuguacuuucugggaagaucccugaagccaucacagaggcuccccaacuucugagucgcccaucuguugcugugggagugugaacggaucgcugaaggagagggagcuuugcucucucuaggugggcaaguuuccugggcucucuguguugccucccucuggcuucuuccucccgugcccucuccccgugugccccagggggaucagggauccucacccuccugaggcccaguggggaagaaugaacauggcuucauccagguuaacugaugcugccauuugcccagccucuuccaucccagcccugucagugagcccaggucuggugcaacugcugcaggaugccuguaguagggaacucuggaaguguauugggcugaggugggauuuucccuccccacagugcacugagcaauggaggguggugagggagccaugcugcugaauucugguuggcauuuccccauuauguaaaaugggguguuggguagggcagacucugcuuggguuugguuguaagauaaaccuggaggagaagcacaguugucccauugaauuauuugagcaaaaacuacuguaaauaacuuuuuugucuuuugucaaauaaaauuuuuuuuuguuuuuuuaagcagaaaca

SEQ ID NO: 191263 - RNA, 60020 nt, Homo sapiens
auugcgccugcgcagggagcccaaggcaagagccgcuaggcugcccugcccgaagggcucaacugucagugagccugcgcaggaggccaauaggcugccaauacuccuuggacuccccgccagggcccugcugucagugcgccugcgcgcggguccggcgccgagguucuugacugcugugccggacgccagguguagccaugcagcgagccgauuccgagcagcccuccaagcguccccguugcgaugacagcccgagaacccccucaaacaccccuuccgcagaggcagacugguccccgggccuggaacuccaucccgacuacaagacaugggguccggagcaggugugcuccuuccucaggcgcgguggcuuugaagagccggugcugcugaagaacauccgagguagcggcuccggaggggcugaggggcgaagggcggcgaccuggggcgcgggccaggcgcccugagggagggggccccacgagaggaccgaggccgaggagcgagcccugcggcgggaggcacccgggagggcggaccugcgcugggggcgccgaggaaaggaagacccgaggcgggggagggagcccugcggcggggguucccaggagggccugcggcauggggcucccgggacugacuccccgaggcggaggaagaagacauggggucgccugggauaggcgauucguaggaugggagcaggcucccgggauugaggaccugggaggggcagucguagauugggaucucacucucguggguuucuucacuaacuugccaccccggcgcgggacaagcgagacucgggucccuuuuuuuuaguuagaaggagauuuuuccccagaccuuggugggcggcuugcugucauccaggcucgcgggaccccuccgcgcuaaccgcagcuccuugaacacuugccacaucagaggauguucuggggcuuuuagguuucgguuuccucccugaauugaggcuuuuccugaaggggaaggaacuggcuugguuaaucucugaauucccaucaccuuccuuggcaucccagcagcgcccgauaggcguguguugacugcacuugcagaacaugguaaggaacauguuuugcucuuuaaaagcagguuccccuccaaaaucugaaccuugggguuguucaguugaccacugaauccccagcaugccacaguuuggccacauccccuggagaaguguuuagguugaguuuuaaucauauuuuacugauucguauccaagcauccauccuugugaauucuacucaacuuuuuguggugggugugagauuugacuccugccuuauauccucuagguguccaauaggaaggugauucuuuggugguugggauuugcaaauuuaguaaauuuuugcauuuguuagguggggcccuguuuggcuagguuggaaacugggguaggaggaacauuagugguucaggacccaaagauagcuugaauggguaugggaaauugcauuucuccuuuuuuuuuuuucuucccccuuuugcccuuucguuucccuccacugcugggauggauuauuacuuuauuuucuuugacuagcaacaaguggagugaaguaguuccauauuuucugucucaaaaugugguuggcucucuguuucagugguuuguagauuaacucguuacccuccagaaugauguguguuccuuaaaccuacaaccuauugcuaucaaagacacuaugugcuuucauuugguaaaaacugaccaacuguucccaauugcucaugucuuagcuucugcuuugucuugaccaaacuuuauucggacuucucucuucccuuaugggccccucaacucuugcuuacccccagaucugaccaggcaggcacuaaagcaguggaauaugccucccucuggucaguuucuuuugagaaccggcugaccacaguaggaugcuguccuguugggcuacacugcucauuuucccuugcucguccagguuccuauccaaagauucugcuuauuucugcuugcccguccuuuaucauauaaaagaagacccuuuuucuguuggauucuuuuuuuuuuuuuuuuuuuuuuuugagacagagucucgcucugucgccaggcuggagugcaguggcgccaucucggcccagugcaaccucuaacugccugguucaagcuauucuccugccucagccucccgaguagcugggauuacaggcaugugccaccacgcccagcuaauuuuuuuguauuuuuaguagagaugggguuucaccauguuggccaggauggucuccaucuccugaacucgugauccgccugccucagccucccaaagugcugggauuacaggcgugagccaccgcgcccggccucauuuuuuuuuuuuuuuuaauuagagacaggguuuugccauguuggccaggcuggucucaaacucuuggcuucgagugaccauccacccaccucggccuccuaaagugcugggauuacaagugugagccaccaugcccaaccucuguuugguucuugggccucuguuugauuauuuuuuaaaauuuauuuuauuauuuuauuuuuuuucugagauggagucucgcucugucacgcaggcugaagugcaccggcacaaucucagcucacugcaaccucugccucucggguucaagugguucuccugccucagccucccuaguugcugggauuacaggugcacgccaccacgccuggcuaauuuuguguuuuuaguaaagacaggguuucaccauguuggccaggcuggucuccaacuccuguccucaggugaugcauccgccucugccucccaaagugcugggauuacaggcgugagccaccgcgcccggccggccuauguguuugauuccugagccucuugcagauaucugauauuggagcuuucucccuguagaaauagucuuucuucuuuucuuuucuuuuuuucuuuucuuuuuuuuuuuuuuuugagacagagucucgcucugucgccaggcugaaaugcaguggugugaucucggcucacuguaaccucugccucccggguucaagcaauucuccugccucagccuccugaguagcugugacuacaggugcccaccaccacaccuggcuaauuuuuguauuuuuaguagagaugggguuucaccauguuggccaggauggucuuaaucucuugaccugaugauucacacgccuuggccucccaaagugcugggauuacaggugugagccaccacgcccgaccagcaauagucuuucuuucuaauaaaguuucucuuggccgggcacgguggcucacgccuguaaucccagcacuuuggaaggccgaagcagguagaucaccugaggucaggaauucaagcccagccuggccaacauggugaaacaccgucucuacuaaaaauacaaaaauuagccgggcauggugguaugugccuguagucccagcuacuugggaagcugaggcaggagaaucacuugaaccugggaggcggagguugcagugagccaagaucccgccacugcacuccagccugggcgaccgagugagacuccaucucggaaaagaaaaaaaaagucucucuuuaucuaaguccauuuuuuuuuuaauuugauaagccaagcacaagguacagugucccuuuucucauuauggaauacagccucacaagaagucugaaauaaguuacuacacucaacacauuuuaccgaugauguaugcgagguccaaagauguaaaguaacuuuucagagaucacaccacuacaaaaaagagcuagauuuuuuaagguuaggucuuuggacucuagaacucaugugaucuauaccuuaacaaguauucucaucaaaaaccacuggaggccuggcccaguggcucauaccuauaaucccagcacuuugggaggccagugugggaagaucacuugagcccaagaauucaagaccagccugggcaacaucaggagaccucaacuuuacaaaaaauaaaaauaaaaauuagcuaggugcaguggcacaugccuguggucccagcuacucaggaggcugaggcaggaggaucgcuugagcccaggaggucaaggcugcagugagaugugaucgcaccacugcacuccaaccugggcaacaagcaaaacccugucucaaagaaaauaaaagaaaauaguccagaguucuggaauuugaggucaggaaagauuagaauuaauuguauagaaagagaaaggaaaaaacccaacaacacacacacacacacacacacacacacacacacacacaccccucuuccaaaucagaguauugagugcuuucccaggacacacacacacacacacacacucacacacacacacaccucuuccaaaucagaguauugagugcuuucccaggacacacacacacacacacacacacacacacacacaccucuuccaaaucacacacaccucuuccaaaucagaguauugagugcuuucccaggacacacacacacacacacacacacacacacacacacacaccucuuccaaaucagaguauugagugcuuucccaggagguuugagaaaaaucaacacuuuaagcacucuugaauucacgguuuuaacuuguuaauucuaagaacaauagacuuagguuuccuucccuccccaacucaaaccuuguuaauucuaagaacaauagacuuagguuuccuucccuccccaacucaaagcugcugaccuggcaaaaccccaacagguagucggguuucacuuuccuuuuugcaacugguuuuucuuggaacuaauuuacacaaauaauuuugaaauuuucacgugauuuaucaaaaaaugcuucuugguuuaguuauuuaauuaaaauuaagucuuuacaaguagcagaucaaaaaagugguacuuggcacaauccauugccugcaguggguacucacuuauguggaucuggguaaauguugguguauccaaauugaaagaaaaugaaaagcauauguuguauacauugaauuugucuuuuuucuuccauagaaaaugaaaucacaggcgcauuacugccuugucuugaugagucucguuuugaaaaucuuggaguaagguaagaaugaagaaauaaauucacguuauaaccaaacacacuuuauccaucuuucagggacaaagcccaaaaucucugauauaaacuguccucauuuuaaaucuaugaagugcuuuaaaacagcagaaucccuugccugcugguuuuguuuguucauuuguuuuuugagauagucucuuguucacccaggcuggaguaucucggcucacugcaaccucugccucccggcuucaaguuauucuccugccucagccuccugaguagcuaggauuacaggugcccaccaccaugccccacuaauuuuuuuucgguuuuuuuuuuuuuugagacagagucucgcucugucucccaggcuggagugcaguggcgugaucuuggcucacugcaagcuccgccucccggguucaugccauucuccugccucagccucccgaguagcugggacuacaggcgccugccaccacgccuggcuacuuuuuuguauuuuuugguagacacaggguuucaccauguuagccaggauggugucaaucuccugaccucgugaucugcccgccucagccucccagagugcuggaauuaccgcgcccggcugccccacugauuuuuguacuuuuaguagagaugggguuucaccauguuggccagacuggucuugaacucuuggccucaagugauccgcuugccucggccucccaaagugcugagauuacaggugugagccaccgcgacuggccaccugcuguuuguuuucgcuguacaaauccuauguuugcuauuacuguuuauuccuauuuuaguuuauuuuuaauuuuauuuauuuauuuauuuauugagacagagucucacucugucacccagacuggagugcaauggugcgaucccggcucacugaacccccuggguucaagccauucuccugccucagcuuccugaguagcugggauuacaggcaugcaccaccaugcccagcuaaguuuuguauuuuuaguagagacaggguuucaccauguuggccaggcuggucucgaacuccugaccuaagguggucuggaguucugaccuaaggugggccaaggucugcccaccuuggccucccaaagugcugagauuacaggcauaagccaccguguguggccuuauuccuauuuuaaauaauguugcagacaaaucuucaucaaguuuguagugaccaacuuuuuacucucaaguucagaauaauugaauuauacacacugggaaauacauaagaaccaauagggaaaaaaauguuaguaagaaaaucaaggcuacaccccuaucuugagcauauuucuagguuuuccuaaagauuggaauaugcccugguauuagauuuaaagacacuaugcaaaacaggcacuuuuuaguuguauaauuugggagaagucauuuaacccuucaguuucuguaccuguaaaauggauaacaauaaugagaugauguacauaaaguguugaagcauaugauuaacgcuuaguaaauuuuauagauagugauacagaaaauuaaaaaauuagccggguacugugcaugcaccuguagucccaccuacacucaggaggcugaagcaggaagaucccuugagcccaggaguucaagguugcagugaucuaugauaagcuccugcacuccagcuugggcagcagaauaagacccugucucagauagguagguagguagauagauacauauauacauacauacauacauaguuacauagauccaucucuguguauggcuguagguucuagggucuagauuagaguggggcuccuuuaaugaucucaguagaggaucuggugcuuaaauacuucuuuuuuuugaagcggaguuuugcuuuuguugcccaggcuggagugcaauggcacgaucucgucuuaccucaaccuucaccucccagguucaagugauucuccugccucagccucccgaguagcugggauuacaggcaugcgccaccaugcccagcuaauuuuguauuuuuaguagagacgggguuucuccauguuagucaggcuggucucgaacucccgaccucaggugauccacccaccucguccucccaaagugcugggauuauaggcgcgagccacugcgaccggccuuaaauacuucuuaaaaugaagauuuuguuucuguuagaaaauuggcaacaguggggaaauauggccuucucuucugaaauuuuaguuacauguuguuugugguaacaguaaccaaagaaucaaaacaaaggauuauacugaauuacuuccugugcuguugcuuaguaauugauaacagaaguacauugugaaacaagaucacuguagaacauuuaacugacuuccaguaaauauccuuuggaucagaaucuccagggaccucaucuuagcccuuucuuuuuuuuuuuuuuuuugagacgaagucucacucuguugcccaggcuggaguucaaguucagugguguucaagugauucuccugccucagccuccuaaguagcugggacuacuggcaugugccaccaugcccgguuaauuuuuuguauuuuuaguagagacgggguuucaucguguuagccaggauggucucaaucuccugaccuugugaucugcccgccucaggccucccaaaguucuuuuuuuuuuuuuuuuuuuugagauggagucuugcucugucacucaggcuggagggcaguggcgugaucucggcucacugcaaccuccaccucccagauucaagugauucuaccaccucagccuccugaguagcugggacuacaggugugugccaccaugcccggcuaauuuuuguauuuuuaguagagacaggguuucacuauguuggccaggguggucuugaacucccgaccucaugaucugccugccucagccucccaaagugcugggauuacaggcgugagccacuguccccggcaugacucuuucauaaccacauuucagcccucucaguccucucaaaguccccuuuacuacuuguuucuuguacauaauaguugcuuacuauuugaccugaauggaauuuguucuaauacagucuuucuuuucaagggagccaugugcauguuuguggacccaagugcuauugauucauucagugaauauuuuuggaaagcucacuauguacuaggaauucuuccaugaauuuggggcacaugagugaacaaaacagacaaaggaacacuauauugcaguguuccagaaggaacacuauauugcacgucucugugccccaccucauaacucaaauucuguaggacuccuuagagcuguauuguucuguauaauaacaacuagcuucacguuuaaauuaauuagaaguaaauuaaguaaaaaauuccucaguuacacuagccauauuucaaguacuuaguagucacuauggcuaacggcuacuguguuggacagagcagauauagaacauuuccaucaucgcagaaaguucuacuagacagugcugccuuacagguugccagugggauuagcccuacccaccacuccauccaguugcucacaguaguaccaaugcaaucaacuuguuaauggaccuuuguacuguuuuuaccuaauuuccuauuuuacccucccuagaccccccaaucccugugcccagaguucaccccaagauuaauuacuugcaagcucuuauccuggacccugcuuucuagggagaauccagcuuagacaagcacuccuaguaggcccucaauuuuaugaacaaccauugauuuauaaagguuuuuuuaacaaguaagaaacaggccaggcgugguggcucaggccuuuaaucccagcacuuugggaggccgaggcgggcggaucacgaggucaggagaucgagaccauccuggcuaacauggugaaacccugucucuacuaaaaauacaaaaacaaaaaagaaauuagcugggcaugguggcgggcggcuguagucccagcuacucgggaggcugaggcgggagaauggcgugaacccgggagguggagcuugcagugagccgagaucacgucacugcacuccagccugggcaacagaguaagacuccauuucaaaaaaaaaaagaaguuagauagaaacauugucacguuaaauauacaugucaauuguaagaagcauuaaauuucagaaauguuggaacacaggaauaaaauucuuucauaaucuagauauccuggcccaugacuucuuuaaaucuuuauuuaaugccauguccuuugcuaaacaaaacaacccccugguuuugggugguuuuauauacucuaaucagugauuuugguuuuguuuuguuuuguuuuugaguuggaguuuugcucuuguugcccaggcuggagugcaauggcgccaucucggcucaccgcaaucuccgccucccggguucaagcaauucuccugccucagccucccgaguagcugggauuacaggcaugcgccaccaccacgccuggcuaauuuuguauuuuuagaagagacgggguuucuccauguuagucaggcuugucucgagcucccaaccucaggugauccacccaccucggccucccaaagugcugggauuacaggugugagccacugcgcccggccgauuuugggguuuuaagcgaugaauaccaaaugucaguuuaggaaaauauuaaguggucacgggguuaguuuagguuugauauuuuaugcuaugacuccgguuuugcucaacuaugugacuccccuuaaacuaaguccaccuauaaguacuucugaaagccuggcuuuacacugugcuuguuaugucaaacugaugaggaggauaggggaauaggaaaacacgaaauuugcugcuuuaauuuaucagcuguaauaaugcuucuguguaucccaagauauuauucuuaaguguucuuauuaccauggguucaguguguaccauagaggccaauguagugccucugacucccagucuauguaugacuuguagaaagauacuuuuuuuucaaucugguuaucuaguagaucaguaaaacccuuugccugcacucucuguugacacccagccaggagggaggaugauaugcugggcccaacuaguaauuguaaaugaagcaggauaaugaaucacaggacuucgagcugcucaaauuuaauucccauuauguauuuucuugaaacuggagcauugugagggaguacugacaauggaaaaugaauauaaauaaaguuaaagccuucauauguauuucauucaugcuugagucauaccuggugcucauaaaucaauccaggauuaugaggguagauguugacuucaguuugguuaaaaggaaguacaguuugagcauugaguagacauggagauguggaguuuuucaagucuuaaauuuaccaagagagaggagggucaaggacagaaggcugugggaggccuauauugauucagcaggagaguucccuaucuuaacagcaaaggaaggagagaguuucuaggagggguauguuugaauuauugauuguuccuuccaaucuaacuucuguuaguguagauaauauaaaguuuauuaugucuacuauauacugcagggauuauuauuaagcaaauaaugauagacuugcuuauccuauuguaauuuuaguuccuugggggagaggaagaagcugcuuaguuauauccagcgauugguucaaauccacguugauacaaugaagguaagaggaucugaguuuguuauguuuuuugaauauaaagugauauaacucaauuauguaaaauucauuuugaagagaauaggaggaaaucugcuucucagugauagaauugugaguaguggaucuuuucuaaacuuucugcacuuucuaaaaugagcacagaguauuuaaaucagaagaagaacuaaaauauguuuaagcauacagaaaagcauaaguagaccacuacccaacuugucaaauauuaauauuuugccuaauuugcuucaagucuguuauuuuuagagcaaaauauuagaaacuauugaagaccuccuuuguacauucuuuuuuuuuuaaugaaauguggucuugcucugucaucuaggcuggaguacaguggugcaaucucagcucacuccaaccuccgucucccuggcucaagugauccuuccaucucagccaccccaguagcuuggacuaugggugcaugccaccacaccuggcuaauuuuuguauuuuuuauaaagacggggucuuccuguguugcucaggcuggucucaaacuccugggcucaagagauugaccugccuuggccucccaaagugcuaagauuacagaugugagcccccacgccuggcccuguuucuauuuauuauguuucuauccuuuucucccuagaaguaauaagcaucuuccugaauuugauguuuaucauugucaugaaugguuuuuacucuuauugcauauuuauguauauccauaaacaauguauaguauuguuuuacauauuuuuaaacuuuauuuuuuugagacagagccuggccuuuuuuuuuuuuuuuuccucuuuuugagauguaaucucucucugucacccagguuggggcucaguggcacuaucuugucucacugcaaccucugccucucaggaucaagugauucuccugccucagccucccaaguagcugggauuacaggcauacaccaccacacccggcuaauguuuuugcauuuuuaguagaguugggguuucaucauguuggccaggcuggugucaaacuccugaccucaagugauccacccaccucguccugccaaagugcugggacuacaggcaugagccacugcgcccagccagaaugugcauuuuucacaagcucuucagagugauucuaaaaccauacuugaugaaauguuucuuguuuuguuagugacaggaaauagaccuuauuuacucuuuugacauuccuagguuaagaaaacuuaguuucagaccugggagaagauguaggauaucuucuuuuuuuguacuuuuuugcccgaucaucauuugcauuuuucacuuuuuuuaaaaaauagauguaauguauaguauuugaguuauuucagaucccucucuauaagaauacauauuuuaauuuugcuuuugcaaguuauagacuucuuuucuuucuuucuuuuuuugagauggagucuugcucuguugucuaggcuggagugcaguggcacaaucuggcuuacugcaaccucugccucccaguuucaagugauucuuuugucucagccucccagguagcugggacuacaggugcacaccaccaugcccagcuaguuuuuguauuuuuuuuaguaaagacaggguuccgccauauuggucaggcuggucucgaacuccugaccucaugugauccgucugccuuggccucccaaaguguugggauuacaggcaugagccaacacgucuggccuacccgguuauuuucuuuuucuuuucuuuucuuuuuuuuuuuuuuuuuuuuuuuuuugagagggagucucgcucuguugcccaggcuggagugcaguggcaugguaucagcucacugcaaccucugccucccagauucaagcaguucuccugccucagccuccugaguagcugggauuacaggcaccugccaccacgcccaguuaauuuuuuuuuuuuuuuuuuuuuuuuuuuuugguauuuuuaguagaggcaagguuucaccagguuggccaggcuggucuugaacuccugaccucaugaucugcccaccuuggccucccaaagugcugggauuacaggcgugagccaccagcccguucuaggcuuauuuucuauugaaaaucacaucugaaaaaauuuaaugaacauuuuugguucaacuauauaauaauguuuuguuguuguuuuguuuuguuuuguuuuugagauggagucuugcucugucucccaggcuggagugcaguggugcaaucucggcucacugcaacuuccaaaucccagguucaagugauucuccugccucagccuaaaucagcuuccugaguagcugggacuacaggcgcaugccaccaugcccagcuaauuuuuuguauuuuuaguagagaugggguuucaccgcguuagcuaggauggucucgaucuccugaccucauaauccacccgccucagccucucaaagugcugggauuacaggcacgugccaccgugccugucccuguuuuguuguuuugagagggaguuucacucgguugcccaggcuggagugcaguggcgugaucucagcucacugcaaccuccgccucccggguucaagcaauucuccugccucagccuccugaguagcugggauuaccagugcaugccaccacacccggcuaauuuuuguauuuuuaguagagacgggguuucaccauguuggccaggcuggccucgaacuccugaccucgugaucugccugccucggccuuccaaaguuuugggauuacaggcaugagccaccgugcccagccaauaauauauuuuugagguaauauuuaaggcagucagugguuucaauugcccacuuuuauucuuucuauuuuucuguaaaaagaacauuguuggcuggguaugguggcucacacccguaaucccagcacuuugggagacugagguagguggaucacuugagcccuuaaguucaaagaccagccugggcaacauggugaaacuccaucuacaaacaauagaaaacaauagaaaaauuagcugggugugguagugcacaccuguagucccagcuacuugggaagcugauauaggaaaaucaccugaaccuggggagguggaggcuucagugagccaugaucacgccgcugcacuccagccugggcaacagagugagacccugucucaaaaaaaaaaaaaaacaaaccaacauuguuuaaccucauuuauaaauuauaaaugacaguuguuggaaauagauuuucaaacuacugaaucacggcuuaguaaugaaaucaauaccuuaaaugaauuuaacuucaucagcaaugcaguucaacaagaauugaccuaguuugcuacucaguugcagaccucaaggauuucuacccuaauuucauaccuaccuaacuugauacuuaaaacauaaaugcuuuauugagauauaauucacaaguuguaugauucacucauuuuuaguaugcaagacagugcuuuuuagaaaguucacaguguuguucaaucacacacaauuugauuugaguuguaagagcucuuuauauguucuggauguaaauccuuaugggagauaugauacacaaauauuuuuucccagucuguggguugucuuuuuacuuuuuugaugguguucuuuggaucacaaaaguuuuaaguuuuuauguaauccaauuuauauuuuuuuuguucauuugugucuuguacuuuuagugucauauuuaagaaaccauugccgaacccaaggucaccaugguuuguucuugacacaguguucuuuaugcuaaauuuaguucaguuggccucugaagcugagauuguguaauggugaagagggagugcaguguuugacauaaugaggacuaauuuuucaaauguaucaaugaaucuuuuuuuuuuuuuuuuuugagauagagucucacucuguugcccaagcuggagugcaguggcacaaucucagcucacugcaaccuuugccuccuggguucaagcgauucuccugccucagccuccugaguagcugggauaacagacgcccaccaccacgcccagcuaauuuuuguauuuuuaguagagacgggauuucaucauguuggucaggcuggucgugaacuccugaucucaggugauccacccgccuuggccucccaaagugcuggcauuacaagcaugagccaccaugcccugccagaaaccccaucucuaccaaaaaaagaaaaauuagccaggcgugguauaguuccagcuacuugggaggcugaggugggaggaucgcuugaacuugggaggcagagguuacaaugagcccugauuguacuccagcuuaugugauagagcuagacucugucucaaaaaacaaacaaacaaaaaagacaguuauuacaaccugaaaaauuuacagugaaggcuuuuagguccuuaaaugguuuaaaaguagauuuuagccaggcgcgguggcucaugccuguaauuccagcacuucgggaggcugaggcgggcggacacgaggucagccugggcaauauagcaagacuuugucuccacaaagaauaaaaauaaauuagcuaggaauggugguacaugccuguagucccagcuauuugggaggcugaggcaggaggaucccuggagccuaggaguuugaggcuacaguaagcuaugauugugccugugaauagccaacgcacugcagccuggugagaaagcgagacccuaucucuaagaaaaacaaaacaaaaagaacacacacacauaaacacauuguucagcuguacaaaauuauuuucuugcuuuuuuucuucuuuuuuugagacagaguuucucucugucgcccaggcugaaguguuguggcacaauaguagguuacugcagccuugauccccuggggcucaagggaucuuccuaccucagccucuagaguacccgggacuacagaugugcgccacugcauuuuuguuuuuaaagauggggucucacuauguugccuagacuagucucaaacucuuggccucccaaagugcugggauuacagaugugagcaccugcacucggaccugcaugauuucuuaucuauaugguagaggaauuuccaucuuucuuucuuucccugccucccuucuuucuuuucuguuuuaaugaugagugcuguauagauacauuuagaaaaaaaaaaauuuaggccgggcacgguggcucacgccuguaaucccaacacuuugggaggccgaggugggcggaucacuugaggucaggaguucgcggccagccuggccaacauagugaaaccccaucucuacucaaaauacaaaaauuagcugggcauaguggcacaccccuguagucccagcuacucaggaggcugaggcaggagaauagcuugaacuugggaggcagagguugcagugagcugagaucgugccacugcacuccagccuggguaacacagugagacucugucucaaaaaaaaaaaaaaaaauuagacauaauaccuauagugauauggguuacaugauguggaugaauguguuuaaaucgaaaugaauaugcauguuuaacuugaauacaagacaaacuuauuaaagacuaagucauauacauaauaaaaaaucaaaauccuuauuuuucuguuauucacauccauuaggaagaaguaaaauauacucaaauccaauauacuugaucugucugguagugauaccuaaauaagguaaugauguuaacaucuugucauuuccguuaguauuuuuacuugaaaaaucaaauagcuuugacuuugcacuauaauuaggaauggcugcacacaaauuucaguuggacuuacaugucguuauuuguauuaauuaaacauaauuuucuagguaauuaaugauccuauccauggccacauugagcuccacccucuccucguccgaaucauugauacaccucaauuucaacgucuucgauacaucaaacagcugggaggugguuacuauguuuuuccaggagcuucacacaaucgauuugagcauagucuaggguaagaagggaaugggguggggaacuugcaguuuuuaaguauuuucucugucucaugaaauaguuaucuuaggccaggcaugguggcucacaccuauaaucccagcacuuugggaggcagagguggguggaucacaugaggucaggaguucaagaccagccuggccaacauugugaaaccccaucuuuacuacaaauacaaaauuagccagacaugauugugcgcaccuguaauccuagcuacucaggaggcugaggcaggaggaucacuugaacccaggagguuggugguugcagugagcugagauugcaccaucgcacuccagccuaggcaacaagagcaaaaccccaucucaaaaaaaaaaaaaaaaagaaagaaaaagaaaacaggaaaaaaaagaaauaguugucuuaaucuuuuagagaauaaauaguuuuacaaaaugaugauaauguccuuauuuuauugaugagaaaauugaggcuuuuuuuuuuuuuuuuuuuuuuuuuuugagacagagucucuuucacuaggcuggagugcaguggcguaaucuuggcucacugcaacuucgaccucccagguucaagcaguucuguaccucagccuccugagcagcugggauuacaggcgcccaccaccacacccggcuaauuuuaguaauuuuaguagagacgggguuucaccaucuuggccaggcuggucuugaucuccugaccuugugagccaccugccucggccucccaaaguacugggauuacagguaugagccacugugcccagccccaaaauugaggcuuuuuauuuaccuuguugcaauuuauuuauuuuauguauucuuaaccaccucagaucuuuccuggaaaaauaaugaaaguaucuauagacaggucaguuggauuuguuuuuaaauauuaauuaaaagcuaacaggggcugggugugguggcucacaccuguaaucccagcacuuuuuuuuuuuuugagauggagucucacuccgucgcccaggcuggagugcaauggcacgaucucagcucacugcaaccucugccuccaggguucaagugauucuccugccucagucucccaaguagcugggauuacaggugcccaccaccacgccuggcuaauuuuuguauuuuuuaguagagacaggguuucaccacguuggccaggguggucuugauuucuugaccucgugauccgcccgccucggccucucaaaaugcugagauuacaggcaugagccaccgugcccggccaaucucagcacuuugggaggccggggcaggcggaucacuugagaucaugaguucgagaccagccugagcaacauggugaaaccccgucucuaguaaaaauacaaaaauuagcaaggcgugguggcgcacgcugcagcuacuugggaggcugaggcaggagaauagcuugaacccgggaggccaagguugcagugaacugagauagcaccauugcacuccagccugggugacagagugagaaucagucucaaaauaaauaaauaaauaaauaaaagcuaaugggucgguugcugauacaacuaauuauguauauuugauuauuuaauuuuucuguauucucuauuuacucugguacagaguugcucuuucaaaccagaucauuuucuuaccugucaggaaaugcguaaguuaaaaaagcauucauaaucuuagagaaggcgaugccucuguuacauacaacuaagcugagacguuggucugcauuuccauuaugcaguguagagccaggaggaaguggacagggaagaauagacagucuuugagauuuucaugaaguacucacaguauauuacuuugguuuucuguuuguguagaagcauuuuuaguuaggcacaacaugugucuauacucaaauguucauucaucaacaaauauuuaucgaaccuuacuaagcccuaccaaaccacaaaaagauaacaaucgccucuguccucauguagcucagaguucaggggaaaagaauuuaggaauggcucagauggaagugcuggaagugcauuuaaguacuucaucuccaauuauguuguaaacauuacaaagccagauauuccuacuuuaaaaaaaaacugugguaaaauacacagaauagaaaauacauagucuuaaguguuuuuuaaguguacaguuuaguaggguuaaaugcauucacauugugcaaccaaucgauugccaaaacucuuaucaucuuacaaaaccaaacuugccaaaacucuuaucaucuuacaaaaccaaacuugccaaaacucuuaucaucuuacaaaaccaaacuugccgggugcaguggcucacaccuggaaucccagcacuuugggaggcugaggccaguggaucaccugaggucaggaguucaagaucagccugggcaacauggcgaaaccccgucucuacuaaaaauacaaaaccagccgggcaugguggaguguaccuguaaucccagcuacuccugagguugcagugagcugagaucaggccagugcacuccagccugggcaacacagcgagacuccaucucaaaaaaaaaaaaaaaaaaacacgaaacuguauacguauuaaacaacucuucaugucuccccccgcaaccccccgcaacccccuaguaacuaccauucuacuuuuuuuuuuuuuuuuuuuuuggagacggaguuucgcucuuguugcccaggcuggagugcaauggcgcaaucucggcucaccacaaccuccgccuccucgguucaagugauucuccugccucagccuuccaaguagcugggauuacagccuuccaagcagccuuccaaguagcugccucagccuuccaaguagcugggauuacagccuuccaaguagcuggcaccugccaccacgcccagcuaauuuuguauuuuuaguagagauggaguuucaccacauuggccaggcuguucuugaacucccgaccucaggugaucugcccaccucagccucccaaagugcugggauuacaggcauaagccaccgcacccggcccucuuuuuuuuguuuaugaauuuggcuacucuagguaccucaucuuagugaaaucauauaauauuugucuuuuugucacuggcuuauuucacuuagcauaauuuccucaaaguucaucuauguuguagcaugugucaguauuucuuuccuuuuuuauuuuuuauuuuuuauuuuuaaauuauuuuuuauuuccuuuuuaagguugaauaauauuuuaucauauguaucuaccacauuuuguuuauacauucauuuguugauggauaccuguugcuuuuaccucuuggcuauuuugaguagugcugcuaugaacaugucuguacaaauauauucucuuucuuuuuuuggggggagggugguggggacggaaucuugcucuguugcccaggcuggagugcaauggcaagaucucggcucacugcaaccuguaccucuuggguucaagcaauucuccugccucagccucccaaauagcugggauuacagguaccugccaccaugcugagcuaauuuuuguauuuuuuaguagagauggggcuucaacauguuggccaggcuggucucgaaccccugaccucaagugaucugcccgccucagccucccaaagugcugggauuacaggcgugagccccugagcccagccaaucuuuucaagaccuacuuucguuauuguggguguauacccagaagugaaauugcuaaaucacugugguaauuccguuuuuaauuuuuguggagcacccauacuguuuuccauggcagcuacaccauaauacauccccacuaacagugcacaggcuuccaacuucuucacaucauguccaacacuuguuauuuucugguuuucuuuuuuuaauaguagcuauccuaaggggugugaagugguaucucacugugguuuugaugugcauuccucuaaugauuggugauauugagccagagguccugcuuuugggauuccguuuguguguguuccugccuaguucugaaauauacuguucaguaaaguugcccuaaagguauguuagaauguuuaaggaaacauacugaaguucuugaggaccagaacuaucacuccucuugcaaacagaaaagugacuuuuuguguuuuugcucugcagggugggguaucuagcaggaugucuaguucacgcacugggugaaaaacaaccagagcugcagauaagugaacgagauguucucuguguucagauugcuggacuuugucaugaucucgguaagcuguacaaagagacaaaguuguuauguaaaaucauaacauauguuaccucucuuugacguuaaaaaaucagaucaaccaagagaauauggaaauuguauuuuaauucuucaguugauguuaguauaaauguacuguugcuucuuccuagaaugauucauaaguagaaaacauugcuauuuuauuuucuuggcaacuuucagugaauuucucauguuaaacaucuuugcuaaagugguuuuuuuguuguuguuuuuuuuuugagacagaguuuugcucuguugcccacgcuggagugaguggcucauuaucgguucacugcaaccuccgcuuccugguuucaagcaauucucgugccucagccucccgaguagcugggauuacaggcaugcaccaccauauccagcuaauuuuuguauuuuuagcagagacgggguuucaccauguuggccaggcuggucucgaacuccugaccucaggugauccaccagccucagccucccaaagugcugggauuacaggcaugagccaccgugcccggccaucauguuuacuacagguuauaugaaagggcuuuuugcuagugaguuuuucuuacuacugcuuuuaggaugauaugugaauuuuauuuuucuuuuauccuucuuaugcuuauuuuuuuuuuuuuuuuuggucuuuuuuuuucuuccuuuuuguggagaacaggaucucgcuauauugcccaggcaggucucgaacuccuaggcucaagcuauccucccgccucuccucccugagagcugggauuacagguguaagccaccgcgccuggccuuguccuucuuaucaaauaaaaucaccauuuuuccuucgguuauuuggugaaauccauuuuuuuucauauuuauaaucucuaaucugcccaaguggauuaacacauuuagagaacuccuugucuuuucugauccaugugaggucuuaggccacuuuaauccaagcaaaagaauauaauccuuuuccugugacaaagagaaaggggacugucccauuuauuuuuuuauuuuugagauggagucuugcucugucacacagauuggagugcaguuggcacuaucuuggcucacugcaaccuccgccuccuggguucaagugauucuucugccucagccucccgaguagcgccuggcuaauuuuuuucuauuuuuaguagagaugcaguuucaucauguuguugaaacuggucucgaacuccugaccucaagugauucaccucccuuggccucccaaaguguugggaauacaggcauaagucaccacguugggccgggacuguuccuuuuaaaucauggggguuuuuaccucuauccuuauaguuuauuccuacuuauucagggacucugagaguuuguguguacccucagggcaggggaagggaggugcaugccacuguuuggauagccagauacuuaaagcaaguaggcacucuuuuuaugucccccggagacuuacaaagaaccaauaccagccccuagaugauaaauuugauggauucuugguauuuugagggagaaucauugggaaaccuuugccaguccccaggagccugagcacugcauuagcgagccuuuauguguagccugugacuugcaaagcagggccaaggcuagucuagguagacuucccucuccaguuaaguggcucacuucuuuuuuuuuuuuuuucagauggagucucgcucuguugcccaggcuggagugcaaugguacgaucuuggcucaccacaaccuccaccucccagguucaagccauucuccugccucagccucccaaguagcugggacuacaggcacaugccaccaugcccagcuaauuauuauaguuuuaguagagaugagguuucaccauauuggucaggcuggucucaaacuccugaccucaggugauccacccgccucagccucccaaagugcugagauuacaggcaugagccaccacacccggccaaagauagauuuuuuuaagcuugagaguuauaagagaaauucuaauuuuuucuuccugcaccccaguggauuuucuuuuuuuuuuuucccgagacagaaucucgcucuguugcccaggcuggagugcaguggcgcaaucucggcucacugcaaccuccgccucccggguucaagcgauucuccugccucagccuccugaguagguaguauuacaggcgccugccaccacacccgccuaauuuuuguauuuuuaguagaaacaggguuucaccaucuuagccaggcuugucuugaacuccugaccucgugaucuacccgccucggccucccaaagugcugggauuacaggcaugagccaccgcgcccagccccuuuuuuuuucuuuugagauggagucuugcucugucacccaggcugggguguaguggugugaucuuggcucacugcaagcuccgcuucccagguucacgccauucuccugucucagccucccgaguagcugggacuacaggugcccgccaccaagcccggcuaauuuuuuguauuuuuaguagagacaggguuuuuaccauguuggccgggcuggucucgaacuccugacucaaagugauccacccaccucagccucccaaagugcugggauuacaggcaugagccaccacaccuggcccuaguggauuuucuugaaacugcuauuuuaauccagauauuuucaaucugaagauuucaaaaaguuuuuggcauuaacauucuuuuuaguuacacagaauuguccauuuaucaagcccugugugguggugcaugcuuguagucccagcuauucagguggcugaggcaggaggaugacuugaggucaggaguccaaggcugcagugcauaaugaucaugcuugugaauagccacugcacuccagccugaacaacauagcaagacucugucucuucaaaaaacaacaaaaacugcccuuuuaucagauuuauguaaaaccuggugacuggagacugcucgauggagagcuuacuuuuccauguuucugcuuccuguucuccuguuuuagaaauaggaagaaaggguuugucccuuuuugugauuguauuuuuagauuauuaauuucuuuugcuauucaaguuaaacuaaaaagauuaaagaauucaguuuggcugagugugguggcucacgccuguaaucccagcacuuugggaggcugagacgggcggaucaccugaggucgggaguucgagaccagccugaccaacguagagaaacuccaucucuacuaaaaauacaaaauuagcuggaugugguugcacacgccuguaaucccagcuacucgguagccugaggcaggagaaucgcuugaacccagggggcggagauuguguugagccaagauuguaccacuacacuccagccugggcaacaagagcgaaacuccgucucaaaaaaaaaaaaaaaaaaaaggaaaaaguuuuuguugguuuacagauguuuuucuuguucuaaggcugcuuuuguuuuuaaggucaugggccauuuucucacauguuugauggacgauuuauuccacuugcucgcccggaggugaaauggacgguauguauucauacagucaauagucaauaaaaagaaagacuauuuaagcagguuauuuaguuaauuuaucuguuugguuccacuacuguguuauaaaauacuuccccauuacaguguccagggugcuuucauucacauauauauauauaugcuuuuguuugguucucacaguagucuguaaggaaguuaucguuaucucccuuuuuacaaauaaaggaacuugaaacucuuggauguguauugaugcaucaaaaaucacaaagccguuaaauacuggaaucagcaauacaaaaccaguugccaguuuaauacuccuucugcuccauuguacuacuguauaauaaaaggccaacuccaguuuugacacauuugguaugaccacgaacuaacuuaccagccaagucauauauauuaaaugaaucauuuuaaaauuaggcauuugcagguggcugucccauauuuuggaaucaauuuuugagaaguaaaauuagguugguuuuuacuacacuguauuucuggaacgggaauagaaaaaggauauuaauauauauugaaaacuucuuacaugucaaccacuuuuuuuuucucucucucuuuuuuugagguauaguucacauacaauaaguuguccagaucuuaaguucagugaguuuugacaggcguauacauccauaugacuauuacccagucaggauauagaacauuuucaucuuccugaaaaauucccaugugcuuuuuccuagucaauucucacucccccucaccccaccaucaccuucugauuuuuacaaacauaaaugaauuuuguuguucuuagacuugauuaagcagaaucauauaggagguccuauuuuaugccuugcuuuauuuacucaacauaaugguuuugagauuuguucauguuaugugccucaguaguugauccuuuuuuuuaucgccuacguaguguggcauuaugcaaauaagucacaauuuguuuacccuuucuuguuuuguuggaauuuggauuguuuucagguuuugguuguuauaaauaagguugucgugcauauuaucguacaagauuuugguagaaauacauuuucuauguuguuguaguguggaaaguuaauuacauuuuuaaaacaagaaauacauucagcagaaauacauuauuuuauaaaaauaaaaauagauaaaauaaagaaauacauuuucauuucacuuagguaaauaccgaggagcuagaauugcugggucauaugguagauauguauuuaauucuauaagaaacuaccagaguuuuccaaugcgguuguaccauuuuacacucccaucagcaacauacuggaguuccaguuguuuuacagccucaucaacauuugaccuuucaaauuagcccuucuaaugagugucaaaugguauuucaugguuugauuuucuaauguauguugaauacuauuuccuguacuuuguacuuuguuauugauauaucuucuucugcaaagaacucucaacauuuuacucguuuaaaaaguuugauugcuugcucuuugauuacugaguuguaggaauucuuuauguauauauaugguuagguauauguauugugaauauuuuuccccagugucuggcuuggccaauucauuuuuucauggugccuuuugaaaaacagacguuuucaauuuugaugaaguacucugguucugcaagccaguaaaauggguaguuucucaccaguuuuucuguccuggggccugcccuuaggcaaaaaaccauaaaaccggaaugucacccagcaccucucccuucuaaguauugaggucuaacauccacuugguuuuggucucucuccaggaccuucagggaguuguccagagcuuauaguuguuuucuucugcaguugaucuaauaggaucuucucaaucauuaccaaaucuauuccuuuaagcauuuugccuuucacauuuaaauccuuagcucguguacaauuuauuuuuguguaaguauaugggagaaaucuuuuuuuuucuuuuuuuuuuuuuuugagauggagucucacucuguugcccaggcuggagugcaguggugcgaucuuggcucacugcaaccuccaccuccuggguucaagcgagucuccugccucagccuccugaauagcugggauuacaggcaugugcuaccacaccuggcugacuuuuguauuuuuaguagagauggcuuucaccauguugguuaggcuggucucgaacuccugaucucaugauccacccacaucggccucccaaagcgcugggauuacagacgugagccaccgugcccggccgagaaaucuaauuuuuuaauaguucauccuauccccacugacuguaauaccaaccccaacauuuauuaacuucccauauaugaugaaucauucugcauucuguucuguuuccacacuuguuacuuggggaagaaaaaaaaagaagaaaagaaauuuuuaucugagaaauaugagccccuuuacauuaucaggcccagagaggcauugaaauagaacagcaaucaugucacgcccccuugagcuaaauaauuauuaucucuugaagccagcuguuaugugggaugccagguaaccauaaaaugccauauauccuguacuucauaauauguagccaaucacuaacuaauguuauuucuguaagccagugaacauuccugacuaacaacuuuuguuaucaccuccucuuugugaucaccuccuccuccugauuuaugcucuuuucuuuuuuuuucuuuucucucccuucugucucugucucucuuuuucucuuucucacuuucuuucuuucucauucuuucucuuuuucccuuccuuccuuccuuuccuuccuuucuuucccuuccuucccuucuuucccuuccuuuucuuuccccuucccccuucccuccuuuccccuccccuccccucaacaggaucuugcuuugucacccaggguggagugcaguggugcaaacauggcuuacugcaaccucgacuuccaaggcucaagcaauucucccacuucauccuccagaguagcugggacuacaggcacacacuaccaugcccagcuaauuuuuuauauuuuuuguagagggagugggccucacuuuguuacccagacuggucucaacucccgagcucaagcuaucugccccgcuuggccuccuaaagugcugagauuacaggccuaagccaccacaccuggccaguccuuuuuuguuuaaaaacuugagccucuuuuguucuccccaagcauuccccaaggcaauuuguaaauguguccucaaccuuggcccaaauaaacucucuauauuaaauauuucucagcuccuuccuuuuagguugacauacuuuauaauaagauuuauguuuuuauuuuuuccuuucuguggagaacagagucuuacuauguugcccaggcuggucuugaccuccagacucaagcgauccuuccaucucagccucccaaguagcuggggccacaggccugcaccgucacaccuggguauuuauuuguagagauggagucuuacuauguugccuaggcuugccaugaaagucauacaucuuuguuauacuuacuccuaaguuccuuauaauuuuaguuguuauuauggucugugcuagcuuuaugaaacuuaauuuuuucuguuugcuaguauauucacaguuggcauugauauauuuaaaacuacuauuuugaaaaucccuuacuuuauuuauuuauuuauuuauuuuuauuuuauuguuuuugagagagggucuugcccugucacccgggcaggagcucagugaugucaucuaagcucacugcaaccucugccucccagggucaagugauccaccucauuuuuauuuuuuaaaauacucucucuuggccaggcgugguggcucgcgccuguaaucugagcacuuugggaggccaaggugggcggaucacaaggucagaagauugagaccauccuggcuaacggugaaaucccgucucuacuaaaaauacaaaaaaauuggcugggugugguggcaggcaccuguagucccagcuacucaggaggcugaggcaggagaauggcgugaacccaggaggcggagcuugcagugagcugaaaucacgccacugcacuccagccugggugacagagugagacacugugucaaaaaauaaauaaaauacucucucuuuauauauagauauuuuuuuucugaaucauuagaaaguaaguuuugaccaggcacaguggcucaugguuguaauaucaacauuuugggaggccaaggugggcagaucgcuugagcccaggaguucaagaccagccuggacaacauggugaaaccccgucucuacaaaaaaauuuaaaaauuagccaggcauggugggguggcaggauugcuugagccugggaggucgaggcugcaaugagcugugaucgugcuacugcacuccaacguagguaacagagugagaacuugucucaaaaaaagaaaguuaguuuuuagacuggacacaguggcuuacaccuguaaucccaacaguuugggaggcuaaggcaggaggauagcuuugagcccaggaguucaacaccagccugggcaacauagugaaacugucucuacaaaauuaugaaaacaucagcuggucauuguggugcacaccugugguccuagcuacugagaacgggaggauuacuugaauccaggaguucagggauacacugagcuaugaauaugccacugagcuccagccugggugauagagcaagagcccugucucucaaagaauguaaauuguugaaauacuuuauuucuaaauacuucaguggguauuuccuaaaaacaacauuuucuuauauaaccauaguauaauuaucaaaaucaguaaauuaauguugaugcaguacucuuaucuaauucagacuuucaaauuuuaccaauuguccauauagaaaaaggggaaaaaaacuuuuuuucccugguccagaauuacacauugcauuuaguugccauuuuucuaguuucuuuugaucuggagcaauucuucagucuuuaucguuagugacuuugucauuuuuuuaaagagcaacugagcuauuuuguggaauguuccucaauuugaguuucagugugauguuuccucauggauucaagcuaugcauuuuugguagaaugccacaaaagugauguguccagaucggacgcaguggcucacaucuguaaucccagcacuuugggaggccaagguggguggauuaccugaggucagaaguuggagaccagccuggccaauauggcgaaacccugucucuacuaaaaauauaaaaauuaucugggcaugguggugggcaccuguaaucccagcuacucgggaggcugaggcaggagaaucaccugaaccugggaggcggagguugcagugagccaagaucacgccauuucacuccagccugggcaacaagagggaaaaaaaaaaaaaacaaccacaaaaaauuagcugggugugguggcacgugccuacuugggaggcugaggaaggagaauugcuugagcccgggagcccaggaggugacagagcuagacucugucuccaaaaaaaucagugaugcauccuucauaguguaucaucucaggaggcacauaaauccuaguugagccaauaccaaugauauuaauucugcuuacuugauuaaggcauugucugucaaaucucuccauuauaaaguuacuauuuuuccucuuuguaauuacguauaucuugauucaauucguuuuuuuuuuuuuuuuuuuugagacagagucucgcugugucgcccagccuguagugcaguggcgugaucucggcucacugcaaccuccgccucccgaguucaagcguuucuccugcuucagccuccugaguagcugggacuacaggugcaugccaccacacccagcuaauuuuuauauuuuuaguagagauggggugucaccauguuggccaguaugaucuugaucuccugaccucgugaucugccugccuccgccuccuaaagugcugggauuacaggcgugagcuacugugcccggccaauuuguuuguuguuguuguuguuuuuuggagacaaggucuugcucuguugcccaggcuggaguacaggcaugaacauagcuaacugcagccucaaccaccugggcucaagcaauccucccaccuuggucucccaaguagcugggaccacaggcgcaugucacuauacccagccaaucuuuuuaucuuuuuguagagacagggucuugcuuuguugcccaggcugcucucgaacuccugggcucaagcaauccucccaccuuugccucucaaaaaaaugcuaggauuacaaaugugagccacugcacccagccugauucuguuuuuguggguuuuuuuuuuuuucuuuugaaacagagugucacuuuguugcccacccaggcuggagugcagggcgaucucggcucacugcaaccuccaccuccuggguucaagugauuguccugccucagucccccaaguagcugggauuauaggugcacccuaccaugccuggcuaauuuuuguauuuuuuaguagacaggagguuuugccauguuggccaaacuuguacuguugaccucaagugauccgcccaccucggccucccaaaacgcugggauuacaggugugagccaccgcacccaggccugacagcccugauucuguuuuuaagaauaguuucuggagcaagaauuguuucugcgggggcggggaaagaauaguuauagggcaaguugcuuguaauccugccacuuugggaggcugagacaggaggauuauuugagccuaggaguucaagaccaaccuggucaacaaaucaagacccugccucuacaaaaaaaucuaaaaauuagcuggguaggguggugugcaccugugguuucagcuacucgggaggcugaagugggaggaucacuugagcccaggaguucaagacuacagugaccccaugaucacaucacuggacucuagccagggcaacagagcaauucccugucucuuuuuuuaaaaaaauauaguuauaggauaauucagguuuuguuuuucaucuugaguuaguuuuugguaggaucuaggaaagggcagaugucuucaggaguucauuugauccuuuacauugauugugaaugagugagcagagagagaugagcaaacaggccaauuggagauuucaagggagaucuuuguuuuuacuggcaaguuugcaguuaccccuuuucaccacuagaugguagugccuaacagagcuuauaacugcacguguucaaaggcugaugaaaaaauaaaauucaauuuuaugaugauauuuauuaaaauguaauucugucuacaugaucuuauaauauucauuuaggaacuguaaaugauuauaucauuaaaugcauuaaauauguuuaugaaauaaguuuuguaaaagguuuguagacuacuaguaaaaugaaaaaucugacagguuuuuaaaaauguuccuaagauugugguuagaaacuagagaauuaauaugcaauagaccuuuaucucagaauuacuuggaauugaggauaauuuuguuagucagggcucccaaugggcuagaaucuuuaacacaucauauugugcuuacuuuuccuagcaugaacaaggcucaguuaugauguuugagcaccuuauuaauucuaauggaauuaagccugucauggaacaauauggucucaucccugaagaagauauuugcuuuauaaaggaacaaauuguaggaccacuugaaucaccugucgaagauucauugguaaguuuauguacagcuuaauuuuaacugacuggugcuuuucaucuagccuuuucaugauuccuucugaguuauacauuuggcuauuuuagaggcuaaaugauaaaauaugaguucuauguuucuacuguuuaaugcaaaaaauaaaaggcuuauauuuuuuucuaccucucaacugaauuaguuagaaguuacuucccaaaaauauauauacagaaauucuuuuuagagacagggucuuacucugucacacaggcuggagugcaguggcacaaucucagcucacugcaacuuccaccucccaggcucaagcgauccuccuaccucagccuccugaguagcugggaccacaaacgugcacuaccaugcccagcuaauuuuuguauuuuuuguagagaugggguuuugucacguugcccagguuagucuugaaauccugagcucaagugaucugcccagcucugccucugaaagugcugggauuacaggugugagccacugugcuuggcauaaauucuuuucuuuucuuucuuucuuucuuuuuuuuuuuuuuuuuuuuuuugagauagagucuuacuguguuggccaggcuggaguacaguggcaugaucucagcgcagugcaaccucugucucccaggcucaagcaauucuucugcuucagccuccugaguagcugggauuacaggugugugccaccacgcccggcaaaucuuuguauuuuuaguagagacgggguuucaccauguugcccaggcuggucucaaacuccugaccucaggugauccacccgccucagccucccaaaguggugggauuacaagcgugagccgccaccgcgcccggccauaaauucuuuuuuagugaauauauaugcaguauuuuauucauuaaaaaaaauuuuuuuuuuuggagauguggucucacuauguugccuaagcugguuucgaacuccugggcucaagugauucucccacuuuggccucccaaaauacugggauugcaggcgugagccaccauaccuggccugcaguauuuuauauagaagccuaaaguaacuuuguuuggaauguaaauguguauguuuuauuuaaccauuaaaaugaacauauuuggccaggcucagugacucaugccuguaaucccagcacuuugggaggccaugaugggaggaucacuugagcccaggaguuugagaucagccuggguaauacugaaacccugucucaugccuguagucucagaugcuugggaggcugaggcaggcugcagugaucugugauugugcaacugcacuccagccugggcaacagagcuagauccugucuacaaauuuaaaaaaaaaucauauuugaaauauuuauaggaagaucuacaaaaaaguugaaccaguucaauggaaaaucuguuuuguuuccuuuuugaucuuuuguauuuuuuuaauuaaaaauaaaguugggaaauaauuucccccugagauuuuuagggcuguuuccucaaauauauacaaguguacuuacaguauaagauaaacagaugaguuuuguagcaaauauccuauuuccaaaaaaguggagcucaaagaauacauucaacaaugcauauuauuuagacuagguauguagcuacuuugaaagauaguacuguuuuaaugcaugaauucaagcauuguuaguuuauuauuagauuuuauauuauuuauuuauuuauuuuugagacggugucuugcucuguugcccaggcuagagggcaguggcacaaccucaggucacugcaaccuccgccuccugaguucaggcgauucuccugccucagccuccugaguagcugggaguacaggcacuugcuaccaugcccaacuaauuuuguguuuuuaguagagacaggguuucaccaucuuggccaagcugguuucaaacuccagaccucgugauccgcccuccucggccucccaaagugaugagauuacaggcgugagccaccaugccuggccuagauuuuauauuuuucaaaaacuuauaaaccaagaaaacacaaaaguuguugguuuugggaaauguaauagaguucagaucuuuucaguggcacaagaaaaugugguaacaauaggguaucauauaccuuagcauuucuuuucccuuucuacuaguuuugaaaugaaguggaagaaagaaagaauagaaccuucuaguuuaucucauauucccagucagguaucuguuuauauuuuacagauuaauaaaauugcuuugcuuuguuuauaaauagauuuggugccuauccuaaaacuuccaguggguuuucuugccuuccaguggccauauaaagggcguccugaaaacaaaagcuuccuuuaugagauaguaucuaauaaaagaaauggcauugauguggacaaaugggauuauuuugccagguaugcacugaacacuucugaaaaguuggcuaaaauauuuauauaaauuuaguauuacuauuuaagguacagcuuccuuguugaaaaauuucaucucucuguuuuggaauccuucuagggacugccaucaucuuggaauccaaaauaauuuugauuacaagcgcuuuauuaaguuugcccgugucugugaaguagacaaugaguugcguauuugugcuagagauaagguaagcugugccagaggaggcaauaagaagaauguuguuccuggucugaaauuuggaaauaaccauuuaacaauuuggaauaauugguaaaucgucagucucuuuacuuaauuccuaggauuuguaaauaucuuuagucucuucccuucuacugcauuauuaaauaauaauaaaauuaacauggacauuuauuaaguuuugaguuagacacugguuuugggguuuuuuuguuugguugguugcauuuuuuuuuuuugaaauaggaucucacuguguugcccaggcuagucuugaacuccugagcucaagugauccucccuccucagccucccaaguagcugggacuacaggugcacacuaucaugccuggcuuguaugaggcaucauuuuaagugcuuuggacggaucaacucauuccguauaacccugugagauagauacuauuauuccauucaacaggcaagcaaauuaaggcacagagaaggcauauaauuaacaagugguagaguuggaauuucaacccaaaaaguuugguuccagagucucucucuuuuuuuuuuugagacggagucucgcucagucacccaggcuggagugcaguggcacgaucucggcucacugcaagcuccgccucccggguucacgccauucuccugccucagccucccuaguagcugggacuacaggcacucgccacuaugcccggcuaauuuuuuuuguauuuuuaguagagacaggguuucaccguguuagccaggauggucucaaucucuugaccucgugaucugcccgccucggccucccaaagugcugggauuacaggcaugagccaaggugccuggcccagagucucauuuuuaaucacuguauuaguguugaaaaauuuuauacaguugacaccugaacaaaaugguguuuaggggugcuguccccucuccuaguugaaaaucuguauaaaacuuuucuuuaccuuuuuuuuuuuuuggagauggagucucccacuguugccuaggcugggguacaguggcaugaucucggcucacugcaagcucugccuccuggcuucaagugauuuuucugccucagccuugugacuagcuagguuuacagaugcaugcuaccacgcccagcuaauuuuugucuuuuuaguggaaacaggguuucaccauguuggccaggcuggucucgaacuccucaccucaagugauccacccgcuucagccucccaaagugcuggcauuauagguguaagccacuguaccuggccugcauauaacuuuugacuucccaaaaacuuaacuaaauagccuucuguugaccagaagccuuauugauaaccuuaauggucaguuacacacauuuuguauguuuuuuguuuucuuuccagacagggucuugcuguguuacucaggcuggaguacaguggcacuaucauagugcauuguagccuugacuuccugggcucaacugauccuuccuccucugccucccgaguagcugggacuacaggccuaugcuuggcuaauucugaaauuuauuuuacagagguggaguuucacuguguugcccaggcuggucucaaacuccugggcucaagcaacccauccaccucagucuccuaaagugcuaugauuauaggugugagccacugcauccagccuauuuugaauguuacguguaucauauaccauauucuuuuuuuucuuuuuggauacaggaucuuacucugucacccagauuggaguguaguggugcgaucucagaucacugcaaccuccaccuucccagcucaagcaaaucucccacuucagcuucccgaauagcugggaccacaggcgcaugccacuauaccgggcuaauuuuucuauuuuuuuuuuuguagagacaggguuucgcuauguuccccaggcuggucucgaacuucugaccucaagcaacuuguccuccuuggccucccaaagugcugguauuacaugugugagccgccacgccccaucuacuguauucuuacaauaaaguaagcuagagaaaagaaaauguuauuaagaaaaucauaaggcaaggccaggcgugguggcucacaccuguauucccagcacuuugggaggccaaggugggcagaucaccugagguuagaaguucgagaccagccuggccaaccugggcaacauggugaaacuccgucucuacucaaaauacaaaaauuagcugggcgcaguggcgagugccuguaaucccagcuacuugggaggcugaggcagaaaaauaacuugaacccgggaggcggaggcugugguaagccgagauugcgccacugcacuccagccugggcggcagagcaaggcuccaccucaaaaaaaaaaagaaagaaagaaauucauaaggcagagaaaguauauuuacuauucauuaaguggaaguagaucaucauaaaggucuucauccucaucgucuucacauuaaguaggcucaggaacaggagggauuggucuuacugucucagggguggcagcggggcaaggaaaucuguauaagugaacucucacaguucaaacauguguuguuaaaggucaacuguaguuaaacagcugaaaucacuaggucccuguuagauggcagucauguaaucaaaaaguaguauaguacuauacuauagaaagucaagaagggcuaggcguggugguacauaucuguaaucccacuacuucgcaaggcugaggugggcaaaucucuugggcuaccgaguuugagaccauccuggccaacauagugaaacccugucucuacugaaaauacaaaaauuagccaggcgugguagcauacaccuguaaucccagcuacucaggaggaugagguacgagaaucgguugaaccugggagguggagguugcagugagccaagauugugugccacugcauuccaaccugggugacagagcgagacugucuaaaaaaaaaaaaaaaagucaagaaugaagaacauaagaauaguaauaccuauuuccuagaguuauugggaggauuaaaauauauauauauuuaauuuaagaugccuaaaacggaaacugucacagaguuugagcaugugauagauuuuaggguuuuuuuuuuuuuucuuugaguuggagucuugcucugucacccagacuggagugcaauggcgugaucuccgcucacugcaaccuccgccuccuggguucaagugauucucccaccucagccucccuaguagcugggauuacaggcacccgccaucaugcccggcuaauuuuuguauuuuuguagagacaggguuucaccauguuggccaggcuggucuugaacuccugaccucaggugaucugcccaccucggccucccaaagugcugggguuacaggcaugagccaucgcaccuggccuaguuuauuaagaaugaaaguucuuggccgggcacaguggcucacgccuguaaucccagcacuaugggaggccgaggcgggcagaucaugaggucaggagauugagaccauccuggcuaacacagugaaacuccaucucuacuaaaaauacaaaaaaauuagccgggcuugguggcaggcgccuguagucccagccacucgggagacugaggcgggagaauggcaugaacccaggaggcaaagcuugcagugagccgagauggcgccacugcacuccagccugggcaacagagcgagacuccaucucaaaaaaaaaaaaaaaggaagaaagaaaagaaaaagaaugaaaguucuugcaaugaaggacuuguacuccagccugggcaacagaucgagacuccaucucaaaaaaaaaaaaaaaaaaaaaaaaaacaaagaaugaaaguuagcuggguacaguggcugaugcauguuaucccagcaaggcugagguaggaagaucacuuaagaccagccugagcaacauagcaagaccucaucuuuuaaaaaaaaaaaaaaaaaaaaaaaaaaugaaaguugcaagccaauaaauggcuuuacuaaucugccuccucauuuuuuaguggggucaaagguguuaaugaagaagccccggugcauagcccucuugucugccacuaucccuuuuccuuccuuguccuauauacuugucucuaauaacguuaacauaaucugauccuauuaauauuuacuucauguuuuccugcaggaaguuggaaaucuguaugacauguuccacacucgcaacucuuuacaccguagagcuuaucaacacaaaguuggcaacauuauugauacaauguaagaaacuugauugucauuucccuauaaaauuuuccuugauacuuggcuagaguaucauacuaggcucaacuagacauuucuagaugaguucaagugaauauuaagugauuaaauugaaaaugguuuccuuaaagaaaaaaaaucuagcauaaaguuaauuuaguuggaggaaaaggagggaaguggauaaaggggcagauggagggaaguggauaaaggggcagaugaagggaagaagagcuggcuuaggccagacgugaagcggcagugcugagaucacucaggaccucggcacagguagucacuuacacaccauucucaucaggagaaugggagguaggacaugaauauuuaaauucugagauuaaugacaaaaguuaacuuuaaggauuaagauuaaugucuauuuguauccuuucaaauauuuaucaaaauuaguaccaaaugguaaaaccaacaggaauuuuaccucuuccugacccagucagaaccauagcagaaaacuguacagccaggucucuccgugacucaaagauccauaaggaguuaucaaacacugggugugagucaaguuacuucuuccaugucucuaaaauagccuuaaauugauuaacuuuucauguucguuuucacauuuguguugaggaaguauaucuucauuccuauuuuuuaccuauccuuugucaugagcagauuacuuggaauaccuucuccuauuuguauguuaauucuucgguaagaguuuuuguuguuguuauuguuguuguuuuguaauucagagauaucuaguuucaaagccuggcacuguuucuuccuaacuugguuaaaucaaaauuuacuucauuucugcaucuauaaaaugagggcugaauacaccuaccuuauuguugggaggaauaaauaagauggugaaugcaaagcccugcgacagugccuggaacacaguaagcauggcagcucacagcuuaccaagcacaaauuuaguacgguggagaagcaguugucuuuagaacacugugccucauuauuuuguuucccuaaaguagaaagauuuccuuaaguaagacauaaggcaaauauucaaaauuucucauaaacauaaauuuuugcaaaaugauuuuuaggauuacagaugcuuuccucaaagcagaugacuacauagagauuacaggugcuggaggaaaaaaguaucgcauuucuacagcaauugacgacauggaagccuauacuaagcugacagguaagaaguaacagguaacauagaugguccaucucagauaaacuguaagaagucccugaauugccaaugaguuauuuuucuuucuuuuauuuuucauuuuuaaagauaauuauuuaauuuuaaaaaaauaaagaaagggucucacuauauugcccaggcuucucucaaauuccugggcucaagcgaucuuccugccuugacucccaaagugcuaggauuacaggugugacccacuguacacagccgauggaacgauuuuagcuucccaaguaauuaucuccuuuugaauuugaguuuuauuucugucuuguaccaauaaagugacuuugauaaagggauuugaccuaucugaaucuuucaucuauaaaaugaggguaaugauaccuagcauauaguuuuguugugauguuuaaaugaggcauagcaccuaguauagacuugauacguaaguacucaauauacauuauuuaacuuuuuuuuuuuuuuuggagauggagucucgcucugucaccuaggcuggagugcacuggcacaaucuuggcucacugcaaccuccaccucuuggguuucagcaauucuccugccucagucuccuggguagcugagauuauaggcaugccccaccaugcccagcuaauuuuuguauuuuuaguagagacaggguuuuaccauauuggccagggucuucucgaacuccugaccucaugugauccacccgccuccaucucccagagugcuaggauuacagacgugagccacuacgcccggcccauuauuuaacuuuuaaauuuaauuuuuuuuuauuuauuuauuuucagacaagauuuuauucugucauccaggcuggagugcaguggugccaucacagcuuauugcagccucaaccuccggagcucaagugauccucuugccucagccucagccaaguagcugauuuggcuacuugggacuauaggcaugugccaccacaccugggaauuuuuuuuuuuuuuuuugauacggagucuugcucugucgcccaggcuggagugcaguggcacaaucucggcucacuacaagcucugccucccggguucacaccauucuccugccucagccucccgaguagcugggacuacaggcgcccgccaccacaccuggcuaauuuuuguauuuuuaguagagaugggguuucaccuuguuagccaggauggucucgaucuccugaccucaugauccgccugccucagccuccgaaagugcugggauuacaggcgugagacaccgcccggccacaccugaguaauuuuuuuaauuuuuguagagacagggucccauuauguugcccagacuugucauuauuuaacucauaccuggacuaauauugaacaccaaaaaacugacuuggccauuuaacauuauuuucauuauaaaaacacaagaugccaggaacaucuguccacacuucugcagaaacaaaaucugcagcuuaguguggaaaggaggaaagagagguaaaggguaaaggugguucuuuuuuuuuuuuuuuuuuuuuuuuggagggggguggacagaguuuugcucuuguagcccaggcuguaaugcaauggcacgaucucggcucacugcaaccuccgccuccugaguucaagcgauucuccugccucagccuccugaguagcugggauuacaggcgcccaccaccaugcccagcuaauuuuuuuguauuuuuacuagagacgggguuucaccaugucagccaggcuggucuggaacuccugaucucagaugauccaucugccucggccucccaaagcgcuggcauuacaggugugagccaccgcgcccagccacagcugguucuuuaaugugggaaaguauugacugagauaaagcaaaagaaguagaacaaaaaguguacaccagucagaguucuuaguuacaaauuaugaaacuguuuaacuaaaaauaaaauugggccgggcacgguggcuuacgccuguaaucccagcacuuugggaggccaaggcaggcagauuaccugaggucaggaguucgagaccauccuguccaaaauuguaaaaccccgucucuacuaaaaauacaaaaaugagccaggcgugguggcacgcaccuguaaucucagcuacucaggaggcugaggcaggagaaucgcuugaacccaggaggcagagguugcggugagcagagaucgcaccacugcgcuccagccuaggcaacagagcaagauucugucucaaaaaugaauaaauaaaaauaaauaaauaaauaaaaauaaaauuggaaagcaaucacauagcuuacagaauccguggaaaggcuggaggcucugaaaauggagaaaaacaacagaagccaagugaccuaagacacagccuaaucacucuaccguagcuuccugccgagagugcugccguucuaccacagcuggauucuauuugcugcacacugacagaaugaaaccuaaacuagcuccuccuaaacuguguuugaagaaccaguuuuuaaaauuaccaaccccuugcagauugauauuucuguaaaguaugauaaaaaugaauuacuagaaaaaugaaauggggggaaaaggcauguaaaauacaagcccaaauuuuuauuauucaacuugacagacuucacauuacaccuuucaguaaauucaaucaaaagauaaauaauaggccagacaagguggcucgugccuauaaucccagcacucugggaaaccaaggcaguuggaucgcuugagcccaggaguuugagaccagccugggcaacauggugaaacccuguuucuaaaaaauuuaaaaauuagcccugguggugcgugccuguagucccagcuacucaggaugcugagguuggggggaucacuggagcccaggaggccgggguugcagugagccaagauugcaccacugaaguccagccuggguaacagagcgagacccuguaucaaauaauaauaauaaugauagagaaaaaauuuaaaaauuaaauuacaagaacuauauacauuguucuuuaaaaauauacauguaaggcuaggcaggguggcucacgccuauaaucccaacaccuugggaggcugaggcagguggaucacuugaguucaggaguucaagaccagccugaccaacauggugaaacccugucucuacuaaaaauacaaaguauuagcugggcgugcuggcgggugccuguagucccagcuacucggagacugaggcacgagaaucaauugaacccaggaggcggaggcugcaauuagcugagauggcaucacuguauuccagccuggaugacagagcaagacuccuucucaaaaauaaaauaaauaaauaaguaaaauaaaaguuaaaaaaaaaauugaacaagcugaagauauuuacuuuuaauuuucauucauaauaaugcaagugaugccauauuuuaaaaagucagccaggcaugguggcuuacgccuguaaucccagcacuuugggaggccgaagugggcagauacgaggucaggaguucgagaccagccuggcgccuguaaucccagcuacucuggaggcugaggcaggagaaucauuugcacccaggaggcggagguugcagugagcugagaucgcaccauugcacuccagccuggguaacagggugagucugucuaaaaaaaaaaaaaaaaaaaaagucaucuuuauccagguguggcggcaugugccuuuagucccagcuguucaagagacuaaggcaggaagauuaauuuuuucaaauuauauuuacauuuaaacuagcuuuugguuuagcugggcaugguggcaugugccuauagucccaguuacucaggaggcugaggcgugaggauugccugaguccaggaggucgaggaugcagugagccaugaucacgugccacuucacuccagccugacaacagagcgagacccugucucaaaaacaaacaaaaaaaaauuuagccaggcauggugguguacgucuguagucacagcugcucaagggcugaggcaggaggauugcuugagcacaggacuuugaugcugcagugaacuaugaucgcgccacugcacuucagccuaggccacagaaccugaccuugucuccuuaaaaaaaaaaaaaaaggccaggugcaguggcucauaccuggaaucccagcacuuugggaggcugaggcggguggaucacuugaggccaggaguucgagaccagccuggccaacauggggaaacccaaucucuacugaaaauacaaaaauuagcugggugugguggcauguaccuguaguuccagcuacucaggaggcugaggcacgagaaucacuugaaccuaggagguagagguugcagugagccaagaucacgccaccgcacuccaacuugggugacaaagcaagacucugucucaaaaaaaaaaaaauugcacagauauauauauauggagaaagcgcaugcagaaaaacauuaacaauuguugaauuuaagugaaggauauuuuauuuugaaauuuuucaaaauaaaaauugggagaaaaugaaagaaaggaaaaacauuucuucuacucucaucaucgaaugggacauuaaaaaaucauuguuuuauuauuauagaaauuuacaaagccauguaccugucacuuagcuucaacaguuaucaacacauggcaguuuugcuucaucuacccacucuugucaaacacuggacaauuuagaagcagauccuagacauaauuuugcuuguaaauacuucaggaccguucucuuuuuauuauuuuuauuuuuuagauagugucacucugucacccaggugggagugcaguggcgccaucucggcucacugcaaccuccaccuccaggguucaagcgauucuccugccucaaccuccugaguaguugggaccacaggcaugcaccgccaugcccggcuaauuuuuguauuuuugguagaggcaggguuuugccauguuggccaggcuggucucaagcuccugaccucaggugauccaccugccuuggccucccaaauugcugggaucacaggugugagccacagcgccuagccaccauucuuucuuaaagacaaaauaaaacaugucaacaauaaauccauacaccuuuaugugcccaucacccagcucagcagucaucaacuccaaugcagucuuauuucucucuauccuuccccacucucuggauuaccuggaaguaaauccaagacauugacaggaacuuuuuuuuuuuuuugagacagucucucgcucuuguugcccaggcuugagugcaauggcacaaucuuggcucaccguaaccuccacuuuccggggucaagcaauucuccugccucagccuccugaguagcugggauuacaggcgcccgccacuacacccagcuaauuuuuuuguauuguuaguagagacaggauuucaccauguuggacaggcuggucuugaacuccuuaccucaagugauccgcccgccucggccucucagagugcugggauugcaggcaugagccacuaugacuggccgacuggaacaguuuuaaaagguuuuuucacuuaaaucuuuuaaaaauuuuucucacauugcuaaaauaauaauguaccuacauuugcgaacugccuguuaagaucauuucaauagaauagcacuauauaauucuuuaacucuguguuuuuauuuuaauauaacugaaaugucauuaaauuggcagauaacauuuuucuggagauuuuauacucuacugaucccaaauugaaagacgcacgagagauuuuaaaacaaauugaauaccguaaucuauucaaguaugugggugagacgcagccaacaggacaaauaaagauuaaaagggugaguuaucaggcaucuuuccauuagugaaagguuaucucuguccuccaagaggagaccacuaaccuaucgugauacuaugacucuguacuaagugcuuuacguuuauucucauuuaaucuucacaguagugcaggggucuuaggccuguuuuacagauagagaaacugaggcuucacugagauuaaauaacuugcucaugaaagcauauuuagccaggauucaaaagccaggucuaacuuaacuccaaaucuuugaucucauccaggaagugagagugggucuccaauuuuggcuagauucagacaugagaaaaugaauauaagggaaaggaaccucaaaagaaagugccugcaugagcuucauugaggcuguggugaccuguuguaaugacuugguuccuucacaggauaucagucucccagauggcacauaccugucuucuuuagcucaaauaucuauuuucaccuccuacuuguugaagaguuuucuguuugccagaaagccguaacacaagucauacuuauaaccacauccuaccucaauaauuucuuggguuauacuuuacuuccucuuguuguacuaauagguuaaugucacuuuuuuuuuuucaaaaugugaauuuuguuuguuuguuuguuuguuuuuagacagagucucgcucugucacccagguuagagugcaguggcgcgaucucagcucacugcaaccuccaccucccggauucaagcaauucuccagccuaagccucccgaguaguugggauuacaggcacccgccaccacgcccagcuaauuuuuguauuuuuaguagagacgggguuucaccaugucggucaggcuggucucgaacucccgaccucaugauccgcccaccugggccucccaaagugcugggauuauagacgugagccacugcgccuggccacuuuuuacaauuuuuuacaaaaaugcucucuuuguuuaacgagugacauugguaggagcuauauuuguuaaggauaucucuaaucguuuuucuuaguuaggugccauuuucauaaagagaaccuguuuguggcucaaagacuugaugaaaaauggauucuaacauggggagucuuguguuuuccaggaggacuaugaaucucuuccaaaagagguugccagugcuaaacccaaaguauugcuagacgugaaacugaaggcugaagauuuuauaguggauguaaguaauuagcccaguaauaaacugagugaauacguuuuaaagauaaagcacccaccauuauaaaaguaguacauguucauuuuagcaaauuagaaaaauacagaaagaugaugugcccucacaaagagaaccaauauuauuaaccacaaaaacauuuuguucaugauguuuugccauuauuuuuaauauaauuguggucaugugauuacauugucuauauuaauuaaaaauuuuuaauuacacaaguaauacauuuuaauuuuuuuuauugccugcauacaagcacagaggaaaaaguuguggggccaggcacgguggcucacgccuguaaucccagaacuuugggaggcagagguggguggaucaccugagucaggaguucaaaaccagccuggccaacaaggcaaaaccccauuucuaguaaaaauacaaaaaaauuagccgggcuuggugguuugcgccuguagucccagcuacucgggaggcugaggcaggaggauugcuugaacccaggaggcagagguugcagugagccgagaccaugccacugcacuccagccugggcagcagaguaagacugucuccaaaaaaaaaaaagaaaaagaaaaaaaaaauugcugggcacgguggcucaugccuguaauccuagcacuuugggaagccgaggcgggucgaucacaaagucaggagauugagaccauccuggccaacauggugaaacccccaucacuacuaaaaauacaaaaauuagcuggguaugguggugugugccuguagucccagcuacucaggaggcuguggcaggagaaucgcuugaaccugggaggcggagguugcagugagccgagaucacgccacugcacuccagccugggcaacagagcgagacagcacugcaccucaggccaauagucucagcagauuacacccuggaccuuaucaacauucaaaacugcccucccuguaaaaucacuaguuuaacauacuuuucucuguccacaaaccccuuucuuccucauccauguuuuccuagcucaucaggcccucuaguuuauuguguccucacuuucuucgagcuugucaguggccuucuaucuucauuucucuccacguguaggccgagugagguggcucacgccuauaaucccaguacuuugggaggccaaggcgagugaaucacuugaagucaggagguugagaccauccugcccaacacggcgaaaccccaucucuacuaaaaauacaaaaaaucagccaggugugguggugcgcgccuauaaucccaguuacuugggaagcugaggcaggagaauugcuugaacccagaaggcagagguugcagugagccgagaucacaccacugcauuccagccugggcgacagagugagacuccaucucaaaaaaaaaaaaguaucuuagauaacgugauacaguaauucacucauuuucugcaguuacccucaacucucuuuuccuucuuugcaucuaccuagcagaaggccaaacaaccuagaugaaucaaaucuaaacaucuccacacccauaccuggacacauaaaugcuccuggauaccaucacuauacaggcauaucuauaaauuuccggucacgaaacuaagcugggccuucuggcaggcuuagugugauucucccagucucuaauaaucauuucaguccaggcacaguggcucacgccugcaaucccagcacuuugggaggccgaggcggacgaucaccugaggucaggaguucgggaccagccuggccaacauggcaaaaccccaucucuacuaaaaauacaaaaauuagccagggaugguggugggugcugauaaucucagcuacucaaggaggcugaggcaggagaaucacuugaaccugggaggcggagguugcagugagccaagaucaugccacugcucuccagccugggcaacagagcaagacccucaucucaaaaaauacuacuacuaauaaucaucaucaucauuucaaacuguccucccuccucucagaacuccaaccaugcuucccaccuccagcuguauucauccucaugaguaacccaaccuuuggcuccuauuuccaagauaaacuauaggccauuagguagcaacuccuuagaccuuucucaccaaagaaacaagccuuccuccaucugucacuguauucaguauucccauucuuauaguggggaaacagcuuuguucuugucaaaggcuuaggguaauucuacuuguguucuagagaaguguugucccauagaacuuucugcagugacagagauauucuuggucagugaugucccuuuccauagucacuagcugcaugcagcuguugagcacuuaacaugugguugcuguaacugaauaacuucauuuuuuauuguauuuaguguuaauuauuuauuuauuuuuuagagacaaggucucacucuguugcccaggcuggagugcagugauguaaucacagcucauuauaaccucaaacuccugggcucaagugauccucccaccucagccuccugaguagcuaggacuacagacaugugccaccaugcccagcuaauuuuuaaguuuuuuguauagauagggucucaccaugcugcccaggcuggucucaaacuccuggccucaagcaaucuugcugccuuagccuccugaagugcugggauuauaggcaugagccacugcacccagccaauguuaguuuaaacuuuuguuuaucuugagacagggucucucucugugccccaggcugaagugcaguggcaugaucaugccuugcugcagcaaaaccccauccguaccaaaaacacaaaaauuauccaggugugguggugcaugccuguagucccagcuacucgggaggcugaggugggaagaucgcuugagcccaggagguggagguugcagugagcugagaucgcaccacugcacuccagccuaggcaacagagcaagagccugucucaagaaaaucaugaacaccacacugcucuuccccucuccucuuuuucagggucagacucaucuucccuuaccuuucuaaggcaccagauuccucuccagauacuucuuucuugcugucuuuuuuuuccuuuauguuuuuauuuuauguauuuuuuaaauugauaaaugauaacugucuauuuucaugggguacauaguguauauaaaugucagaucaggguaguuagcauacccaucaucucaaacauuuaucauuucucuguguugggaacauucaauauucuccuucaagcuauuuaaaacuauguaauaggccgggcacgguggcucaugccuguaaucccagcacuuugggaggccaaggcgggcagaucacaaggucaggagaucgagaccauccuggccaacauggugaaacccugucucuacuaaaauuaaaaaaaaaaaaagugagccaggcaugauggcacacaccugucauccuagcuacuugggaggcugaggcaggaaaaucgcuugaacccaggaggcagagguugcagugagccgagagcgagccacugcauuccagccuggcgacacagaaacuccauaucaaaaaaaaacaaaaaaacuauguaauagauuacuguuaacuaggccggccccgguggcucaugccuguaaucccagcacuuugggaggcugaggcagguggaucacuugaggccagaaguuugagaccagccuggucaacauggugaaaccccgucucuacuaaaaauacaaaaauuagcugggugugguggugcauaccuguaaucccagcuacuuaggaggcugaggcaggagaaucacuugaaccugggaggcagagguugcagugugccgagauugugccacugcaguccagccugggcaacagagcaaggcucugugucaaaaaaaaggaaauuacuguuaacuauagucguagucauccuacaguacuauagaacccuagaacuuacuccuccuaucuagcuguaauuuucuuuucuuuaacaucuugccuccucugaacagccaaaguucuaagaguugccuucucuuacauuuuuuuuuuuuuuuugagacggagucucacugugucacccagguuggaguacgguggcacgaucucggcucacugcaaccuccagcuccuggguucaagcgauucuccugccucagccuccugaguagccgggacuacaggcgccugccaccacaucuggcuaauuuuuguauuuuuaguugagaugggguuucaccauauuggacaggcuggucuugaucuccugaccucgugauccgcuggcuucggccucccaaagugcugggauuacaggcgugagccauugcgccucuuacauuuuuguuucucauuuucuccugaaccuuuuuuucuguugccaucacuguacucucuccagaaucaccggugacuucagaguugcuaaauccaggagacaguuucaguccucucugccucugagcuguuuccucugccugcaauucuuuuucuucccaccuaagccuguuuguuucuugcucacuuaguaaagucacuuucccaggaaaauguuuccggucauucuccgggcacccuaggcuacaucagguaaccuguuagaacauuucaaagcacccuuugcuuuucaacugugguugaauacuuuuauaauuauuuguugaauuucaaucuagggcugccugguuugugggggcuaggauuuucuuuacuuauuuauuuuuggaggcagagucuugcucuguugccuaggcuggagugcaguggcgcaaucucaacucacugcaaccuccgccugccagguucaaccaauucuugugccucagccucccgaguagcuugaaccacaggugcacaacaccacgucuggcuaauuuuuuuuuuuuuuuuuuuuuaguauuuuugguagagacaggguuucaccauguugaccaggguggucucgaacuccuggucucaagugagccacuguguccggccugggauuuuauuuuaaaguguccuuguuguaccucuagugucuaucugugucugucacauagcagggauugaguuuacaccacacuuagaucaaacacacaagugcauuucccauucuucccagauuucaauaccaaaucccuaagaguggucacgaaccaguuauuuuuauuccaccaugagucacaucaacauucuuauuuccaaauccccagaaggcucuguuccauuucuuucuuucuuuuuuuuuuuuuuuuuuuuugagucagagucucacucugucgccaggcuggagugcaguggugcgaucucggcucacugcaaccuccaucucccagguucaaacaauucuccugccucagucucccgaguaacugggguuacaggcgcaugccaccacgcccagcuaauuuuuguacuuuuaguagaggugggguuucacuauguuggccaggcuggucucgaacuccugaccucgugauucacccaccuuggccucccaaagugcugggauuauaggcaugagcuacugcgcccggccucuguuccauuucuuguuaugcuccuacagcccugaguucaguucuccugcuugcuauaugauuacuugugaauugcuuuuauuuagguuaucaacauggauuauggaaugcaagaaaagaauccaauugaucauguuagcuucuauuguaagacugcccccaacagagcaaucaggauuacuaaaaaccagguaacuacuuaggcaaaacaaauauacuauaguggcauguagcaaaucuuuauaguaaauuagcauuuuauaugcaaauuagguuuuaaggcauaucuuuacaauuaaagugggccuggcacaguagcucauaccuguaaucccaguguuuugggaggcugaagcaggacgaucacuugagacgaagagcuuaagaucagccuggccaacaaagcgagaccccaucucuacaaaaaauaaaaaacuuaggcaugguagcucaugccuguaguuccaacuacuuaggaggcugaggugggaggaucacuugugccugggaggucaaggcuucagugagcugugauugugccacugcacuccagccugggugacagggagaucuugucucaaaaaaaaaggaauaguuaggagccuagggaccagcugauaucuccaaugugugacuucaaggugauagugaaaucucuucauuuuaaaaagguuucacaacuucugccagagaaauuugcagagcagcugauucgaguauauuguaagaagguggacagaaagaguuuguaugccgcaagacaauauuuuguucaguggugugcagacagaaauuucaccaagccgcagguagguggccuguuacucacaaacuuugcacaauuuuuuauuuuuaaguaaaaaccaaaaguaagucuaucugcugaaaaguucccauuuaaguuauagucauuugguuaugguuuugaaaauaaggucuuucacuuucuuuccuuuuaaaaugucugaaucugugucagccagugauuucuuccuacaggaguugggaauggauacuguuuagcauuauuguccuaauaauaaaaaugugaacauguaaauaaugcuuucuaauguuguucaccaguggcccuggaagguuauucauagugucuccaucuuucagagguuaccaaagcugaguaguuaacuuguuuaacauaaaauugauaauagacuucauguuucuaaaccucguuacuucaguauauuaguuagcuauuuaaauuaucuagaaugugaguagagggaagaggagccaagccacaguugccaacccuguagagaagguuguuaaaauugucucuuacugaccuacacaugguaggugucugcacagagaauguggccaguuggcauuuauugaaugaaugaaugaaugaauaugauuggcaugcagggcaacagugcuuuacugccuagucuagaacucucccucacaccucccugugugucaggugcuaaagggaacaaaggauagggugagacaugaaagcguagcucaggaugucggugcuuuaucaagugccacaaggcaugauccagguaagaucucugaggauucagagaguugggagaucucugggagaagccuggugaaggggcaggaucugcuagaucuagaaggcaggguuguguuuggaugaguagcagggagaaugcaggguauauuuggcagugggaggagcacaaaggcaugaagcuggaaugagcugagacuguuuaggggaccaugaggagaccugucaggguagaaaauucuuuuuuuuuuuaauuaauuaauucauucauuuuuuugagauggagucuugcuuugucacccagguuagagugcaguggcacgaucuuggcucacugcaaccucugccucccagguucaagcgauuccccugccucagccuccugaguagcugggauuacaggcaugugccacaaugccuggcuaaauuuuuguauuuuaguagagaugggguuucauuauguuggccaggauggucucuaucuccugaccucgugauccgcccaccucggccccccaaagugcugggauuacaggugugagccaccaugcccagccagaaaguucuuacuguuaaguguggagagguuaaaugggaagaguggacuagauuauugagaaccuuggauaauuggcuaagagauuuuuuucucuguacaguggggagggaaucauugagcauauucaagaauuaccaugcacuguaugaucuaccugaaugugugucaucuccaacuagagugacacccgugggaauaagaguagaauugucccuuggugucuguggggaacuaguuccaggacccccacagaccccacagauagaaaaauccauggauaggcugggcgcgguggcucaugccuguaaucccagcacuuuugggaggccgaggugggcggaucacgaggucaggagaucaagacuauccuggcuaauacugugaaaccccgucucuacuaaaaauacaaaaaauuagccggcgacugcacuccagccugggugacagagcgagacucugucucaaaaagaaaagaaaagaaaagaaaaauccacagaugcucaagucccuuauauaaaaugguauaguguuugcauaugaccuauacauauccuccuuuauacuuuaaauaucucuagauuacuuauaaaaccuacuacaauguaaaucuauguaaauaguuguuaauacuguauuguuuagggaaucaugacaagaagaaauucuguacaugcuuaguauagacacagccauccauuuuucccccuucauauuuucuaucuacaguugguugaaucugcccauggaugcagagggccaacuguaugucuguccuagguacugugaaacuaaaucacugaaacuaaaucacugaaaacucuagcugcagauagacuggaacuuggagagucuggaaauagagagucaagagaggcuauuaaaguuuggcugugucgugauaacuacuauaaauuugguacauucacucacggagugaguauuuugccaugcccuguguuagguaccuggaacaguaccuaagauagacaguuccuaauaacccauggaucccauucagguuggggauaauaaucuaguuggggauaauaauaauuauuauuaauuuuucuccauaaguuaauaauuauaggagcaugguaaguacuuuggguauagggugaguacacagucuuagaagaggaaaaacaaggaggauuuagcuggucuugguuggucaggaaaagcuuauuuaaagaagggcuuauaaacugagaccugaagguugagugaggaguugucuggguuaagggcuggcagcaggagguggugguaggggagggguugaggcauagacaccacaggguuaggucggaagaugagaaagaacaugaugcauuucaggaaggagcauagaguguggaggugucuggggcuuuaucaaaguccugucagccaagagcaguagggagcauugacacugaaggguuuuaagcaggaaagugacguauuuguuuacauuuauaaaauucacuagaacugaaaguagaaugaguagaaauuaaaaaguuggcuauaugcuaggcaugguggcucauaucuguaauccuagcacuuugggagguugaggugggaggauugcuugagccuaggagucugaggcugcaaugagcuaugaucacaccacuacacuccagccugguugauagagcaagaugcugucucaaaaaaagaaagaaagaaagcaagcuggguagaaauagagaugaguuuaaagacaaauaaauacuguugauuuugagauaggccuuuaaguacaaguaucaugacaauaggaugacuuuuuuuugagacagagucuugcucuguugcccaggcuggagugcaguggcacaguuucagcucacugcaaccuccaccucccggguugaagugauucuccugccuccgccuccugaguagcugggacuacaggcacgugccaccaugcccggcuaauuuuuguauuuuuaguaaagacggggucucaccauguugcccaggcuggucuugaacucccgaccucaagugauccaccugcuuuggccucccaaaguguugggauuacaggcaugaaccaccacgccuggccuaaaugauugccuuuacugaggucaggaguucgagaccauccuggccaacauagugaaaccccaucucuacuaaaaauacaaaaauuagccauggugaugcacaccuauaaucccagcuacuugggaggcugaggcgggagaaucgcuugaacccuggagguggagguugcagugagcuaaaauugugccacugcacuccagcaugggugacagagcaaaauuccaucucaaaaaaaaauaauaacacauuuuuuaaaaacuauuuuuaauaguucuaucaagucagauccaguguaguucaacagaaaaaauuuaacaugggggugagauacaaaaguuuuggcagagcuaaaugagcauagaggacagugauucaacagcaggaagcugcuaccaccucuaggauaggagagaccaagggagcaggugggaguccaggagcuggggccaccugcaaaagcuagaaccacagaauagucacugccacugccgcucgugccagaggagguagggagagaaaaaaccugacuucucugcccucuucucaccuccagucucccaccagagccucccacugaccaaaucuaacuggaaaccaacaggcaugggagcugagaaauguaauuuaccggaguagcuccugugagacagaguagggagaggaagagugaagaauggaucugagagcaaauaagcagaugaggagcacgaauccucccaccagcauuguauuccugguacaacagaggcucuccaagaucgugcaucaucuuguaaccaaagaagaucuacccacaaguucagaacaguuuagcauagagucaaguauuaggaggccuugcuucuuaccucuaugguuucacgucauuguaucgccucccuuuggaucucucccuuauuuuggguggaggagcuucuuuggcuggagccuaugcugaugggaccaacguuagagcuuugaugcagagaaaaauuuaaauucugcagguacauacuguucuuccuccccuucuuugccaucuuguagaccugggccuuuuauugcagaggggaccaggcgagagagaagcuagggguucagugcaucccgucuuucuccugggaaaacaggacagaguuugugcuccgugaaggugugugaaggaggccauagaggugggcagugguaugcugcucccagucaucucugcagaggccaguggcuguuuucaugaaggcucuuccugcguaagacuguaguguuucuaauuugccccaagcacagggcauauguaauuuggaguuucccuggauugaggacagcuagaagcaaucuauaugcaagaugaggaugugcgcacuugagacuuucacucagaaauaagaugauggaaacuggcuuuucucuauugccuguuuuucucucucuuccuaauaggauggcgauguuauagccccacucauaacaccucaaaaaaaggaauggaacgacaguacuucaguccaaaauccaacucgccuccgagaagcauccaaaagcagaguccagcuuuuuaaagaugacccaaugugaaugucuguagucaguuguuuacaaacucccucuccugcacaauucauuuagaggcuucaaucauagaauucugcaaauuaaugacaacucaugcuuuaauuuuguauuuugaauguacacgcaugcugaagcuaaguaacuuuuaaucaaagaaauaagaugguauuaggcaaaucuuacuauacuaugaaaagcauuaccuugccuauuuuuaauauuauuaaagccuuucuccuucaguagucuauuuucuuagaauaacaacucuuuuaucuauucugaacucuauuuuuuuucuuuuuuaagagacaagguuuugcucuguugcccagcuuggacucgaacuuuccugggcucaagcgacccuccugccucagccccccaaguagcugggacuaaagucaugugccaccacacccagcuuacucugaacuuuuaugacagaugauuguuuuuuguuuuuaauguagaaaugagacaaggguacaaauuggaacuagaaauugacauugucauugacaaacauggcuaaaaacaaaacaucaaauccugcccccgugaagaguucccugucaccucaaguuugaggauaguccucuaagagugaccuaagcauaagugaaagacaccuccccucacccuucuagcccccuacaaggugccagguugggguaaagaguuggagaugauggccaggaguggccuccaacacgcuggugagaggccugauuagguuuuggggaagaucugagagcucuggccucuucgugaguggaacauaaagccgccucuuguugggagauccuaccccagugacagaggaaucccccaaacuaggcugugcccuggcuccguggcggcuccagacccggguagugccuuuguccccugaauacucacucccccgguccagagggccuucccacugcccagccuggagaaggccuccccugaccugcucucucaguauccuggagagcuggccagaggccaucacaggcaucauccucagagcuccucagaccugggacuuuguuuuugcugguucagugcauuuuguguauuuaagagcaaacacuagccaggcguggcggcgugugccuguagu

SEQ ID NO: 191264 - RNA, 98233 nt, Homo sapiens
gcaggugguuguggguagcgcgccugggagggagaaagaagucgggggccguggcgcgcagcccgcggggccugaagggauguucgaggacaagccccacgcugagggggcggcgguggucgccgcagccggggaggcgcuacaggcccugugccaggagcugaaccuggacgaggggagcgcggccgaagcccuggacgacuuuacugccauccgaggcaacuacagccuagaggugagcggcagcagguggggcggccggacccuacccucgccaggccccaccccugccccgccccuuccucggccuaugggguggugggaguuuccccaccuaggagggucgcugcgcagccaagcgccgaggggcgggaaagguggguguagcucagccaauccacccaucauuuugaggcgggaaacugaagcucaggaaaggagcggccuaggucccgcgccgcucagaccccaggcuuccugaccacacuucccucuaccccgccaagcgccacaaaagucauggugcugcccuuaaaucaguaagaacaaauauaaugguaaagugaaaaugaacugcaugccaagacaucacugcccagagcuuuaaauggacccucaguuccgucugaaccccuucugugauccccauuucacgcaagaggaagcggagcccuagacggguuaagcuacaggcccaaggucacacgguuagagauggagccagacccagggucugagccguuuaaccuccacccucugcuucaccaggguggagcugccggucgcugugcagcaguuugaucaaagccaaugugcacacgaagcugaucucagcccuacguuuccuccuccgucagagcaucguccugaugcuuugcaucagugucuggcucugaauaaaacaaaugucaguuauaauuacuugauuuuuuuccccaucauucuugcauuuuauccucgcaacagcccugugaacauggcauggcaaugaguauuagacugcuuuccaggugauaauggcaaggcucagaagguugucuugccuaggauuauucuaauauagaaacccaggcugggcguggcggcucacgccuauaaucccagcacuuugggaggccaaggcgggcggaucacuugaggccaggaguucgagacuaaccugggcaacacggcgaaaccccaucucuacuaaaaaaauacaaaaacuagcugggugugguggcgccugccuguaaucuagcuacucgggaggcugaggcaggagaauugcuuaaacccaggaggcauaggccgcagugaguggagaucacaccacugcacuccagccugggugacagcaagacucuaucuaaaaacagagaaagaaacccagacgagcauaagcccaguguagacagaauugugauggaguguauuucauguagcaccacuggccucauguucaaaggcuuucaugugccaagggcgcuggacccacucccagggugcaccacugacucaccacccagugaaauaauugcuggguucaaaggcauagaguuggaaaagugucgauuguaugugugccuauauaugaaggaguaguaccugaaaaaagugucuucagaacuggauagacuggguaaaggacaaugguccacauccguggguggcaugacuggagagcugugggaagaauaagaaaguaagggagauuagaaugaauggcgucucaauugaaaacagauugauuuuugaaagccugagaaagcauuucugacauccuaggucugauuuggucucucuugcccaaggucacaccaucugucauugaauaagcauuuacugugucaaacuauggucaaggcaugcaccuguuucagauucuugaauaugacaaguuuguucccaguuuugugguauauccaugccauucccucugccuggaauauuuccccucacccccaacaccaggaaaaguugagagcuaaaucucuaguuaggcagaguugaauaggacaucuucaauguuugcucuacuuauuuauuuuuucuuucuuuuuuucuuccuuagaaacagggucuuggccgggcgcacgguggcucacaccuguaaucccaccacuuugggaggcugaggugggcagaucaccuuaggucagggguccaagaccagccuggccagcauggugaaaccccgucucuacuaaaaauauaaaauuagcugagcauggugacgugcacuuguaaucccagcuacucaggaggcugaggcaggagaaucucuugaaaccaggagguagagguugcagugagccaagaucacgccauugcacuccacccugcacaagaguguaacuccaucucaaaaaaaaaaaaaaaauggaaagaaacagggucuugcucuuuugaccaggccuggaaugcaguggugcaauuauagcucacuguaaacucaaacuucugugcucaagugauguuccugcuucagccuccccaguagcugggacuauaggcaugcaccacggugcucagcuaauuuuucaauuuuuuguggagauaguaucugacuauguugcccaagcuggucuugaacuggccucaagugauuuuucugccgcagccucccagagcauugggauuacaagcaugagccaccgagcccagcccaaugcuugcuuuagaaagcacaaauguaugaacugaaauuuuguguuuauucuauccaguguuuauuuuccucuuuuuuuaaaaucaauuuuuuaaagguauuuggaguagucauuuucauauaucucaugcuuccuaagaagucuuucuccaaucccuaccccucucuagucuaccugacaaacuccugcuuacauuuuuauugauuuacaaauuuugucuccuuuugugaggccuucccuaaacuguagucaaaaucaguuauucacugcacuauauucuccuacaacacuuuaucuucaguucuucuuauagcuuguauaucucaccaauuauaaaugauaguaucuguuccucuucuuagcuccagaugugaaguucugugagaucagaaaacauuuuuuguauuucuaaggccuggcaaguaggccuuagaaaugcaaaaaaugguuucugauaucauagaauucauagaauuuuuaugaaauaggauuuuaucaaauagaauuguauucuauuuuauucucauggaauaaaauaguugacuuuuuuaaggaaagaaagucaggccaggcacaguggcucacaccuauaaucccagcacuuugggaggcugaggcaggaggaucacuugagcccagaaguucaagaccagccugggcaacauagugagacccuaucucuacacaaaauaaaauaggcugggcaugguggcucacaccuguuaucccgacauuuugggaggcugaggcagguggaucacuugagcccaggaguuugagaccagcuugggcaauauggugaaaccccaucucuacaaaaauuagcugggugugguggcaugugccuuuagucccagcuacuccagaggcuaagguggggggauugcuugagccugggaggucgaggcugcaguggcccucauuccugggaagucaagacugcaguggcccugauuguaccacugcacuccagccuggggcaacagagugagacccuguuuuaaaaaguaaaauaaaaaucaguguauucuuuaaugucuuuaaaaaaaucgaaacaauaauuuuaggacuuauauuuucaccaucuugcuagaauuuucauuuaguagccuguauccaaaggcucuauaauacuuggaugcuaaucccaaacaacucuuucucuuuuucuuuuuugagacaaaaaaagggccucaggcacuucucccaucucagccuccagaguagcugggacuacaggcgcauaccaccacguccugcuaauuuuuuuguauuuuguagagauaggguuuugcuguguuacccaagcuagucucgaaccccugaacucaagcaguccacccacaucagcuucccaaagugcuggaauuacaugcguaagccaccaugaccagacccuauucccaagcaauucauuaaucaaagcuuguaaaaauauucaucuuuaagcuuaccugccucauuuagugcuuugagaaaagacuucucauuccuucaggguaggaacauuggguuuauugauggccacccauuucuacccaccccuuuuagauuauugcaagaaaucuuuuuaucaaucuuuuuauccuucuaggguuuggucuuaaagacagucuguggaacaguguauaagaacacuauuguguugugcuaucagauuuacaucuguaauucuuuuuuuuuuuuuuuuugagauagagucucguucuuucacccuugcuggaguccagugggucagucacagcucacugcagccuuaaccuucuggacucaaaugauccucccaucucaguuccccagguagcucuaacuacagacgugccacauacccggcuaauuuuuuccuuuuuuguacagacgggggucucacuauguuuccuaggcugaucuugaacuccugagcucaagcaauccucugccucagccucccaaagugcugggguuacgagcaugagccacugugccuggccuuuaucuguaauucuuguuuuuuuuuuugagauggagucucacucccguugcgcaggcuggagugcaguggcgugaucucggcucacugcaacccccaccuccuagguucaagugauucuccuuccucagccucccaaguagcugggauuacaggcgugcgccaccacaccuggcuaauuuuuguauuuuuuaguagagacgggguuucgccacauuggccaggcugcucucaaacuccugaccucaggugauccacccaucucggccucccaaagugcuaggauuacagacgugagccaccgcaccggccuauccguaauucuuaauccuuaaacuucagcuauuguauuucagcagugaagucaugaagugauucuagcuuggagaugucugaagucuaaugcagaaaauuguugaauucccaaaugucaccuuuuuguggcauuguaaauugagauaucuacuaauauaaagagccgugcuuacuacagucgugugcugcagaauguuucagucagugauggaccacacauacuuuauuuuuacuauauguuuucuguguuuagauacacaaauaauuacuauuguguuacauuuaccaacaguauuuaguauaguaacaugcuccacagguuuguagccuagaaacaauaagcauaccauauagccuagguuuaguaggcuaugcuauguuugcacaacaaaauugccuaauguugcauuucucagaauauaucccugucauuaagcaaugcauaugacuguauuuuaaagaugacauguuuugggguaaauccccaaauguuuaccuuacaaaaaugacagucuccuucauguugcguaagauuaauauuaauuuuuuaugugugacucccuugccaacuuuuuacucuguucuugccuuucccugccacacuaaagagaaacauaaagcaaaaacgauagaaacuucaggaucaucaaggccauuucuuaaaaucaagaaagucaugcugacaaauuuuaauaaaacucuucugguaauucagacaugcuucacuuaaugacagggacauggucuaagaaaugcaacauuaggugauuuuguugugugaacuucacagaguauacuuaugcaaaccuagauaguguagucuacuauacaccuaggcuguuuaauauagccuguugcuccugggcugcaaacuuguucagcauguuucuguacugaacacuauaggcaacuauaauggugaguauguguguaucuaaacauaaaagggguacaguaaauuauaauuuuuuaaauauauagaacaguuagaacauacaguauuacaaucuuuuuugugugugugacagagugucccuguguugcccaggcuagacuguaguggcacgaucucuacucacugcaaccucugccucccgaguuuaagcuauucuccugccucagccucccaaguaggugggacuacaggugcaugccaccacacccagcuaauuuuuugcauuuuuaguagagacggaguuuugccauguuggccaggcuggucuugaaccccuggccucaagugauucacccgcuccagccucccaggcaugagccaccgcgccuggcaaguauuauaaucuuaagugaccaccauuguauaugugguccaguguugaccaagauguuauguggcauaugccuguauuagauuuggaguguaggugaaagaguuuuuuucuuuuuuuuuuuuuuaagagacaggauuuaagagacaggaucucgcucagcugccuauguuggaauguaguggcacaaacauagcucacugcagucuugaacuccugagcuuaagcgauacucuugccucagccacccaaguagcugggacugcaggcaagcaccaccaugccuggcuaauuuuuuuauuuucauuuuuagagucuacguugcccuggcuagucuuaaacuccuggcaucaagugauacucgcaccucagccucccgaguuacugggauuacaaacaugagccaccaagccaggcuuuuaucuuuagauuaauauuaauuuagcauguuauaguuguaaaaacacagaacuaagaguaaggaguuuuauacccauuacugcaacuaacagcuuugugaccuugggcaaauaucuucacuucucuggcccuuuaucuacauaaggaaaauugagaccagauaauucuacaucucuuguuucuagaauuaaagcauuuuaacauaauauuauaccuguuuugcuguuugucuuuugcuugccagggagaaguuacacacugguuggcauguucauuauauguugcaugccgcaaaagcauuauucccacgguuggaaaggguaucauggaaggcaacuguguuucacuuaccagaauacuacguucagcuaaauuaagguaaaccucuuugauguuuuuaaauguuauauaagcucuaaauuuuggaaucaguuuucucuuguuuugagaucauuugacuucauuuaauuuuuauuuuauuuauuuauuuauuuauuuauuuuugagacgcagucucacugugccagccaggcuggagugcaguggcacagucuuggcuuacugcaaucucugccuccuggguucaagugauucucaugccucagccuccugaguaucugggauuacagacacacaccaccaagcccggcuaauuuuuuguauuuuuuuuuuuuaguagagaugggguuucaucauguuggucaggcuguucucgaacuccugaccucaaaugaucuacccaccucaaccucccaaagugcuaugggauuauagacgugagccacugugugacuucauuuaauucuaaguuauaacauagauaauccuuucccaauuuucauauucuuucucugccuuucucaaauucugcuagaaaccucuguguugaaucuuuagcuauacuuuuuaaaauuaauuuuuuaaaauuuggaaauaauuuuaggcuuacagagaaguuacaaaaauaagaaaaggacaauacccauauacccuugacucagagucaccuguuauugacauuuuaucccauuugcuuucucauuugauuuuucuuucuucaauauauagaucuuucucucucucucuuuuuuuuuuuuuuuugagauggaguuuugcucuuguugcccaggcuagagugcaguggugcaaucucagcucaccacaaccucugccuccuggguucaagcgauucuccugccucagccucccgaguagcugggauuacaggcaugugccaccacgccuggcuaauuuuguauuuuuaguagagacggaguuacuccauguuuggucaggcuggucucgaacucccgaccucaggugauccacccgccucagccucccuaaaugcugggauuacaggcgugagccagcacucccagccagaucuuucucuuuuuauccucaaccauuucagucuaaguagcauacauuuguagccuuuuaccccaaaauacuucacuguguauuucuuuaaauaacuacaguacagcuaccaacuucagcaaaauuaacacugauaaaauaauuuuauuuaaccugcuaacucuguucuaguuuuguuaguugauucaauaauguucuuuauggcauuuuuuuuccuggaaguacaauuucuaauuaaggaucagguauugcauuugcuuaucaugucuauuuauucuucuguaauuaggaacauuuccacagccuuucuuuuucuuuuaugacauuaccauuuuugaagaauauaauccacaaucacuuugucccuuucuuuaauuaaaaaaaauuuuuuuagaggccgagucuugcuguauugcccaggccucgagugcaguggcaccuuuuuagcucacugcagccucaaacuccucagcucaaaugauccuccugcuucagccucccaaguagcugagacuacaaucaugugccaccaugccugacugauauuuuuaaaucuuuuuauagagacagggucuuacuauguugcucaagcuugucucaaaguccugaccuuaagugguccucuugccucagccuuuuuuuuuuuugggacagagucucacucuguugcccagguggagugcaguggugcaaucuggacucguugcaaccuccgccucccggguucaagcgauucuccugccucagccuccugaguagcugggacuacaggcaugugccaccacgcccagcuaauuuuuguauuuuucguagagauguggauucaccauauuagccaggcuggucucaaacuccugaccuugugauccgccugccucagccucccaaagugcugggauuacaggcgugagccacugugcccacccucauccccucuuuuaauagaugguucccaauuuuggauuugucuccuauuaacuuuugauuagaugcagguuagucauucccugauggaaaacuguauaagugauuuugucuccugaggauaucacaucugaugauggcauguguuauccaucugcaucucauuggugauguuaauuuuugucaucuggucaagauguuguccuauuucucuacuguauauuaauuuuuuucaccuugcagcuacucuaugggucucagauacaucuuuuacuuacucuaguaucaagcauauagaauuauuuggcuggauaggaaacaaaacaaauuuagcuauccaguuuggauucaugcuaauauucuuuguuucugggacaaaacuauuuguggucauugucuauuugcuauuccuguguuuccagaauagaagaggagcaaaguuuaaagcccuauucagaaauggcaaauagguuuuaguugaugcuaaauuuaaauuuuuuuuuauuuuuauuuuuugagacggaguuuugcucuuguugccccggcuggagugcaauggccugaucucagccuccccaguagcugggauuacaggcgcccgccaccacgccuggcuaauuuuuuauauuuuuaauagggagaggguuucaccauguuggccaggaugguuucaaacuccugaccucaggugauccacccgccucggccucccuaagugcugggacuauagacguaagccaccguguccagccuaaaaaaaauguuuuuaaacaacuuugguucuaaaaauaaaauaagaugauaaaaauuaaaugaagaucaaugggguuaauuuuuuaauugagcaagacauuaucauuguuaguauaaaacaaucugaucuuuuucugucaauguuugucauuguucauauaauuucaaaaaucuuuguaaugacagauucugggggaacuaaacaaaaaagaauuauaacaaaacaaauguagagcaguacauggcaggagaaucacuugaaccuuggagguggagguugcagugagcugagauagcgccacugcacuccagccugggcgacagagcaagacuccauuucaaauuaaaaaaacaaggcugggcgcgguggcucacgccuguagucccagcacuuugggagaccaagccggguggaucacaaggucaggagaucgagaccauccuggcuaacacagugaaaccucaucucuacuaaaaauacaaaaacaaaauuagccaggugggcgccuguagucccagcuacucgagaggcugaggugggaguauggcgugaacccaggaggcggcgcuuauagcgagccgagauugcgccauugcacuccagccuaggugacacagugagacuccgucucaaaaaaaaaaaaaaaaaaaaaaaaucaaauuucaaauaaugaaacaaacucuggagauggacaguggugaugguugcacagugugaauguacuuaaugcuacugaacuauagacuuaacagugguuacaacgguaaagguuauguauguuuuaccacgcacacacacguacacacaaauguauuuucaaaaauuuuaaauaauacagaaggcuuauaaguagaaagcaguauccuuggccacgcacaguggcucacaccuguaaucccagcacuuugggaggcugaggcggguggaucaccugaggucaggaguucaagaccagccuggccaacaugaugaaacaccgucuuuacuaaaaaauacaaaaaaauuagcugggcgugguugcgggugccuguaauccuagcuacuggggaggcugaggcaggaaaauugcuugaacccagggaggcgaagguugcagcuagcagagaucgugccauuguauuccagugugggugacaagagugaaacuccaucucaaaaaaaaaaaaaaaagaaaagaaaagaaaaacgucuccuuuuggcacucuccguaauuaaccauuauuaauaauuucuucuggccaggcgcaguagcucaugccuggacuccccagcacuuuggaaggcuuagacgggcggaucaccuggggucaggaguucaagaucagccuggcuaacauggugaaaccucauuucuauaaaaauacaaaaaauuagucgggcaugguggggcacaccuguaaucccagcuacucgggaggcuaaggcaagagaauuucuugaacccaggagguggagguugcagugagccgagauugugcuauugcacucuagcuugggcaacaagagcaaaacucugucucaaaaaaaaaggucuuccuauguacaaauauauaaacuuguuuuuugguauuuuuucuuuuuauuuucuuuucucuuuauuuguuugagacagagucuugcucugucacucaggauggaguguaguggugugaucacagcucacuacagccuagacaucacaggcucaagcgaucccucacuucagccucccgaguagcugggaccacagguauacaccaccaugcuuggcaaauuuuauauuuuuuguagagacgggucucaccauguugcccaggcugguguuuuuucuuuuuaaaacauaaauuauacuauauguguugcucuacaguuauuuuucuuuauauuuuggaaauucuuccauaucagcauauguaguucuaccucauuaauuuuuuuaaugauacuaggauauuuuaggguauaaggaucuuucaucuauuuagccaugccuuauggccauuucgauuguauccaguccuuuguaguugcggacaaauaaacaucauuguaaagaugauauuucugauaaauuccaaaaauauguaugauuccuaaaaaugggucaaaagauguaucuuuuuuggucaggcccaguggcacacaccuguaaucccagcacuuugggaggccaaggcgggcagaucucuugaacccaagaguucaagaccagccugggcaacagggugauacccuguuucuacaaagauuagccaggcaugguggugcaugccuguaaucccagcuacucgggaggcugaggugggagaaucacuugaacccaggagguggaggcugcagugaguuaugaugaugcaacucuacuccagccaggcugguaaagcaagacccacucucaaaaaaaaaaaaaaauccauuaaaaauaauuacaaacuuaugaaaaaaaagaaaacuaagucuuuuuaaaauguagauugauauucucaaagucccuuucccccaaaauguuuauuuuuuuuugagcuagaaucuugcucuguugcccaggcuggagugcaaugcacggucucugcucacugcagccuccuccuccuggguucaagugauucuccugccucagccuccccaguagcuggggcuacaggugcaugccaccacacccaccuguauuuuuuuuuuuuuuuuuuuuuuuuguauuuuuaguagagacgggguuucgcuauuuuggccaggcugaucuugaacuccuaaccuugugauccauccaccucggccucccaaagugcuaggauuacaggugugagccaccgcgcccagccuguuuuuaucuuuuuuauuuuuuguuuguguuuuuugagacagggucucaccuugucacccaggcuggagugcauugucgcgaucucugcucacuugcaaccuccgccuucugggcucaagugauccucccaccacgcccuccugaguagcugggacuacaggugcauuucaucacgcucagguaauuuuuguauuuuuaguugagacaggauuucaccauguuggccaggcuggucucaaacucuuggccucaagugauccacccgccucagccucccaaagugcuaagauuacaggcaugagccaccgcgcccagccuuccgcaaaacguuuuuaagugucaaauuuuuaaugcuaaaagagcaguuacccagcaucaauguguucauucagagaaauaaacaaaaauuucaaaugauuuuguuugcuuugacuuauaauaauuugggcuguuuucaaaauuucaacuuaaauauaauuuuuuuaacuuuuauuauuauuugagucagggucuuacucuguugcccaggcuagaguacaguaacaugaucucagcucacugcaaccucugccucccagauucaagcaauccucccaccucauccucccaaguagcugggacuacgggugugugccacuaugcccagauaauuuuuguagcucuuuuuuuuuagagaugggguuucaccauguuccccaagcuggucuugaaguccugagcucaagugauccacccaucuucgccucccaaagugcagggauuacaggggugagccaccacaccuggucccaucucuagauuauuuauaccuaauacaauguaaauacuaugucaguaguuguuacacuguauacuuuagggaauaaucacaagaaaugaaguugguacauguucaauacggacacaaccauccuuuuuuuccaauuauuuuugaugugugguugguugaauccauggauguggaacucacagauauggaggguaaacucuagagagagagagaguguguguguguguguguuuguauguguaugguguuggugguggaguaaaauauauauaacauaaaauucauaaaguugacaauuuuuaaguucagcauaccuucaccuucacauuguucaaccaacaccaccaccauuucccgaacuuucuuaucuucccaaacuauacacauuaaaugguaacucagcuguuuagcuguuaguccagcccagcucugccucagugaacuaugcugugcucugcuccacugaggugcagggcugacuguaucaucaccagcaggggggauggcuggccccaaccugaggaggagaaaaagaaggagguacgcaggucccugggguuucugguuguauucuugucccuaggccccugcguugucccuuagugagggagaaaccuuaugauccuggcccagccuugcaggcucccccggcauagagacacaugcucugugcugucuucuaggggcugcugcugcccuaugucuccuggccaguugacauuuuggcaaccaugaagugaccugaagcgagccuccauuuacugauauuauaauuggagccuugguaccauucacccaaucucgcugagccagcaggggucucuggugagucuccucucagauuucaaaucuuccuaauuuugguuugagauucauacuuuguucaagcaaccaauuccacacuugauggagcuggaauuaaaguucugcuucuaaggacacaaucauagacacugguuauuuuaccuaggcuuugauuggaauggcaaauuuucagauaugaccagacugcuuuaaaacauugagguuguuuuuguuuuguuuuuguuuuuuagagacaggcuuuuacucuguugcucaggcuggagugcaauggcaugaucauagcucacugcagccucaaacuugggggggucaagcuguccucuugccucagugaccuaaguagcuggggcuauaggugcauuccaccaugccuggcuaaguuuuuguuuuguuuuguuuuuugucuuuucuuagagacugggucuggcuuuguugcccagguuggucuugaacuucuggcuugaggagauccuccugccuuugccucccaaagcacuaaagcacugggauuacaggugugagccaccgcaccagccaagguuuacuuuauagagcugauaaaaaagauuugggaagauugacucgccauugcagaacaaucauguauuugggucauguuuaagucaauaucucacaccauuaggaagguucauuccuaagaaguugagucucauggaggggggaauauuacaaaggaccaaagcugaauuuuaaacaagagagaagugguccuggaaacuguuucagacuacaugacugucccuuugaucaaagcaauuccuugagcaaucauuauuguucaaagguucccuaacaaggucccugaccuugcaguaaguaaaagaugucacuuucugacaagcccaggaaccucaagauauuuuuggggacuucaggaagagaggauuucacccaaugcauacagguauuaugggaacagucugaugauggauccuuggcuugacuucuuagccucaaggcuuuuaaaagucuaauccaaaauuccuuaugaauguuccaacaaaaccaacuuaaaagagccuagguggccacucacuauucuuauugcccccuaugcaaagaaucaggccaaauauauuacuaaaccuuauuuugaaaguagauugcgagccaggcgugguggcucacaccuauaaucccagcacuuugggaggccuaggcggguggaucuauugaggucaggaguucgagaccagccuggccaacauggugaagcccugucucuacuaaaauuauaaaaauuugcugggcgcaauggugggugucuguaaucccagcuacuugggaggcuuagaaacgagaaucaccugaacccaggagguggagguuguagugagccgagaucgcaccacugcacuccagccugggccacaaagugagauuccaucucaaaaaaaaaaaaaagagagagagaguaaauugcggcgggaccaggcacaggcagcauuuugggaggccaagaugggcagaucacuugaggccaggaguuagagaccagccuggccaacacaguaaagccccaucuuuaccaaaaauacaaaaaacagccgaacaugguggugcuugccuguaaucccagcuacuugggaggccaaggcaggaaaauugcuugaacccaguggacagagguggcagugagccaagauugccacugcacuccagccuaggcaacagagcgagacucuugucucaaaaaauaaaaucaaauaaauaaauaaaauaaauauuuuuaaaaagaaaguaaauuggucccacuaagauuaaucuuugguaaaaauggggaauugaagaggaaaaaaaaaaguacauucuaucaaaauuauagcauaccuauuauuaaauuccagccuugacuauuuuuuuaaauuuauuauuugcauagaauuuggacuaaguccugaauucuuuccugucugcaagucuugaaauugauguuucuaaauuuuucucccacuuuucugacuugaaaucacuaaaauuaaaacugcuuuuuccugaagccuggcaaacugaaacuggacaauuuuacguaaacuucagaaaagucaccauaguagcuuacauauagaaaccuuugugggcugggcgugguggcucaugccuguaaucucaacgcuuugggaagccgaggugggaggaucgcuugggagggagcccaggaguucaggaccagccugggcaacauaguaagagacuacuuuuuagucucuacaaaaaaauuuuacaaagaauguuagugaaguguggugauaugcaccuguagucccagcuaucuugggaggcugagguagaggaucacuugagcccaggaguuccagacuauagugagcuaugaucaugccacugcacuccagccuaggugacagagcaagacccuucucaaaaaaaaaaaaaaaaaaaaugcuuuaagcccagcaucuaaaaaucucaacuggcugcccccuguucucaaaaacuaaguaucuauaucccagauaaaucagauaacaucacuaaguuaauggccgauauaaagacccaaauaaaagauuggcuaaacagcugguuuagaucuugggaaacuugauaacaaaaaaaguuucuuuuucuaaaaauuauaaucauuuguuauuuuuugucuacacugcuguuauggcauuugaggguuuuuuuuuuuuuuuuuuggcugagacagggucuuacucuguggcaucagcuggagugcaguggugccaccucagcucacugcagucucuaccuccugggcucaguccucccaccucacccucccaaguagcugggacuuaacagguacacaccaucaugccaggcuaauuuuuguaguuuuuguuuuauagagaugggguuugccauguuaccaaggcuggucuugaacuccugagcuccaagggucugccugccucggccuccuaaagugcuaggaacccaugacaguuacaucuucagugugaaauguuaaauauaccuucccccugcccgccccccaaaaaaagaccaucuugacuaaucagaucauuguaacuauacauuaagccuuacauaggaaaauauuaguguuaaacuucaaauaaaaccaaaaugaaaacugcccauuucacccuuacccccagccucagcaaccaccauucuacuuuuucuuccucuaugaauuugauuacucugagcaucucuuagaagugucauccuacaauauuuguucuuuugugacaugcuuauuucacuuaucguaauguccucaaggaaauggcugauuccaaugcuuagcagacguguuuucucugaugcaucuggaacagcuucuuaugccagaaaguaaggagugcucaacaaaaugguggaggugugucaaggaacuuagaagcuagguugaaaagacucccauugguagacucccguuauuagaaaggaaugcugcuuacauuagaaugccagcuaauaaauguagaaaaagugguagaauuagaaaauagucaccauuuugcaaccucauaguaauaauugauacagucaaagaucaucaauggauauuaaaacuagugaauaaaaguuugaugaagaacagaauauucacguaauugcaaagugucuccuaugaaucacuaauuacaaaggaaaaaauagaaacuuugaaauggaaaacauggcacauaccaccuaaaucaaguacaaaguuaucaguaaugggacuaauggauaugauccucugacaaggauaugacaucacuuagguaauacucuugucaaaaauacauagccuaaaucuaauaaugagggaagcaugagacaaacccaaauuagggacauacuacaaauaacugaccaauugucuucuaaaauguucguguuacaaagaagucugaggaacugguuccaggcugaaagaaacagaaaggaaaugacaccuaaaugcaauacaugcuacuggauuaggauguuuaaaauugcuccgaaagaacauuuggacaauugguaaauuuuaaauuuaaguugaaauauggacuaauauuuuaucaauguaaaauuuucugauuuugauaauuguacuuugguuauguaagagaauuuuuuuuuuuuuuuuucagaaaauagaaacugaaguauuuuuggguaaagggcaugaaagcuaaacgugacucucaaaugguucagaaaaaaauuauauguauauugcaauaacuaggauuauccagagaaaaagagccaacaagcuauauauagagaaaaauuuauuuuaaggaauuggcucacacgauggaggcuuggagaguugaaagucugaugggguaggccccauguuggagacugcacuuugagucuucaucuugagggaagagcugcaguuugagucuugaggcagucuugugguagaauuucuucuuacucaagggaggucagucuuuuuucuauuaagaccuucagcugauuggaugaguuccaccuacauuaugaagaguaaucugcuuuacuaaaaguccaccaaucuaaauguugauuucaucuaauaaacaccuucacaaaaagauccagaauauuugagaaaauaucugggcaucguggcccagccaagcugacacauaaaauuuacuaccauauaugcauauguauauacaguauacauguauauauagauggcugggcaagguggcccacaccuguaaucccagcacuuugggaggccaagguggggcagaucaucgaggucaggcguuugagaccagccugaccaauguggugaaacccagucucucuaaaacuacaaaaaauuagccgagcuugguggcaggcgccuguagucccagcuauucgggaggcugagacaggaaaauugcuugaacccggaaggcggagauugcagugagccgcgauugugccacugcacuccagccugggcgacagagcaagacucugccucaaaaaaaaaaaaaaaaaaugauaaagcaaauaugcaaaauguuaauauuugguaaaggguauaaaggacuucuuaugcucuccuugcaaguguagguuugaugguauuucaaagugaaaaguuuaagagauaaaaggaaugguauacaauggaauaaacuccagcuguuaaagugauagaagggguuuuacugauguaaaaacauguccaagauaaauuagaggaaaaagcaaggugcagaauauuguagguacauuaauccuucuuuauccuugguuucacuuuccaugguuucaguagcccaucagccaugguuugaaaauauuaaauggaaaauucgagaaauaaacaauuuuaaguuuuaaauuguguaugguuuugaguagcauaaugaaaucuugugcuauccacuccauccugcuugggacgugaaucaucucuuuguuuacuguauccaugcuguguaugcuaccugccuguuggccacuuaguggcccucucaguuaucagagauugacagaucacaagaagggugaguacaguacaauaagauauuuugagaaagagagagagaccacauucacauaacuuuuauuauaguaaauuguuauaauuguucuauuuuauuauuguuaaacucuuacugugccuaauuuguaaaugaaacuuuaucauagguauaugcguauaggaaaauauauacucuauauaugguucuguacuauuugcaguuucaggcaucucuugagucuugcaauauauucccugaggauaaauggggggacuacuguuguaguaugacaucauuugaguggaaaaaauuauguaugcugguauauguuuauaaauucccaaaauaccucugcaaagauaaacaaaaccuggugacagucuauuagucccuaaggcaaccaugauugccuuaguggagaaaaacugggaggcaggugaugagaaagagaauuuucauuauacaugcuuuaguaacuuuuagaauuuugugcuugugcauauuacuuauuaaaaaacaacaccuucacacaaaguaucaugauaugcaucuuuguauuuuugccuguauuuuuuacuuucuucuuagguuagagucuuuaaaaaguaauuucuggaugaaaggacuugagcauuuuuaaggcuuuuuauucauguugccaaauugccucuagaaaagugaacaaauuaggccggugcaguggcucacaccuguaaucccagcacuuugggaggccgagguggguggaucaccugaggucaggaguuugagaccacccuggccaacauggcaaaaccccaucucuaccaaaaauacaaaaauuagucaggugugguggcaugugccuauaaucccagcuacucaggaggcugagggaggagaaucacuugaacccaggagguggagguugcagugagccaagaucgcgccacugcacucuagccugggagacagacugagacuccaucucaacaaaaaaaaaagugaacaaauuaauauuucuaacauauuuacauguauuuacuguaaccucuuuggaguaguguuguggggagguauuuuuuaauagccuauugagauauuaugacauaccauauaauucauccuuuaaacuguacaguuccaugguuuuuuguauuuucacagaguuguguaccaccaccacaauccauuuuaggacauuuccaucaccccaaaaagaaaccccuguuagcauucacuucguauuccaacccccacacccagcucuuggcagccacugauccaacuucugucucuauagaguuuucuauucuggacauuucauauaaauggaaucguauaauauguggucuucuguguuggcuucuuuaggauaauggugucaagguucauccaugauguagcauguaucagcaguucuuuuuaugguugaauaauauuccauugcauagauauaccacauuuuguuuauccauuuaucaguuaaugaguuauuucuaccuuuuggcuauugauuaguguugcuaugaacauuuguauacaacuuuuuauguggacauauauuuuuucuuuuggauauauauggagaggaguggaauugcugagucauauggugauucuauguuuaacuuuucuuugagacagagucucacucugucacccaggcuggagugcaguggcaugaucucggcucacugcaaccugcgccucccagguuucaacgauucuugugccucagccuccugaguggcugggauuacaggcgugaaccaccgcucccagcccuguguuuaaccuuuuuaggaacugucaggcuuuuuuccaaggugacuguaccaguuuacguccccaccaggaguuuacaaggguuccaguuucuccacauucuugccaauucuucuuguuauccaucuuuuuuauuguagccaucccaguuuugauuugcauuucccugauggcuaaugauguugagcaccuuuucauguacuugcuuggauaguguauucucuucucucucucucucuuaaauuuuuuuuuuuuuuuuuucugagacagggucuugcucugucacccaggcuggagugcaauggcgcaaucauggcucacugcacucucaaccucccaggcucaagcgaucugccuaccucagccccucgaguagcuaagaucacaggugcaugccaccaugccaagcuaauuuuuaaacuuuauauagagacagguucucucuauguugcccaggcuggucucgaacuccuggacucaaagcuaucuuccugccucagccucccaaagugcuggcauuacagguguaagcuaccaugccagcuuaaaauuuguuuguuuauuuugagacagugucucgcucuguugcccaggcuggagugcaguggcgcgaucucagcucacugcaagcuccgccuccuggguucacgccauucuccugccucagccucccauguagcugggacuacaggugcccgccaccacaccuggcuaauuuuuuuuuuuguauuuuuaguagagacgggguuucacuguguuagccaggauggucucgaucuccugaccuugugauccacccgcuucggccuuuuaauuuuuuuuauaagaugagaucacacuauguugcccagacucaucucgaauuccucagcucaagcaguccucccaccuaagacuccugaguagcugggacuacagguacaugcugccacacccaacuugaguaguguauucuuuuuuuuuuuuuuuuucuuuuuuugagacaggaucucacucugucacccagacuggaguucagugauguggucacagcucacugcagccuugaccuccugggcucaagcaaucuucccaccucagccucuugaguagcugggacuauaggugcacacuaccaagucuagcuaauuuuuaaguuuuuuguagacaugaggucccacuauguugcccaggcuggucucaaacuccugggcucaagcaauccucccaccucagucacccaaagugcugggauuacagauaugagccaccacacccagcaguagcauauucuuuguaacagaaucccaaugaauugaaagcugugaaguuuacuuugcuucuuauuuuaguuuuaaaaacuguaauuaugauuuaaguuauaacagugcuauaagguuuuuuuguuuucaaacacccugaugcauuuuguuccagguuaggaaagccauucuugggagaguaguauguacaauggauuauaugaugauguagucaaggcucuuguuuauaaaaagcaaguaucagucuaggcaacaaaaagugauaccccugucucuaaaaaacauuuuaaaauuagcugggugugggggcacauaccuguggucccagcuacuugggaggcuggagcgggaggaucgauugcuugagcccaggaagucaagcccgcagugagccacaaucaugccacuguacugcagccugagugacagagcgggacccuaucucaaaaaaauaagagauaucacuuaccaacuuugccugaccuaaaagaaguauuggauaggugauaaaaucuuuaggaugacuuaagaaaacuacgcuuagaaaaggccaggaacaaaaggaugcuggccacacagccaaagagcauaucacagaauccaucuagcagggacauaguuugcauggcuagcaaugcugucccuggacauugccacuuuauuugccccaggagauugauccugcucuaagaauucaccacuucuucacuucucugcaccagcagcuucagauucaaaaucucaagcagauguaucugauaaaggauaucagauuauaugccuucauccuagcuuccaguaaagcugaucuguuuagugguagacaaggcucaaaaguggaaauguccucaaagcagaggguuucacaugcaaaaugugaucauccaaaaauaaaaacagucuuuuuuuuuuaagacggaguuucgcucucguugcccaggcuggagugcaauggugcgaucucagcucaccgcaacuuccgccuccccgcaacuuccaccuccccgcaacuuccaccucccggguucaagcaauucuccugccucagccuccggaguagcugggacuacaggcaugugccaccacgcccggcuaauuuuguauuuuuaguagagacaggguuucuccauguuggucaggcuggucucgagcuccugaccucagguuguccaccugccucggacucccaaagugcugggauuacaggcgugagccacugcacccggccaaaaaacaaaauuuuuaaaguccucuguaagggagcauaauuuuuuguaagccaaaaaauauuuaguaaucugacaaauuuuuugcugcuguugguaagaaucuuuuaaugagguccuuaagagucucagauuauaucagcauguccagaguuugaaugcuguauuaggacguuuuacguugcuaugaaggaauaccugagguugggugacuuauuuaaaaaaagagauuuauuuggcccaggguucugcaggccguauaggaagcauggggcuggcaucugcuccuggugagggccucaggaaguuuacagucacgguaggugaagggggaggaggcacaucacaugaugagagcaggagcaauugagggugggaagugccacacuuuuaaacagccagaucucaggugagugacaacuaaacucacuaccaugaggagagcaccaagccauucaugagggaucugcucccaugacccaaacaccucccacuaggcccaccuccaacauuggaggucacguuucuuuuuuauuuuuuugagacgggcuuucacucucuugcccaggcaguagcauguucaugacucacugcagcuucaaccccucaggcucaagugauccuccugccucagcuuccugaguagcugggcccacagucacacaccaccaugcuuugcuaacuuuuaaauuuuuuguagagacgagaucucacuguguugcccaagcuggucucaaacuggugggcucaggugauccuccagccucacccucccaaaguguugggauuacaggcaugagcuaccaugcccagccaaggaaauuacauugcaacaugagauuuggaggggacaaaacauccaaaccacauuaaauagcuuuggaugauuugcuauuaaugucuucugucaccuuaaaaagaaauuauaaguauuggccaggcgaaauggacucaaguaagccuuuccaaucuacaugaaauaaucagaacauagggccgagugcagugguucaugccuguaaucccagcacuuugggaggccgaggcagguggaucaucugaggucaggaguucaagaccauccuggcaaacauggugaaaccuugucucuacuaaaaauacaaaaauuagcuaggcaugguggugugcaccuguagucccagcugucaggagguagaggcaggaaaauugcuugaagcugggaugcagagguugcagugagccaagaucaugccacugcacuccagccugggugacagacugagacuccaucucaaaaaaaaaaaauuacaaguauuauucuguauauauugcuagaccuuuaauuaagugagcuuugacaugacaaguuuucuaucuaagaccacguuaacauagggacauaaaaaaauguacccagaauuggccugggcacgguggcuugcuugaacacaggagguggaaguugcaguaaaccaagguggugccacugcacuccaaccugggcaccagaacuauuaaguuuuuuucugaguaugugcuaccuucuuuacuuuugguuguggaaccacacauuggaacucaaacucuugaauuuuacuccuaaccuguaacaaucuggugcuuuguaaucaaauucccauuuggaaaauggaauugucuuuccauuugggagacuucuguuuucccucaaacuaauuuuauuuuauuuuauguuuuuuuuuuuaaauuuauuuauuuuuuauugauaauucucggguguuucucacagagggggauuuggcagggucauaggacaauaguggagggaaggucagcagauaaacaagugaacaaaggucucugguuuuccuaggcagaggacccugcggccuuccgcgguguuugugucccugggaacuugcgauuagggaguggugaugacucuuaaggagcaugcugccuucaagcaucuguuuaacaaagcacaucuugcaccgcccuuaauccauuuaacccugaguggacacagcacuuguuucagagagcacaggguuggggguaaggucacagaucaacaggaucccacggcagaagaaguuuucuuaguacagaacaaaaugaaaagucucccaugucuacuucuuucuacacagacacggcaaccauucgauuucucaaucuuuuccccaccuuucccgcccuucuauuccacaaagccgccauugucauccuggcccguucucaaugagcuguugggcacaccucccagacggggugguggccgggcagaggggcuccucacuucccaguaggggcagcugggcagaggcgccccucaccuccuggacggggcggcuggccgggcggggggcugacccccccaccucccucccggacagggcggcuggccuggcagggggcugacccccccaccucccucccggaugggggugcuggccuggcggggggcugaccccccccaccucccucccggacuggguggcugccaggcggagacgcuccucacuucccagacuggguggcugucgggcggagaggcuccucacuucucagacggggcggcugccgggcggaggggcuccucacuucucagacggggcgguugccgggcagagggucuccucacuucucagacggggcggccgggcagagaugcuccucaccucccagacggggucgcagccgggcagaggugcuccucacaucccagacgggguggcggggcagaggcgcuccccacaucucagacgaugggcggcugggcagagacgcuccucacuuccuagaugggauggcggcgaggaagaggugcuccucacuuccuaggugggauggcggccgggcggagacgcuccucacuuuccagacugggcagccaggcagaggggcuccucacaucccagacgaugggcggccaggcagagacgcuccucacuucccagacgggguggcagcugggcagaggcugcaaucuuggcacuuugggaggccaaggcaggcggcugggagguggagguuguagcgagccgagaucacgccacugcacuccagccugggcaccauugagcacugagugaaccagacuccgucugcaaucccggcaccucgggaggccgaggcuggcggaucacuugcgguuaggggcuggagaccggccuggccaacacagcgaaaccccgucuccaccaaaaccagucaggcguggcggcccgagccugcaaucgcaggcacucggcaggcugagucaggagaaucaggcagggagguugcagugagccgagauggcagcaguacaguccagcuucggcucagcaugagagggagaccguggaaagagagggagagggagaccguggggagagggagagggagagcuccuaauuuuguauuuguaguagagacgggguuucuucauguugcucaggcugugucuugaacucccgaucucaggugaucucaaacuaauuuuauaaccugucaaucuguuaacuaacauuaacuuuguaaauuuuaugcaaaauauugucuagguaauauagagaauaaaggaaguagauaggugcucucgcucccuccauagcaguaaacucuaugugaugaccacuaauuaauaaccuguauuccccuggugauccugggaacgaaagugauuucauagugaggacuuuuuuuuuuuaauuaaauuuaggcuugagggaugguguuuguucuuuguucauguaagacagugucuugcuuugucacccgggcuggaguacaugauugaggcuaacugcagucucgacauccugggcucaagcaauucucccaccucagccucccaaguaccuggggcuacaggcacaugccaccacacccagcuaauuuuuuaaauuuuuguagagauggggucuuaacuauguugccugggaaaucuggcuuuuuaauaaagagucuuagucaugaauagaauauuuccuuucaauccauuauuuaaaugaauuuuaaaggugccuuuuuucuccuccuuuuuuuuuuuaguuuaauacaauuuuuuaguaaaaugaagaaauggauggacaugucaaaucuaccacaagaauuucgugaacguauagaaaggcuagagagaaauuuugaggugucuacuguaauauucaaaaaauaugagccaauuuuuuuagauauauuucaaaauccauaugaagaaccaccaaaguuaccacgaagccggaagcagaggugagcccuuaauccuuauauaauugacauaaagauuaugauacaaacuaagagaauauacuuuuuugaaagucuguuuuuuaugaaaaguauuccugcaaagaacuuaauuauuuucuuuuuaaauccauguacaauuauccauauuuggaaauucaggauaauacuuuuacuuauuuuucuuucuguuguuguuuuuuuuuuuuuuuuuuuuuuuuugaggagucucauucuguugcccaggcuggagugcaguguccugaucucggcucacugcaaccucugucucccagguucaagcaauucuccuaccuuagccuccugaguagcugggaucacaggugugcaccaccccgucuggcucauuuuuuguauuuuuaguagagaccaggucucaccguguuggccaagguggucucgaacuccuaaccucaggugaucuacccaccucggccucccagagugcugggauuacaggcaugagccaccacacccagcccuauguucugauuauuuuaugcagguuggaaaggcuuacuuaaguccauuucauaaauaauagauuacuuuucuucaugaauggaauuucauguguaauuugaucuauuugauauuuacauuuacuauuucaguuuacaugauauuuagcgagcuagucagacaaaaaguaauuuuuuucccuuuuuaggaggauuccuugcaguguuaaggaucuguuuaauuucuguuggacacuuuuuguuuauacuaaggguaagaugacacuuucaguggucuuacauuucuacucugggaacuuggugcuauuugacaugagagguuucugguuuuugugucuuuuuuuuuuuuuuuucccuuauaaagguaauuuucggaugauuggggaugacuuaguaaacucuuaucauuuacuucuaugcugcuuggaucugauuuuugccaaugcgauuaugugcccaaauagacaagacuugcuaaauccaucauuuaaagguaagaccuuuuauuuauuuuugaaaacugauuaucaguuuuuggaaaaagauuuuuaaaaguugacuauuuuuuuuucccucugcccuuccuacacugucaaacuagguuuaccaucugauuuucauacugcugacuuuacggcuucugaagagccacccugcaucauugcuguacugugugaacugcaugauggacuucucguagaagcaaaaggaauaaaggagcacuacuuuaagccauauauuucaaaacucuuugacaggaagguacuguacuuauaauuagaugacugagauguuuacagaucaccaguaaugugaaaagaaaaaaauguuuuaagcaaguucucagcauuauagaacuuagggucaggauucccaggcuuuagccucuacugugauucagaauuuccuuaugaucuugugugaugugagaaacagagcuguugaaaaaugugaccaacuauauguacuguuggguaaauguacugucagaggcaaccguaggagguacugauaaagaauuguaaagaauagaacaucagaguagggcugacaaauaauuaggaaaaacaggaggucagaauaagcugacuaauuuacugccacaauuugaauaacugcugacuguugacuaaaaguaggaugauguauaacaaccacaguuuuaauuccauguaaaucgagcagaaaauccaugauaguuuuguagccacuuguaggcuaucugugugcauucuggacauugucuccuugguaauuaacuuagcuauuucuacauuuaugaauuggcuuguuccuuuggguuucaauuucuuauuuccccaacgucgagccauuaaauguaguuaagccucaagauuucucuuugguaaaaggagggguuuggauuauggaucccacuuuucaaauauuaugagauuuuucuuuaagcauaaauucuucccuuacugguuucuucuucuuuuauacaaauuuuuguauucagucuuguguuccucagauaucuauauuauggcccauugucuguaugcuaaacaucucuagcaaaguaaacuuuuuuuaaaggaucccagggacugggcgcgguggcucacgccuguaaucccaacacuuugggaggccaaggcagguggauugcuugagcccaagaguuccagacgaaccugagcaacauggcaaaaccuugucucuacaaacaauacaaaaauuaguugggcaugguggugcacaacuguagucccagcuacuuggcacgcugaggcugcagugagccaugauuguaccacugcacugcagcccuggugacagaacaaaacccugucucaaaaaaaaaaaaaaguuaaaaaaaaaaguuauuugcaugcuaaauaguuuauccuagucugaaagaaauauuuaauaauucuguuuuguguguguguuauaacaauauggaaauuuagauaaauuucacguuuguguguguauuaauaugcuuaauuauauggugucccaaaauaauuuuuuguucacagauauuaaaaggagaaugccuccuggaccuuucaaguuuuacugauaauagguaaauaucuaguacuaauggugccuggcuuaucacaagcugucauauuuguugauuuguugaaauuuguuaagcauaacaguauaucaaaguaagaccuccaaauucaaguucucucugcuuuaguggcauugaauguuuauuaucacuaagacuuguuggcuuuaaauacauuuauuuuaagaaaucaaggccaggcacgguggcccacaccuguaaacccaucacuuuggaaggccaaggcaggcagauugcuugagcucagaagguuggagaccagccugggcaacauggugaaacccugucucuacaaaaaauacaaaaaucagccagacguaguggugugagccuguggucccagcuacuugggagguugagguuggaggaucguuugaaucugggagguugugguugcagugagccgugauugcaccacugcacuucagucuaggugacagagugagacccuauuuccaaaaaaaaaaaaaaaaagaaagaggccgggcaugguggcucacgccuguaaucccaacacuuugggaggccaaggcgggccgaucacuugaggucaggaguuugagaucagccuggccagagaucagccuggccaacauggugaaaccgcaucucuacuaaaaauucaaaaauuaucugggugugguggugcacaccuguaaucccagcugcuugggagacugaggcaggagaaucacuugaacccaggaggcagaggcugcagugagcugagaucaugccacugcacuccagccuaggcgacagagcgagauuccaucucaauuaaaaaaaaaaauuauugauacuuacguauuuauuuuuauuuuuuuagagaugggaucucacuguguugcccaggcuggucucuaauuccuggccucaagcaauccucucaccauagccucccaaagugcuaggauuacagguaugacccaccacacccggccaauuggcauuuaaaacagcuacucagccaggcgugcaauggcuuaugccuauaaucccagcacuuucggaggccaaggcaggcagaucacgaggucaggagauugagaccauccuggccaaaauggugaaacccggucucuacuaaaaauacaaaaauuagcucggugugguggcacacgccuguagucccagcuacuugggaggcugaggcaggcggaucgcuugaacccaggagguggagguugcaguaaguugagaucgcaccacugcacuccagccugggcagcagagcaagacucaucucaaaaaaaaaaaaaaaaagaaagaaaagaaauuaaggccgggcacaguggcucacaccuguaaucccagcacuuuggaaggccaaggcagccagaucgcuugagcucagaagguuggagaccagccugggcaacauggugaaaccuugucucuacaaaaaauacaaaaucagccagacguaguggcgugagccuguagucccagcuacuugggaggcugaggugggaggaucauuugaaucugggagguugagguugcagugagccaugauugcaccacugcacuucagccugcuugacggagugagacccuauuuccaaaaaaaaaaacaagaaaaaaagaaagaggccgggcaugguggcucacuccuguaaucccaacacuuuggggggccgaggugggcugaucacuugaggucaggaguuugagaccagccuggccaacauggugaaaccccaucucuacuaaaaauacaaaaauuaucugggugugauggcgugcaccuauaaucccagcugcuuggaagacugaggcaggagaaucacuugaacccaggaggcggagguugcagugagcccagaucacaccauugcacuccagccuaggcaacagagcgagauuccaucucaauuaaagaaaaaaaaucauugacacguauuuauuuuuauuuuuuuagagaugggaucucacuguguugcccaggcuggucucuaauuccuggccucaagcaauccucucaccauagccucccaaagugcuaggauuacaggcaugacccaccacacccagccaaauggcauuuaaaagagcuacucagccaagcucgaagugacucacaccuauaauccuagcacuuugggaggccaaggugggccaacauggugaaaccccgucucuacugaaaguacaaaaacuauccgggcaugguggcacaagccuguagucccggcuacucaggaggcuaaggcaggagaauugcuuaaaccugggagguagaggcugcagugugccaagacugggccacugcauuccagcuugggugacggagugagacucugucuuaaaaacaaaaaacagccacucucuugagaaacucauaaacagacccaaugacucuguauuugauuuuacauucuuucauuaaucacauguuggcagugcccauauuuuuuuuuggagacggagucucgcucugucgcccaggcuggagugcaguggcgcgaucucagcucacugcaagcuccgccucccagguucaugccauucuucugccucagccucccaaguagcugggacuacaggcaccucccaaguagcugggacuacaggcgcccgccaccacgcccggcuaauuuuuuguauuuuuaguagagaugggguuucaccguguuagccaggauagucuugaucuccugaccucgugaucugcccgccucggccucccaaagugcugggauuacaggcgugagccaccgcgccuggcccauuuuuuuuuuuuuuuuuuuuuuuuuugagacagagucuuguucuguugccaggcuggagugcagugguguaaucuuggcucacugcaaccuccaccugccauauuucaaagccacuaguguuuccuuagugaucagaaaccauuuucauaauuagauucaacuaguuuucagauuaaguauauguagucucucacuuuugaaaguaauuuauugguuguauauaugaauuugaagaauguccauaaucagguaggacccucugauauuguuagauggucagaguuaauaaaaauuagaaaguugucaaguuuucuaagcuguaaacacuaaaucuaucuucaagucaaaauaaauccauuguguaacuuaguauuacagcuuauaauaauucucuuugcagcaaagcagugaauaaggaguaugaagaguauguucuaacuguuggugauuuugaugagaggaucuuuuugggagcagacgcagaagaggaaauuggaacaccucgaaaguucacucgugacaccccauuagggaaacugacagcacaggcuaauguggaguauaaccuucaacagcacuuugaaaaaguaauauaaccuagccuggccucaaucuugaaugaucuuuuucucucugugugugauucuacuaacagcagaagcaucuuucaaguuaaaucuugagcuucuucuacuaauucauauuucucaugaaagccuuaaaagguaauuuuuaaaacuggcauuuaguauuuuuaccucauuucuuacuauucauauuuuauauccauuuucccagcaugacuggguuuauuaguagaguauaugucuuuugacaugaagaggaaguuuugcuuucuuacaguucuuucuuugcuucaacuuaggcuccguuacguugcuuuaaauuuuaguuugcuuuccuacccgugacacaaacuauguguuuuucuguaacuucagccauaaaacucuggacuugauuguuaauggccaaggcuuaacucuguauuuauguguaaaauggguuggaggaagagaucuaauggaaaauucacuugucuagaacauaguaaaaccuaaguuuuaguccaagcuuuaccauuaacuuugucaacugaaauaaguuuuuaaauuucucuguuccuauuuccucauauauaaaauuaaauuauguauacauuaucuuucaaaucaguggugugaagauuaaaugaaauuauauguagaaagugcuuuuaaaaaguguuauucaaauauaaggauguuauuagcauaguauugcuaaaaauuucauggauauuacaaauaugaauagagaagaugguauaugcacugaauuaaacacauaauaaggaagaugguaacuuuuaaaaacucacggauuuuucuuuucugacagaaaaggucauuugcaccuucuaccccacugaccggacggagauauuuacgagaaaaagaagcagucauuacuccuguugcaucagccacccaaagugugagccgguuacagaguauuguggcuggucugaaaaaugcaccaagugaccaacuuauaaauauuuuugaguauguacaauacuguuauuuuuccaaaugucuuuuuaaaauuagauuucuuguuccauucuauuuuuaguauauucagaauucucaagauaguggauguucaucuggcaaguuuuacuauaccauuucaaucacaaaauauauugaccuaaaaccauauugaaguaccuauuaaaaauuauguauaacagucaggcacaguggcacacaccuguagucccagcuacuugggaagcuaguuuggccaacauagugagacuaauuccagcuuggccaagauagggagaccuuaucucucccuuuuuuuuuguuuuuuuuuugagacagggucucgcuaugucucccaggcuggagugcagugccgcaaucacagcucacugcagccuccaccuccugggcucaagcaacucucccaccucagucccccaaguuagcuggaacuacaggugcaagccaccaugccuaauuuuuuauauuuuuuguagagacaggguuuugccauguugcucaggcuggucuugaacuucugagcucaagugauccaacugccucggccuuccaaacugcugggauuacaggcaugagcgaccaugccaggccaacuuugucucuuaaaaaaaauuauauauaauguuauuucaugggaguauagacuuuuagagauaaguguaccuuaaagauuauuuagcacugauauuucacucuuauaacuaccccugaguuaugcauguuuugauuuuacauugacuuuauuuuuaauuuauuuuuauuuuuguuuguuucuaaagaucaccuguauaaggacauacauuaacuuuaaauggggccauucuaaauguccauuagauaggggacuaauugcauauuggugguacagccauaaaaauggauuuauuuauuuauuuauuuauuuauuuauuuauuuauuuugagacagaguuucacucuuguugcccaggcuggagugcaauggcaugaucucggcucacugcaaccuccaccucccagguccaagugauucuccugccucagccucccgaguagcugggauuacaggcgugcgccaccacgcccagcuaauuuuguauuuuuaguagagacaggguuucuccauguuggucaagcuggucucaaacucccgaccucagaugauucgccugccucggccucccaaagugcugggauuacagacgugagccaccgcgcccagcccauaaaauggaauuuuauacaguuuuuuuuuuuguuuuuuaaggaagcaugauuccugguaaagaugguagaaugaagccagaucagagaaccuucuuuccuaauaccuaauaaaauaagagaauagucaaaaccagcaaaauauuuaucaauggcaaccaaaugaggagagagauaugauuucaugacaaauuuccaaaguagagaucaaaaagaaaauucaugauucugguauucccaucccuaagcaguguuggggaaagaggguauagugauagaucuugagaauucucaucaauacuucagauuuggagggaaacaaaugggggaguaggcagacagauaaaaagucauacaaaccuucccaauugaaaguccguauguaccaccagcaggaucccagcagaacaacugccaagggcugccauuuuccaacauuccaugaugauuuggggagagauccucauauaccuagacgucccugacuaggaauagugaacccuagaauaggaauauuuaacuaaaucucagaagacaaagcgaagcccugguccuccaagaaaagcugaacauagcugagcucucccccauuccucaaaccuucaggauacaagaaaguagacagaacaaucuccagccucagaaauagcucagaagaaaagcauacugccaguaagauaggaagacugucacggaucuaccuuccauaucauuugaguaaauagaucuggauugaacuacuguucaaacaugaauaaguugaaaagcagugacaaagcaaauauacaaauaugucaauaagaaaaaggaaguauagaaugcaaaagaaaaaaaaucuagacacaaauaaauggaaacgcuggguguuguggcccaugccuguaauugcagcacuuugggaggcugaggcgagaggaucaguugagcccaggaguuuaagaccagccugagcaacaugaugagacccugucucuacagaaaaaauuuaaaaauuagucauggugauaugcauuccagcuacuugggaggcugagaugggagaaucacuugagcucagccaugaucacaccauuguacucuagccugggcaacagagcgagacccuaucucaacaaaaaaaaaaaaaggaaagacaucuguguuuguggacuggaagacuuaauauuguuaagauauccauauuagaggccaggugcaauggcacauaucuguaaucccaggacuuugagaggccaggguggguguauugcuugagcucaggaguuugagacuagcccgggcaacauagcgacaccucaucucuacaaaaacaaaaaaacaaaacaaauaaaaccuggucauuguuucuuucuuuccuuuuuuuuuuuuuuuucuuuugaggcggagucuugcucuauugccaggcuggagugcaaugacaugaucuuggcucacugcaaccuccaccucccagguucaagcaguucuccugccucagccuccaaguagcugggacuacaggcgccugccaccaugcccagcuaauuuuuauauuuuuaguagagaugggguuucaccauguuggccaggauggucucgaucuccugaccucaugagcugccugcuucagccucgcaaagugcugggauuacaggcaugagccaagggcugccauuuuccaacauuccaugaagauuuggggagagauccucauauaacuagacgucccugacuaggaauagugaacccuggaauaggcuuuuuuuuuuuuguuuuguuuuguuuuuuuuuuuuuuagacagaguuucgcccuuguugcccaggcuggaguacaauggcccgaucugcagccuucgccucccagguucaaucgauucuccugccucagccuccugaguagcugggaugacaggcaugcaccaccacgcccggcuaauuuuuuguauuuaguagagacgggguuuuaccauauuggucaggcuggucucgaacuccugaccucaggugauccacccacccuggccucccaaagugcugggauuacaacagguguuagccaacaggccuggccaauuuuuguauuuuuaguagagacauguuucaccauguuggccaggccgaucuccaacuccuggccucaagugauccaccuaccuuggccucccgaagugcugggaauauagaugugagccaccaugcccggugucaaaccuaaaagcuuuaacauagcaaagaaaacaaucaacagaguaaaaaaaacaaccuauagaaugggaaaaguaauuguaaaccauauauuaguuaagggguucauacucagaauauguaaagaacuccugaaacucaagaacaacaaauaacucaauuuaaaaacguauaaaggauucagcagauauuucuccaaagaguauaugcaacuggccaaaagcauaugaaaaaauauuugauaucacuaaucagggaguuacaaaucaaaaucacaaugagauaauaccucacauaucagcauagccacuucccacucaucaccccaaaaaaaccaaaauagcagguguugguaagaauguguaaaaauugggacccuuacacacuguugguagaauuguaaaguggugcagccacuauggaaaacaguacggacguuccucaaaaaauuaaaaauagaacuaccauauaacucagcaauaccacuucuggguauacauccaaaagaauuaaaaacagcaucucaaagggauauuugcacaucauguuaacugcagcauuauucccaauagccaaguuguggaaacaccuuaaguguccauugauagagaaagaaaaugcuguggguguauguguguguguguagauagguagauagguagguagguagguagguagguagguagguagguagguagguagauagauagauagaaagaaauagagauaugagauggaauauuauucagccuuauaaaagaaggaaauacugccauuugcuacaacauggaugaaccuuuaguacauuauguuaagugaaguuagucaaucacaaaaagacaaaauacugcaugauuccacucauauaagguacauaguauagucaaacuuacagcagcaaaguuuuauuacauguguauacaaucuguauuuuuauuauauaauuuuacguguuaaaauauuuuaucauauaaagcuuugcuuacauauguagauuuccaacugagaauacaacuuuggcugcuaaaaacuaauucuugaaagaaggcauguuggccgggcaugguggcucaugccuguaaucccagcauuuugggaggcugagguggguggaucacaagguuaggagaucuagaccagccuaggcaacauggugaaaccccaucucuacuaaaacuacaaaaauuagccaggugugguagugcgcgccuauaaucccagcuacuugggagguugagacaggagaaucgcuugaacccuggaggaagagguugcagugaacugagaucgcaccacugcacuccagccuggguuacagagcgagacuccgucucaaaaaaaaaaaaaaaaaaaaagaagaagaaggcauguuaguauucugguguggagucuuuuuuguuuguuuguuuuuguuugguuugguaauugguuccucuuguauuuuguagaucuugugugcguaauccuguggaaaacauuaugaaaauacuaaaaggaauaggagagacuuucugucaacacuauacucaaucaacagaugaacagccaggaucucacauagguaagaaaagaaaacuacaguuggcauagcauugaaaauaaguaauccccccaaaauuagaaauucacgguuuuuccucucccguuauucuuauuucuuuuuuuuuuuugagaccgaguugcccaggcuggagugcaauggcaugaucucgacucacugcaaccuccuccucccagguucaaacgauucuccugccucagccucccaaguagcugcuauuacagggacccaccaccacaccggcuaauuuuguauguuuaguagagauggaguuucaccauguugguuaggcuggucucagacuccggaccucaggugaucugcuugccuaggccucccaaagugcuaggauuacaggcgugagccaccauucccggccugcccugcuauucuuaauguaucagauuuaaguuuauauauaauuuuugcuuuucaguccuuaacaacuaaaauucauuaacacauguuuucucuguauuucccugauagacuuugcuguaaacagacuaaagcuggcagaaauuuuguauuauaaaauacuagagacuguaaugguucaggaaacacgaagacuucauggaauggacaugucaguaaguaaauccacucucugagcuacuggcaagguccaaaagucagccuggaagcaguguuuugagaggcucuguaaggcguugugggagucaccaaucuaugacacacuuggccaggauggcauuuaguugacuuuagcacaugcaaggcuaaucaaucuaggcagaaaugugaaauaacguaaaguucaucuuugguacacaucaguguuuuuuaaguguuuuuuuuuuuuuuuuuuuuuucuguccuucauucccagcuagugaucccuccaccuguuaaagcaacuguuaauuaagacauuuguccauaccuuccaaggauuuuggauuauaaaaugguauggguuuuucuuguuuuguuuuguuucuuuaacuaugaccaagucagaccacugucuccaauaagauguguaaaagaauuuuucuacaaauucagaccuaucauaugaucuuuguuuccuccuccuucauuauuucccucugcagucacucuuggagucuucuaacuuuucuaucccaauaggaacagguugaugucuuaaggaugcugcguaacuauuguaauagaguuucucuuuguguuuaccuggaaauuuuuuucaugucuuuucuguguugguuucucuuuucugugucuuucuuuuucauaguuuacgcuaauaucuugauggugcauacacuuccauggcuuccugagaaagaaguaaauuuuuuuuuuuuuagacugagucuugcucuguugcccaggcuggagugcaguggcacgaucucggcucacugcaaccuccaucuccuggguucaggugauucuuaugccucagccucuugaguagcugggguuacaggcgcccgccaccacgccuggcuaauuuuuguauuuuuaguaaagacaggguuucaccauguuagccaggcuggucucgagcuccugaccucaagugaucugcccaccucagccucacaaagugcuaggauuacagccaugagccaccucacccagcugaaagaaguaaauuuuuuaacuuuuauuuauuuuaauuuuuuuaauuuuauuuauuuauuuuuuuagauguagucucgcucugucacccaggcuggagugcaguggcgcgaucuuggcucacugcaaccuccgccucgcgaguucaagcaguucucugccucagccucccgacuagcugggauuacaggcgccugccaccacacccagcuaauuuuuucguauuuuuaguagagacggggcuucacugucuuggccaggcuggucuugaacuccugaccaugugauccaccugccuuagccuccaaaagugcugggauuacaggugugagccacugcaccuggccaacuuuuuauuuugaaauaauuauagauucacagaaaguugcaaaaguaguacagagaagucccacacauccuuuauccaguuucccuaaugguuacaauuuuauauacugcaguaucagaacuggggaauugacauuaaaacaguguguguguguguguguguguguguguguauaaaauuguaucauaugcauagauuaaccauaaccaaaauaaaaauacugaacuguuaaagaucuccuuccugcuaccccuuuauaguuaguuacacuuacuccucucagccauuauuguuuuccacuucuacauacucuguaugaauuuaguucuuuucaauuuguuuuaguuauauuguagcccaggauauguuuuaucauggugaauguucuguggccacuugaaaagaauguauacaguaaauccucacauuuaaccuugucaguagguucuuggaaacagugacuuuaagcaaaaacaacauacaaugaaaccaauuuuaccauaggcuaacugauauaaacaggaguuuaaguucuuuuggcauaugucuagucacaaaaaccucaccaaacuucuaaauaaagacaaaacacuuauaauguuaaacauugaaauaaauaagagaaaguaauaaaaauaaggaagauuauuacuuauccaguuauuccuguucagggucaugagagccuaccucagcagcucacgaugaaaggcgggccccaacccuagucaggacaccauuucaucauaggacacacacacacccacacuuacacugucacaauuuagauaugccaguuaagcuaauguacauaucuuuggaauguaagaagaaaccagaguacccagagagaacucaugcagacguaggagaauguguaaauuucauacaguggccccagcugggaauccauuauuuuucauuguuacaacaaacugguguugagcgaaaugguguuauucaaggaucugcuguauucugcuauuguuggauggaguguucuguaaaugucaguuuuaucuuguugguugauguuguuauuuuauauucuugcugauuuccagucuaguuguuauaucaguuguugacagaggauguugaaguguccauguaugauuguagauuugucuauuucuuucaagucugucagcuuuucuccacguauuuugaagcucugcuguuugaugcuuacacauuuaggauugcugucugccuucuugaugaauugacucuguaaucauuauaaaauguuccucccuggccaggcgcaguggcucaugccuguaaucccagcacuuugggagacugaggcagguggaucaccugaggucaggaguucaagaccagccuggccaacauggugaaacacugucucuacugaaaauauaaaaggcugggcaugguagcucacaucucuaauccuagcacuuuaggagacugaggcaaguggaucaccugaggucaggaguucgagaccagccugaccaacauggcaaaaucccgucucaacuaaaaauacaaaaauuagccaggcgugguggcgcaugcccguagucccagcuacucaggagucugagacaggagaaucgcuugaacccaggagguggcaguugcagugagccaagaucgcaccacugcacuccacccugugcaacagagugagacuccaucucaaaaaaauaaauauaugaaaauacaaaaauuagccggguaugguggcaggcgccugcaaucccagcuacucgggaggcugaagcaggagaaucgcuugagcccgggaggaagagguugcagugagccgagaucacaccacugcacucccacguggaagacagagagagacugcaucucaaaauaaauaaauaaauaaggcugggcacggcggcucacgccuguaaucccagcacuuugggaggccaagccggguggaucacaaggucaggaguuugagaccagccuggccaacauagugaaaccccaucucuacuaaaaauacaacaauuggccaggcauaguggugugcaccuguaaucccagcuacucgggaggcugagacaggagaaucucuugaaccugggagguggagguuguugugagccaagauugcaccacugcacuccagccugggcaacagagcgagacucuaucuaaaaaaaaaaaaacuuaaaaauaaaauaaauaaauaaaauguuccucucugucccugguaauuuucuuugcaucuaccugauguuuaugaauaaccacuccugccuucuuuucauuaauguuugcauggcauaucuuuuuccauccuuuuucaagugaccuuugaagugaauuucuuauagucaguguguaguugggucauuuuuuuuuuucuaaucugugcuaaucucugucauuuaauuaguaaauuuagaugacuuaaaauuaguaauuguuauguuagcacuuaagucugccauuuuauuuuuguuuucuguuuguucucacucuuuuuuuuuuaauuuuguuuucuuuuuccucccucucuguugguuacuugaacauuuuuuagagccuuguaaagauuuuuuuuuguauagauguuuuguauagccauauaaccaauuuaaguaaaguauagaaaucuuaccucacuuaaagucccuuuuuaaagauuuugcauaaguaacuuuauuuuagacucauaauugauugauaguugucuauguacagaauucaagauuggugggagaggccaggugcuguggcuuaccccuguaaucccaacacuuugggaggccaacgcagguggaucaccuaaggucaggaguucuagaccagccugaccaacauggugaaacccugucucuacuaaaaaauaccaaauuauccagguguaguggcacaugccuauaaucccggcuacuugggagaggcugaggcaggauuguguuaacccaggaggcagagguugcaaggagcugagaucacgccauugcacuccagccugggcaacaagagcgaacuccaucucagaaaaaaaaaagaaaaaaagaucugugggaggcugaggcaugaggauugcuugagcccaggaguuugagguuguaguauacuguguauuguauguaugcuguguaguaugauugcacugugaauagcuacuguccuccaaccuaggcaacauagcaagaccccaucccuaaaaacaaaaaaaaacuuaaaaaaagaaaagaauucuagauugacaaucauuuuccuuuaugaguuugaagguacuguugcauuauuuucuauuauagauuccacuguuacuaaugagaaguccagugacauucucauucccacuuaguaguaugugaccuguuuuuuuuuucugaaaucuuugaguaucuuuuaucacugauguucuuaaauuuauaaaaauguaucuuacuguguuuuuuuucauucaugugucugucauucccacagacuugcccguuuagucuagaaauucaugcccugcaguucuuggucguuuuauuuuguuauuucuuagaugguacauugcccacugauuuaucuuucuggaacuuucauuuuucagaugauggaccuucugaauugaccuucuuaauuucuucucuuguuuuccauuucuuuaucucuuuuauuguaccuuuuuuuuuuuuuuuuuuuuuuuuuuugagacagagucuugcucugccacccagacuggagugcaguggugcaaucucagcucacugcaagcuccgccucccagguucacgccauucuccugccucagccucccaaguagcugguacuacaggugccagccaccacaccuggcuaauuuuuuuguauuuuuaguagagaugggguuucacccauguuagccaggauggucucgaucuccugaccuugugaucugcccgucucggccucccaaagugcugggauuacaggcgugagccacugcgcccggccuuauucuacuuuuaaagauauuuacucaacuuuucaucuagucccaaugaacuuuuaauuucagcuauauuuucauuucucuuucauguucucuaaaguuacuaauuuagauuuauucgaaauuuucuugacugcuucgucucuguuucuccugaauuuuucuccauuuuuuuucucucucucucuuuuuuuuuuuuuugagauggaguuucgcucuuguugcccaggcuggagugcaauggcacgaucuuggcucaccgcaaccuccgccucccagguuccagcuauucuccugccucagccucccgaguagcuaggauuacagggaugcgccaccacaccuggcuacuuuuguauuuuuuguagagacgggguuucuccauguuagucaggcuggucuccaacuccugaccucaggugauccacccaccucagccucccaaagugccgggauuacaggugugagccaccaugucuggccuuuuuucucucucuaaaaaauauuuuaaauuuuuuuaaauguuaguuuauaucuuuuauuaacucauacacaguuaguuaucuucugguuuguugaagcaguaagucagacauuugccacaauaaugucugucaaaguggcuugccauaaacacuccagcaccacauucaucagaagggcacucucgacgaaagcaacuaauuuugccguucucaucuaccuuauaauauuucaggauagccagcuuaaccuucuuucucuugugcuuacucuucuugggagugguguaagacuucuuccuuuucuuagcaccaccaugaagucucaacacaagaugaagaguagacuccuuuugaauguuguagucagacaucuuccaguugcuugccagcaaauauuagucuuugccgaucaggaggaauuccuuccuuauccuggaucuuggucuuuacauuuucugucguauccgaggguucaaccuugagggugaugguuuucccuguaaggguuuucacgaaaaucugcauuugcagauggcggaucuuuaaauuuuuuuuuguuuuuuguuuuuuguuuuuugggacagagucucgcccugucacccuggcuggagugcaguagcaugaccucggcccacugcaccuccaucucccggguucaaaugauucuccugccucagccucuugaguagcugggacuauaggcauaugccaccacgcccagcuaauuuuuguguuuuuugguagagaugggguuucaccauguuggccaagcuggucucgaacuccugaccucagguaauccaccccccucggccucccaaagugcugggauuacaggcuugagccaccgcaccuggcuuuuuuuuuuuuuuuuuuuaauacgauggugucucgcuauguugcucaggcuagugucaaaacuccuagguucaagugauccuccugccccaguuucccaaguaccugggacuacaggugcaugcugcugcaccucgcuuuucuguuuguuuugaccuauguuuuucagguaagagguuuuccucaaaugucagauaauucuuagugguccacuuaaauuugaaugagacacuaaaaacguguucaaagcucugugaaugaggcaguaaaaguuuguuuuaaagcucuuuuauuucaagaguggaaguaaaaaauccauugaccucaggugaucacauaguauuagagacuuaucugcugguauccguaagacuuuucuggaauaucucaguuucuccagagacauaucuguaaaucucuugccuggcuguugguguuguggaucagaagaaggaagggaaacuuggucuuaugguucagucugcagaguuucaccuaaaacccuagucuuuucugugccuaauguucucuaccucugagucuccaguucaauuucucuagagaauaauccuguagauuccuguggagacagaauagaggucugucaucugaucccauagaguggggguuguguggggaccugaggauccuaagacuuucagaucacccacccaaugcuucacccccacuucccauucugccuguguccucaguugcuauguauuuuagaucagauucuuuuguuuuaagugucucacugcagguccuuaugcuugaucaucgucccuucugcugaguaauuugucauccuucauauauugugguuuacaguuacaaaugacugcuaguuuuacugaugauggaguuucuguuuuuuauccucccuugauuuggggcgauacuuguuuuuuguuuguuuguuuuaguuuuuuguuuuuucugagacugagucucgcugugucgcccaguauggagugugguggcgugaucuuggcucauugcaaccucugccucacagguuuaagugauuccacugccucagccuccggaguaacugggaucacaggcacgcgccaccacacccagcuaauuuuuguauuuuuaguagagacgggguuucaccaucauggccaagcuggucuugaacuccugaccucaagcaauccaccugccucggccucccaaagugccgagauuacaggggugagccaccacacucagccaaucuagggugauauuugaaagaaagaaggcaacaaauaccauuuuuaaaacugaaaacuuauauuaaacuuaaugguaaaguaggacuuuuacuuucucagugaaguauuucuuuuucugaacaguuuugucuaaacugugacauauuaccuuucauuucuguguuuugauaaauaaacccuuauguugacaaaacaauuaacugucauuaagaaaaauaaccaauucuaaugcuuuucuguugaugggaauacugacuuuuauuauuuguucagauuucaaagcagauuguuauguacaccuuauuuaaauuuauucccuacccacugagcaagaauagguauuauaggaaaacuaccaauuugagaacucaaauuuuuaucuccaguaaucuaguguaauauaauuugcacguuauuuuuucuuguuuuuauagguuucuuuauggaauggcaaagacugaaauugcugaaaaauauuaaacuguggucuuucucuucccccagguucuuuuagagcaagauauauuucaucguuccuugauggcuuguuguuuggaaauugugcucuuugccuauagcucaccucguacuuuuccuuggauuauugaaguucucaacuugcaaccauuuuacuuuuauaaggugagaugaaaacaaaguucuguuaugagaugaaaacaguguuucucacagaaacauuguauuuaucuuagugcugaagaaaaacacuguugugauaucuggaaaguguuuccagauguguucugaaaauauauauuccuggcuaggcaugguggcucacgccuguaaucccagcacuuugaaaggccaaggugggaggauuaucugaggucaggaguucgagaccagccuggccaaaauggugaaacuccgucucuacuaaaaauaccaaaaaaaauuagccaggcauuguggcgagcaccuguaaucucagcugcuugagaggcugaggcaggagaauugcuuuaaccugggagguggagguuugcagugagcggagaucauacaauuacacuccagccuagacgacaggagcaaaauucugucucaaaaaaaaaaaaaaagauaauauauauuccucuugggugaaaccaagaacacaagagagaguugagcauacaguggcucacaccuauaaucccagcacuuuggaaaacugaggcuggaggauggcuugaguccaggaguuugagguuacagugagguaugauuaugccaccacacuccagccugggcaccuaagcaagacccuguuucaaagaaaaaaaaagagagagagaaggugagaguaucaguaaauuaagucaaucuuacagcuucaguuccuuuguuaacacggacuugaaaaugugaccuggaacuaguacuuaacuucaaauuuuccauauuuaugaaugaaaauuauaauccuauuaaacaaaugcaugaugaagaacaaaaaacgcuuucuaccaagaggaaggaagaccuaaaauugauuuuggugguggucuaacuaauaaagccguaauaauagauuaugcuucuuccccaaguuugagcuaauucagugugaaugaaucuuacuuaccuuaccuuuauuuuucuugcuagaacuauuuuuguuaaucuuuucaaaauaaaacagaggucauagcuauugaacuacaucaucacccucaauaacguuuagucaucacagucaauaacguuuaauguuacauaguaucgaacuuuaagacuaaugcuacuguuacgcuucuuggcaugauuuaguuaauauuuagucaucuagguacuuuucuacuggugauagaaaaauugguuugaagaguuaaauuuuuauaccuaaaguaugccugaauuaaaguuguagaaaaugcaggucauuggaaagcuuaucugugugaauuacugagugugauuaaaguauuuuuagguuucuuagggagaagugauucuacuauacacucacuuuaauguuaauguguguauucaacuuuugccauuaggaaaaaguuuaguuuugucaacaaccucauaguaauugguuuuuauuuauaacauccuuauuuuauucaagcagcuaaaugccuuuuuuuucaauagagacucgguuucacuauguugcccaggcuggucucgaacuccuggucucaagcaauccucucacuguggccuccuaaagugcugggauuacaggcaugagccacugugucggccuccuuuguuuuuuuaaaugacauaaaugauaugugcucauugaagaaaaucauaaacauaaaugugggccaggcacgguggcucaugccuauaaucccagcacuuugggaggccaaggcgggcggaucaugaggucaggagauugagaccauccuggcuaauauaguaaaaccccaucucuacuaaaaauacaaaaaauuagccaggcaugggggcacgugccuguagucccagcuacccgggaggcugaggcaggagaaucgcuugaaccugggaggcagagauugcagugagccgagauggcgccgcugcacuccagccugggugacagagugagacuccgucucaaaauaaauaaauaaauaaauaaauaaauaaauaaauaaauaaguaaauaaaugugaauauuaaagucauacaucauaaucuauuaacaaucauauuauuaauauuuuguguauauaaacuuuauucuagauacuucccuuauaaaauggaauuauaguguauauacgcaaagucacuuuaaauaguucauucauucuguuauuuugaguuaguggaaaaaauagucuggaaaggagcaauacauucaaaauagaacuagacuuggaacccaagaccugacuucucccacuguuggucuguugaccaguuuucaccuaucguugccucaaguugucauuuauaauauaaaacgugaaaaacagaaauauaugugaacauauuuuaaagaacuuaaaaacuccuuuauaaauuagaagauguuaguaagccacagaauuaugguucaaagaugacuuugguucugugccacagaauaaggccacaguggccgggcgcaguggcucacaacuguagucccagcacuuugggaggccuaggcgggcagaucaccugaggucaggaguucuagaccagccuagccaacauggugaaaccucggcucuacuaaaaacuacaaaaauuagccaggugugguggcaggugccuguaaucccagcuacucgggaggcugaggcaggagaaucacuugaaccugggaggcagagguugcagugagccaagaucacaccacuguacuccagccugggcaacagagggaaacuccgucucaaaaaaaagaagaagaagaagaaagccacagcuaguccuacaugcaaguccagacuagaacuaacugcuugaaaccacauugccuucucacuuucuccucugcagguuauugagguggugauccgcucagaagaggggcucucaagggacauggugaaacaccuaaacagcauugaagaacagauuuuggagaguuuagcauggagucacgauucugcacugugggaggcucuccagguuucugcaaacaaaguuccuaccugugaagaagugagucugggcaaggcugauaaucguaucauuaaaaaaaaaaaaaaaaaaaccagcuuuauugagagauaauuccuauaccauagaguucacccauuuuaaguguacaauucagugguuuuaguauauaaauagauaugugcagccauaaccacaauuuuagaauauagucaucacuucaaaaagaaaccuacauccuuuagcuaucacuucccuacccccgaaucuucucccuagcuguaaguaaccacuaaucuacuuucugucuccauaaauuugccuauucuagacauuucauauaaauggaaucauaaaaauguagucccuuuugacugggcaucugucacuuagcauaauguuuuuaagguucauccauguuguagaauguaucgguauuucauuuccucucuuuuuuuaaggcgggguuucacucuugcccgggcuggugugcaguggacaaagauggugcacugacuacacccucaacuuccucggcccaaacuguccuucugccucucaaguagcugagaccacaggcacauaccaccacacccacacccggcuaauuuuuuuuucuuucuguuuuucuuuuuuugagauggagucuugcucugucacccaggcuggagagcaguggcacagucucggcucacugcaacgucugccucccaguucaagcaauucucugucucagccucccguguagcugggauuauaggcacccaccaccacacccggcuaauuuuuuuuguacuuuuuuuaguagagacgggguuucaccaucuuguccaggcuguucuugaacuccugaccucaugcuccaccugccucagccucccaaagugcugggauuagaggcuagaggcuugagccaccgcgccuggccacacccggcuaauugugugugugugugugugugugugcacgcgcgcauguguguguagagacaggaucuugccauguugcacaggcugaucucaaacuccugagcucaagcaguccucccaucucagccucccaaagugcuagaauugcaagugugagccaccacaucuggcucauuuccuuuuguugcuaaguaauauuccauuguauggaugcuacauuuuauuuauccauucaucgguugauaaauauuugaguuguuuccaccuuuugacuuuuuuuuuuuuuuuuuuggagggggggggacaagaucucacucugucacccaggcuggagugcaguggcgccaucacggcucacugcagccucaaccucccaggcacaaaugaucuccccacagccuucugaguagcugggacuacaggcacacacaccacaccuggcuaauuuuuguaguuuuuguagagaugggaucucccuauguugcccaggcuagucuugaauuccugggcucaagcgauccucccaccucaguuucccaaagugcugggauuacaggcaugagccaccacaacuaaccccuuuuggcuauuaugauugaugcugcuaugaacauucaggcacaaguuuuugugugaacauauguacauauguuuucauuuuucuuggaguggaauugcagguucauaugguaacucuguuuaagcuuuugggaaacugucagacugcuuucuaaaauggcugcaccauuuuauuguuccuacggucaauguagaaagauuccaguuucuucauauccuugcuaaugcuuguuauuaucugccuuuuuaauccugccauucuaguaggagugaaguaauaucucauugugguuuuauuugcauuucccugguggcuaaugaugaucaacaucuuuuuaugugcuuguaagcuguuugcauaucuucuuuggagaaaugucuauucagaucuuuugcccauuuuguaauuggguugucuuuuuauuauugaauuauaggaguucuucaucuauucuagauacaaaucccuuaucagauaaaugauuugcaaaauguuucucccauuuucuagguugucuuuucacuuucuuuuuuuuuuuuuuuuuuugagacaaagucuugcucuguugcccaggcuggagugcgguggcgugaucucggcucacugcaagcuccaccucccggguucacgccauucuccagccucagccuccugaguagcugggacuacaagcacccaccaccacgcccagcuaauuucuuuauauuugugguagaggcaggguuucaccguguuagccaggauggucuuccaaagugcugggauuacaggcaugagccacugcaccuggccugucuuuucacuuucuugauggugucuuugaaaugcaaaaauuuuuaauuuugaugguguccaauucagauauuuuuucuuuugcuucugcuuuuugauaucaugucuaggaaaccauuaaacuuacuuaaaaauuuucaaaugucuguauaaagauugaacacuuuucauuggugguauucagaauuaaaaaauaaaaaacagaggcuggugcaguggcucaugacuauaaucccagcacuuugggaggccaaggcaaguggauugccugaggucaagcguucgagaccaggcuggccaauauggugaaaccccgucucuacuaaaaauacaaaaaauuagcugggcaugguggcacacacccauaaucccagcuacuugggaggcugaggcaggagaauugcuugaacccaggaggcggagguugcagugagcugagaucgugccauugcacuccagccuggacaacagagcgagacugugucucaaaaaaaaauuaaaugaauaaauaaauaaaaauuaaaaaugugugcccagaguugugcacaaauuacauuuuuaauaguaguaucgugagaaauugugggguuuuuuuugucuacuucuguuauucuuuuguaacucgugucuuuugauucuuuguuuugucuccuuauguacuucauuaaucuucuugaauuuuucccuaaucccaaacuacuagaacuguccaaggccaggaggaauuggaaagaagaugguuucuugaaaucucucuuccauacuucuuuggucuuuugcagcagacaguaacuuauugggccacucuucaguauucaucaguuuauuuccauugaagaacuucagacuccuucaaguucaaaaaagcugugaacuugaagaaggauuaguauugaagccguugcucuuauaacuuacuaguugugugaccuugggcaaauuucacauucagauccucaauuuucucaucccuaaauggagaaugauacugccuaccucagagguuuaguucuugugguugguaacuuaccuauauaaauuauaagguuaaaugaaaugaacucuuuccauacguucguuaacauuaagaauugagcacuuuauccaaguuguauuuugugaagaagugagaaagaaauaaaauaguaaaaaaaaguuaagaaaacacuuuuucggccaggcacaguggcucacaccuguaauccuagcacuuugggaggcugaggugggugaaucaucugaggucaggaauucgagaucagccuggccaacauggugaaaccucgucucuccuaaaaauacaaaaauuagccgggcaugauggcacacaccuguagucccagcuacucaggaggcugaggaaggagaauuacuugaaccccgggcguuggagguugcugugagcugaaaucgugccacugcauuccagccugggcaacagaaugagacuuuaucucaaaaaaagaaaagaaaacauuuuuaauaaguuuuaaucagcaaguuuaucuauauguaaaucaaaggguuuuuguuuucuacagguuauauucccaaauaacuuugaaacaggaaauggaggaaaugugcagggacaucuuccccugaugccaaugucuccucuaaugcacccaagagucaaggaaguucgaacugacagugggagucuucgaagagguagguucaacauugguaaaggaaugaaaaaguaacaaagggcauuuggcuuuuuuucagggaaaauuuuaagucuugugaguauguuauuaagaaaucuaauuuauucagcaggguucgaaaaggagcuugaugcuugugccagcaccccuguguagcucauuguacacuauauuauauacuauaguguauucuauauuaauagaauuuuaaauguaauuuauuuaauaaauauauguaaucuuuccugaaugcuaauggagaacuguuuaaauaagcuaaagucaggcacgauggcaucuuucuguaguccuagcuacucagaaggcugaggcaggaguauugaggauuguguuugaacccagccugggcgaaauagugagaccccccucaugucccagaaaaaaagaaaaagaagaaaggaaaaaacaagauaaguguauuagccuguucucacacugcuaauaaagacauacccaaaauuggguaauuuauaaaggaaagagguuugauuuacucacaguuccacauggcuggggaggccucacgaucaugguggaaggcaaagggaagagcaaaggcacaucuuacauggcagcaggcaagagagcuugugcaggggaacuccucuugauaaaaccaucagaucucaugagacuuauucacuaucaggagaacagcaugggaaagacccacccccaugauucagugaccucccaccuggucccucccaugacacgugggaauuaugggaacuacagucaagaugagauuuggguggggacacagccaaaccauaucacuaagcuaaauaccuacuuuuccaaauuucccaaauuuauauucuuccuuugccuguguaugucucuguagaaaaacauuuaaagcaaaauaaaauuuguauucucuuuggaaugcuuaaguucaucuaauaaacuaguuauuuuuauucuuaaaauaguucauuuugagacuuaccaauggaaagauuuuaguucauucuuccuuauuuucucuugugauguagcgagcugauguguguaucuuguggauuauauagcgcuuggauuuuuaaaaaucaguuaaaaucuccugaccacauaguaucccuuaacaaaucuuagaugaacaaguauucagguuacauaguacgguacauccauuuuuggacucugugugauuguguauguguguuugucugucugcaaucuuugcuuuacaugcaaugcaggaucauaaaaaugacugcaggccaggugcgguggcucacaccuguaaucccagcacuuugggaggccaaggcaggcggaucaccugaggucaggaguuugagaccagccuggccaacauggugaaaccccaucucuaccaaaaacacaaaaauuagcugggugugguggcgggugccuguaaucccagcuacucaggagguugaggcaggagaaucacuugaacccgggaggcagagguugcagugagccaagaucacaccacuggaccccagccuggcggacagagcgagacucuguuucagaaaaaaaaaaaaaaaaaaaaggccaggcacaguggcucauuccuguaaucccagcacuuugggaggcugaggcaggucaaucaugaggucaggaguucaagaccagccuggccaagauggagaaacccuaucucuacuaaaaauacaaaaauuagccaggcaugguggcaggugccuguaaucccagcuacucgggaggcugaggcagggaaucacuugaaccugggaggcagagguugcagugagcaaagaucgugccauugcccuccagccugggcgaaagagcgagucuccgacccaaaaaaaaaaaaaaaaaagauugcauaaggucaggcacaguggcucacgccuguaaucccagcaguuugggaggccgaggcagguggaucaucugaggucaagaguuugagaccagccuggccaacauggugaaacccugucucuacuaaaaauacaaaaauuagccaggcauggugguguacaccuguaaucccagcugcucaggcagcuaaggcaguagaauugcuugaacccaagggauggaguuugcagugagcggagaucgcaccacuguacuccagccuggggacagagcaagacugcaucucaaaaaaaaaaaaaaaaaaaaaacaauggccgggcgcaguggcuuacacccguaauccuagcacuuugggaggccgaggcgggcagaucacgaggucaggaguucaagaccagcccgggcaacacagugaaaacuggucccuaguaaaauacaaaaaauuaggcaagcauggcagcaugcgccuauagucccagcuacuugggaggcugaggcaagagugaggcaagagaauugcuugaacccaggaggcggagguugcagugagccgagauugugccacugcacuccagccuggucgacagagugagacuccgucuccaaaaaaaaaaaacaagauugcauaagaugugaauacucagucauuuuaaucagugggaauaauuauaauuauuauaauuguuuuuugaucuuuacgaaucuugucaaaauguuaaaaaaaaggcucuucuuucugucaguuauuaauguuuagagaaaugaaaaaauaguaaaaauauuuaguauacuauaauuuaaaacuuacgaaauauugagaauuauuuucuuuuuuaaaaacuuagcaagaauaguuuaaacugugcuugccaccuuccucucauauaauuuauaacuaagugagcaucuuuucuguaccuugacagauugucauguuucuaaauuuggauccgcuuuacauuuguauauucauuacauucuuauugagcauccaccauagcuguuccaguacugugcuaagaaaagaucauuucaauggauuugcagcuaacuuuauggcuucaacucgagucuugccuugaaaugucaccuuuaaacaugccuagucagauucaagggcuugcguggauuucuuagauauaaggcauucacauggacucuuguaaaagaguaauggaaacaacuauagaaauuugcacuuguuuacugaagacaggagaaguaaaagcugcuuucauaagcccaagaauuacggagauuuuuauuaaacuauaacuauuuucccaaucaccucacuaauacagagagcuucuaaaucauugccaggggucauuuucauaccuuuugaacauguuuugaaaauagauuacagggccaggcgcaguggcucacgccuguaaucccagcacuuugggaggccgaggcgggcagaucacgaggucaggagaucgagaccauccuggcuaacacggugaaaccccaucucuacuaaaaauacaaaaaauuagccgggcaugguggcgguugccuguaguuccagcuacucaggaggcugaggcaggagaauggcgugaaccugggaggcggagcuugcagugagcugagaucauaccacugcacuccagccugggcaacagagcgagacuccaucucaaaaaaaaaaaaaaaaagaaaagaaaauagauuacaugacuaucuaauuaucuagugaauguaaaaauaaauaaugaaggccgggcacgguggcugaagcuuguaaucccaaaugaggcagguggaucaccugaggucaggaguucaagaccagccuggccaacauggcaaaacccugucucuacuaaaaauagaaaaauuagccaggcaugguggcacaugccuguagucccagcuacuugggaggcugaggcaggagaaucgcuugaacccaagaggcagaggucacaguaggccaaaaucgugccacugcacuccagccugggugacagagcaagacuccaucucauaaauaaauaaauacuuuuguuuuaaaagcauauuauugaccuaccuguaaggaauaauugguugagggaagaauugugaaaaaagauguagaaaagauguaggguuguaaggggcuagaaaaacccgugcagcugguagagagggaauggaaagcagauccugugaaaggauagcacaggaagagaggcaaaauccauaauccuuacuuuauuuuugaucaacacaguacugccaacccucagauuaaggcaagguaagcagauuuauaucaucuuuacucauaucuucugauagauuuacuaaagaugauuccauaucuacuaaauuagaaagccagagcuaccgccuuaaacugcuuggagugcaaauauucacaaagaggcaaaacugugacccaaauuccugauuuuugcuuuugcuucccuucuucucaggugcucucuacuagguaagauugggagauauuggacuacuacuaaaauuuagugcucacuucauucuaccucucaaccucuacuuuguccuuaauguuuugcuccuuuaauguaggcagagguucaagaaaccaggaagaugagugaucauaauuuucacguuuuaucguagugacuuauuucaugccucuuucucccaguagacuacauauuccaugagggcaaaggccauguuauucauaucuagcuagugcccagcauaaguaacucacuaucuguugagugaaugaguaaaccuaauuuauuauuuuggaauacauuucuguuuuaaauuuauuauuuuuuuuuagauaugcaaccauugucuccaauuucuguccaugaacgcuacaguucuccuaccgcagggagugcuaagagaagacucuuuggagaggaccccccaaaggaaaugcuuauggacaagaucauaacagaaggaacaaaauugaaaaucgcuccuucuucaagcauuacugcugaaaauguaucaauuuuaccuggucaaacucuucuaacaauggccacagccccaguaacaggaacaacaggacauaaaguuacaauuccauuacaugguaacguuauagugcauuuguuuuguacuuuuucugagauaaaaauuuaagaaaugucuuaguggauuagaucacaugguuuuucuaacucauuauuuuuucuugaaccuauacuuuuuuuuuuuaaauagauuugaauuuuuuagagcaguuguagauucacagcaaaauucagaggaagguacagacauuucucauagucccccuuccccaaccagaggcauauaaagccucccucauuaucaguauuccacaccagaaugcuacauuuguuacaguugaugaaccuacauuacugacacauuacccaaugcccauaguuuacauuaggguucacucuuggugaauaguuuauugauuuugagaacguauaaugacauguaucugucacuauagcuccauacagaguaguuucacugcccuauaaauccucugugccccaccuuuuuguuuugaaccuauagugguuuuuuuuuuauuuuuaaauuuuauaaauuuacuacccucucuguuuguuuagacuuauuuuacuuuuucuuuucuucuuuuuuuauuuuuugagacaggaucucacucugucacccacauuggaguacagcagcaugaucucaucucacugcaaccucugcucccaggcucaagugaucgucccaccucagccuccugaguagcugggaccacaggcaagugccaccacucccagcuaauuuuuucuauuugugguacagaugagguuuuaccauguugcccaggucucaaacuacuuuuaaaauguucuuaucugagcuuuccaauauguauguauugagcaaaaauucuguuuuuugacuaacagcucaagugcucaaaauguuaaaaaaaaaaaugcuuuuuuuuccaauaaauuuaaacuauaaauguaucccaggcaaauacaaaauagagaacaaaauuugcuuuuuuuuccauaaauuuaaaguauaaaaacaaaaccgaauauucuuguuucuagaaaauaaggauuuaugcggggcaugguagcuuucaccuguaaucccagcacuuugggagaccaaggcaagaggaucacuuuagcccaggaguuugagacccagacugggcaacauagcaauauccuaucucuacaaaaaauuaaauuagcugggcauggugauguaugccuauggucccagcuacuuaggaggcugaggcaggagaaucacuugagcccaggaauuugaggcuacagugagccaugaucacgcuacuguacuccagccaggacaacagagcaagacauugucaaaaaaaaaaagaaaaagaaaaaaaaaagggggcccggggggcgccaggcacaguggcucacaccuauaaucccagcacuuugggaggcugaggcagguggaucacuugaggucaggaguuugagaccagccuggccaacguggugaaaccccgucucuacuaaaaauagagaaaaaacauuagccgggugugguggcgcaugccuguagucccaacuauucaggaggcugaggcaggagaauugcuugaaccugggaggcagaggucucagugagccaagaugaggccacugcacucccaccugggugacagagugagacugucucaaaaaaaaaaaaaaaaaguccagcugcaguggcucaugccuguaauccuagcauuuugggaggccaaggcaggcagauggcuugagcugacgaguucgagacuaaccugggcaacauggcaaaacucccaucucuaaaaaaaaaauacaagccgggcacaguagcucacuccuguaaucccagcacuuugggaggccgaggagggcagaucaugaggucaggagaucgagaccauccuggcuaacauggugaaacccugugucuacuaaaaauauuuuaaaaauuagccgggugugguagcaugugccuguaguuccagcuacucaggaggcuaaggcaggagaauugaacccgggaggcagagguugcagugagccgagaucacgccacugcacuccagccugggcgacagagcaagacuccaucucaaaaaaaaaaaaaaaaaauuuaccaggcauaguggcuugcaccuguagucucagcuauuugcggggguugaaaugggaggaucacuugagcccaggaggucgaggccacagugagcugagauggcgccacugcacuccagccugagugaccaagugagacccugucucaaaaaaaaaaaaaaaaagaauucagucauaaccuagaauuacuauuuuguagccuucuuauacacacagauauauguauauauaauugucaaaauauauauaguugacaacuuuccuagaacauaugcagauuauuucuaauaaugcuuauacauucaggugucgcaaaugaugcuggagagaucacacugauaccucuuuccaugaauacaaaucaggaguccaaagucaagaguccuguaucacuuacugcucauucauuaauuggugcuucuccaaaacagaccaaucugacuaaagcacaagagguacauucaacuggaauaaacaggccaaagagaacuggguccuuagcacuauuuuacagaaagguauguguuuuuauagcacuuuagaagaauuuguuuaaucaauggaagaaagauugaguaacagagacagacuuuggucuuuuuuuuuucuaauauacauaacacaaaauuuaccauuuuaaccauuuuuaaguguacaguucaaugguauuaaauacauucacauuguugugcagcuuuauuacuaccgucuaucuccagaacuuuuucgucuucccauucugaaauucuguauccauuucucccuuuccccagcuucuggcaacuacuauucuacuuucuguuucugugaauuugacuacucuagguucuuccuaugagugaagucauacgauauuuguuuguuuuugugacuggcuuagcguaaugucuucuagguucauucauauuauagcuugugccagaauuuccuuccuuuucaaggcugaauaauauuccauuguaugaagaagagaaaaaaagaacaaaagaaaaaauauuccaucauaugaauauacuuuuuuuuaauaccacauuuuguuuauucauucaucugcugaugggcauuuggguugcuucuaccuuuuggcuauugugaguuaugcugcuaugaacauuuguguacaggugucuguucaaaccaggcgugguugcucaugccuguaaacccagcacuuuaugaggccgaggcaggaggaucacuugaacccagggguuugagaccacccugggcgacacagugagacccuaucucuauuuuaaaaaaaaaaaaaaaaaaaagcagccagguaugguggcagaugccuauagucuuggcuauuuuggaggcugaggugggaggaucacaugagcccaggagguugaggcuacagugagucgagaucacaccacugcgcuccagccugggcaacagaacgaggcccugucuuaagaagaaaaaaaaauagcaacaaauaucuauucaagucucugcuuucaauuccuuuggguauauucccagaaaugggagaguaauuuaguauuucauuuucugaggaaccaccguaccauuuuccacaguggguggaccauuuuacauuaccacuagcaaggcacaaguguuccaaguucuucucaucguugccaacguuucguguuuucugguuuguuuguuuuuuugauaauggccauccaauggguauaaagagacaucuuacuauaguuucaauuuucauuucccuaaugauuaguaauauugaguaucuuuucaugugcuuuugcccaucuauauaucuucauuauagaaaugucuauucgagucuuuugcccauuuuuuuaauuaugaguuuuggguuuuguuuuuguuaaauuguaggaguucuuuauguauucuagauauuaaucuccuauaaaauauacuauuuacaaguauuuucucccauucuguggguugccuuuucauuccguugauaguguucuugacacaugaaaguuuuuaaucuuaauaaagucaauuuauucuuuucauuuuuugucugugcuuuuggugucauacacaagaaaucauugccaaauccaguauuauaaaacuuuuccccuauguuuucgucuaagaguuuuauaguuuuuagcucuuauauuuauuaugucuauuuuuuuuugagacagagucucacuuuaucacccaggcuggagugcagucacgcagucacagcucacugcagccuccgccucccagguucagaugauccucccaccucgacccucugagcagcuaggacuacaggcaugugccaccaugcccagcuaauuuucguuuuuuggguuuuuuguuuuuguuuuuuuuuuuuuugagacagagucucacucuguugcccaggcuggagugcaguagcgcaaucucggcucacugcaaccccugccucccggguucaagcaauucuccuuucucagccuccugaguagcugggacuacaggaauaugccaccacgccuggcuaauuuuuguauuuuuaguagagacgagguuucaccgugcugguuuggcugguuucaaacuacugaccucaggugauccacccaccuuggccucccaaagugcugggauuacaggugugagccaccacgccgggccuguuuuugaacuuuuuuguagagacgggguuucaccauguugcccaggcuggucucaacucgugagcuuaagugaucugcccaccucagccucccaaagugcugggauuacagccgugagccaccacgcccagcccauuuuaauuuuuguauaugguguuagauaagggucuaaagucauucuuuugcacauggauauccauuuuucccagcacgauuuguugaaagacugcccuuucccauugaaugagcuuagaauccuuguugaaaagucacuugagcauagauauggggguuuaauucugggcucucuauucuauucauuggacuauaugucuaucuguauucaguaccacacuguuuugauaaccauagcuuugugucauaaguuuuaaaaucaggaggugugagaccuccaacuuuguuuuucuuucuuaagauuguuuuagcuauuuaagauuucuugagagucuguaugaguuuuaggauggauuuuucucuuucugcaaaaacauuguggaauuuugacagagauugcauugaauauggagaucgcauuggcuaguguugacaucuuaagaaugucaagucuuccaguccaugaucauaggaugucuuuucauuugcgucuucuuuaauuucuuucagcaacauuuuguaguuuucuguauaugucuuuugcaagacaaguccuugcuuaagauuauuccuaaguauucuuuuugaugcuauuguaaguaauaaguaaguagaauugucuuaauuucauuuuuuagauuguucauuaauguaaaggaacacaagagauguuguuguauugauuuucuugcagcuuugcugauuuguuuauuaauucuaucaguuuuuauggauucuuuagguuuuuugaguuuuccauacacaagauuaugucaucugugaacaaagauaauuuuacuucuuucuuugcaauuuggauuucuuuuuccugccuuauugcucuagcuaggaauucccguucuauguugaauaaaaguggugaaagcaaacauccuugucuuacuccugaucuuagaggaacaccuuucagguuuucaauuugaguaugauguuaacuguggguuuuuuauauacaguugacccuugaacaacauguuuuugcacuguacaaguccacuuauauacagauuuuuuucagccaacacagaaugaaaauacaguauuugagggaugugaaaccuguguauauagagggccaucuuuuuguacauggggauucuacagggccaaaugcaggacuugaguaugcauacauucagguauaugcaggggcuccuggaagaaaucuccuguguauaccaagggauuacuguauauccuuuauuauguuuagguaguuuccuucucuuccuagcuuuuugaguauuuuuaucaugaaaggguguuaaauuuugucaaaugcuuuccuguaucacuugaaaugauuauguggccauuuucccuuuguccuuuuaauaugguguguuauacugaaugauuuccuuguuuuaaauuauccuuaccuucuaaaaauaaguucuacuuggucaugguguauaacccucuucauaugcuguugaauuuguuuuacuaguauuuaguugaggauuuuugcgccaauauucguaagagauaguggucuguauuuuuucuuaugcuuucuuugucuggcuuugcuaucaaguaauguaccuuuagccacuuaaaaaauacauuugaccuuucaagagaacauuaugauccuggugagcuauaaguuuagacucaggcucacaggguuugauucuguuuucagaucuaacuuauguuuuuugccagcuuguauucuuuucuaacuuugaguaaguaguuggccagccucuggaauuuacugaaacucuuuuguguuauguugccguagaauggaguucacugugggacaaauacauguuggaucucaugggugaauuuuaauuagcgaagaaucauucuaaagauugcugggauacugugagaaggcuauauauuuuuuauuauuauuauuuuuagagacaaggucuugcucuguuacccaagcuacagugcaguggcaugaucauggcacacuguagccuugaacuccuggguucaagugauccucccucuuugaccucccaaagcacugggauuacugugugagucaccacccaagccauuauuuauuuauuuauuuuugagacagucuuacucugucuaccaagcuggaaugcaguagcgugaucucggcucacuacagcuucugucucccagguucaagcgauucaccugccucacccucccaaguagcugggacuauagguguccaccaccacaccuggcuaauuuuuguauuuuuaguagagacgugguuucaccauauuggccagccuggucucaaacuccugaccucaggugaucugcccaccacagccucccaaagugcugggauuacaggcaugcgccaccaugcccagcuguuacucauaauuuuuauuauaaaucuaggccaggcaugguggcuuaugccuguaaucucaguauuuucagaggccaagccaggaggguuacuugaggcuugcaguucaagaccagccugggcaacauagcgagacccagucucuaccaaaaaauuaaaaaauuagccagcauaguggcccaugccuguagucccagcuacucaggaggcugaagugggaggauaacaugagcccaugauuucgaggcugcagugagcuaagaaggugcuacuacacuccagcccaagcaacagaguaagaucccgucuccaaaacucaaaaauaaauaaaauaaaucuaauguguuacccuuuaaauuagcauaugaccaguucuuauuauaaugccuaaauuauuuuaauauuaauggaaagggacuaaaaacgguugaccuuagacauaacuugaauuuguccuaucucuuacgagcacauuuugaaucaucagcuucugauaagauagacauguuaaucagauauuuauaaccaaacaugacugcagugcaucccacagcuagaugguuggcuagcccauucuauugcccagguuggaguacagugacuauucacaggcacaguuauagcacgcuagagcccaaacuccuaggcucaagugauccucuuucauuacccuccgaguaccugggucuacaggcaaauuuaaguguauuucucuacuaaucauucuuuuuuuauuauuauuuugagacagggucuugcucugucgcccagacuagagugcauaggcacgaucaugucucacugcagucuaccucccaagcucaagagauccuccugccuccugaguaguaggaccacaggcaugcaccaccccacccagcuaaauuuuuuuuuuuuuugguagaaauggagucucgcuguguuucccagguucaucuugaacuccugggcucaagcgauccucccaccucagccucccaaagugcugggauuacaacaggugugagccaccaugcccaacuaauuguucuuguaauaauuuuuugguuuuuuuuuguuguuuuuuuuuguuguuuuuuuuuaagauggagucucacucugucaccaggcuggagugcaguggugcaaucucagcucacugcaaccucugacucccuaguucaagcaauucucugccucagccucccgaguagcugggauuacagggacgcaccaccaugcccagcuaauuuuuuuauuuuuaguagagacaggguuucaccacguuggccagaacagucucgaucuccugaccuagugauccaccaccucagccucccaaaguacuaguauuacaggugugagccacugcgcccagccuaauaauuuuuuuuuuuuuugagauggagucuugcucugucacccaggcuggagugcaguggcacgaucuuggcucacugcaaccucugccgcccggguucaagcaauucuccugccucagccuccugaguagcugggauuacaugugugugccaccacacccggcuaauuuuuguauuuuuaguagagaugggauuucaucaucuuggccaggcugaucuugaacuucugaccucgugauccacccgucuuggccucucaaagugcugggauuacaggcaugagccacugcgcccggcaauaauuuuuuauauguccuuuuuucucuaugcuaaauaaaucuucuuuaauuuauacucuuccucaaucauguuuuucuccauucuuuugucacuugaugucauggaaggucucagcccacacucugaauuagauaauuuuacauuaagauaaaacaugaggauuauuuuuuacauuuuuauaucaaauccuauuucuuucacaguaccucuaauguguuuucugaccucgggcauagugauuaucuauuuauuucuuagauuucaguuuagcuguuugaaaauaauaguagcuuaaacaagagaauuuaucuuucacauaaagucuguguaaauaguaugggacugcugugguuaccacgaccauuaagaacccagguccuggccaggucgguggcucacgccuauaauccuagcacuuugggaggccaagacgggcggaucaugaggucaggaguucgagaccauccuggcuaacauggugaaaccccaucucuacuuaaaauacaaaaaaauuacccaggcaugguagcaggcaccuguaguccuagcuacucgggaggcugaagcaggagaauggcgugaaccugggaggcggagguugcagugagccgagaucacgccaccgcacuccagccugggugacagagcaagacuccaucucaaaaaaaaaaaaaacccaggucccuucaagguuuuuuuggccauuuucaacacaagguuucuaacucaguccaugaugacugcuucccuuccagauaucauaucugcauucuagccagcagaaagaaaaagagcaugccuccucaccuucagaaccuguccuagaaguuacauacaccaaugcuguuuauuucccacuuagucauauagccacuuguagaauguuuuuuuuuuucuuuuuggagacaaggucuugcucugucacccgugcaggggugcaguggcaagaucauggcucacugcagccucaaccucccgggcucaagcgauccucucaccucagccuccugaguagcugggacuauaggcacaggcuaccacacccagcuuauuuuuuaauuuuuuguagagaagggguuucgcuauguugcuuaggaugguuucaaacuccuggacucaaccaguccguccaccucacccucccaaugugcugggauuacagaugugagccaccgugcccaggcagaauuuucaaaggggcaaauauagucuuuauuacaggaagguggguguaaauguuaaggguucuguuauugcagaagaggagacagacacuggaaaacaacucauuuauagcuucuacaaccauucuuugucuucuguuccuuucaauuauagcucauuuauuuucauuacauuguggguuuuggagcaacugauucuccaaggaauuucaucuuuuagggaaaucccuucuuugaaugaaauagucuucagaaguauaaacaaaauauaugaaagcagagcugcuuugguuggcaguugggaugguugagggagagucuugcucuuuucaccaccuuuacuggcuucucuccucugucccuucacccccuccuaugccuaaggacuguuuuaacaacagagcuugaaaauauagcaguuuccccauuuacuuaccauuuuuaauuuucaaaauggcaaauuauugccucugauaauuaaccuaaguuugacagaaauaagacuuuuuggugaauucuuuauuuugaauguuguuuuagaaucuaacauccuuuuccuuucauuuaauuauaaccugcucauagauuagaagcuagaaaauauaaaaggaacugaaaugucugaaucuauaauaaauucaaaauaaccauucauugaguaaauuauaacgauuaucuaugcugaacucagugugaugcugguguucuaugccuaaauagaauuuacugugaauguuagaaucaaaagccuuccagcguauguguauccuguaagcauuggaucagcucuguaaaagauacuuuaccaaguauuacuuaacuacauauuauuuuuaauuauucuagcuaggacuauauaucuuaucuucuccuuucaugaauauaaaguucuagcaucuuucucucugcucuuacccuacuauuuacugagcauggcuggaccagaaacaaggggagaggaugcagaaaauuuguuugcuguaaaauaaaucacugguggcuuuggagucaacuguuugucucucuuuauauuagaucacugaguagcuuaaauuaguuuuuaagcucgguuuguagguauuuuucugccaaagauaauuuucuguaagggguaacuuuuuuuuuccaucuggaaauuuaaagacauaguuugggccaggcgcagugacucaugccuguaaucccagcacuuugggaggccgaggccagcagaucaccugagcucaggaguucgagaccacccuaggcaacauggugaaaccccaucucuacucaaauacaaaaaaaaaaaaauuagccaggcgugguggcacuugccuguagucccagcuacucgggaggcugagacacaagcaucacuugagcccggagguggagguugcagugagccaagaucaugccacugcacuccaacuuaggcuacagagugagacuccgucucaaaaaaaaaaaaaaaaaaauaguuugaauagaauagucugguuuaggaauaccacaucacgguuaucaagucuuaaaauaaaaaaacaaucuugcaggaucuagggccagggaauugaacugaauuuauuuucacaggcuuuaaaaaaaacaacaacuuuguaucuuacuuauuuuaacauuccuguuucguucccauugugcuccuaaaaaguguagaauauaggagcaauuuuuuaaaugguuuugcuuucugacucauuuuuggagucaaauauuucauuuauuauuuggcauguuagacccccuagcaauuuuaccugaacccaaagagaauagacagagacuucugagcuuugaaaaauuaugcauucgagccgggcacaguggcucacaccuguaaucccaguacuuugggaggcugcagugcauggauuacuugaggucaagaguuaaagaccagccuggccaacaugaugaagcccugucucuacuaaaaauacaaaaauuuagcuaggcgugguggcaugcaccuguaagcccaguuacucgggaggcugaggcaggagaauugcuugaaugcagaaggcagagguugcagugagccaagauugugccacugcacuccagccugggugacagagcgagaauccaccuaagaaaaaaaaaaaaggaaaaauuauauguucauaauugucaugaugcagguaaauccuauauuucauuuuuucuuacuuuacauaguuggcagcauagaguaauagaugacaucuuuaaaaaauuuuuucaaguaguuuugcuuuaaucuauauccuccugccauagcagugaacuagugcuauagaacagaaauuuuauuuaauuuaguauaucaacagccuauguuuuuuaaucuuggucuugguaagacauaaaaauuugagaaaugauuuacuugguguuuugcaucaauguguuaccuucuauuuuaggucuaucauuuggcaaguguacgcuuacgugaucuaugucuaaaacuggauguuucaaaugaguuacgaaggaagauauggacguguuuugaauucacuuuaguucacuguccugaucuaaugaaagacaggcauuuggaucagcuccuccuuugugccuuuuauaucauggcaaagguaauguauaaauugggagaagaggcugggcaugguggcucacacguauaauccuagcacuuucggaggucaaggugagcagauagcuugagcccaggauuucgagaccagcuugggcaacauggugaaaccucaucucuauaaaaaauauaaaaaucagcugggcauuguggcuugcaccuauaggcccagcuacuugggagacugaggugggaggaucucuugagcccaggaggccaaggcugcagugagccgagaucaugacacuguaccucagccugggcaauagagcaagacccugucucaagaaaaauaaaaguuucuguaccauaucgcauauugcuuucucgugauuuauugugcugccucagaagagcauuuuacuuucuaguugcuacaacguguuuuaagucauggaauaacauaucuugcuuguuuuuuaaaauucucauauaucugauacaaucauuugucuugacuguacuggccacacuggcaguccuagcagauguauacaguuaagacuugauuuuucagcuuuuugagacagagcauauguuuuuaaacuccuuugugaccccuccucccacaaugccucuuugaaaucucuguaaaaaauaggucuuaauaauuguuacugcagcacuauggugguugacgagaaaaugcaccauacaaaaggcaacaaaaagggagcaaagaagaaaaugguugauucauuuuuuaagaaagauugguuugauguaaaaaagcaccgacuauguucaauacaagaaauacuggaaagacacuaguuaccaggacucaaggaaccaaauugcaucugauagcuucaagagucauguguuugaaguguaucuugcugauuugcagaaugaugaaguugcaguuagaaaacucaaccugaagggccgggcgcaggcucaugccuguaaucccagcacuuugggaggccaaggcaggcagaucacgaggucaggagaucaagaccauccuggcuaacacagugaaacgcugucucuacuaaaaauacaaaaauuagcugggcaugguggcacgcgccuguaguccuagcuacucgggaggcugaggcaggagaaucacuugaaaccgggaggcagagguugcagugagccaagaucaugccacugcacuccagccuggaugacagacugagacucuaucucaaaaaaaaaaaaaagaauuaaaaaauuaaaagauaaauguuacuaacuaaucguguguuuuccagaagacuguuagaguucaggcuuugccauuucuagcucaucauuauagagaacagguuuagcacuaauggacagugaagcaggggaaaagagugacuuaagugaaguuuaugaucacagagaucccagaaggaauuccuuuuuggaucacuaauccauuuucuuccuuuuggccaccacugugacuucugucuaagcauuagaaacccuacagucuguccugaaauguuaaaaccuaauccuguaauagccacucaguuugauugagaaucaucacuguaagauauuuuuaauccuucguaugugguuaauuuacuuuuaaguaaguacuuaaaaauuaauaaaacuggagacugcagggaauuaaacagaucugaguuuucuuauaucuuuuuuuauauaaagaaauggauuuucaguagagucacaccauagcaguuucacugcuuuuugauuaaugaaacuauuaagugaguccccacaggccacaaagccugaacuuuaaagguagaaaaaaucauaaauguuagugguuuuuagucauggacuggccugggguuaaugguuuucugcaagguugcucucagugccaacuuauaauugaaguuuuguucagagccauuuuucuuucaaaaagcaguugauaaaugcgguuuuuauuuuccuuagguaacaaaagaagaaagaacuuuucaagaaauuaugaaaaguuauaggaaucagccccaagcuaauagucacgugaguuacauuauuuuuccuacuguccaaaaauagauuuacucuuuuccacugacaaguuauauaaaagguaaacuuauuuuauaguuuuaauauacuucagauuuucuguuuuaauggauaacauuaaacucaagagauaauuucauugaaggacaguuucaauagaagccaggaagucugacuguuuccgacucauccauauacuuucauauacuucucauaaguucugccauuccauuuguucauuuaaugaaagauauguauaauggcugggugcggugucucacgccuguaaucccagcacuuugggagguggaggcagguggauuaccugaggucaggaguucgagaccagccuggccaauaugguaaaacccugucucuacuaaaaauacaaaaauuagccaggcguggugucacacgccuauaaucccugcuacucgggaggcugaggcaggagaauugauugagcccaggaggcagagguugcggugagccaagagcauuccacugcacuccagccuggccgacagagcgagacucugucucaaaaaaaaaaaaaaaaaaguuauguauaauaauaauaauauucuuuaauuauaugacuuuauuuuuuaaugauauuuaaacccagugaaauuugaggauucauuaaccuaacuacagcuucuuuugccaucugcuaagcauccuaauguuugcaucuuugaauagauguuaaacauuucugauuauauuguucugaccguggugaaaauuccaugaaaccuuucagucaugguagcagaguggacuggcacacaauaagcauuuaaugaauguucaugucauauuguuguuauuauuguaccugaagaacacaaguaaauuaccuuaaggguuugaucauucaagaaccuaguugcucugcucuuaggaagcauaauggccucuucucuggcccuggaaauuguagacagaaagagagagguaguggccuagacugcagaccaaaauagagauguggccucaguauuaguaguuauauccccuucuaagagagcuuuguuuaagcccuaaaauacauuauagcaagcaauauagagacauuugaagaaccaaguacagguauuuguuauauccugugauaagcuaagaguuucugggcuucuucaggaaaaucccucaggaacagagccuagaaagcucuagauuguccuugaagaucauuaaggugagguuagugugagucaagaaugggccaagccaugguucccugaauaucuucuuaauaccaguaaccuauaauacaguacaagggggaauggaucaugccuuuccagcuaucucagaggugagaaauaguuuaggggcagggaagggaaaagauuuucauguggccaucugaaaggagaugggaaugggcugggggcagaaaaacaagcugcauuaagaacaaaugacucugguccaggcgcaguggcucacgccuguaaucccaccaguuaaggaggccaaggcagacagauugccugagcccaggaggucaaggcuacagugagccaugauugugccacugcacuccagucugagccauagagugagacccugucucuaaaaaaaaaaagaaaaaaaagaccaauugauuguuguguaaggaauuaagaagaaggaggaauuaauucaggucuuuuguuuuuuguuuguuuguuuuauuuuguuuuguauuugagcagagucuugcucuguuguccaggcuggagugcaguggugcgaucucagcucaaugcaaccuccacccacugaguucaagcaguucugccucagccucccuaguagcuggaauuacaacugugcgcuaccacacccagauaauuuuuguauuuuuaguagagaugggcuuucaccauguuggccagcuggucuugaacgccuggccucaagugauccacccaccucagccucccaaagugcugggauuacaggugugagccacugcaccugaccaaauucaggucuuuaaaguugcuuucauuuaguaaaaccugaucaucagucuuuaguugcuauuucuucuguuuuauaaacuaagcccaucuuagaugguaggcucuucuccaguauccccucuuuuaugguauguguuauaaucuauacuuacuagagcuaauaacauuuuacccuugaguaucacuuauacagacaaauaguuuuuaauugguuugauauuuugcucuucucacuuugauuuuguuuaaccuguaccucugugacugagcuguccuuuucuuccccucuggcauguagguauauagaaguguucugcugaaaaguauuccaagagaaguuguggcauauaauaaaaauauaaaugaugacuuugaaaugauagauugugguaaguuauccaauuuaacauauuauauguaaaacacauuggaucacacuguacauaauacagugggugucagacaacauggaaaugugaaucauaaggaggugagguggacaaugcauauguuuugaaaacaaauaaguuugagauuagaaugugcugguauaguuuauugaaaccauuaauuuguccccuguuaauuguguuuuggaagaaguuuucuagucuacuuauacauguuaaugaaacacguaaaagagacuuaauaaaauucuaaaaucugaaugacagggaaaacaagguagcugacaguaaucuucccgaggagucuguuaagaaaaugucccggcugggcaugguggcucacaccuguaauuccagcacuuugggaggccaaggcggguggaucacgaguucaagagaucaaggccauccuggccaacauggugaaaccccaucucuacuuaaaaaaaaaauacaaaaauuagcuagguguggugguauacgccuguagucccagcuacucaggagccugaggcaggagaaucgcuugaaaccaggaggcggagguugcagugagcugagaucacgccacugcacuccagccuggcggcaaagugagacucugucacacacacacacacacacacacacacacacaagaaaauguccuguucauauaaguauuacuuauagguaauucugcuaccacaggcaagacugcacccucuugccaccaucaugcuaagacuucaggcacuaguaaucuuuuuuuuucaaagaaagaaaaaucaaaugguuaguauucauacaccucuucugccuaccuccuuucccuugucucaucuuuccauguauuucagguguauguaauauauacauguguauauacuaugauuuuuuuuuuuugagauaggguuuuguucugucaccuacacugaagugcagugguaugaucaugacucacugcagcauggacaucccaggcucaaucaauccuuccaccucagccucccgaguagcuggaacugcaggcaugcaccaucacccuggcgaauuuuuauauuuuuuguagagacgggauuuugccauguuugcucaggcuggucucgaaaucgugagcucaagugauccgcccaccuuggccucccaaaguacuaggauuacaggcaugagccacugugcuaagccuagguacugugauuucuuuaaugccacagugugagacauuuaggucauuucuccuuuucuugucucgucuugucucgucucgucucgucuucucuccucuccccucuccucuccucuccuuuccucucuucuucccauccccaucccccuccucucccccuccccugcccuccuuucucuuuuauuuuuucuuuucuuuucuuuucugagacaggaucuuacucuguuacccaggcaggcaugcaguggcacaaucauggcucacugcagcccugaccuccggugcuccuuucaucucagucuugugccacacccaacuaauuuuuuguagaggugggauuuugccauguugcccaggcuggucuccaacuccugggcucaagcagucucccuaccauggccucccaaagugcugggaugacagguguaagccaccaugccuggccagguugcuucuaauuaugcacagcucugugaugagcaucauuuguagcuuaaucuuuaggccacauccuuaggauaaauucuuaagagaaaaucugaugaauuaaagcaaauuuuuaaauuauaaaaauauccauaaucauuaugguguccacugggauauaaacuuuuaagauuucauucaccaaaaagaucuuuuaauaauguccuagaaucugacuccguuugaggauaauaggccaaacucaauucuuuuuacauaaguguauuauucuggagccuuuucaaggcaacgaggaguauauaagacaguaacccuagccgggugugguggcucacaccuguaaucccagcacuuugggaggccaagguggguggaucaucugaggucaggaguucgagaccagccuggccaacauggcgaaaccuugucucuacuaaaaauacaaaaauuagcugggcaugguggugagcaccuguaaucccagcuacuuaggaggcugaggcacaagaauugcuugaacccaggaggcagagguugcagugagccaagaucacaccacugcacuccagccugggugacagcgugagacuccaucucaagaaaaaaaaaaaaaaaaaaaaaccgcugggcacgguggcucacgccuguaauccaguacuuugggaggccgaggcggguggaucacaaaaucaggaguucaagaccagccuggccaagauggugaaacccgucucuacuaaaacuacaaaaauuaccaggugcaguggcagacaccuguaaucccagcuacucaggaggcugaggcaggagaaucacuugaacuugggcggcagagguugcagugagccaagauccugccacugcacuccagucugggcgacagagcuagacucuaucucaaaaaaacaaacaagcccgggugcgguggcucacgccuguaaucccagcacuuugggaggccgaggcagguggaucaugaggucaggagauccagaccauccuggcuaacacggugaaaccucgucuccacuaaaaauacaaaaaauucuccgggcgugguggcgggcgccuguagucccagcugcuccagaggcugagguaggagaagggcaugagcccaggagguggagcuugcagugagcggagaucgcgccacugcacucuacccugggcgacagagugagacuccaucucaaaaaaaaaaaacaacaacaaaaaaagccauuuucuauauuuguuauacauguugcuuaccuauccagggugguuuuucuguuccuacaaaaccagacaucagagguuagcuagaaagcuguggaucacuugccuguuuuguguuuuuucuaugagaaacuaacugcuagcaaguaucugagcuacaagagcagugaaguuccagagaguagaaguaagcaaaagauaauagacgaugucguuuucuguuuuguuuucuuuuugauaaguaucugccaaagaaacuugggugacugagaguuugccacuuccuguauauauagguuucagaucaaauucugcuacacaauuucuuucuuucuuucuuuuuuuuuuuuuuuuuuuugagauacagucucacucuuguugcccaggcuggagugcaauggugcgaucucggcucacugcaaccuccgccucccagguucaagugauucuccugccucagccucccgaguagcugggauuacaggcaccugccaccaggcccagcuaauuuuuguauuuuuaguagagaugggguuuugcuauguuggccaggcuggucuugaacuccugaucucagguauuccacccgccuuggccucccaaagugcugggauuacaggcgucagccacugcaccugaccuuuuguuuguuuguuuugagaccaugucuugcucugucacccaggcuggaguacaguggcacagucacagcucacugcagccuugaccucccaggcccgagugauucucgacucagccacguccuggcuaauuuuuauauuuuuuguagagaugggguuucaccauguugccaaggccagucuugaacuccuggguucaagugauccaucugccuuggccucccaaagugcugggauuacaggcgugagucaccgcacacugccuuacauacgguuauuaacuagauauauuuauuagcaaguaagcaaacaaccauuguuacagauccuguacaguggugguggcacagggcagggagaauauccagugauaaugaacucaggaauucuggcacucaaaaagagagaacacaguggcuuacaucuacaaucccagcacuuugggaggccaagccaggaggguggcuugaacccaggaguucaagaccauuguggguaacauagugacagccuauugcuacaaaaaauuuuuuaaaauagccacacaugguggugggcuucuguaguccaagcuacucaggaggcugaauugggagguuggcuugagcccaggaugucaaggcugcagugagccaugaucuugccgcuguacuccagacagagcaagacccugucucaaaaaaaaaaaaaaaaaagagagaaaguuauguaggaggauauacagucagacaagucuauauucagauaagucaccuuccaguucuuagagcuaugguuagaugcuaugacccagauuuggacacaccaaagaacaccaacuugggaaaaacaguucugguucuauaaacaaauucauuaugaguuguaaaauaauuacuguuuaaaaagcacacacacaauuuauauauccuaugcaguaaguucauauaucccaguucuaugucugaccagcacccauagaaaagauuugcucaagaacaggugccaagauuucagaugcaggauucagucaaccuuaaggcuaccaucaagcaaauaccguggaucagaauucagggcuggacacaggacuucucagagcuuuuagccuuaacauuauuaucccuaagaguaaagcugagagacuucacuggaucuuucaucccuuucauggcuauugaggguagugucucaaauuuuuuuuuuuuuuuuuuuuauugaucauucuuggguguuucucgcagagggagauuuggcagggucauaggacaauaguggagggaaggucagcagauaaacaagugaacaaaggucucugguuuuccuaggcagaggacccugcggccuuccgcaguguuugugucccgggguacuugagauuagggaguggugaugacuuuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaauaauuuuucuuaguacagaacaaaaugagaagucucccaugucuaccucuuucuacacagacacggcaaccauccgauuucucaaaucuuuuccccaccuuuccccccuuucuauuccacaaaaccgccauucucaucauggccuguucucaaugagcuguuggguacaccucccagacggggugguggccgggcagaggggcuccucacuucccgguaggggcagcagggcagaggcgccccucaccuccccaacggggugacuggccgggcggggggcugacccccccaccucccucccggacggggcggcuggcuggcgggggggcugaaccccccaccucccucccggacggggcggcuggccgggcagaggggcuccucacuucccaguaggggcggccaggcagaggcgccccucaccucccugacgggguggcuggccgggcagggggcugacccccccaccucccucccggacuggguggcuggccaggcggggggcugacccccccaccucccucccggacggggcggcuggccuggcggggguugacccccaccucccucccggacgggguggcugccgggcggagacgcuccucacuucccagacgggguggcugcugggcggaggggcuccucacuucucagacggggcggcugggcagagacgcuccucaccucccagacggggucgcggccggguagaggcgcuccucacaucccagacggggcggcggggcagaggcgcuccccacaucucagacgaugggcggccgggcagagacgcuccucacuucguagaugggauggcggccgggaagaggcgcuccucacuuccuagaugggauggcggccgggcagagaugcuccucauuuuccagacugggcagccaggcagaggggcuccucacaucccagacgaugggcggccaggcagagacgcuccucacuucccagacgggguggcggccgggcagaggcugcaaucucggcacuuugggaggccaaggccaggcggcugggagguggagguuguagcgagccgagaucacgccacugcacuccagccugggcaccauugagcacugagugaaccagacuccgucugcaaucccggcaccucggcaggccgaggcuggcggaucacucgcgguuaggagcuggagaccggcccagccaacacagcgaaaccccgucuccaccaaaaaaauacgaaaaccagucaggcgugacagcgcgcgccugcaaucgcaggcacugggcaggcugaggcagggagguugcagugagccgagauggcagcaguacaguccagcuucggcucggcaucagagggagaccguggaaagagagggagagggagaccguggggagagggagugggagagggagucaaauauuuuaaccaaucugcuuaucuuaaauacuuuugauuuccugaacaugagcucauuuuuagcauuagucacacuuaauaaacauucauuauuuucaucaguaaaaacccauuucuggcuguacaugguggcucacaccuguaaucccagcacuuugggagaccgaggcgggcagaucacuugaggucaggaguuugagaccagucuugccgacauggugaaaccccaucuuuacuaaaaauacaaaaauuagccaggcauggugguaagcacuuguaaucccugccacuucggaggcugaggcaagagaauugcuugaacccugggggcugagguugcagugagcugagauugugccacugcacuccagccuaggcaacagagcaagacucuuucucaaaaaaaaaaaaaaaaaaauucugaccuugaguauguuaaugagcaaagcauuggucauugacugagauaugccuagcagaaacuguuggaguggagaaugaauuuccugauuaaaacaccagcucacuccucaugggcugugaauucuucaaugucauguuagcagacugcuccagaguggcagucuugauuagaauacuugugagacccagguuauagcuuaaccuaaguaacacaaacauaacacuguacucaaguguauuguaguuaauugaaaacuuuacauugcuuccuuagaaacuuguuuuaaggauuaaaaagaauuauauuuaggcugaguguuguggcucaugccuguaaucccagcacuuuggaaggcugaggcaggaggaucccuugagcccggaaauuaaagaccagcaugagcaacacagcaagaccccugucugcaaaaaaugaaaauaaaaaauuagcugggcaugguggcucacaccuguagucccaacuacuugggaggcugaggcaggaagaucacuugaauccaggaauuugagauuggagugcacuaugauugcaccacugcacuucagccugggugauagagcaagaucuugucucuaaaaauaaaaaagauaauuauauguauauguauguauguguggacacacacacacacacacacacacacacauagucaugugccauauaaugauguuugaguccgugaugguccacacauacaacagugguccuauaagauuauagugcuguauuuuuacuguaccuuuucuauguuuagauauauuuagaugcacaaauacuugccauugugauacaauugccugugguauucaauacaguaacaugcuguacagguuuguaccuuaggagcaauauacuauaccauccagccuagguguguaguuggccauacaaucuagguuuguguaaguauauucuauaguauucucaugacaaaaucauuucaacaaugcauuucugagaagauaacccaucauuaugcaauacacaacuauguauacauauaugcauauauauaauauuuaauacagggcuuguucauaguaaggccuuaguaauagcuauuauuuauaagcaauaucaaauuuauuguauuaaugaguauggcuuuuuuagcauuagucacacuuaauaaacauucacuauuuucaucaguaaaaacccauuucuggccggacaugguggcucacaccuguaaucccagcacuuugggagaccgagauggggucucacuguguugcccagacuggucuugaacucuugggcucaagugauccucccaccucagccucccaaagugcuggaauuacaggcaugagccaccauacccggccaaguauguuuuuuuaaaugucuuuuuuuucuucaguuuuuuuuuaauuuuagagaugagaucuugcucuguugcccaggcuggaauguaauggggcaaucauagcucacugcaaccuugauuuccuggguucaagcgauccugucaucucagccucccaaguagcuagggcuaaaggugcaugccaccacaccuaguuuuuaaauuucuuuaauuuuuaaaaaaauuuuuauagagacaggguuucaccacacccagccucccacaauuuuaaauguuugguucauucaaguaaaguauagcuccuuaccuuauguuaguauuaacagcuggaauuggaaugacacagaaauauagagacacuauagucucugucucaagaaauuucuaaucuaaggaggacauuaaauaauuuuagaccaggcguguucgcucaugucuguaaucccagcacuuugagaggccaaggugggaggaucacuugagcccaggaguuagagaccagccuagaaaacauagggagacccugucucuacaaaaaguaaaaaaaaauuagcucgguguggcagcgugcaccuguagucccagcuacucgggagacugaggcaagaggaucaagaaccuuucauaaaaacaaaacaaaaaaauaauuuuaauugauccauauaaugagaauaaccuagaagagcuguuaacaagccaguauccuuugaaacaguguuucccagaaugguaguauaaguguuuugggggguccaggcgcaguggcucacgccuguaaucccagcacuuugggaggccaaggcgggcagaucaccugaggucaggaguucgagaccagccuuuccagcuggcgaaacaccaucucuacugaaaauacaaaaauuagccagacgugguggcaugcuucuguaaucccagcuacccaggaggcugaggcaggagagucgcuggaucccagcgggcagagacugcagugagccgagauugcaccacugcacuccaggcugggugacagagcaagacuccgucucaaaaaaaaaaaaaguguuuugggggaagagagacuauacacaaaaaacuggggaaguauggaauuaaagugaacaugagaguuauuuuuuuuccccaacugcaguacuucucagagccuuauacuaacaugaauuucugaauuuccaauauaauauacagcauuuccucaacuuuauuuaaccacauagcuccccuccccucccacccucgucaagauccuuuagaaauagcagaagugaaaaagacauccaaauuaagacugacauccccuggggcuguuugguuuuugaaccauguuuguguuuucugguuuuccuaaggugaaggcauugcuucuacccauguucucaauguuuguaggccaguguauugagaaugagagcuuuuuucauauaugugcuaaauucuuuuuaauugguagugguuuucuuagcacaugguucuuguguauacaaguaaaugauaguuuguaauacccuguaauacucuuccuuccccaaaaaauaguaggacaaaguucugccugguuucacaagcuaucccagaguugcaccauuaaguaggaaacuauguugggguaagcuguuauuuuacaauugagggugcucaguaaaaccugaacacugguuccugaucaggguuccuguuguaugugguacaauaaggcucuuagaacaccugucaccugccauguauuugcagagaaauaaauguaauucauuuugcuucuuccuuaaccucucaggauaugcuuuaccuuuuagaaucuuuccaccuuucucaaagacacaagaagaauaucugcaggccuuuuaguugucugaagcugagguuugccacugccucccauacuguagaacuuagcuaaacaccagcccagggcuguuaccccucuaagagccacuagugacagugagcucaacagcuaugguugugaaaacauucugaaguggaaucuagagaaaagagcaccaccuucaguucauauguuugcauuucucuagauuccaauuugacuuauaaguaauacagauggauugcugaaccuucucugaaaauauuaauuucucuacauaaagauuuguggguuuuuuuuaauauuguagaaaggucauuuaaaucaccaacuuguauauuaaaguaugcuuuguggcugggcaugguggcucaugccuguaaucccagcacuuugagaggcugaggcugguggaucacuugagcccaggaguuggaaaccauccugggcaacauggcaaaaccccgucucuacuaaaaauaaaaaauagccaggcaugguggcacgugccuguggucccagcuacucaggaggcugagaugggaggaucacuugaauccaggaggucagggcugcagugagccaagauugcaccacugcacuccacccugggugacaaagugagacccugucucaaaaaaauaaaaaguaugcuuuguaucacaacauugcauucuuuuuaacagacuuagaagaugcuacaaaaacaccugacuguuccaguggaccagugaaagaggaaagaggugaucuuauaaaauuuuacaauacaauauauguaggaagagugaagucauuugcacugaaauacgacuuggcgaaucaggaccauaugguauguucuauguuuuacuacuuuauuauuauuugcugucauaguuggauuacuauaaguuuauuuugcuagauaaauauguccaaguaaaauuacuagcaauuaaucagagcauguccaguaacuuaaucagugauuaaggcuaugguacaacagagaccagaggaaaucaugggaucuguugcccaggcuagagugcaguggcgagaucugggcucacugcaacccuugcuuccaggccucaagcgauccucccaccccagccucccaaauagcugguacgacagccacaugcccccacgccuagcuaauuuuuuuguauuuuuaguagauacgggguuucaccauguuggccaggcuggucuugaacuccuggacucaagcaaucuacccaccucagccuccuaaagugaugggaucacaggugugaaccaccacgccuggcaugaauuuuaucuauaccaugauuauguugcuagaaauuccguauacauauggguaagaacuugaugggaacaugaauauuaaaacaacuaauuuguuuuuuuuguuuucuuuuuuuuuuuuuuuuugagacagucucacccugucacccaggcuggcgugcaguggugcgaucucagcucaacugcaaccucugccucccgggcucaagugauucuccugccucagccucccuaguagcuaggauuacaggagugugucaccacaccuggcuaauuuuuuguaucuuuaguagagacaggguuucaccauguuggccaggcuggucuugaacuccugaccuugugauccgcccaccucggccucccagagugcugggauuacaggcaugagccacugcacccagcaaauuugguaaauuuuucuguuguuauauugugagauuaauguuuuucucaagucaaagacaaaaggggccaggugugguggcucaugccuguaaucucagcacuuugggaggccuaggcgggcggaucaccagaggucaggaguuugagaccagccuggccaacauggugaaaucccaucucuaccaaaaauuagcugggcgugguggcaggcaccuguaaucccagcuacucgggaggcugaggcaggagaaucacuugaacccagaaagcggagguugcagugagcagagaucgcgccacugcacuccagccugggugacaagagggaaacucugucucaaaaaaaaaacaaaaggaggucaggugcuguggcucaugccuguaaucccagcacuuugggaagcuaagccuggaggauugcuugagcccagaaauuugagaccagccuagaaacacaggaagacccugucucuuaaaaaaaaaaacuaaaaacuagccguguaguggcugguacacaccuuuagucccaacuacucagcaagcuaagguagguggaucgcuugggcccaggaggucaaggcugcaaugagccacaaucgcaccaccacacuccagucugggcaacagagcaagacccugccucaaaaaaaaaaaaaaaaaaagaaagaaaaaaaaaaaagaaaagaaggcccuagcagaagcugcagccggacagccaauagcuguuucuauguaucuaugugccucuguagauuucuguucuuccucuuuucauggaauauggucuaugacuauccucagaggucauaacuguucauccugcuucaguuucacuuccccucugucaugugcuauacucggaauaucucuaccaucuuaauuuauuuccauuauacaggauauuaaaaaugaaauccuugcucauccaacuuauuuauaaaucuuuuccauuuccauaugaagucuuucccauuucauuaacagauuuuuuccacguuggaaucauccugcuggcuaauagaauucucugccucuuuuauucucucugcuacugcuuugguugugagcagguauguguguagagagagcuuguuacagcaaguguuagaagauugguuacucuuugucccuacuuuuuuuuuuuuuuuuugagaaggagucucgcucuguugcccaggcuggagugcaaguggcacaaucucagcucacugcaaccucugccuccuggguucaggcaauucuguaacucagccuccugaguagcuggcauuacaggcgccugucaccacgcccagcugauuuucguauuuuuaguagagacagaguuucaccaucuuggccaggcuggucuugaacuccugaccucaugauccacccgccucagccucccaaaguguugggauuacaggcaugagccaccgcgcccagccuguccuuacuuuuuaagcaugaauaugagguucucaugcucguggcuuaacuccuggugucuuguccagaauuuuuuuuuucuuuugagacagagucucacucugucaccccaggaggagugcagugacauaaucgcagcucacugcagccucuguccccggguucaaacaacugucaugcucagccucccgaguggcagggacuauaggcgcacgccaccacaccuggcuaauuuuuauauuuuuaggagcuacucaggaggcugaagugggguuucaccauguuggccaggcuggucuccaauuccuggccucaagugauccgagcaccuuggccucccaaagugcugggauuauaggagugagccacugcacccggccccagaauucuuuuuuuuuuuuuuuuuuuuuugaggcagagucuuggucugucacccaggauggagugcaguggcacaaucugggcucacugcaacaccucugccuccuggguucaagcaauucuagugccucagccucccaaauagcucggauuacaggcauaugccaccacgcccagcuaauuuuugcauuuuuaguggagacggaguuucaccauguuggccaggcuggucucaaacuccugaccucaggugauccgcccaucucagccucccaaagugcuggcauuacaggugugagccacugugccuggccagaauucuuaauacuaguuauaggacuuccugaaagauccaggaaaauaggccgggcauaguggcucacaccuguaaucccagcacuuugggaggccaagguggguggaucaccugaggucaggaguucgagaccagccuggccaacauggucaucucuauuaaaaauacaaaauuaaccgggcgugguggcacaugccuguaaucccagcacaugccuguaaucccagcuacuugggaggcugagggaggagaauugcuugaaccugggaggcagagguugcagugagccuagauugcgccaucgcacuccagccugggcaacaagagcaagagauacuccaucucaaaaaaaaaaaaagauucaggaaaauaaauucuaguuuaucuauuguuguuaaaaaaaaaaaagaagaaguaaaggaucauuuuuuuucucaaccauaaaugagcuuuuuacaguauaacuguuuucuaacuagaagauaccauaagaauaaaaauaugggauucaaaaacaaagaaaaacuuuuaucuaaaaaaucugacuuuuggguuauuuuagauggaugcuccaccacucucuccuuuuccacauauuaaacaacagccaggcucaccacgccgcauuucccagcagcacuccauuuauauuuccccgcacaagaaugggucaggccuuacaccaagaagcgcucugcuguacaaguucaauggcagcccuucuaagguaaggugaauaggcuaaaaguuggauuucagauuaacagucaguaacuguuaauccugccucuuuuuuuuuuuuucuuuuuuggccaaguuacuacuauacuaauaaaauaugaaauguuaacuauggcaugucuccucucaucaagagcaguauauucaguuugagguaguuuaauccauuauuauugacaugguauuuguggaguucacuuugaaaguccagcauguuuuccuguucaagcaagaucuugagaagggaccaguaaggcaacaccugcaaguggucagaccugggggaugucaaguugaaagaaaggcauuggaagugaaagugcauuugguagauggcacccaggauaggaagaugucugaaaacacaagccuccucuuacguacauagacaacucugugaucaucuccauccuuauccuuguucaguggugaagaugugguauggacaugauugcuguuuucagagacuucauggacuaucaagcagauauguucaguaugucuccagaagucagaaucaguauaaacuggaagaaauuguaguggggcagauuguaacucuguccaaauacaguggcuccuucuuauuacuuuccuauucaguuauacagauaacuacagaguuccuacuauacuugacaaaguuggcuaagauaauauaccugacuggacacagugacucaagccuguaauccuagcacuuugggaggccaaggcgggcagauugccugagcucaggaguucaagaccagccugggcaacauggugaaaccccgucuuuacuaaaaauacaaaaaauuagccaggcaugguggugcgcaccuauaaucucagcuacucugcuguggaggcugaggcaggagaaucacuugaacccggcaggcggagguugcagugagccgagaucaccccuuugcacuccagccugggcgacagaacgagacucugucucaaaaaaaaaaaauguugaaaaucauuacucuaaggaagaagaucucaaacuguagggagcuuuaaaaucauugggagggcuuguuaaaacagauuagggccgggcacgguggcucaugccuguaaucccagcacuuugggaggccgaggcaggcagaucacgagaucaggaguucaagaccagccuggccaacauggugaaaccccgucucuaaaaauacaaaaauuagccgggcaugguggugggcaccuguaaucccagcuacuugggaggcugaggcaggagaaucgcuugaacccaggaggcagagguugcagugagccgagaucgugccauugcacuccagccugggcgacaagagcaagacuuagucucaaaaaaaaaaaaaaaaaaaaaaaacagauaaggcuaggcacgguggcucacaccuguaauucuagcauuuugggagcccaaggugggggaacacuugaggccaggaguucaagaccagccuggccaacauggcaaaacccugucucuacuaaaaagacaaaaaaauagccaggcaugguggcaugugccuguagucccagcuagggaggcugaggcaggagaauagcuugagcccaggaggcagagcuugcagugagccaagaucaugcccugcacuccagccugggcaacagagagagacugucucaaaaaauaaaaaauucuagaugcuucugcugcuucuggucuggguacuacacaucgagagcuacuguuauacaguaaauucaguuguuuugguuuggauugguuugguuuguuuuuuuuuuuuuuuuuuuuuuuuauuguucugcaaccugcuauuuuaauucaacucuaccucauggacaucuuuucacagauuuagacucuuaguucacaggguaggaaagcacaaaggccauaggacucuugcauaaugggaagcuuauuuuucuuuuuuuuuuuuuuuccauuuuuuuucuuuuuuauugaucauucuuggguguuucucgcagagggggauuuggcagggucacaggacaauaguggagggaaggucagcagauaagugaacaaaggucucugguuuuccuaggcagaggacccugcagccuuccgcaguguuugugucccuggguacuugagauuagggaguggugaugacucuuaacgagcaugcugccuucaagcaucuguuuaacaaagcacaucuugcaccacccuuaauccauucaacccugaguggacauagcacauguuucagagagcacaggguuggggguaaggucacagaucaacaggaucccaaggcagaagaauuuuucuuaguacagaacaaaaugaaaagucucccaugucuaccucuuucuacacagacauggcaaccauccgauuucucaaucuuuuccccaccuuuccccccuuucuauuccacaaaaccgccauugucaucauggccgguucucaaugagcuguugaguacaccucccagacggggugguggccgggcagaggggcuccucacuucccaguaggggcggccgggcaggggcggccgggcagaggcgccccucaccucccggacggggcggcuggccgggcggggggcugacccccccgccucccuccgggacagggcgacuggccaggcggggggcugaccuccccgccucccucccggauggggcggcuggccggguggggggcugaccccccccaccucccucccggauggggcggcuggccaggcagaggggcuccucucuucccaguaggggcggccgggcagaggcgccccucaccucccggauggggcggcuggccgggcggggggcugacccccccaccucccuccuggacggggcggcuggccgggcagaggggcuccucacgucccaguaggggcggccaggcagaggcgccccucaccucccggacggggcggcuggccgggcggggggcugacccccccgccucccuccuggacggggcggcuggccgggcggggggcugaccuccccgccucccucccggacggggcggcuggccgggcagaggggcuccucucuucccaguaggggcggccgggcagaggcgccccucaccucccggauguggcggcuggccgggcccggggcugacccccccacauccuuccuggacggggcggcuggccgggcagaggggcuccucacuucccaguaggggcggccgggcagaggcgccccucaccucccggacggggcggcuggccgggcgggggggcugaccccccccaccucccucccggacgggcagcuggcugggcagagggaugacccccccaccucccuccuggauggggcggcuggccgggcggggggcuaacccccccaccucccuucuggacggggcggcuggccggguggggggcugacccccaccucccucccagacgggguggcugccaggcgaagacgcuccucacuucccagacggaguggcugccgggcggaggggcuccucacuucucagaggguguggcugcugggcggaggggcuccucacuucucagacggggcgguugccaggcagagggucuccucacuucucagacggggcggccgggcagagacgcuccucacaucccagacggggcagcagggcagaggcgcuccccacauugcagaagaugggcggccuggcagagacgcuccucacuuccuagaugggauggcggccgggcagagacacuccucacuuuccagacugggcagccaggcagagaggcuccucacaucccagacgaugggcggccaggcagagacgcuccucacuucccagacgggguggcggccgggcagagucugcaaucucggcacuuugcggggccaaggcaggcagcugggaaguggagguuguagcgagccgagaucacgccacugcacuccagccugggcaccauugagcacugaguaaacgcgacuccgucugccaucccggcaccucgggaggccgaggcuggcggaucacucgcgguuaggagcuggagaccggcccggccaacacagcgaaaccccaucuccaccaaaaaaauacgaaaaccagucaggcguggcggcgcgugccugcaaucgcaggcacucggcaggcugaggcaggagaaucaggcagggagguugcagugagccgagauggcagcaguacaguccagcuuuggcucggcaucagggggagaccguggaaagagagggagagggagaccguggggagagggagagggagaggagggagagggagaggagggagggagaggagggagagggagaggagggagacgggaagcuuauuuuucuauucuugguuugguuuuugagacaaggucucacucuguuucccaggcaugaucacugcucacugcagcuucaaccuccccaggcucaggugaugcuccuuaaccucccgaguagcugagacuacaggcacaagccaccacaccuggcuaauuuuuguauuuuuuguagagaccagguuugccauguugcccaggcuggucugaaacuccugggcucaagugauugaaccaucuuggccucccaaagugcugguauuacaggccaccacaccuggccuuaaaucuaauuuuuaaaccaccugaaaagauuaguucaagccaucccuuauuagguuguucuaaguuuuaaaaagaguccuuaucccaguguuaagauuuggauagaggauagagcacaggaaaaaacaauuagcuugguuguuugcugccauuuccccucucccucuuuuacucacacacguucucuauuucugcacagaguuugaaagauaucaacaacaugauaaggcaaggugagcagagaaccaagaagcgaguaauagccaucgauagugaugcagaauccccugccaaacgcgucugucaagaaaaugaugacguuuuacugaaacgacuacaggauguugucagugaaagagcaaaucauuaauguuguucuuguuucuaugauaaaagcacuuucagauuguucugcagaaaguuggagcucuguccuucaaaccuuuuagcccuauagaugauaaauaucacuggguuauaagaaaaaauugcacaaaaauuaugugcuuuuuaaaauauuuauccaaaauguaguugacagagauguauuuugaguuggauuggaaaggaauauuuuaagugccuuuuaaaaauacuaauaguccggccaggcgcuguggcucacgccuguaaucccaggacuuugggaggccaaggcgggcagaucaccggaggucaggaguucgagaccagccugaccaacauggagaaaccccaucucuacuaaaaauacaaaauuagccgggugugguggcgcaugccuguaaucccagcuacuugggaggcugaggcagaauugcuugaacccaggaagcggagguuguggugagccaagguugcgccacugcacuccagccugggcaacaagaguaaaacuccaucucaaaaaauauauauauauauauaaauagggaauuuuuuuuaauguuugcuccuugaguuuucaagaugaaauaaggagaaaccccauaacuuuuuagcucucuuuuaaaaauaaaugucuccuucuguguucuguaauaugaggauaaauaaucuacuuuugauagcaugcuuugagauauuuguauucuuaauuuaauauugaaggaagggguugguucccauaguaccuggccagaggguuauauaccauccugucucuggcccacugugguaauuccacauccagguaccaccgccauucagaguugucucaccccuucucgugccuuuucucuccuugagcuuuauaaacagauuuguaccugagccccagugcuacacucauccuugcuuuccagcccuaagccaucucagccugaugucacaacccaauaaauggggcacuuucuucuuuuguaaacuauuauca

SEQ ID NO: 191265 - RNA, 27613 nt, Homo sapiens
gggaacuacuuccgggggagcggcgcggcggcgcgggaggugagugccgcagcuuugcgguggggugggaaccgagagagagccguccucggugcgguggccuggcuuucccggccggccugucuccagcggcgccgcuuggugggcccggcugucgcuccgcucagggccugaauacguucccucggcgguuguucgaaaguuacuuccggaggggaauuugagccccccgggaggcggagggccucgccuggggcagcccugcgcuuucgugcggaggcugggccagaacccagggcuccucauggccugguccgggccuuuccucccacggguggagcaguaggagaacccugagcuccagagugaaucuggccaggguucgaauccguauggcucucuuaccgugggcaagucacgguuccucucuggcccucaguuucgucuucuaaaauggacauacacgcuuguacugcgggguaaaccgagguggugaauguaaagcccuuaguaggugcacaguccauguuuguuguacgaauucuaagagaagcgagaaaugaauaugagaaacauuuuuaaaauggugacaacacauuuagauuaauaauuauauuuugcagggcaucugcacaccaguuucagcccaccggcuaccagugugacuuugcccagagagguggcuuagcuuugcauucuaaucuaguuuugcgugguucuuaggaauuuguuuuaaugggacgggccaggcuguacaacccauugccauaaagcgguaacuucuuuuucuuuccuuuuuuuuuuuuuaaagccauucuauuuauuuauuuagagacggagucucucucucguccacgcugaagggcaguggcgggaucuuggcucacugcaaccuccgcuucuuggguucaagcgauucuccugccucagcuuuccgaauagcugggauuacagacgugugccaccacgcccggcuaauuuuuguaucuuuaguaaagacaggguuucaccauguuggccaggcuggucucaaacucccgaccucaggugauccacccgccucggccucccagaguguugggauuauaggcgggagccaccacacccggcuuuuuuuucuuuuuaauuaaaaaaaaguugaaauagagauggagucucacuauguuuuccugccuggucuugaacuccuggaggcaagauauccuuccuccuggaccucccaaaguguuugggauuacuggcaagagccacugugccuggccuaaaacaguaacuucugacacugguuucuauuccccagucuguuuucagcugaauuuucacaauagaauuuaaaguuacuucauuagaagccaagaauggccuaccagcacaguacacaacauugggagaugaaggccuguggcagucgugaaaucugaguuuuucagucuuaagagaagauuuaguauuugcuaagucuugagagcuauacuugucucagugguuuuuuauuuauuuguuuugaaauguugacccauucuuuuuuuccccaauaaccuuuuuguuuuagaauaauuuuagauuuacaaaguuaucgcaaagauacuucagugagugcccauauagcccacguuuccccuauuacuaauaucugaaaugucacaauuacugaaccaauauugauacauuauuauuaacucuaaucuguacuuuauucacauuuccuuaguuuuucccuaauguccuuuuucuguccugguauuauccagggcacccuauuacauuuagucaucauaucucuuuaggcucaucaucucugugaucguuucucagacuucccuuguuuuagaugaacuugaggguuuugaagauaguacugacuggucagauauuuugcagaaggaccuuuaauuaggauuugccuguuuuugacaugaguaagaucaggguaauggguuuuuggggaggaggaccacugauaggguucggcuguguccccacccaaaucucaucuugaauuguagcucccauaauccccccauguugugggaggguccuggugggagacaauugaaucaugggggugggucuuucccaugcuauucuccugauagugaauaagucucaggagaucugaugguuuuauaaagggcaguuccccugcacacacucucuugccugcugucacauaagacaugcccuugccuccccuuugccuuuugccgugauugugaggccuacccacccauguggaaccgugaguccguuaaaccucuuuuucuuuauuaauuacccagucucggguauuucuucaaagugguaugaaaauggacuaauccaaccacagaaguaaagugcuauucucaucacaucauaucaaggguacauacuaucgauaugaguuaucauuguugacaucuguuagcuugagccaccuggcuugagguaguagucaggcuuuuccaguguagaguuacuuuuccuccugcacuuuccgcacuguacuuuuggagaaagucauuauguacagcacacauuuaaggaguguggaauuaugccccaugcuuaaaggcagaguauauaaugcaaauuauuuggaguucucugugggaaauuugucuguuccccuauuuuuugcuuacagagucauauauuuguaucggugugaacucauggauuuguuuuguuuugagacagggucucccgcugucgcccaggcuggagugcaguggugcagucuuggcucacugcaaccuccaccucccggguuuaagugauucuccugccucagccuccugaguagcugggauuacaggcaccuaccaccauggcuggcuaauuuuuguauuuuuaguagagagaguuucaccauguuggccaggcuggucuugaacucuugaccucaggugauccaccugccuuggccuccugauuacaggaauccccucuccugggauuacaggcgugagccaccaugccgggccugaacucauggauguuuauuuuauacuuuggaccagaauccaguacuacuuuauuuuguugcugaaauuguuccuccauuggccauugggagcucuuccacuuggcuccuguaucccuuugacauaucccccucuauauguuuugcuuuguuuuguuuuguugagcacuuucuuucuauuccagacucaucugguauguuucugccccaguccuagaauuagccauuucccaaggagcccuggcuccuuuuauuggagaauggcccagaaaacaagaucugggcucuagguaugcucagugcuucucaguguccuugcuucuaggccuucgcaguggacagaguaagagacauacguauauaugcacagaucuagaaguauuuccauauauaaccaccuguaucuacguucagcuaaacauaacugauguccaacucuuauccaugacugcauggauuguucuagcuuggcaguccccaaccuuuuuggcaccagggaccgguuucauggaagacaauuuuuccacagaccuggggguggggaugguuuugggaugauucaagugcauuacauuuauugugcacuuuauuucuguuacuauuacauuguaauauauaauggaaugaucauacaacucaccauaauguagaaucagugggagcccugagcuuguuuuccuacaacuagacagucccgucugggggugaugggagacagugacagaucaucaggcauuagauucucauaaggagcacacagccuagaucccucacaugcacaguucacaauaggguucguguuucuaugagaaucuaaugcagccgcugaucugauaggagguggaacucagacgguaaugugagugauggggagcggcuguaaauauaaaagaaacuucgcuugcucaccugcugcucaccuccugcugugcggccugguuccuaacaggccauggacugguacuggucuguggccuggggguuggggaccuguguucuagcuuccuucucuugcuugucuguaaccucccacuccaccugugacaaacccgacucccaccauucaccauacauuuacuuaauuguuccauuuagcauacauguauggugguuuuagaauugcucccccgauccccugugggaaacaacuuaucagcuagaguacaguguguacgugcaguuccuuuugccuucagucuuacaggcuccacucguuuucaaaguuacuuaggucagcacccuauucccccacuacccuuucagugaaguuguuuaauacauuuggauucagaaugucacauucugcauuccauccuggaacacccugacuucaugcguguguauguugguguguuuuaaaaacugggucucacuauguugcccaagcuggucgcaaacugccgggcucaagcaauccuccugccuuggccucucacaguucugggauuaugggugugagccacugugauggccuuccuaugucuuuuuaaaaauauuugcauacauuaaacuuuacucuuugugcugucaagauuuuuggguuuugacaaaugcuuaauauuuuguauuccuaauuauagugucauacaggauaguuuccccuucuucagggauuauuuuuaacuucuuucagauuucaccucagcauuccuguuggccuucaccaaaauauaucuguaagcugagaauuuaccaccuccacagcuaccacccuggugcaaaugugucuuuugacuguuaaaguagccucuucacuggucuccuugcuuucagucuuguccccuacagucuguugucaacaaagcagccagagggaucauuuugaaaugagugagaccaugugauuucuuugcuaagaaccuuccaguaguucccuuuucacucagagacuggccagaguccucauaauggccugcagcuugcuuacuugacuguucuugaucaugaugcuuauuccugccucagggacuuggcccuugccgucccuccauccugggauacucuggcagauguuuaaaugacuucuuccuuugcuuucuucuuuccucuguugaaaugucaccuuugcagagaggcccuuccccgaccaccucauauuaaauaguacuauccucuucuuccuuccuguauguauuguaauacucaccccugacauugcauguguauguguguaugugaguacuucuaacugaauggaaacuccguggcagggauuagaccagugccuggcacauaguagauucacaauaaauauuuguccaaugaauuaaugucuuacgucaccagugucuggcauucaggggugaacuucgcaguguccaguaaccucaugaaauuauuugccacguucaguaauaauuaauuaugcaccuuuuguuaaauucugaugggguaugaaaguccccugguguauaaaaaccucuaccuguaagcaagucuggagcaggacagggcuagagaccaggauagcagcucugcccugacucaucaggagagucuagggaaaccucguggccucucagcuccuccuugucguuaaaugaugacucuguugguugaggcaucugcucuugcuuucgaggugggaaacagaggcauaggcuuagucauuuaccaaauauuuaugagucaggaccuggaauaaacucaagauguacccaagauccuugcuguucaagagauuacaauggaucaaauagaaaacaguagauuccaguguaauauuucucaaacaauaagaaauaacauucuaaaauuugauccagcacaugcaugcucagauguagauggauguugaaaaagcuucaggauauaauaccggcccuuaaugugauacucuuugauauuuucuauuguuauuuaccuacuuaaauaaagugcuggcuaauaaaaaaugcugguugcagcccccuaaaugguuuuccuggcucacuaaugggccacagccugcaguuugaaaacgauugacauacuggguaagcgcccugacucuggggaagccagccccuuugaaucuugccuuugccacuuaucagccagguuaucccuggguaggucauauaaccucuccaagccuugguuuccucauccucauuaguaauaccaccucccagugugguggugaaguaugcgaguugcugccuguaaagugcuguucgcaacaccuggccguucauuugccgacugcugcugcugcuggaacaauggccagggaacaaaaccugucacagccagucgaaggggugucuccuaguugagaucugcaggaugaauaggacuuguuugacuuuggucaucaggaaaggaaagcccagaaauacuggcaggagggcugggaaguaaagcacagaggugcagagagaacuagaugagagccguacggcgcacaguguguguagagcaguuuauguuuccagaaccuuuucacaaccacccuccuguuacaccugugcuguccaguagggaaccuuuggccacauguggcuuuuuauuguuaauuaguuaaauaaaaugaaaaauucaguuucucuguaacauuuaaguuuucaacagccacauguggcugguggcuaccauuuggagaacacaaauacagaacauuuccaucacugcagaaagcuuuauuggacaguaugacauuauacccuaacaaaagucuugugaaggaaguagguagggcauagauuuuucuuagauacuuuauuguuucauaacauuccaaaaaauuaaaacucaugacuuauucaccuuaacagcaacuauuuauguuucuguagcaucuuuugaucuuuagcccaugaaaucagcuuauagaugguuccaaucauaguguuuauacaauugcuuauuuuuuucaauuacuguuacuuugcaaagacuuuccacugaccugauacacaauguuuauauuugccggguuagugaagagggauuaugccaugauguaccaucacuggguuaacugcuuccugauuguuggacgccuggguugcuuccuguuuuucaguauuaugaauagugcugccaugaacuuuuuuguaccugaaggcuuuuucuucuuuugaauuguuuccuuacuauaaauucuaggaaguaaguuauucagucaaaggauauaaucacuuuuauggcucuuguuauauuuugucuaauugccauuuuuuaaaaaaaggccuaaauguauuauagguaucauuguugcuuggcucaugagaacaucccgucuccagaggucaagagauuauuagcccaaaguguagcuacuugcagauagagcaggggcuuuuguccucugcuucccaacucuugcccuaucuuucuauuguaccacuccaaauauuucuuaucacaauguugcuguuaguaguaacacuaguaaaucugaguauuuauaagcucauaaagcuuguuacagccuuaagcaaaaagcuuggggccaagggcguuuuaaaaaaugcacacuuuaugaggugcaacugcggagaaaugaggacgcguucuuaagcuuugguauucacauggugguggugcugguagaggcuguuacauuucuuccagugaagcuguucuugcagccgccuuggaauucacuucagggccaguuuaugagccaccccaaguaaucugcuuggagucugagcaucauaccuuguauuugaccaaaaaugguauuccugagcucagugccaccugauucacugcacuuggaaccagaugauguugggcucuuuccagaagucaaauccuuccugggaggaugaagaucugccagcucugaggauucuggcugggaagaaaaagagccucaagcuuugaaggccauucccaugguagacagagcugaugugaaaaguggccauccuguugccccaggcacaugaccuucugaagugaccaggcugaaagggaagcaauacucguguguaaguccggcucuguuuacuuacgaagguuguuuuuauuauucuucgguuacuucauguuggaaacauggugcaaagcagugaagcagcagagccaagguggcggcaggccuuuuuuuuuuuuugagauggaguuucacucuuguugcccaggcuggagugcaguggcgugaucucggcccacugcaaccuccgucucccgaguucaagcgauucucuugccucagccucccaaguagcugggauuacaggcaccugccaccauguccggcuaauuuuuuuguauuuuuauuagagacgggguuucuccauguuggucaggcuggucucaaacuccugaccucaggugaucugcccaccucagccucccaaagugcugggauuacaggcgugagccacugcgcccugugaggcaggucuuuaggauugucucuaccccagggcuuccccacagaaauauaauacagacuauguauaauuuuacauuuuccaguagccacauuuaaaaagcaaaaagggaugaugccuguaaucucaacacuuugggaggcugaggcaggaggaucacuugagcauaagaguuugaggcuacagugaguuauguuugugccauuguacuccagccugggugacagagugagacccugucucuaaauaaauaaauaaauaaauggguaaaaagaaacagauuuuuaaaaaauugugacaaaauauauguaacaaauuuaccauuuuaaccauuguuaaguuuacaauucagugguauuugcaguguuguauaaccgucaucacugucuauuucuagaacuuuuucaucuuugcaaacugaaacucuguacccaguaaacaauaucuccccauuucccuucccuccagcccuugguaaccucaauucuacuuucugucucugaauuugccuauuccagguaccucauauaaggggacucauacaauauuuguccuuuugugucuagcuuauuucauauauauuuauucaaagcucauaauguuuucaagguucauucauguuguagcauguaucagaauuucauuuccuuuauggcugaguaauacuccauuguauguauauacuacguuuugcuuauccauucaucuguuuauggacucuuaguuguuuccaucuuuuggcuauugugaauaaugcugcuaugaacauuaguaucuugaguccuugcuuucaauucaauuuuuuuuuuuuuuuaaacaggaucucucaccccgucacucaggguggcgcaaucacgacucauuggcucacugcagccuagaccucccagcuggagcaauucuccugccucagccuucugaguagcugggacuacagguguguaccaccauguccggcuaauuuuuaaauuuuuuauagcaacagggucccacucuguugcccaggcugguuucaaacuccuggguucaagugaugcuucugccuuggccugucaaaguguugggcuuacacuuugggcguaacccaccaugcccagccaauuauuuuuuacguguauuuuuugguggcaggguggggugggggcagggucgggugggggcagggucucgcucugucacccaggcuggagugcaguggcgugaucguggcucacugccuuaagcuccugggcucaagugauccucccaccucagccucucgaguagcugggaauacaggagugagccaccacuccugccuaauuuauuauuuuuuuuguagagauggggucucgcuguguuguccaggcuggucucaaacuccugagcucaagugaucugcccaccguggccucccaaagugcugagauuauaggcgugagccacugcaaucguuucagcauguaaucaauaugaaaacauuaugaaugagauagauuacauucuuauuuucauacuaggucuuugaaaauggguguguaauuagcaucucaauucaaacuagcugcguuucaagucuuaauagucauguguggcucauggccaccauauuggauagcucagacuuagcaaaauauugcauuguggcacagaucucuggaaacacaaaggguuuuagauucaagugggccugguuccaaaguaaauuugccccuuuaucauugggaugggcagaagaaagccacugaugggugcugugguaaagggggagcaguucagucaugccaggggaagaggagggugacaggagaggcauguuggggagaugacacuugagcucagccuuagaggcagagugggggcuuugucaagcagucacagugggaaaggacauucuuugcagaguaugcagcuugggcagaggcccaggauuuugaaagagcccagugcucuuggagaaccacagcaguucuuucagcuugacuaggauauuaggagugggggcccugcugagaggagaggcuggagagcugggcugaggcuggaccuugcaccacuggccaccacugccccugucauucacgccaucagcagcucuugucuggcuuauuggcaggggccuccuccuggcucucccuguguccacuuugccucuccccuuguugucccuccuccauuuaaaaauggaagucagaucaugucacuuuucugcucaaaacccuucaguggcuuuacauuuuacucaaucaaauuggagguaucaggguccgcccccacuccucucugaucauaccuccuuccacccucccuccugaucacuucucugccuguacuggccucauuuccccacccuggggccuccacacuugcuuuuuucccugccuggaacguguuucccucagauacacaaauggcucccucucucacuucuuaucucuuccacuccauucccgucucuguucuucagagagagccuucucaucacaaaauaaaaugaugcccuuaaguuuuuuccaaaaugcuuaucacuaccuggcauaucacaucucgacguguucauugucugcuuccauccugagcauguagaggcuccaagaaagcagggguuugucuguuuugcucauucuucagugcuugguauucaagaaauauuuguugaauggaugacuacaugaauaaauaaacaacaaaaccugaaacguagcagccuuuaguaaauguauguugauuugagauuuuuguugaagugcuucccuuugcauuuauuuauuuuucucaacuuuauguuuggaaaacaucagauacacagaaaaguugaaagaaugguucauugacugaccauauguucccaacuuagauucaagaguuguuaacauuucacaauuccuguauauauucuuggguguguguguguguguucaaguuaaaagucaguuacaggcugggugagguggcucacaccugcaaucccagcacuuugggaggcugaggcgggcagaucaccugaggucaggaguucaagaccagcguggccaacguggugaaacccugucucuacuaaaaauacaaaaaucauccagguguguuggcccacaccuguaaucccagcuacucgggaggccaaggcaagagaaucacuugaacccaggaggccgaaguugcagugaucaugccauugcacuccagccugggcgacagagugagacuccaucucauaaauaaauaaauaaauaaauaaauaaaugucaguuacagaaauaugacacugacccuuugcauuuacaaguugguucuaaagaguggugagucagaagagacgucaggcagcaagcgacuugggccauggccucugaccuagacuucucaccuccggaggugcccgagcccacuuuccuggagaaccugcuacgguacggacucuuccugggagccaucuuccagcucaucugugugcuggccaucaucguacccauucccaagucccacgaggcggugaguuuuucccugggagccucagcuccucugagugccaggcuggguucugaguacuaacaguaggugccaccacaacugagaucagcagggucuacauugggccuuuuugauuuagugugccucugaauuuccaccugguggguugaaccacauagcuaauacuuuauuuguucauguacccauuaaggagauuuuuauuuagugccuacuacauuucagacucugcugaagauguagugucugcaccugaggagcaucuaguccuugggaggaaggcagauaacaaaaacauaccuccaugugcucccaugagaaguacagaguccagugaggcuauauaacaagggggagagagaccugaucuuacccugggcugugggcccugccgaggaggcaguguuugagcugagacugaaggaaugagcaggcuucugccaggugaaagugggcaaggggcgaggacaacauuccagggagagggcacugcacgugcaagggacucaauaaaggaaggggcuaauucaaggaacugaaugaaggugacuguggccagagcacagagggggcaugaugaguggugcagccagaggugugggcaggggccagaggguuuuaagugugagaaugacauggucaaauuggcuuuuuuguuguuguuuugacucuucuucuguaaguaucuuuauaacuauacacccuccuucuacccacuuucuugcccacucccauuugcucgugacauugauuuauuggagaaagcaggucguuugucaugugggauaccuacaucccaggaauuggcuauugcuucucuguggugucauuuaacguguuucucuguucccuguguuuccugucaacaggaguuccauguagaggccugauuccauuccagucagguuauuggguacgaauaccucagagcuggugcuauguacucccuacuguguggcaucaacaagcagguggugucuggcugcugcacauuuagagauucuuggauugaucgguggguuuaggugguaucagcugaucccuccauuauaaaaauccggucagucuuucaccuaagcgguuuuagcauccauugauggucguugcuuagauccauuauuuccuucugcaucuguuagcuggaauucuuuaacaaagaccuuuuccuuaucacuuguaugauuacucugaauugcucuucauaaugaaaagcaggaaaaaugcuugguucuuucccuuuauuuaucaauuuucaaaguugugaguucagacucuagcaacuuccaaugaugaccaaugaagcuuugguuuucauagcauucugaacauauuuuuaauauauuuaauauguuuuaguuuuuuuuuuuugagggcacuuaucugccauuaauuuguuuuuuauguucagugggagccccuuuaaguugaugucuuuguucuuugucauacuucauuagucuuugauagcuuccuugcuucaugguucaauaagaugucacaggcucuuuuuugugugugugcgagacagggucuugucuguugcccaggcuggagugcaguggcacaaucacagcucacugcaaucucugucucccaaguucaagcaauucuccugcuucagccucccaaguagcugggacuacaggugugccaccauggcuggcuaauuuuuguauuuuuaguagagacacgguuuugccauguugcccaggcuggucacaaacucuugggcucaagccauccacuugccuugagcucccaaagugcuggaauuauaggcaugagccacugcgccuggccccaggcucauuuuguacauuuccugccccagucuuggaaucagucauuucucuaaaaugcucugguucuuuuuagcuagaaaauaguaucuagaggcuacaguugggacauuagaaguuuucagugcuacugagcugugauugcaucuaggccuuucaauaaacagaaauagaaaauaaacauuuuuuaagaaaugaaaaaguugugaguucauacugguauuuccaauucaaauguaaggugauaguguuucuauuuauuugauuuuauacuagugucuuguaacucuuuaucuuaugcuggaaaucuuguucucaauaacauuaacaaaaugauguaucugcuagauccuacugaaucugagguccccaggaccaccccagguucagugaugcacuaggacucucagcuguggcagugaaaggauaccagguauggcggcacagggaaaagguacauggggcagagacuggaggaaacaggcgcaggcgucugagugcucucccauuggauacccacaggaaggauuuguggcaaugugugugaaguguuaucuagcagggaagugaguuagagacucagugcccacaucucuuacugaggacugguuacagaagcacccuuggccuagcauguaccaaaauuccagacuuccagaaagcaagcagguguucagcaugaaccuuauuguuuacacaguauaggcguggugagccacucuuaucauuucugggaauugugagaaccaccuggaauccaaguucccagaugccagucaagggccaaccuugcaagcaugcuucucuaagauuagcaauuuauauuaacuuuauucugcucaucuacaauauaccaguuacacuuuuaaaauaacuauauuuuuuacuacuaagacucagaaugaaauuuaagacuucuuugugauucuuuuuuggccuuaaaauaugucuuuguggagauacaaggucaaaauguuguguuuaguaacuauuuuucucuguguaggucucccaucaugagauauaguuugguuaauuugcuucaaucuguuuuuaauuuuuagagauuuuuaaaauuuugauuuaauuuguuguuuuaauuauauaaaacauuuauauacaauauuucucaaagucaaaacuauauaacaagguacauuuacagaaguuuccuuuaaucucauucuccuccacccuauucccuuccuucccacauaguuaacaguuguuauuaguuuaucuuuccuuuguuucuuuuugaaaacaguaacaaaugcauauauauguguaugguguguacauauauauuuauauuccccccuucauuaaauaaaagauagcauacuauuaaacacaguuuugcaacuuucuuuuuucacuuaacauacgcaauauguucuggagauccauauaucuuggauaucacuguuccuggagaugcugcuucuguagcugggaggaugauggggaauuacugauacaauguggaaccuauugaugcaguggagaacuauggugaaggaacaggcuuagggugggugcagggaaggaacaugccaaguucaguuuuaaacagauacuuuaacaugucugggugguucugucaaaaaagccgguggauuuacaaggucucuagcaggaggagugcaugggcugaguguugaccagcaugugggaguugauacgaugucauuugaagccacggcaggggacagggucuccuaaggagagaauguggagggagaugagaagaggaccuaggccagagcuggaggggcuccagcauagagggcacaggcaggggaggagcagccagcaagggugggaaaaccuuggugaacagggauggguucguggccucuagguugucuuguccaucucuuauucugguaucuugagaaggagaucacuauuggcguucuuccacccacaauuguaucgcauuuuaaaaacaucaccucugugcuccugggcucugucccugcagacguggcaugcuauucgguauuauaaauaacaaaugugguuguugguggcugaugaggccugcuaagagucccgagggagggaggugaugagccuucuuguuuuauaggcagagguguguggcuguuuggagagcagggaggcugcucaccuccuguuguguuugaagcccuuagaaguaagccacagaagccuggguuaguucagcaaacuucagaaaaggagccccuuuauuguucucuuuaagauuuucagugggauagugcguuaaagucuuuugaggcagggaguugaugaaggguucaaaaauaugccaucauaccccccuacccacugccauuuagagguuacuuuuggacaacaaccucauguuuuuaaauuuaaauauaguacaugacaucucucauuuuuauuaaucuugcauuuagggaaacaaggcucacacaaguaaauugucuucauaacugaagcuuacuguuuuaacuuuuuuuuuuuuuuuuuagcuuuucaauggaucaguagcaaaaaaauacaguacuguugaucuaacuuuuuacuggcgcaucaggggagcaaauggccccagguuauacaggggguucugucgcuagcucucugugugucuccauaaggcagccuuucucacuuccgaaacuccuaacuagauagaaaggaaacacagcauucugugcauaaacaggauuacaaagagaggguggaugcugagacugugcugcuuagagguugucccuaauagcugagauuuggaaggaguuuggaggggaaagaaggggguuuuaacauggggacgggguacucuuagggagaaagggagcccaugggagugggggcagcuuguaagacacuaggcagccagagggcaguugggagauaccuggaaguggaggguggcaggagguaggagagggggcagaagugagggugggaggacccagagaacagucuugcccucuuugccguuuugcucagggcaaaaucuucccucuugcuuagccuauagaaacaggguuuauuaguggcuuuuugggucagaagauaauauuuuuggcuccagaugaugggaaagccuuugaaaagcaaaagaauguuuccuguucuaguaagccgauuuuuugcaacuugcuuaugacuucaguauuucaauacuuagcagauuauuugaaagcucuuuugggguuaaucagggaggaaaagagggaacacauacaaaugcuucccaccccacccccuuccuuuucauaguaggagcaagagucaauuuguaaaaucaaaaaccaagucccuagaaucguaagccaaaugaaaagguuuucucauuggcaacucauuaaacucagaccuaagaaaacaaacauuuguuugagccugauggaggcgugggccacacuuaauccaagcauuuucuuguaggcuggauucuaaaauagaagauaguagguccuaguaccauuuccaucuaguccagguuagcugguaaguuucaucucucaugccaagucugaucaauugcuugguggccauggugaaaaggauucugggggcugcugcuuugcucuggaggaaagaaauugaucaaugaugucuguuugcugugagcugggauuagagaaugacagugccgguccuuggacuggccaaugauucuccacaaggcugcacauagaaccaucuggggaacuuucaaaggccuagaccacacccagagauucugauucaguuguucucugaagccuuggaucaguauuuucuuuuuauuuauguuuuugagacagggucuugcucuauugccuaggcuggagugcaguggcacaaucguagcucacugcagucucgaccuggacucaagugauccucccguccucugccuccucaguagcugggacuacaggugugcuccaccacaccuggcuaauuuuuaaauaauuuuuuuguagagacacgguuucacuauguugcccaggcuggucuugaacuccugggcucaggugauucucucaccuuggccucccaaagugaugggauuacaggcaugagccagugugcccggcuuggaucaguauuuuuuuaaaguguccaggugauuguaauaugcagccacuacucaagucuuuagauaauuucccucaaacacaaaccaauuuuaggaggacaggauauguucaguucuuagauguguuaaguuugaaauaauagcaaaauguuccgugugggaaaggaaaggcgagcaagaaguugggaauagagaccugacaauuauuuuauuaacagagcauuaugaugccuguaaacccagcacgugggaggcugaggugggcggaucacuugaggucaggaguucaagaccagccuggccaacauggugaaacccugucucuacuaaaaaugcaaaaacuagccaggcgugguaguguguacuuauaaucccaguugcuagagaggcugaggcaggagaaucccuugaacccgggagauggagguugcagugagcugagauugugccacugcacuccagccugggcgacagagcgagacuccaucucaaaaaaaaaaaaaaggaaaccaaacaaauacagcauuauuacuugaaacccaagaaugaguugcugaguuuugcaagggaaaugaagauccaggaaagacgugaacuuggagcauacccaaccuguugaaguaguuuccgugcaauguagauagacugagaaggugcgggugcuguccuagaacccaagagcaggagcgccgcagggccuccggaaguggugggaacugggacuuacugcuccucacuggcaugcccucugccucccuuccugucucccuccugucuuuugcuuuucuaacuaggacccugcuucucugcuugcuggcccuguggugagaugcagcacagccacuaaacacaaccaugccuuccugcuggucucaguuccagcauccccagggaaggaacuguggcugacccagcuugggacagcuguggccaguggaggggaggggaggguucuguggagugaccucugagugaggaugggaagguccauucccacagggggacugcuaggcagacaaagcuggggucucccuuucucucccucucucaagugacaggcagagcagugggcaggagaccaggagaguguggccucccugaaguccaccgagugguucauggagagcacaugugacaccaguucccuggagaggauuggggaaagccagccuagucugacaccaccacuguguuccagcugccguccuucagaguuggguuucaguagaagaaaguucucaauagggaguuccuggcuuucuagggaaguccugggauagguuugaggggucugugaucccccucaaauuguguacaagaaugugagguuuuauaugccuaggcacauuuucugggggagaugguccauagccucucuacauggagugcagugggaagugggggacagguuucuucucaagguggggagccugucuuccuccuccccauaacccuccuccaagccucuuccggaucgauuucuacacagaguguugauucagccagauaaggugcacgaagguaacuaagcaaguggguguagacuuugaguucagcaacuuguguggcagauagucagucauacacgguagugaaucagaaacucuccuaguuucaguguugacuauucucaucuguucauaugcuuauagugcaucucgucagcucacagccagcugccugcuucuagaaggcagguccuuucacuucuacucugccauguuuguugauugccaccgucucauauuaguggggacucuuccuguugcaaguucagaaacagcuccagcagcuuccccgaauggaaacaguauuggcucuuggaacugggaauuucaaaggacagcuggauuuagggguucaaggggucuccagggcuucaugugucucucucucuccuggcuuuccugggagugcuggcuuccuuccuaggcccuuguucuguguugggaaagauggcugcagcagccacagucagugcccuuaucagucgggauugacaggugagagaagccauuucucugccucuccucaccuucugagucucauggaaggccucuccuuggccacauacaccuugucucacaggugggaagcaggaaugagugcugucucuggccaggccacauuuagcugccuacucuugugaccccagugacugagagucccccagacccccaugggauagggaaagggcaggguccccauggaaaagaggugcugggaagacagacagccgguggccagcauugcgaucuaguggaggacucgccacgggcgauggugagagugguggcuuucaauaugaugcccguggagacuucacaaccaaccagaaagcccugcaguguuuagaccccugaugauguuuuggcucaucaguauggugagccaccugcaccuacugcaccacagguggcucauuccuguggugcaguaggacaguggccuagaaggucaggacucuucuggaaaauuuugcacaagggucuugauuuuaaacgaggccgcuaguugccagugaggccugccguaaauaaauaaugagccccaggcaagcauccacccauucucaacaccucaggacacagacucacagaagcaacugugcauuucugcucugugugguuuuaaagcuugggaggagguugcaguugaauugagaggcaggcuguuuuuuacuuaaugacccguucuggagagauugccgugugaugaggguauaaacaugcuuccaccagccuguggucuggagauguguaccgaccgguucuugggagagacggcuggacacacaaggagccacagagcagccaguggggagggccagcauagucgugcugaauugugucuggaaugagcucccaaggcuguucuuucuaaucacaguucuccccgccugccaagcgcauccuggacuccgugucuccguuugccuuguugaguccacauggauggccuuccuugcucucuguuucagccaguccuaucuuuccucaaggccacugcuaguuucaucucugcgaggccuucucagcucccacccugucucaggcccucauggcccgcugggaugggcagcaccuucagcguuaagcagacuggucugagugcugaccugcuuuuagucugccuccgucaucagaagaggauauuccugccuaacuccauuguucuuagagggucaugcaagauaaggugcacgaagaugccugaguauagcaccugggccauuuucaaggaaagaguggccugcguagaaugacauuuuguccugauuuacaggacuaaauccacauugaacuguagaguggaaaucauaaaauucaaugcacuuuucaugcuggaagggauaugauguauuguggcacacauuugauuauuuggaucugaugaauagcagcaauuuucuggccugguaagcgcugcagagcugcuucauuauugauggggccuguguccacagaggacgccacugugaacccaggagccaccuggccucgggaguuuucuuuuauaugugacagugugauugcugaggaaacuugaggcucgcuugagaggaggcgcagugcucccagauuuaaaggcagggcugucggcuuuguagucugccgucuguguggcugguacgggcagcguacauuugaggagaaaugaaaaggcagcccuuaauugagagucauucuugucagugaagaacuuggagcuacaggcccuguguggcugggaccccagggcccaggucaugugggucacggccgccuuugcuucccugcagcuugcauggggccgucaccuggccucagggagccugaguggccuugccaguggaguguggcucgugguggcuggcucaccagggcgauggagaggcucggugagcauccacauggcacacagccacuaagugugcguucucaucuucauuccccguggcacagugcccacauguacugggugcagguagagauacagaggaggaaagggagcagaguacugggagacacuggcuggccaguaucucagggugacaagaguaggcugcacgacggggccugccuggagacaggggccaagaccgagcaagaggccuggagccccugcugggugucuuggaauuuaucucacacaaaggggaaccagcaaaguuuuugaaggaggaaacagacacgauugggauuguuguugucauuguuuuuuuuauuuguuuguuuguuuuuguuuugagcgaaacuuuuuuugaguuuugcucuuguugcccaggcuggagugcaauggcaugaucucggcucacggcagcccccaccuccuggguucaagugauucuccugccucagccuccugaguagcugggauuacaggcaugcaccaccacgccuggcuaauuuuguauuuuuaauagagauggcauuucuccauguuggucaggcuggucuugaacucccgaccucaggugauccaccugccuuggcuucccaaagugcugggauuacgggcgugagccaccgcgcccggccuguugucauuguuuuaggaaaaucgacucugaaaggaacguaaaguaaacucugacgagcauggggagguagaggcacgggcaggagagucugugggaggcagaugcaaccaguggggccggcaggggaccugggucugaucugggcaguggaguguguccagaggggacuggcugggucuagagcccguuggaaagcggaauggacagaccuuggggacagguuggaugcugagaacucauaaaugacuuggagguaucuagcuuggguaacugggugcgugacggcucuaaaagcugagguagggaagagaggaggaggucuggggugaggaggagacagaucaagcauucagaugacucgauaacuguaauauguacacacacccacagaagacucccuucagcuguaaaaaaucaagcgugaucuggagcacaaacccacuuuucugauugcuguagggacuuuagucacaaacaagggguuguaggugacccauugacagauagguucucagaggagcuguacuuaccauuccagaggcaccuugugguucugggggcugcuaaguagagaguagauuucauaguuaacucagauucaacuuauuccuaccccugagggccccaggaaaccugggagaggcuggaccguguacccaugaagagguuaguuucaaaucuugggucugcuacucaccagcuaaggccuuaggcaagucauaugaccugagugucuguuccuuuguuuauaaauugggccucauuauggcacuuugugaggccgucauguccagacacauaacacagggucuggcauauuauaaacaauaaauaauuagcagcuguuguggcucuuguuuuuuagagagggaaucucucucuguugcccaggcuggaguguaguagcuauuuacagacacagucauagcgcacuacagccucaaauucuugggcuuuagugauccuccugucucaaccucucgaguagcugggaggacaagcaugugccaccacgcccagcuguuguuauuauuggcagcuaugcuuaaggcauaauuuaggccaggguauguauauucgguuuuaagucuguucauauccucugugaucauggaaaagugaggccugguuuuaagugcuguauuuucaugggaauaaacaagaaugaaguucucaugguuacugggagaccuuggcuguucuuucauuucauucauucauucacucauucauugauucagcaacaguugaagcuaucccaaagugcucaugggcuaauaggggagacuaacaugaaaacauguaacuggcugggcgcgguggcucacgccuguaaucccagcacuuugggaggccgaaucgggcagaucacgaggucaggagaucgagaccaucuuggcuaacauggugaaaccccgucucuacuaaaaacauaaaaauuagccaguagcgggugccuguagccccagcuacucgggaggcugaggcaggagaauggcaugaacccaggaggcggaacuugcaaugagccgagaucgagccacugcacuccagccugggcgacagagcgagacuccgucucaaaaaaaaacaaagaaaacauguaacuaugggaaaauaauaguggcauuaugggcugggcgcaguggcucacgccuguaaucccagcacugugggaggcugaggcggguggaucacuggagguuaggaguuugagaccagcuuggccaacaugauaaaaccccaucucuacuaaaaauauaaaaaauuagcugugcgugguggcgggugccuguaauucuagcuacucaggaggcugaggcaggagaaucacuugaaccuggaaggcggagguugcaaugagcuaauaucgagccacugcacuccagccugggcaaaagagugagaccuugucuuaaaaagaaugguggcauuauaagguuccugggugccuaggggcccgaggagggaggaggggcugcccccagcuggaaggaggagcagggaaggaaggcuagacagugaguaggaguguauucauggacagggccaaaccaugggagcaguuugccggguggccaaggaaacagguauuccuguugaugaaggugaccagcggaagcucuggggccugacucagugugagggaugaagaggagcccaugugaggcuggagagguggccuuucuuagaugccauuccagagacagccacuggaagcuuuaagguggaaggugcaguggucagaccugcacuuuagaauaguuccuuucgugggugcaugaggaauggacagagacagcaggcacuuugcuuagcugugggcggaacugaagggggaauuggaugcuggagagaguagcagaaucaagagguagagggggucaugucagcaggacauggugacccacuggacaguggggagcagagagagggugagguuaccgggucucugguugcuccaccagugggaggagggccgggccuucugggucugggacaguuaaguuggaggugccuuggagaugccaguccugauugucuggcagacagcuggaucaagggagaggucugggaggugccagaaugguugaggcucuagagacagggccuguggagugagggaggcacuggggcggcaacugggucucacugucccuguggucucugaacugagccccacugaaacuggaggagcccccagccuugagcucagaaggcagacuccuuccuagagauccaggcaggccuugcaaauuuuguuuuguuuuguuuuggccaaguuacauaaacagaguagggggaccuucagaucauuuugauuuuuggugggaggaggcucagcaggccgaaggaauccagcacugcagugagaggccuggcuggggaggggaagcccuccaguuaucuugggacaaucacuccuugggggccugggaccuggcuggcucuucauaucugguuaucucgccuggcugaugggagacgauguuggccgauaggagggagcugacaggccucuggaucagauccgaggcagggacugcccuucccugcaugggcccuccucuucuguagggugggcugaggcuugggccacgggccaauggggcaagcagggaaggucagggaguaaagugagcuggaagccgggguugggaaaugaaacacagagggguauuuuucucaucuggaaguguccccccucccaggagucuuagucugcuucuuauuuucccauuucucaauaaagaacaugggcacugagaaacauuucccaaucauagugcugggggcggcagggugugggggccacggucggcaccugaaaaggggcagcgccuccucagccccucacugccaugagggaaugcagggccauugucaccggaugguuaguuucaagagaaucuaggaauccagauuucaugggaaaucucccaauuggcuuaaauuuuuaaauaaacacugccggccagaugaagucuguggccuggacgaggccugugggcugugguuggcguucucugggcuagcccggccucucugacguccguccuuucuggccacggcacacugcaaguuaucacccagaggaggagaggacacuagauaggagcacacugagccuauuccagauacuucucugacaugagccugaguggcugggccaagcugugucccuucccuggagucucccuuccuuaucagcacaaugaacgccagggcuagaucuguggguuucaaccuuucguuccuuagcagcagaacuuuguuucauuucaaucuuacaagggacaaaucacaguguaugaaauagauugaaaaucagagcugcuccugucgcccagggagucuggaauucugccccgaggcugccucugcccucccccacagaggcaccucugacaggcuccgcagaacacagugugggacugcccaccugccggcuggcccucugcaccccucccaguccuggcauucuguggguugaaugggaggacaagaauggcagccagaggagggcaagccacagugggucugccccauagccagcuccucgcccacauuuuguccagucccuggcacgaggugaucggccagucacugggugcagcuggcacuuccugggugcuuuccacguaguuuugccuccucacaucagcccuguaaggcggguguggcuauuuccauuucacaggugaguaaaccaagacacagaaaggggaagugaguuucacacaaggucaguuggcuggaaagggaaggaucccagguucuaccugggcgucugagaccccacaagcugcucccuccccguggggcuuccuuuauucuucacugagagccacgaugcuccggggcagucccacauccgugugggugguaggucccgggaaugacaguuuccaucucuuguguuucuguggcaugcuucuuugcuuucagaugugaucuccuuuugcuggcgucaggcuugauccaucuaagcaggacucuccuuuuuaucaccucacaggaggcugaaccgucugagcccagaagugcugaggugacgaggaagcccaaggcugcuguuccuucugugaacaagaggcccaagaaagagacuaagaagaagcgguagaagaggaggccugaggagcugggcgggcagggagagggucuuggggacagcccuccugggaaucuacauuguguucccccgcauuccaggcucagggucugaggaggcugugacgcccuaugaccgcagagaucuagacagucguaacaguccccaggcuccagcugggcaauccaccacuuccucuuccuucugcuucugugacgguuuagagucaagggggcugaaacacacugugagcauagacuguauuagguuuguucagaagccgggucagcucacagagucacauuuucuugcuuagucaugugucccuccuugaguugcccccuccuuguggguuuacacuacauuugggagucauugucuaaugcugacaagcacacccucucccauuauuugugcacuacagaucuccuccugaucagucaccuuuguugcugcuguguagacagagccaggccucaccuguuuguuuaggccaagaugccauggacaugcagcguuagugaucccacuagcugugacagccaggcccagaaaaugccuggcgugagagccagcagacagccaggccaggguaggcagugccugcuucugcuccaucaggugcaggggauuuggcugaaggcgugcauauuuccugggcacaaacuuccugagccucugaaaugggaggcucgucaauuucagaccaaccucuuuucaacccaucauagcacguucaaggugugccuuuuacuucuaccuguacaucccccaucccuucaauucuuucauucccugaccagugagaggguuccugggggaaguauggugaauaaacugacaugcaugcuucagaa

SEQ ID NO: 191266 - RNA, 23993 nt, Homo sapiens
ggcggggcuggacgcgcgcuccaagauggcggcgaacguguucccguuccgcgacgcccgugccgcaccggacccagugcuggaggccggcccgguggcacacgggccacugccgguaccgcuggugcuggacaacgggucguuccaaguccgcgcuggcugggcgugucccgggcaggacccaggucccgagccgcgccugcaguuccgcgcggugugcgcccgcggucguggcggggcacggggcgcgucgggcccgcagguggggaacgcucugggcagccuggagccacugcgcuggaugcugcgcucgcccuucgaccgcaacgugccggucaaccuggagcuucaggaguugcugcuggacuacagcuuccagcaccugggugucuccucacaggugaagggcggaguaggcugggcugggcuggguuugaggggaggggugcggucucgucuccgcucacucugcucucggagagguaacagucacuucaguagcuccgauugucuuuuagucgaccagaugcuaggcgcuguggguguagcagcgaauaaaaugcugcuccuuguaucuuggagcauaccuuugggcauauaugcuuguuuguuaagaagcccauuuauuaacaaauacguauugagcacuuacucugugucaggcacuuuuuaggcauuuggaguacaugugugaacacaaaacuuccugugcuuauggagcuguuaauacuauggaaagauauucuaguaugaaaaggcagacaguaaacauagaaauaguagauucuacgccgugauaggagaggagggaguuacauuuuuucaguaagauggucaggguaggacucgugaaggugauguuugagcaaggacuugaaggaggugauucagguagcaagccaugugaauaucugaaggaaaaacgguccaggcagagggagcagccaguaaaaaggccccgaggcaggagugugcccuaauccuaacugcaaggcugccugugugagggggagaguaguaccugaaagaggaugucagagagguaguggagaggcagaucacacaccuuauaggcuuuuacugagugaaauggggagccauggcaggguguugagcugaagaaggaccugacuuguguuuuaaaaggaucacuauuacugcuguauggagaaugaauugucuuggaucauaggguggaaacagggacgaguuaggaggcuguuggaauaacccagguaagggaugaugguggcuuagaugaggcagauagcagggaaugucauuagaagcaguuggauucuggaaauacuuugaagauagagccaacacgauuugcugacaguuuggaugggaccuugacuuaauaacuuaaauugacucuacuuucguauuuucaaguaaagaugagaugggaguuuuauaaucgccucugaucagguuuuugauuaagaagccaaaagcaaauucaguccugcaauaaggauuuuggguucuuuuaugcuucaaaaagaguauucuguuaccacucauuuauuugcccuuuucuuucaaaguagggcuguguugaucaucccauaguuuugacagaagcugugugcaacccacuguauucacggcaaaugaugucugagcuucuuuuugagugcuacgggauucccaagguugccuauggaauagacagccucuucagcuucuaccacaauaagccaaagaacucgaugugcagugggcuaaucauuucaucuggauaccaguguacgcauguuuuacccaucuuagaagggaggugaguugcacuuguggcauuugagugcgauuuugagaagcauucaggaaacauuuauuuacugcgugcuuuaaaggcagaguagaaagagcaaguacuagccugugaacugagccguugggcuuagcuuugaacuaccucacugugugacuggguaagucccuuugcccauaguuguguccuuugugaccuucuggagggaguugggguggaugaucucuuaguuccacauccauaauucuacaauauuauaauucugacauaauggggagauagcuaacauaguaucugcagguaguaggcauucaguagaaauguuuugaauaaauuuaaucgagaccaucuuuguguucuggaguuuuuuuuguuuuuuuuuuguuuuuguuuuuguuuguuuguuuguuuguuuuuugacagagucuugcucuguugcccaggcuggagugcagugggaucuuggcucagggcaacguccgccucccggguucaauugauucuccugccucagccucccgaguagcugggaccacaggcaccugccaccauuccuggcuaauuuuuuuuauauuuuuagugagacaggguuucaccauguuggucaggcuagucucaaacuccugaccucaagugauccacccuccuuggccucccaacaugcugggauuacaggggugagccaccgcgcccagccaauuucaaguuauuuaaucacuauuguuuagaccuuucagguacagugccuggcacguaauggacccuuacuaaauauuuucaaguugaauaaaaggcaaggguaguuuaugucauauuuaaaaaucuguugccacuuuaucguugagcuuuaacugucugauaagagccuaggccaccacuguguucuccugagguuucucacauuggcacaaagagacccacgcuuuacagcugaaugccuggguuugcagcucugcuacuuaacuuccucacuucauuuccugauacguaaaauugggaaaaacugauuucccaggguuacccugagaaugaaaugagauaagguagguaauggcacuuuguaaacuguaaagcagacugaacauauaaggcaaauaccauugaauuucucaugaaguuucuaugaaaauuuuugaagaaaaaaguaauucuuagguguuaccaaaugcuccugauguaugaaguucucuauguaaacagaauaugcaaaaauaaaaaguaacauauuuuauauugagagaaaauuaccugaaggcugggaaauuaucagagugaaucauaucguguucuaugcuggcaucugcuggugagguaugauacagcagugacauuuuaguucccuacaguaaguuccuagugcucugccacuuacuuucucacauuaggaaaauaaaauuauucugguucuuuuacaguaagucaggaugcgugugguuacuuaacguguuugcuucaguagauguggaguguuaagggagggcuucuuaaacucuggccuucagucaccuagggagcucauuaaaaugcagauccccaggccccaccccagagcagcuguguccugggaauuggcauguuuaaaauuucccccagcuaauucugggauaccuggucccaggacuacaguuugagaaauauaugacgagacucauuaagaucugacuggagugcauacuuguuagguggccgugugacuguaugggugagcuaggaaugccugccuagauaagagguuauaccaggggaacuucaacgucccuucugacuaucagguuuuguauuucuccugcuggucuguuucuucuuuaucugccuuaaauuaucuuguuucucccaagaugcuccauauuucuguccuccagaaauuucagugcuguuuucuacugcuugguuauagauuagaugcuaaaaacugcaagcgcaucaaucuuggaggaagccaagcagcugguuaccuccagcgucuccuccagcugaaguacccugggcaccuggcagccaucacccucagccgcauggaggagauucugcaugagcacagcuacaucgcugaggauuauguggaagguauccaagaggauguuugccugcagcuuuuggguguugucuaccuuguauuccuuaaauuauugccagcaugauucuuugcuugcucacuuuuuaagcaccuccuuccccuuuuuguauucccuuucuuaaacuauucaguaaacugauaacuuauguuguauagguucccuucacaaaugguagcuuuuauaacuugccuuuaauacagaacuuggaauugcacaacuuucagcuuuuccagauauuaaauauuuuuaagagugagcagaacauaucagacuaaaaauaucuuaagcuagaaaacaauugaaauuguuuuauuauacccuuauaauaacaucuaugcugcagaaacaccucuuuuucuuuucaaacuugucuuggacuuuugguuguauuuuacuucaaauuaaaguaugaguuuuaguugcuauugucacaugaaugugaugaaaauaucuuccucgugaauuuaaauaguucauauaaaaccaaaggacuacggacaaugccacugugaauacaacucuauuccaagaauggauuugcuuguugucauugaggguacugaucucagcugaccaauaaugagcuccugaaggacaaaaacugcaucuuuuuuuuuuaauugugaaaaccauauaacauaaauuugccauuuuaaccauuuuuaaguauacguuucaugugugaagagcuguguuuuaauuaacuuuagaaagcauuuauuaaacaucuguuauuccugggauacaaagaaguugcgggagacagauagggaaauaaauaauugaugaggacacucaguccggagaguuagaggcuugccagaagacacggcugaggcacacagcucuccgugcucccacuucucuguucuccaguugcucugguauugacucuuuuuuuuuaguuaacuuuuucuuuuacaauucuaugauaugauuauaaagagagagcaugagggaauuuuuugggaugaugaacucuuccguauccugauugugguguugauuacauaugcuuucucuuuauaaucauauccuguuuuuauccacaauaaacaggaacaaacuacugauacacucaacaacuugaaugaaucucaaaggcaugauguugaguaaaaaaaaaaaaaaguuucaaaagguacauacuauuugauuccauuuaugugacauuuugaaaagauaaaaccauagugauagagaagaagugagggaaagauugccugggcuugggauagagacaagcuuuugggugaacuuguuuucauuucuccagaguaaauagauugcugggucaugugcuugcaugguaugucuuuccguccuucuacuuuuaaucuaccuauaucauuauauucaaagugaauuucuugguaguuggaugauuuuuaaaaaaaaucuauucagucaaccucuauuuaauuguuagacuaaaccauuuauaauuaguuuuaauuauucauaugcuuggauuuagguucaccauuuuauuauuuguuuuuguuccuucuguuuauuguuccucuguuucucucuccugccuccuuuuagguuauucgagcuuuuuuuuuuuuuuuuuaaaguauuuuaucuguuguguuuuuuacucuaccuuuuuauuguaguuuuuagugguugcuuuagagauuacaguaaacacaacuuuucacagucuacuuagauucuguauuuaccacuucaaggggaauguggaaauguuagcaauguacagacuccuuuauuucgcccgguuuaucuuaaaguugucuuauuuauuucaucuguauacauuggaaacccaucagacaguguugugauuuuuacuuucaguugucaaauagguuuuaaagaacucguaaggagauuagucuguuauguuuaaccagauuuuuaucauuucuguugcucuuccuucauuccugaugcuccaagcuuccuucugguguuguuucucgcugaagaacuuacuuagcaguucuuuuagaacaggccugcuggcauuauguccagguuugguagcugcuuuuaguugauugaguggauucagggauuggauggaguguauuuucuccaucugaccuaugucugaaaugcugguacugacuuuaaaaaaaacaauggagucggccgggcaugggggcucauagcuguaauaccagcacuuugggaggccgaggcgaguggaucacgaggucaggagaucaagaccauccuggguaacauggggaaaccccaucucuacuaaaaauucaaaaaaauuagccgggcaugguggcaggcgucuguagucccagcuacucaggaggcugaggcaggagaauggcgugaacccgggaggcagaacuugcagugagccgagaucgcaccacugcacuccagcuaggugacagggcgagccucccgaguaccugggaucacaggugcccgccaccacgcauggcuaauuuuuuuguauuuuuaguagagacaggguuucacuguguuagccaggauggucuugaucuccugaccucgugauccgcccaccucggcuccccaaagugcugggauuacaggcgugagccccugcgcccagcugguauugacuuuaauuguuguguuaauaguguuuccauuucauaacuuucaaaauuguuucuuugaagaauuacacaaauggcgguguccugauuauuaugagaauaauguccacaagaugcagcucccauuuuccagcaagcuccugggcagcacucugaccucugaggagaaacaagaaaggcggcagcagcaauugcggcggcugcaggagcucaaugcccggcggcgggaggagaagcugcagcuggaucaggagcgucuggaccgacugcuauaugugcagguaauagcagacacagggacgggcgcccuuccguguuaacaagauagucucagaagauuuucuugcauauuuuuccauuggccuuaagaugcuuugacuguuugucaccuuuggggucacgaaggaguccagggggaucaucagcauagaauacaguguagaagcagcuguuucugaaagagcuguggacuccagcauuauuuauuuucaccuuauaaacuccuuuauguuuuuaaacuuuguaaguguagcauacaugaugcaaagugcacaaaucuuuauguuucaucuugauggauuuucaaagugaaacucacccguguaucugcugucagguuaagaaacagcauugucagcguuccagaaggcuccuuucaugucuccucuuaguaacuuucccaccuuccuucacaucccccgccccaccaaaaaaaaaaaggguaacaaccuuuuagacaucugucaccaucauuaguuuuaccuaaucaguuguugcuggaacugugaugcaaugcuagccuagagacagagaggugggcagcugugugaaacuggaggcagcuggaggcguggcucugggcaggguaggccaggggagcucuggaagcccucuccagcugucguuuucuccguuuggcuuugaagcuacuuuccuuccuguuugugacugcucuguuuucaggaacuucuagaggauggccagauggaucaguuucacaaagcucugauagagcugaauauggacuccccagaagagcugcaguccuacauccagaagcucaguauagcaguggagcaggcuaagcagaaaauccuccaagcggaagucaaccucgagguggaugugguagacagcaagccagagguaacuuagggccuuggaaggagcagcccuucuugaggggaggaguguccugagaggccugacaucaaagggguugugcccagagucaggagggaaagagagcagaggggauguggguggugguggagauggcacugaccuuguaccaacugaaauucugucagaagggauuucacccuguagauccccggaccccugagcgcagaaagugcauuuaacguaggaagaacauucacacaccaaaccuguggugcugucuugaaccuaaaccagcuccacugauagucauuggcagucauauacuuccuuuaauuuucuuuuaguguuuuauuaaauauauugugguugauuguucacuuaccuccuuuccaucuugauguucccuaaggacagggaucaugcuucauacaugauuuaugaauuuuuuacagcaguugguaguuaugcucaauaauauauguauagguugccuuaagaucagccuuuuauuaguugcuaaagacccuuugcauaagcucuuugauuuucucuucuucuucuucuucuguuuccucacccgugcacuguuaauaaguguuuuugaggccgggcgugcuggcucacgcuuguaaucccagcacuuuggaagucccaggcaggcagauuaucugaggucaggaguucaagaccagcguggcccacauggcgaaacccugucuguacuaaaaauacaaaauuagcugagugugguggcacacgccugugaucccagcuacuugggaggcugaggcaggagaaucacuugaaccugggaggcagagguugcagugagccgagaccgcuccguugcacuccagccugggcaacaagagcaaaacuccaucucaaaaaaaauaaauaaauaaauaaguauuuuuguuuguuugagacagggucucacuuuguugcccaguuagaaugcaguuacauguucauagcucaauauaaccucagacuccugggcuuaaguggauccucccaccucagccuucuaagaagcuaggacuacaggugaacgccagcaugccuaagucauuuuuacaauuuuuuguagagauggggucucaccaaguuguccaggcuggucucgaacuccuggccucaagugaaccucccaccucagccucccaaagcacugggaugacaggcuugagccaccaugcuuggcuguuaauaagugucgaaguagccaaaagagcuuaggccccagcaucuuaguuccuguauggcaaaggggcagccugcaggucacuccucaguccagaagucgcugguugagucgccugccuuuagaacugaaacaaagaguaaguguacauccuguuccuggaucugucaucccuagaauuccaaaacaaaggaacuuacugccuugagacauguuuuaggcaggauaaaccagacuagccucuuguuuuuuguuuuuuguuuuuuccuuuuuaaaucagcuuucauuaagcuguugauuacuuauccuuucagaaaaaaaaugauacuuuggaaaaaugcaagucagugccauuugaugcuggguguagcauagugcuuaucagugaugucagaguugccuuuggcucaacaggaagcuugcuuuugcagugaugggcucccagcuggaggcucgcucaagguucugcucucaccguugcauccucuacaucucauucccaggcugucgauuaugugaggacaguacaugaguguaugcuuuauagagcagauccugagauaggcuuacuagauacaccuuauuggaucaccaagaucuuguguagaaggggccuuuaccaucuucuuccaacacagcaucccagaucagccucaguugaaucagugugugccuuuuccauuuugcuucucuugguuuuucaggucuuugagauuugaguuguuguuuacugaaauccggaaccauguugucuuuguuauguauucauccauauuuaguuuuuaucaugcuugacauguuagcaggacauaguuuucuuuauaccagagcagugccacucagccacaagcagaugagggauuucagauuucaaaaagggaaaaaaaaccaaacagcugugaagaugugauucuucagcaguggggaaacuaguuuuuccuuuucuuuguucauuugucugcauuuguuacaugaugugauucaucacccauucccccauucuuucagcagauacucaguagguaccuacuucauuuuaugcucugguacacacauuuaaaucuccuuggguuuaggggauuuugaaaugccggacugcaaaagauuuuucuauaugcaacaaauuugaugaucaguugggccgggcacgguggcucacgccuguaaucccagcacuuugggaggccgagguggguggaucaccugaggucaggaauucgagaccagccugaccaacauggugaaacccugucucuacugaaaauagaaaaauuagccgggcgucggggcaggcgccuguaaucccagcuacucgggaggcugaggcaggagaaucgcuugaacccaggaggcggagguugcagugagcugagauugugacauugcacuccagccugggcaacagagcaagaccccgucucaaaaaaaaaaaaaagugaugaucagucgucaaagcuuuaaugguuagucagcauucagcauuuuaggguaauucuuaaugaucagagucaauuacagucacauuugugggauaaacuugaccaugacaauggcuagccaguucuaccauucaaaaaguauuuguagaguuuccaauaauauaauucauuuagaaugaauugaaucaauauaugugaaccaaaauucauauugaaauugcacuuaagcaguaauggcugaacugaauuaauacagcuggaauuuaacuaauagaggucucgaaaaucuauuuuuucuuauagaccaaucuauucugacccuugcuauucugcaguuguuucugugaggauguugugaaggagcaggcuuuguuagcauuuuuaccaaguauuuaaaccagaagaugcuugcuuuucauagcuacaagcacagcauaagaggguaggaggggggagaacacagguuuugagcaucaucauuuguuggaaaacgcaaugggccaaauauagaaaguucuccggcuuuacuagccaagaucaggguuggccucugcuucuucuuaugccgcucaaggcuguuuuagggaaccaugcugcaucuucugugguaugccuuggcaaacugucauucccugcaguuccaaaagaacagucauauuaguguuucugaacgccacauaagacauguggagacccuggcaaacucuagcgagagagaagccagccguggcagagaaaacuauucucuguuggaugccuguucucuguguugaaaugaucagcuuuguuccucucugcgacuuguaugaauugggauaaauaaauguccuuuuuauaauuuuugugaagcuaagaaguuaucuuaagaugguaugcuuuggagugaagcuaggugaaggugaauguugauuuuuuuuuggcagcugaagaaaccucuugaaacccaaagcuuuacaaucaucucuauuucaggggaauuugaggguguaucccaggggcccaccacucagugacaggugcaguauaccagggaugcagaggugauuaagauacaaugccugccuuccuggguaccucaaaaacaaaaaaugagggcuauagcaccaugcuuagcugacuguaaugaagcguagcagguauggugguaaaugugugugggaauacacauuugguuuuuugagaaggacuggauguuucagcugggccuugaaagauuauuugggccgggcacaguggcucacaucuguaaucccaacacugagaggcugaggagggaagaucacuugugcccagcgcuuugagaccaaucccugagucacauagaccccaucucuaaaaaaaauuuuuuuaauuagcugggcaugcaucuguagucucugcuugagaggcugaggugggaggaucacuugagcuugggaguucgaggcugcagugagccaugguugugccacugcauuccaaccugggcaacagaacaagacccugucuaaaaaaaaaaaaagaaaaggaagauuauuugauuucaguagguagcaaaaggaggagggaaggacauuuuagguggaaagaaccacacaugcaggcauauagagugugaacaagaaaagcuguggugggugaugaaguggagaugacuauuaaguucuuuacccaucagucuuaugagccugcauauuauccuucagacauucggagccuuccagggauguugagcaagggaaugagacgaugagauuuuguuuugggaaacuaacugguggcaguuaggaugauggguugaagggaggggugagacugcaggugggaaaacaaaacagauguaggaucagauguaggaucccaagaucucgcugccauuugcaagccaaggugacaagaguagcaguguugauaauagagcauguggcaugugccgacuccuugcugagcaccuacguagguguccuccugguucguguucacaacucaauggguagguacuaucauuaucccccuuuuacagacaaggaaagauuuggagugaggucacauagcuagaaguagugcugaucaaauucacacacaggcaguucaauuccagauuccacccuuguaacccuuaggcuguauugaaaggcaguggguagaugguagugccuuuugaccaaguuugggaagauaauuggcuuaguuuugagcaccuuuuuuuuuucuuuuuuuuaagagauuggaucuuacucuguugcacaggcuggaguauauguugugaugauggcucacuguaauuuauccuucagacauucggagccuuccagggauguugagcaagggaaugagacgaugagauuuuguuuugggaacuccugggcucaauugauccucccaccucagccucccuaguagcuaggacuacaggagugcaccaccaugcccggcuaacuuuuugcuuuuuaauuuuuuguagagaugggucucacuguguugcccaggcuguucucgaacuccuggccucaagcaagccucccaccuugccuuucaaagugcagggauuacaggcaugagucaccgugccuggcccugagcuccuuaucuuuaaaauuguuguaggacaucagguggagcuuuucagcacucugugggacaucagguggagcuaugggaggacagaaucaaauggggaggaagaaaagaaaaauuccuggagaaugccaccacuugaaaguuaggugacagaagaaaagccaggacgaagauugagcaggagcaguaagagauaaaggaagccaaaaggguugaugggagaguuaaaagcuugaauggucagcuuaaccuaggaugagaauuauuuuuugaaacaaggaaagcuugaaaggauaagaaaauaggaugugagggugaucuggcugcgauaucugucaccccauugauugccaggguugauucggcugaucuggcuggcuaagcuggugucuuucuguccucaccacuucgugugugucucucccaaagcugcaugcuuggucgaagaggacgaccauccccaauagaggaggacugaucuuccgucaagaguauacgaguagcugcgcuccccugcuagaaccuccaaacaagcgcucaaggacaugaaaauagauaaggaaguagaaugaagaauaaagagggaaguucauuuuuugaggcaacuaagaugaucuuuuaagauuuccaggguugagauuagaaaggagacuguggagaaggguguugggaaagggcaggcagaaggaagcugagaaguaaccacaggauugccuaaauagcaccugggacuuucugcacuccugccccccuggagcauauuuaacuuuucuauugcuacaaaaaccauuccaaacuuagcagcauaaaacagcaaccauuuuauugugcucauggguuuggugggugaggaauugagagaggcuacagggaucucugcuucaaguugccuggagccacugcugggaagaauuaaauaguuggggacuggaaucagcuggaggguuuuuuacuuaccugucugguaucugggcugggaggacucaaggucuggguucaugggggacucuugacccaggcacccacauauggccucuuggugugccuugggcuccucccaguguggccacugguuuccaagagggagcuucccaagagagcagcuagagagugaauguuucaaaagaugaaagcauaagcugcaugaccuuucaggaccuuaccuuagaagucacaugacaucauuugcaccauacuuuguugguuguaguccucacagucccccacugagacucaaggggaggaaacaaagacccuccaccucuguuuggggagugucaaggucacauuacagaaaagugugugggauagaagucacuguugugaccuucuuuuaaaaauauaaucugcuccggagcccaaguggaaagaguacugggaggcauccuuuagacugcaggcuuacugguuggguguaacagaagcagauagaguugguggagggaugacggcaaaagugauuggauuccaggcuggguagagaagggcaugugaauccacaggaaaggucaucacuuggauugagggaggcuggaguggagguuaggaugaagaugaagaauaggguaaaaaugugggauguagagaggaaggacuccaguggagcccagugcuugcuuucaccuguuacuuggggaaucacagguuacagguuuugucuguaguuauuuuaaauacacagaugacaucuuugucuucaacccaguaauacaacagaauuauuuaagggaccaaauugaguguguguuuaaaagggaagagggaagcguuguucguuucucacccgacgcugcccuaaguucacgucccacuuuuacauagauggagaagcagcucagaguguacuguuuccagcucuaguacugugaccuuuaauauaccuuugguugccauuccgagcuggaucagugugacuccagagccugaccaccuucuguuaugucacacugccuccugguuccugguucccccagaugacaaaccaccaaaugaaaaagaacuuugaugauuaauuuccauuccuccccuggaaccccuuuggggucauuccugaagagcuggguuuggugccaagccagaauaggcacagacacucccaugguagggcuccuuucuugugagggaagcugagagucuuccagaucacaaacugcagauggcaaggggaauguuccuuuacucccucucugcugucccugcugggacagaggagccugucauugccucagcuggucuugcugcugcauguaaaaucuuucauucaucucuuguauuaccuacucugaccucaggcuagauuguuuucauguuccuaaagccccaauugucuuauccuuagccucaugauuuauagaacuccagcuuaaggcagaacaaagacuuuggaacugagcaguucugccucuucccacauguccacugccuacuagugugaugugaucuugggcaaguuacuucaccucucugagccauagcauccucacccaucaaauacaguaaugucugcagugaggguugugcagauagcaggugucccuccccucuuugucugauucaguauuggcagggacagcuuuugcuuccuucccugagagcaagguucuuuagauucgugucacccaacccaucuuccuccuccucagauuaccucuauaaaccagcccccucauccugugcacaagucucacaugaagaaacauucacuuuccuuuccaggguuuauccucaagccuggaaaaucccccucaaauacuguagaaucaucuauacugaacagaauuuagaguacauugucacccaucuugcaugccauauuugccacaugacuuuuggugugugaaugugugugggguauugagggguauugccuuauuuuaaugcuaguuuacauuugcaguauauaugaguagguucuagagaaguauauuuaaguccucugaauuauguuggugauuuacauacuucauaaauuccgagaguaaggagagacucagaaugcauacucaauggcgcagucuccucucaagcauacuuggcuuugguuacacucugcuugaacccucccaagacacuaccucauaagacaguccauucugcagcagcugucauuguuacagcauucuuccuugggaugcaacuaaauauuucuacccagaacuucucuccauugagucuaaugacagauggcuaaagaugucuuucagaaccaccaccauccccaacuuauuuuguacaguuuaaaauuaaaagcacccuaacuucucuuuuggaaauggugccagcaugucuagaccccuuccagguucauuguggucauagagggaacuuguucugcaggacuccacagauagcaagcacucugcuaccuuggagccucuagucgcauucccagcccagugggaccugcuauuaagggacugauuguugagcucauuagcguuggcacauacauuuauuuauauuucugaggcagagucuugcucuuucacccaggcuggauuacaguggcaugaucauggcucacuguagccucaaccucccaggcucaagugauccucgaccucagcuucccaaguagcuggggcuguaggugcucaccaccacgcccagcuaauguuuguauuuuuuguagagacaagguuucacucuguugcccacgcuggucucaaacuccugggcucaaggagcccacuugccucugccucccaaagugcagagggauuacaggcgugagccacugcucccuggccagcagauguauuuauuaauuauuaaaagauugcuuuaacuuugcugguagucuagcugccuuguaggauagcagcugucacacccuucucuuagaguugcgugugugguggugugacucaugcaagcagcaagucuuccacggggcccagccaugagcuggcaccaucagaaggcuuuagagaaggcggggguuggugaggcuuguauaaaguaggaaagguaggagaucaaagcaaagcccguuccuggcuuuuuagucuucguguucaugugugcuuuuuuaaaaauagcuuagaaaaauuuucauaguuuuuauguaagguuuuagaacauugggcaagaucccaguucuuuuuuguggcacuaaaaugauagaacugaggccugcugaagguacagguucuguuucauuuugcuccuucucuuagaccccugaccuggagcagcuggagccgucuuuggaagauguggaaagcaugaaugauuuugaucccuuguuuucagaggaaacaccuggaguggagaagccggucaccacuguucagguuugacuucuacagcccagaacaugcuuauucuuugaagguguugaccuaaauggcugggcuagucuguuucuuuaggacuuaaaacuguuauguuuuuuagaaaauuggguaccaauacuuaaaacaucugaaaucagggauuuuuuucccccggugauugaucgauugguucuaguaccaagaucugugaaucucugagaaacaguccacccggcagaaacauuugguaaaguaauugggaacuugagaucugaauacuggcuuguaauaguuucauuuacauuuaagccaaugccaguacacauaauccucuuuggaaucuauguuucugucauuacaaugccaaccagauaaacuguccugagucugagacccaccugggagagagcuuccuugccgugcagggauagggcacuaagcaaggcacugagcaggagacuuguccucuagacucggccuuuuacugcugcucuccacaaagccucucccugcaacucggggaccauuucaugauggaaacauguacauguuuauaauacacagguuggaagaagguaggaaauugaauuagcaggucaagagaguugggagaagcuauacuggcauuaacaagggacagaaacuauugggauuaagaaacgcaguuugaggaaacuagcaacuggaauguuugucauuuggccuaaaaauaucuuuuaaaccuuggguuuuuaaagcccguguuuaacuuggcagcauaucaucagcuauuuguugggacagaaagaauucgagcuccagagauuauuuuccagccaucucucauaggagaagaacaggcugggauugcagagacucuucaguacauucuggacaggugagacagcgaaucugcuuuuccuucuaucuuccugaaccauuuccuuggauuuugcauugaaugguagauuugauggucaggcacuugaaaaugcaucucacucucuucuuuucauugacuugcugugcucagauaguauucccuucaucucuuaucaccaggccuggcacguaacuggggcucuguaguuguuuucugaaccuguaaaugcuggguugacugaguagcuuuaagagugucuuuuaaguuugaacaacccgauaacauguacacugguuuccauguaaaccuucacauuauuaaagacuagugauuuuaaaucacccuaaaaauauugcagagcuaauaaaauuuuuuuccccuccuugcaggcauuuuacuuauuuaagaguuacauuuccauaagaauccagguguuuuacccauuuaugcgggcauuuuccugcagugugaauuugauaauucaaguugggcaaguagagaauggaauuuuguaggacucuggcugcuguuggucauaacggcagggaaacuuguaccuagcaaggaagaaaaagcuguugcugcuacuuuguuugaguggcuuugagcuuugucuugacagugguuggaaagugaucaaacaugucuuagauaaagcuguuauuaaaaaagauaaaaagaaagcacaggucgauagaugggcccucaaaagggaggcauggcuuuuggggauaauggaaauguuuugugucuuaauuguagugaugguuacuggaauguauaaauuaguuagacuuuaucaaaauguauguaaauuuauccucaaguuuauuuuuuaaauguauuauaaaaguauaaaaauucuaaucauguuaaggaaauaaguugaccauucagauuacgguuuugucuggcuguuuggaaacauugggcuggcguuuuguagagacacaaaugaaaaaugaaaguuuugauuuuuuuuuuuuuuagcuuuuuguguagaaguuuuucuguuuuguacugagagcuuacauuucugcauccacauuucguucugauauuugaguuaagggacuauauuaggaguuguuucuuuccuagguacccaaaggacauucaggaaaugcugguucagaacguuuuccucacuggcggcaacacgauguauccuggcaugaaagccagaauggagaaggaacuguuggagaugagacccuuccggucuucuuuucagguacugauuguucgaguagucaauuauuuugaaaauagcauuaccuguuuucugauugcaaaaguaauaaucaugcagaaauauccacuguuaacauuuuuguggcuuuucuucuggucuuaaguccaugcuuaauuuuuaaagcaaaaugggaaucauguuuuauauacuguuuugugguuucuuuaaauuggaagaugaagacaugcguagaauucuaagagugugaaagaguguacaucaaaaauaagucauucuccuacccaguccgggccccuguagacauuguggggcaugggauacauuggagcguuccagacagaaggacuagcaugagcaagggcacaggggccagaagcuuguugagggagugagaaguggcugaguguugcuggagcacauggcugauaaagaggagaggagguggguaacguagagaggucagcagagcccacacugcagagccugugcauccugcuaagaagcuuggccuuggucugcucugcuuugcugcaugaugucguguacauucaggggggcgucucugggcuuuggugcugacuccaucaucaccauuacugaauugugcuaagcuuuggcugucucagugguaggaaggggguaaucgguaccuguugcugggauucaguguacuggugccugucaagcgcccgacagugggccugcauguaauaaacucucagacaugagcuguuguguugagggucccuaagaccauuccaggcaggaugauucucugggaggauucacaggacucagcuuguaauccuacuuacagcugugacuuacuacagcaacucagcagagagacaaggugcccggggugaaaucugggagcaaccagguguaagcauccgaggccucucccuguggagucacacaagacauaauuuccccagcagugccuuguaaaagcacauuaaguguugccaaccagggaagcuuguaggagacgcagugucuaggguuuuuauuugggggcugaucacauaggcacccccugcuuggagcauacccaaauuccaggcucacagaagggaagcacguguuuggcauaaaccacauuauuugugugaaugggcuuauugagccauucuuaucagguggugguaggaacccucccaauauccaaguucccagaugccuaccaaggccccacccuuguaaguaugccuuucuaagguaacaguagggugguccuguuaacucuuuucugcacagcucuuauuuuuaggccauagugaugaaccaugaaggagucuaagcagggaaugugaucugauuuacauuuaguaagauauauuugacacuguugugcaaaauagaguauuaagagaaauauuggaagcagaccaguuaggaggcagcuucccagccucuaggaggaaguccucacuccacucaccaggauuuacagggucucuuguguucugaccuuaagaacuguccaggguucucucaucauucccccuuccacccgcucgucagccacagcuaaccacuauuaguuuuccagaguuuuccugccucagggccuuuguacaugcuggcucccuuugcauagaauacucuuucuccucauccagcuuucucaguggcugguuuccuggaaaucacuuccuccaggaagccuucccugucuuucccuauguuccuuacaagauccaccucuuguaagggaagagacagccacugucuugugaaaagugucccaagcccuuggcacaguauuacuugguagcucugcaggaaauacaaaagcaguggcagagggagaggaagagagggaguugaugugaaagaggcuaaggcagucaaauugucagagcuugauaguaaguuggaucuggggagggaagucggaccuaagauaauuccuaaauucuaaguggagcaacuaguuugcugauuaagagauucacugaacgaggagccgcgggagggaggacaggcuuaagggagaggauaguacguuccauuuccaggguggguugaguuuccaguggacacacgaaaagguggccacagcuagcuggaugagcgcucgguggguaagggggaaagcaagaggguaguuucacacccucccaccugccacaaacauaaaaugugcucugggcacucuuugggaggguagugauguuaaggaugaaccccuaaagaacacuagcauuuaagggcuguaggacacccaugagucuaagaaggagguggaggaagaggaguggggagcaggagagagcagcagugcugaagccagggggugacaguaaggggcaugagcauggggcugggucacgcuggcagcggcgacuuaggaugaaguaguagagaaaaaaaucguagaggauuuucaagaucuauuucuugguaauuuccaaagucucccaugaauuacucugugagcauugguuguggaaugcugcuaccagccagaucuuuucccagcccugcuuuugcuguuauggugucaccuggccuagccucagcuccccccuccccuccuguuucugcccccuuucacauugcuaauguaaugagugugucacacugucacuaagcccuaauguuccaauuuuagauuauguauucagcaguggcucaaacauaccaaccaccuaaggcccuccgugaucauuagaaggaagagaaccccaagaugugcaaauuuacaacuuuaaguuccuguuuuuucuuaaacaguaaaacauuuuuaaauauuacaaaaauaucagacaauuuaaaccaaaaugaaaaccaagaaaacuguaguuucagccucugcgagcaauguucuuuguauacuuuccagucguuuucaucucauguaugguuuuaaccaaaaagagauuggugauagcuuauuuuguaaccuguauuuuuuucacuuucaaauuauuaugacaauuuuuuuauaucaauagguacauuuccagagcauccuuuuuauggcuguauagucuauuaaccauaugucuugcugcauuuuuuauuaguaaugaugacagcuaugcuuuauugaauacucuguaccaggcagcaucuaccaugugccuuacacucaugcacuuaaauccccugaagccaggggguggggccucugguuauccuagugacaagguccucauucacaggccccuugcccacguggcaagcccagcagcuggacuccugagccugcacuuucccaccuccauuugugcauguugauuccacuguuauggccucugcccuucagucccgaaaguucugaaaucaccauucuaaccuggaacucaugggauugguggaguggggaggugagagggagguaggaagugaggcggguaacuccagaacacaggaggcccgauggaagcugcaguguuaccauaaugaucagaucagccuagccgagggccuucucagagcugcugaaccccagcccaacuccagugagaagcaggggaaacuaagugcuggcagccucacagagaacgcccaggucaccccucucugcugccauuucuccugaggcucuuuugcuacccuggcuagagcugccuugcagcggccccuguuucccucuacucagaguggggagcggggccaggaaggccuuuuccccaggucacgggccagccuccacuucaccucucccugacagcuugugguugacagcaucaggcagcaggaggcugagccacuggccccucucugaccccgagugucaggucuuauguuaguaaaaugucugacagccgucuguucuggagagucugggcauuccagcucaccuuuguuuacaggguguggagcuagccccgaacugucuuggagugcacugggcccaccuauguguauauuucuggggauaaaauaucgggggcuguagcugagccaggucaacauucacuccuggagcccugguggagguguccuggugaaucuuuguguuucagguucaacuugccucgaacccugugcuggaugccugguacggugcucgugacugggccuugaaccaccuagaugauaaugaaguuuggaucaccaggaaagaguaugaagaaaagggaggagaguaccucaaggagcacugugcuuccaacaucuauguccccauccgccugccgaagcaggccucccgcuccucagaugcccaggcauccagcaagggcuccgcugcugguggagguggugcuggugagcaggcauagcagaggcccuccagagagacugcccugcacgccaugccuugggccacguuggcagugugacaggacugugauugugcuagauguaccugcccaagucugcuggucacauuuggcagcaaaauggauuucuccuggggagaacaaaguuaagggacacugagaccugcccuucagaauucgguucacuugggggcuucugugguagagacuaacuggccuucugaugucuuuguucaacuguggccagcuguggcaucagcuuccuggagcaguaaaugaagacagaguggaggacacaaauguacaaaaugcacaagacugauuucuuaccacauuuuagucuuucuuguuuuaaaaaaaauucuuuaaaauuuaucuuguccguguagauacuuuauucuucuggauguauucagaaauugcaugaaugcccagugaggggaggucuuucaugcauauaaaaagguaauguuuauugccgggcacaguggcacgugccuguuaaggcccagcuuugugggaggcuaaggcaggaggaucgcuggagcuuaggaguucgaggcuaucgugugcugugaucgcaccugugaauaaccacugcacuccagccugggcaacauaggaagacau

SEQ ID NO: 191267 - RNA, 23993 nt, Homo sapiens
augucuuccuauguugcccaggcuggagugcagugguuauucacaggugcgaucacagcacacgauagccucgaacuccuaagcuccagcgauccuccugccuuagccucccacaaagcugggccuuaacaggcacgugccacugugcccggcaauaaacauuaccuuuuuauaugcaugaaagaccuccccucacugggcauucaugcaauuucugaauacauccagaagaauaaaguaucuacacggacaagauaaauuuuaaagaauuuuuuuuaaaacaagaaagacuaaaaugugguaagaaaucagucuugugcauuuuguacauuuguguccuccacucugucuucauuuacugcuccaggaagcugaugccacagcuggccacaguugaacaaagacaucagaaggccaguuagucucuaccacagaagcccccaagugaaccgaauucugaagggcaggucucagugucccuuaacuuuguucuccccaggagaaauccauuuugcugccaaaugugaccagcagacuugggcagguacaucuagcacaaucacaguccugucacacugccaacguggcccaaggcauggcgugcagggcagucucucuggagggccucugcuaugccugcucaccagcaccaccuccaccagcagcggagcccuugcuggaugccugggcaucugaggagcgggaggccugcuucggcaggcggauggggacauagauguuggaagcacagugcuccuugagguacucuccucccuuuucuucauacucuuuccuggugauccaaacuucauuaucaucuaggugguucaaggcccagucacgagcaccguaccaggcauccagcacaggguucgaggcaaguugaaccugaaacacaaagauucaccaggacaccuccaccagggcuccaggagugaauguugaccuggcucagcuacagcccccgauauuuuauccccagaaauauacacauaggugggcccagugcacuccaagacaguucggggcuagcuccacacccuguaaacaaaggugagcuggaaugcccagacucuccagaacagacggcugucagacauuuuacuaacauaagaccugacacucggggucagagaggggccaguggcucagccuccugcugccugaugcugucaaccacaagcugucagggagaggugaaguggaggcuggcccgugaccuggggaaaaggccuuccuggccccgcuccccacucugaguagagggaaacaggggccgcugcaaggcagcucuagccaggguagcaaaagagccucaggagaaauggcagcagagaggggugaccugggcguucucugugaggcugccagcacuuaguuuccccugcuucucacuggaguugggcugggguucagcagcucugagaaggcccucggcuaggcugaucugaucauuaugguaacacugcagcuuccaucgggccuccuguguucuggaguuacccgccucacuuccuaccucccucucaccuccccacuccaccaaucccaugaguuccagguuagaauggugauuucagaacuuucgggacugaagggcagaggccauaacaguggaaucaacaugcacaaauggaggugggaaagugcaggcucaggaguccagcugcugggcuugccacgugggcaaggggccugugaaugaggaccuugucacuaggauaaccagaggccccacccccuggcuucaggggauuuaagugcaugaguguaaggcacaugguagaugcugccugguacagaguauucaauaaagcauagcugucaucauuacuaauaaaaaaugcagcaagacauaugguuaauagacuauacagccauaaaaaggaugcucuggaaauguaccuauugauauaaaaaaauugucauaauaauuugaaagugaaaaaaauacagguuacaaaauaagcuaucaccaaucucuuuuugguuaaaaccauacaugagaugaaaacgacuggaaaguauacaaagaacauugcucgcagaggcugaaacuacaguuuucuugguuuucauuuugguuuaaauugucugauauuuuuguaauauuuaaaaauguuuuacuguuuaagaaaaaacaggaacuuaaaguuguaaauuugcacaucuugggguucucuuccuucuaaugaucacggagggccuuaggugguugguauguuugagccacugcugaauacauaaucuaaaauuggaacauuagggcuuagugacagugugacacacucauuacauuagcaaugugaaagggggcagaaacaggaggggaggggggagcugaggcuaggccaggugacaccauaacagcaaaagcagggcugggaaaagaucuggcugguagcagcauuccacaaccaaugcucacagaguaauucaugggagacuuuggaaauuaccaagaaauagaucuugaaaauccucuacgauuuuuuucucuacuacuucauccuaagucgccgcugccagcgugacccagccccaugcucaugccccuuacugucacccccuggcuucagcacugcugcucucuccugcuccccacuccucuuccuccaccuccuucuuagacucauggguguccuacagcccuuaaaugcuaguguucuuuagggguucauccuuaacaucacuacccucccaaagagugcccagagcacauuuuauguuuguggcaggugggagggugugaaacuacccucuugcuuucccccuuacccaccgagcgcucauccagcuagcuguggccaccuuuucguguguccacuggaaacucaacccacccuggaaauggaacguacuauccucucccuuaagccuguccucccucccgcggcuccucguucagugaaucucuuaaucagcaaacuaguugcuccacuuagaauuuaggaauuaucuuagguccgacuucccuccccagauccaacuuacuaucaagcucugacaauuugacugccuuagccucuuucacaucaacucccucucuuccucucccucugccacugcuuuuguauuuccugcagagcuaccaaguaauacugugccaagggcuugggacacuuuucacaagacaguggcugucucuucccuuacaagagguggaucuuguaaggaacauagggaaagacagggaaggcuuccuggaggaagugauuuccaggaaaccagccacugagaaagcuggaugaggagaaagaguauucuaugcaaagggagccagcauguacaaaggcccugaggcaggaaaacucuggaaaacuaauagugguuagcuguggcugacgagcggguggaagggggaaugaugagagaacccuggacaguucuuaaggucagaacacaagagacccuguaaauccuggugaguggagugaggacuuccuccuagaggcugggaagcugccuccuaacuggucugcuuccaauauuucucuuaauacucuauuuugcacaacagugucaaauauaucuuacuaaauguaaaucagaucacauucccugcuuagacuccuucaugguucaucacuauggccuaaaaauaagagcugugcagaaaagaguuaacaggaccacccuacuguuaccuuagaaaggcauacuuacaaggguggggccuugguaggcaucugggaacuuggauauugggaggguuccuaccaccaccugauaagaauggcucaauaagcccauucacacaaauaaugugguuuaugccaaacacgugcuucccuucugugagccuggaauuuggguaugcuccaagcagggggugccuaugugaucagcccccaaauaaaaacccuagacacugcgucuccuacaagcuucccugguuggcaacacuuaaugugcuuuuacaaggcacugcuggggaaauuaugucuugugugacuccacagggagaggccucggaugcuuacaccugguugcucccagauuucaccccgggcaccuugucucucugcugaguugcuguaguaagucacagcuguaaguaggauuacaagcugaguccugugaauccucccagagaaucauccugccuggaauggucuuagggacccucaacacaacagcucaugucugagaguuuauuacaugcaggcccacugucgggcgcuugacaggcaccaguacacugaaucccagcaacagguaccgauuacccccuuccuaccacugagacagccaaagcuuagcacaauucaguaauggugaugauggagucagcaccaaagcccagagacgccccccugaauguacacgacaucaugcagcaaagcagagcagaccaaggccaagcuucuuagcaggaugcacaggcucugcagugugggcucugcugaccucucuacguuacccaccuccucuccucuuuaucagccaugugcuccagcaacacucagccacuucucacucccucaacaagcuucuggccccugugcccuugcucaugcuaguccuucugucuggaacgcuccaauguaucccaugccccacaaugucuacaggggcccggacuggguaggagaaugacuuauuuuugauguacacucuuucacacucuuagaauucuacgcaugucuucaucuuccaauuuaaagaaaccacaaaacaguauauaaaacaugauucccauuuugcuuuaaaaauuaagcauggacuuaagaccagaagaaaagccacaaaaauguuaacaguggauauuucugcaugauuauuacuuuugcaaucagaaaacagguaaugcuauuuucaaaauaauugacuacucgaacaaucaguaccugaaaagaagaccggaagggucucaucuccaacaguuccuucuccauucuggcuuucaugccaggauacaucguguugccgccagugaggaaaacguucugaaccagcauuuccugaauguccuuuggguaccuaggaaagaaacaacuccuaauauagucccuuaacucaaauaucagaacgaaauguggaugcagaaauguaagcucucaguacaaaacagaaaaacuucuacacaaaaagcuaaaaaaaaaaaaaaucaaaacuuucauuuuucauuugugucucuacaaaacgccagcccaauguuuccaaacagccagacaaaaccguaaucugaauggucaacuuauuuccuuaacaugauuagaauuuuuauacuuuuauaauacauuuaaaaaauaaacuugaggauaaauuuacauacauuuugauaaagucuaacuaauuuauacauuccaguaaccaucacuacaauuaagacacaaaacauuuccauuauccccaaaagccaugccucccuuuugagggcccaucuaucgaccugugcuuucuuuuuaucuuuuuuaauaacagcuuuaucuaagacauguuugaucacuuuccaaccacugucaagacaaagcucaaagccacucaaacaaaguagcagcaacagcuuuuucuuccuugcuagguacaaguuucccugccguuaugaccaacagcagccagaguccuacaaaauuccauucucuacuugcccaacuugaauuaucaaauucacacugcaggaaaaugcccgcauaaauggguaaaacaccuggauucuuauggaaauguaacucuuaaauaaguaaaaugccugcaaggaggggaaaaaaauuuuauuagcucugcaauauuuuuagggugauuuaaaaucacuagucuuuaauaaugugaagguuuacauggaaaccaguguacauguuaucggguuguucaaacuuaaaagacacucuuaaagcuacucagucaacccagcauuuacagguucagaaaacaacuacagagccccaguuacgugccaggccuggugauaagagaugaagggaauacuaucugagcacagcaagucaaugaaaagaagagagugagaugcauuuucaagugccugaccaucaaaucuaccauucaaugcaaaauccaaggaaaugguucaggaagauagaaggaaaagcagauucgcugucucaccuguccagaauguacugaagagucucugcaaucccagccuguucuucuccuaugagagauggcuggaaaauaaucucuggagcucgaauucuuucugucccaacaaauagcugaugauaugcugccaaguuaaacacgggcuuuaaaaacccaagguuuaaaagauauuuuuaggccaaaugacaaacauuccaguugcuaguuuccucaaacugcguuucuuaaucccaauaguuucugucccuuguuaaugccaguauagcuucucccaacucucuugaccugcuaauucaauuuccuaccuucuuccaaccuguguauuauaaacauguacauguuuccaucaugaaaugguccccgaguugcagggagaggcuuuguggagagcagcaguaaaaggccgagucuagaggacaagucuccugcucagugccuugcuuagugcccuaucccugcacggcaaggaagcucucucccaggugggucucagacucaggacaguuuaucugguuggcauuguaaugacagaaacauagauuccaaagaggauuauguguacuggcauuggcuuaaauguaaaugaaacuauuacaagccaguauucagaucucaaguucccaauuacuuuaccaaauguuucugccggguggacuguuucucagagauucacagaucuugguacuagaaccaaucgaucaaucaccgggggaaaaaaaucccugauuucagauguuuuaaguauugguacccaauuuucuaaaaaacauaacaguuuuaaguccuaaagaaacagacuagcccagccauuuaggucaacaccuucaaagaauaagcauguucugggcuguagaagucaaaccugaacaguggugaccggcuucuccacuccagguguuuccucugaaaacaagggaucaaaaucauucaugcuuuccacaucuuccaaagacggcuccagcugcuccaggucaggggucuaagagaaggagcaaaaugaaacagaaccuguaccuucagcaggccucaguucuaucauuuuagugccacaaaaaagaacugggaucuugcccaauguucuaaaaccuuacauaaaaacuaugaaaauuuuucuaagcuauuuuuaaaaaagcacacaugaacacgaagacuaaaaagccaggaacgggcuuugcuuugaucuccuaccuuuccuacuuuauacaagccucaccaacccccgccuucucuaaagccuucugauggugccagcucauggcugggccccguggaagacuugcugcuugcaugagucacaccaccacacacgcaacucuaagagaagggugugacagcugcuauccuacaaggcagcuagacuaccagcaaaguuaaagcaaucuuuuaauaauuaauaaauacaucugcuggccagggagcaguggcucacgccuguaaucccucugcacuuugggaggcagaggcaagugggcuccuugagcccaggaguuugagaccagcgugggcaacagagugaaaccuugucucuacaaaaaauacaaacauuagcugggcgugguggugagcaccuacagccccagcuacuugggaagcugaggucgaggaucacuugagccugggagguugaggcuacagugagccaugaucaugccacuguaauccagccugggugaaagagcaagacucugccucagaaauauaaauaaauguaugugccaacgcuaaugagcucaacaaucagucccuuaauagcaggucccacugggcugggaaugcgacuagaggcuccaagguagcagagugcuugcuaucuguggaguccugcagaacaaguucccucuaugaccacaaugaaccuggaaggggucuagacaugcuggcaccauuuccaaaagagaaguuagggugcuuuuaauuuuaaacuguacaaaauaaguuggggaugguggugguucugaaagacaucuuuagccaucugucauuagacucaauggagagaaguucuggguagaaauauuuaguugcaucccaaggaagaaugcuguaacaaugacagcugcugcagaauggacugucuuaugagguagugucuugggaggguucaagcagaguguaaccaaagccaaguaugcuugagaggagacugcgccauugaguaugcauucugagucucuccuuacucucggaauuuaugaaguauguaaaucaccaacauaauucagaggacuuaaauauacuucucuagaaccuacucauauauacugcaaauguaaacuagcauuaaaauaaggcaauaccccucaauaccccacacacauucacacaccaaaagucauguggcaaauauggcaugcaagaugggugacaauguacucuaaauucuguucaguauagaugauucuacaguauuugagggggauuuuccaggcuugaggauaaacccuggaaaggaaagugaauguuucuucaugugagacuugugcacaggaugagggggcugguuuauagagguaaucugaggaggaggaagauggguugggugacacgaaucuaaagaaccuugcucucagggaaggaagcaaaagcugucccugccaauacugaaucagacaaagaggggagggacaccugcuaucugcacaacccucacugcagacauuacuguauuugaugggugaggaugcuauggcucagagaggugaaguaacuugcccaagaucacaucacacuaguaggcaguggacaugugggaagaggcagaacugcucaguuccaaagucuuuguucugccuuaagcuggaguucuauaaaucaugaggcuaaggauaagacaauuggggcuuuaggaacaugaaaacaaucuagccugaggucagaguagguaauacaagagaugaaugaaagauuuuacaugcagcagcaagaccagcugaggcaaugacaggcuccucugucccagcagggacagcagagagggaguaaaggaacauuccccuugccaucugcaguuugugaucuggaagacucucagcuucccucacaagaaaggagcccuaccaugggagugucugugccuauucuggcuuggcaccaaacccagcucuucaggaaugaccccaaagggguuccaggggaggaauggaaauuaaucaucaaaguucuuuuucauuuggugguuugucaucugggggaaccaggaaccaggaggcagugugacauaacagaagguggucaggcucuggagucacacugauccagcucggaauggcaaccaaagguauauuaaaggucacaguacuagagcuggaaacaguacacucugagcugcuucuccaucuauguaaaagugggacgugaacuuagggcagcgucgggugagaaacgaacaacgcuucccucuucccuuuuaaacacacacucaauuuggucccuuaaauaauucuguuguauuacuggguugaagacaaagaugucaucuguguauuuaaaauaacuacagacaaaaccuguaaccugugauuccccaaguaacaggugaaagcaagcacugggcuccacuggaguccuuccucucuacaucccacauuuuuacccuauucuucaucuucauccuaaccuccacuccagccucccucaauccaagugaugaccuuuccuguggauucacaugcccuucucuacccagccuggaauccaaucacuuuugccgucaucccuccaccaacucuaucugcuucuguuacacccaaccaguaagccugcagucuaaaggaugccucccaguacucuuuccacuugggcuccggagcagauuauauuuuuaaaagaaggucacaacagugacuucuaucccacacacuuuucuguaaugugaccuugacacuccccaaacagagguggagggucuuuguuuccuccccuugagucucagugggggacugugaggacuacaaccaacaaaguauggugcaaaugaugucaugugacuucuaagguaagguccugaaaggucaugcagcuuaugcuuucaucuuuugaaacauucacucucuagcugcucucuugggaagcucccucuuggaaaccaguggccacacugggaggagcccaaggcacaccaagaggccauaugugggugccugggucaagagucccccaugaacccagaccuugaguccucccagcccagauaccagacagguaaguaaaaaacccuccagcugauuccaguccccaacuauuuaauucuucccagcaguggcuccaggcaacuugaagcagagaucccuguagccucucucaauuccucacccaccaaacccaugagcacaauaaaaugguugcuguuuuaugcugcuaaguuuggaaugguuuuuguagcaauagaaaaguuaaauaugcuccaggggggcaggagugcagaaagucccaggugcuauuuaggcaauccugugguuacuucucagcuuccuucugccugcccuuucccaacacccuucuccacagucuccuuucuaaucucaacccuggaaaucuuaaaagaucaucuuaguugccucaaaaaaugaacuucccucuuuauucuucauucuacuuccuuaucuauuuucauguccuugagcgcuuguuuggagguucuagcaggggagcgcagcuacucguauacucuugacggaagaucaguccuccucuauuggggauggucguccucuucgaccaagcaugcagcuuugggagagacacacacgaaguggugaggacagaaagacaccagcuuagccagccagaucagccgaaucaacccuggcaaucaauggggugacagauaucgcagccagaucacccucacauccuauuuucuuauccuuucaagcuuuccuuguuucaaaaaauaauucucauccuagguuaagcugaccauucaagcuuuuaacucucccaucaacccuuuuggcuuccuuuaucucuuacugcuccugcucaaucuucguccuggcuuuucuucugucaccuaacuuucaagugguggcauucuccaggaauuuuucuuuucuuccuccccauuugauucuguccucccauagcuccaccugaugucccacagagugcugaaaagcuccaccugauguccuacaacaauuuuaaagauaaggagcucagggccaggcacggugacucaugccuguaaucccugcacuuugaaaggcaaggugggaggcuugcuugaggccaggaguucgagaacagccugggcaacacagugagacccaucucuacaaaaaauuaaaaagcaaaaaguuagccgggcaugguggugcacuccuguaguccuagcuacuagggaggcugaggugggaggaucaauugagcccaggaguucccaaaacaaaaucucaucgucucauucccuugcucaacaucccuggaaggcuccgaaugucugaaggauaaauuacagugagccaucaucacaacauauacuccagccugugcaacagaguaagauccaaucucuuaaaaaaaagaaaaaaaaaaggugcucaaaacuaagccaauuaucuucccaaacuuggucaaaaggcacuaccaucuacccacugccuuucaauacagccuaaggguuacaaggguggaaucuggaauugaacugccugugugugaauuugaucagcacuacuucuagcuaugugaccucacuccaaaucuuuccuugucuguaaaagggggauaaugauaguaccuacccauugaguugugaacacgaaccaggaggacaccuacguaggugcucagcaaggagucggcacaugccacaugcucuauuaucaacacugcuacucuugucaccuuggcuugcaaauggcagcgagaucuugggauccuacaucugauccuacaucuguuuuguuuucccaccugcagucucaccccucccuucaacccaucauccuaacugccaccaguuaguuucccaaaacaaaaucucaucgucucauucccuugcucaacaucccuggaaggcuccgaaugucugaaggauaauaugcaggcucauaagacugauggguaaagaacuuaauagucaucuccacuucaucacccaccacagcuuuucuuguucacacucuauaugccugcaugugugguucuuuccaccuaaaauguccuucccuccuccuuuugcuaccuacugaaaucaaauaaucuuccuuuucuuuuuuuuuuuuuagacagggucuuguucuguugcccagguuggaaugcaguggcacaaccauggcucacugcagccucgaacucccaagcucaagugauccucccaccucagccucucaagcagagacuacagaugcaugcccagcuaauuaaaaaaauuuuuuuuagagauggggucuaugugacucagggauuggucucaaagcgcugggcacaagugaucuucccuccucagccucucaguguugggauuacagaugugagccacugugcccggcccaaauaaucuuucaaggcccagcugaaacauccaguccuucucaaaaaaccaaauguguauucccacacacauuuaccaccauaccugcuacgcuucauuacagucagcuaagcauggugcuauagcccucauuuuuuguuuuugagguacccaggaaggcaggcauuguaucuuaaucaccucugcaucccugguauacugcaccugucacugaguggugggccccugggauacacccucaaauuccccugaaauagagaugauuguaaagcuuuggguuucaagagguuucuucagcugccaaaaaaaaaucaacauucaccuucaccuagcuucacuccaaagcauaccaucuuaagauaacuucuuagcuucacaaaaauuauaaaaaggacauuuauuuaucccaauucauacaagucgcagagaggaacaaagcugaucauuucaacacagagaacaggcauccaacagagaauaguuuucucugccacggcuggcuucucucucgcuagaguuugccagggucuccacaugucuuauguggcguucagaaacacuaauaugacuguucuuuuggaacugcagggaaugacaguuugccaaggcauaccacagaagaugcagcaugguucccuaaaacagccuugagcggcauaagaagaagcagaggccaacccugaucuuggcuaguaaagccggagaacuuucuauauuuggcccauugcguuuuccaacaaaugaugaugcucaaaaccuguguucuccccccuccuacccucuuaugcugugcuuguagcuaugaaaagcaagcaucuucugguuuaaauacuugguaaaaaugcuaacaaagccugcuccuucacaacauccucacagaaacaacugcagaauagcaagggucagaauagauuggucuauaagaaaaaauagauuuucgagaccucuauuaguuaaauuccagcuguauuaauucaguucagccauuacugcuuaagugcaauuucaauaugaauuuugguucacauauauugauucaauucauucuaaaugaauuauauuauuggaaacucuacaaauacuuuuugaaugguagaacuggcuagccauugucauggucaaguuuaucccacaaaugugacuguaauugacucugaucauuaagaauuacccuaaaaugcugaaugcugacuaaccauuaaagcuuugacgacugaucaucacuuuuuuuuuuuuuugagacggggucuugcucuguugcccaggcuggagugcaaugucacaaucucagcucacugcaaccuccgccuccuggguucaagcgauucuccugccucagccucccgaguagcugggauuacaggcgccugccccgacgcccggcuaauuuuucuauuuucaguagagacaggguuucaccauguuggucaggcuggucucgaauuccugaccucaggugauccacccaccucggccucccaaagugcugggauuacaggcgugagccaccgugcccggcccaacugaucaucaaauuuguugcauauagaaaaaucuuuugcaguccggcauuucaaaauccccuaaacccaaggagauuuaaauguguguaccagagcauaaaaugaaguagguaccuacugaguaucugcugaaagaaugggggaaugggugaugaaucacaucauguaacaaaugcagacaaaugaacaaagaaaaggaaaaacuaguuuccccacugcugaagaaucacaucuucacagcuguuugguuuuuuuucccuuuuugaaaucugaaaucccucaucugcuuguggcugaguggcacugcucugguauaaagaaaacuauguccugcuaacaugucaagcaugauaaaaacuaaauauggaugaauacauaacaaagacaacaugguuccggauuucaguaaacaacaacucaaaucucaaagaccugaaaaaccaagagaagcaaaauggaaaaggcacacacugauucaacugaggcugaucugggaugcuguguuggaagaagaugguaaaggccccuucuacacaagaucuuggugauccaauaagguguaucuaguaagccuaucucaggaucugcucuauaaagcauacacucauguacuguccucacauaaucgacagccugggaaugagauguagaggaugcaacggugagagcagaaccuugagcgagccuccagcugggagcccaucacugcaaaagcaagcuuccuguugagccaaaggcaacucugacaucacugauaagcacuaugcuacacccagcaucaaauggcacugacuugcauuuuuccaaaguaucauuuuuuuucugaaaggauaaguaaucaacagcuuaaugaaagcugauuuaaaaaggaaaaaacaaaaaacaaaaaacaagaggcuagucugguuuauccugccuaaaacaugucucaaggcaguaaguuccuuuguuuuggaauucuagggaugacagauccaggaacaggauguacacuuacucuuuguuucaguucuaaaggcaggcgacucaaccagcgacuucuggacugaggagugaccugcaggcugccccuuugccauacaggaacuaagaugcuggggccuaagcucuuuuggcuacuucgacacuuauuaacagccaagcaugguggcucaagccugucaucccagugcuuugggaggcugaggugggagguucacuugaggccaggaguucgagaccagccuggacaacuuggugagaccccaucucuacaaaaaauuguaaaaaugacuuaggcaugcuggcguucaccuguaguccuagcuucuuagaaggcugaggugggaggauccacuuaagcccaggagucugagguuauauugagcuaugaacauguaacugcauucuaacugggcaacaaagugagacccugucucaaacaaacaaaaauacuuauuuauuuauuuauuuuuuuugagauggaguuuugcucuuguugcccaggcuggagugcaacggagcggucucggcucacugcaaccucugccucccagguucaagugauucuccugccucagccucccaaguagcugggaucacaggcgugugccaccacacucagcuaauuuuguauuuuuaguacagacaggguuucgccaugugggccacgcuggucuugaacuccugaccucagauaaucugccugccugggacuuccaaagugcugggauuacaagcgugagccagcacgcccggccucaaaaacacuuauuaacagugcacgggugaggaaacagaagaagaagaagaagagaaaaucaaagagcuuaugcaaagggucuuuagcaacuaauaaaaggcugaucuuaaggcaaccuauacauauauuauugagcauaacuaccaacugcuguaaaaaauucauaaaucauguaugaagcaugaucccuguccuuagggaacaucaagauggaaaggagguaagugaacaaucaaccacaauauauuuaauaaaacacuaaaagaaaauuaaaggaaguauaugacugccaaugacuaucaguggagcugguuuagguucaagacagcaccacagguuuggugugugaauguucuuccuacguuaaaugcacuuucugcgcucagggguccggggaucuacagggugaaaucccuucugacagaauuucaguugguacaaggucagugccaucuccaccaccacccacauccccucugcucucuuucccuccugacucugggcacaaccccuuugaugucaggccucucaggacacuccuccccucaagaagggcugcuccuuccaaggcccuaaguuaccucuggcuugcugucuaccacauccaccucgagguugacuuccgcuuggaggauuuucugcuuagccugcuccacugcuauacugagcuucuggauguaggacugcagcucuucuggggaguccauauucagcucuaucagagcuuugugaaacugauccaucuggccauccucuagaaguuccugaaaacagagcagucacaaacaggaaggaaaguagcuucaaagccaaacggagaaaacgacagcuggagagggcuuccagagcuccccuggccuacccugcccagagccacgccuccagcugccuccaguuucacacagcugcccaccucucugucucuaggcuagcauugcaucacaguuccagcaacaacugauuagguaaaacuaaugauggugacagaugucuaaaagguuguuacccuuuuuuuuuuugguggggcgggggaugugaaggaaggugggaaaguuacuaagaggagacaugaaaggagccuucuggaacgcugacaaugcuguuucuuaaccugacagcagauacacgggugaguuucacuuugaaaauccaucaagaugaaacauaaagauuugugcacuuugcaucauguaugcuacacuuacaaaguuuaaaaacauaaaggaguuuauaaggugaaaauaaauaaugcuggaguccacagcucuuucagaaacagcugcuucuacacuguauucuaugcugaugaucccccuggacuccuucgugaccccaaaggugacaaacagucaaagcaucuuaaggccaauggaaaaauaugcaagaaaaucuucugagacuaucuuguuaacacggaagggcgcccgucccugugucugcuauuaccugcacauauagcagucgguccagacgcuccugauccagcugcagcuucuccucccgccgccgggcauugagcuccugcagccgccgcaauugcugcugccgccuuucuuguuucuccucagaggucagagugcugcccaggagcuugcuggaaaaugggagcugcaucuuguggacauuauucucauaauaaucaggacaccgccauuuguguaauucuucaaagaaacaauuuugaaaguuaugaaauggaaacacuauuaacacaacaauuaaagucaauaccagcugggcgcaggggcucacgccuguaaucccagcacuuuggggagccgaggugggcggaucacgaggucaggagaucaagaccauccuggcuaacacagugaaacccugucucuacuaaaaauacaaaaaaauuagccaugcgugguggcgggcaccugugaucccagguacucgggaggcucgcccugucaccuagcuggagugcaguggugcgaucucggcucacugcaaguucugccucccggguucacgccauucuccugccucagccuccugaguagcugggacuacagacgccugccaccaugcccggcuaauuuuuuugaauuuuuaguagagaugggguuuccccauguuacccaggauggucuugaucuccugaccucgugauccacucgccucggccucccaaagugcugguauuacagcuaugagcccccaugcccggccgacuccauuguuuuuuuuaaagucaguaccagcauuucagacauaggucagauggagaaaauacacuccauccaaucccugaauccacucaaucaacuaaaagcagcuaccaaaccuggacauaaugccagcaggccuguucuaaaagaacugcuaaguaaguucuucagcgagaaacaacaccagaaggaagcuuggagcaucaggaaugaaggaagagcaacagaaaugauaaaaaucugguuaaacauaacagacuaaucuccuuacgaguucuuuaaaaccuauuugacaacugaaaguaaaaaucacaacacugucugauggguuuccaauguauacagaugaaauaaauaagacaacuuuaagauaaaccgggcgaaauaaaggagucuguacauugcuaacauuuccacauuccccuugaagugguaaauacagaaucuaaguagacugugaaaaguuguguuuacuguaaucucuaaagcaaccacuaaaaacuacaauaaaaagguagaguaaaaaacacaacagauaaaauacuuuaaaaaaaaaaaaaaaaagcucgaauaaccuaaaaggaggcaggagagagaaacagaggaacaauaaacagaaggaacaaaaacaaauaauaaaauggugaaccuaaauccaagcauaugaauaauuaaaacuaauuauaaaugguuuagucuaacaauuaaauagagguugacugaauagauuuuuuuuaaaaaucauccaacuaccaagaaauucacuuugaauauaaugauauagguagauuaaaaguagaaggacggaaagacauaccaugcaagcacaugacccagcaaucuauuuacucuggagaaaugaaaacaaguucacccaaaagcuugucucuaucccaagcccaggcaaucuuucccucacuucuucucuaucacuaugguuuuaucuuuucaaaaugucacauaaauggaaucaaauaguauguaccuuuugaaacuuuuuuuuuuuuuuacucaacaucaugccuuugagauucauucaaguuguugaguguaucaguaguuuguuccuguuuauuguggauaaaaacaggauaugauuauaaagagaaagcauauguaaucaacaccacaaucaggauacggaagaguucaucaucccaaaaaauucccucaugcucucucuuuauaaucauaucauagaauuguaaaagaaaaaguuaacuaaaaaaaaagagucaauaccagagcaacuggagaacagagaagugggagcacggagagcugugugccucagccgugucuucuggcaagccucuaacucuccggacugaguguccucaucaauuauuuauuucccuaucugucucccgcaacuucuuuguaucccaggaauaacagauguuuaauaaaugcuuucuaaaguuaauuaaaacacagcucuucacacaugaaacguauacuuaaaaaugguuaaaauggcaaauuuauguuauaugguuuucacaauuaaaaaaaaaagaugcaguuuuuguccuucaggagcucauuauuggucagcugagaucaguacccucaaugacaacaagcaaauccauucuuggaauagaguuguauucacaguggcauuguccguaguccuuugguuuuauaugaacuauuuaaauucacgaggaagauauuuucaucacauucaugugacaauagcaacuaaaacucauacuuuaauuugaaguaaaauacaaccaaaaguccaagacaaguuugaaaagaaaaagagguguuucugcagcauagauguuauuauaaggguauaauaaaacaauuucaauuguuuucuagcuuaagauauuuuuagucugauauguucugcucacucuuaaaaauauuuaauaucuggaaaagcugaaaguugugcaauuccaaguucuguauuaaaggcaaguuauaaaagcuaccauuugugaagggaaccuauacaacauaaguuaucaguuuacugaauaguuuaagaaagggaauacaaaaaggggaaggaggugcuuaaaaagugagcaagcaaagaaucaugcuggcaauaauuuaaggaauacaagguagacaacacccaaaagcugcaggcaaacauccucuuggauaccuuccacauaauccucagcgauguagcugugcucaugcagaaucuccuccaugcggcugagggugauggcugccaggugcccaggguacuucagcuggaggagacgcuggagguaaccagcugcuuggcuuccuccaagauugaugcgcuugcaguuuuuagcaucuaaucuauaaccaagcaguagaaaacagcacugaaauuucuggaggacagaaauauggagcaucuugggagaaacaagauaauuuaaggcagauaaagaagaaacagaccagcaggagaaauacaaaaccugauagucagaagggacguugaaguuccccugguauaaccucuuaucuaggcaggcauuccuagcucacccauacagucacacggccaccuaacaaguaugcacuccagucagaucuuaaugagucucgucauauauuucucaaacuguaguccugggaccagguaucccagaauuagcugggggaaauuuuaaacaugccaauucccaggacacagcugcucugggguggggccuggggaucugcauuuuaaugagcucccuaggugacugaaggccagaguuuaagaagcccucccuuaacacuccacaucuacugaagcaaacacguuaaguaaccacacgcauccugacuuacuguaaaagaaccagaauaauuuuauuuuccuaaugugagaaaguaaguggcagagcacuaggaacuuacuguagggaacuaaaaugucacugcuguaucauaccucaccagcagaugccagcauagaacacgauaugauucacucugauaauuucccagccuucagguaauuuucucucaauauaaaauauguuacuuuuuauuuuugcauauucuguuuacauagagaacuucauacaucaggagcauuugguaacaccuaagaauuacuuuuuucuucaaaaauuuucauagaaacuucaugagaaauucaaugguauuugccuuauauguucagucugcuuuacaguuuacaaagugccauuaccuaccuuaucucauuucauucucaggguaacccugggaaaucaguuuuucccaauuuuacguaucaggaaaugaagugaggaaguuaaguagcagagcugcaaacccaggcauucagcuguaaagcgugggucucuuugugccaaugugagaaaccucaggagaacacagugguggccuaggcucuuaucagacaguuaaagcucaacgauaaaguggcaacagauuuuuaaauaugacauaaacuacccuugccuuuuauucaacuugaaaauauuuaguaaggguccauuacgugccaggcacuguaccugaaaggucuaaacaauagugauuaaauaacuugaaauuggcugggcgcgguggcucaccccuguaaucccagcauguugggaggccaaggaggguggaucacuugaggucaggaguuugagacuagccugaccaacauggugaaacccugucucacuaaaaauauaaaaaaaauuagccaggaaugguggcaggugccuguggucccagcuacucgggaggcugaggcaggagaaucaauugaacccgggaggcggacguugcccugagccaagaucccacugcacuccagccugggcaacagagcaagacucugucaaaaaacaaacaaacaaacaaacaaaaacaaaaacaaaaaaaaaacaaaaaaaacuccagaacacaaagauggucucgauuaaauuuauucaaaacauuucuacugaaugccuacuaccugcagauacuauguuagcuaucuccccauuaugucagaauuauaauauuguagaauuauggauguggaacuaagagaucauccaccccaacucccuccagaaggucacaaaggacacaacuaugggcaaagggacuuacccagucacacagugagguaguucaaagcuaagcccaacggcucaguucacaggcuaguacuugcucuuucuacucugccuuuaaagcacgcaguaaauaaauguuuccugaaugcuucucaaaaucgcacucaaaugccacaagugcaacucaccucccuucuaagauggguaaaacaugcguacacugguauccagaugaaaugauuagcccacugcacaucgaguucuuuggcuuauugugguagaagcugaagaggcugucuauuccauaggcaaccuugggaaucccguagcacucaaaaagaagcucagacaucauuugccgugaauacaguggguugcacacagcuucugucaaaacuaugggaugaucaacacagcccuacuuugaaagaaaagggcaaauaaaugagugguaacagaauacucuuuuugaagcauaaaagaacccaaaauccuuauugcaggacugaauuugcuuuuggcuucuuaaucaaaaaccugaucagaggcgauuauaaaacucccaucucaucuuuacuugaaaauacgaaaguagagucaauuuaaguuauuaagucaaggucccauccaaacugucagcaaaucguguuggcucuaucuucaaaguauuuccagaauccaacugcuucuaaugacauucccugcuaucugccucaucuaagccaccaucaucccuuaccuggguuauuccaacagccuccuaacucgucccuguuuccacccuaugauccaagacaauucauucuccauacagcaguaauagugauccuuuuaaaacacaagucagguccuucuucagcucaacacccugccauggcuccccauuucacucaguaaaagccuauaaggugugugaucugccucuccacuaccucucugacauccucuuucagguacuacucucccccucacacaggcagccuugcaguuaggauuagggcacacuccugccucggggccuuuuuacuggcugcucccucugccuggaccguuuuuccuucagauauucacauggcuugcuaccugaaucaccuccuucaaguccuugcucaaacaucaccuucacgaguccuacccugaccaucuuacugaaaaaauguaacucccuccucuccuaucacggcguagaaucuacuauuucuauguuuacugucugccuuuucauacuagaauaucuuuccauaguauuaacagcuccauaagcacaggaaguuuuguguucacacauguacuccaaaugccuaaaaagugccugacacagaguaagugcucaauacguauuuguuaauaaaugggcuucuuaacaaacaagcauauaugcccaaagguaugcuccaagauacaaggagcagcauuuuauucgcugcuacacccacagcgccuagcaucuggucgacuaaaagacaaucggagcuacugaagugacuguuaccucuccgagagcagagugagcggagacgagaccgcaccccuccccucaaacccagcccagcccagccuacuccgcccuucaccugugaggagacacccaggugcuggaagcuguaguccagcagcaacuccugaagcuccagguugaccggcacguugcggucgaagggcgagcgcagcauccagcgcaguggcuccaggcugcccagagcguuccccaccugcgggcccgacgcgccccgugccccgccacgaccgcgggcgcacaccgcgcggaacugcaggcgcggcucgggaccuggguccugcccgggacacgcccagccagcgcggacuuggaacgacccguuguccagcaccagcgguaccggcaguggcccgugugccaccgggccggccuccagcacuggguccggugcggcacgggcgucgcggaacgggaacacguucgccgccaucuuggagcgcgcguccagccccgcc

SEQ ID NO: 191268 - RNA, 842 nt, Homo sapiens
uaguuuacuuugcaugucuuuuauucugaugcauugcacguucuuccaugcauugaugaggcgugugcuccuuccucagcuggcaguuuacuguccuggucugaggaucuucuggggacuggucucucuugcugacucuuucgugucauuuucacaaacaaccuuuugaggaaaaaaagucuuaaggacaaacacaugcuggcaauuagcgccaucgacauuccagauaucggggcugggaaggcagggugagaccugcugggugucaucguucugcucugaacuaggaggacugacuuucagaggguucucgguguccucuucuuccacagcgcuccuguugacacaaacagccucauguuccuccagauuuuugauggggaccacguggcaggcguuguauuugcagguggccaucuuuuuggcuuucuugggguucuuucuccugcacgaugccaggugguacuggaaucugcugagugggauucgguggugaggaucauaagggcaaauuucaaaggcuucuggcuccaugagaaauucuugaagcaggguaucucacugcuagagucuaacggaaaugcuucuuguggagaagcccuuuuguaagaaggauggaguuguccucugcccaguuuuggcccuugggauucuguaggugacggucuuaacuuguggucuguucucuaggacugugagugguggauuagaagagagaugaggagcugccaaaagcagcuacacagagaacagaguuagcaaauggcacccgagacagaacuauagcagaugcaagagccaaaaacccacagccgcuugacucacggauauacuaugauguc

SEQ ID NO: 191269 - RNA, 22826 nt, Homo sapiens
cauccgugcgucuguggaaggcugcguuuccggccugagaaaccgucauguuucuggggagucaccucagcuggcaguuaccaccguguuagaaagcagccucaggaccggccaccuccaucacuggcgucaccaugggggcugugcugggugucuucucccucgccagcugggugaguucggggucccgaguccucgccggaccugcgguuugcggggaaaggccucgagaccagagcugcacgggccuuggcuccagaggcucucgggaugucagcaggcccugggcuacagagggucuccggggccccagacgcaaauccgcgauacccucagguccagcuuaggcggcucgcccuccggguuccucggggaacggaagaggcuaggccgccauuguuuacaauucggauggcuccgcccugcgaggcuuccugacuagguuccucuggagcuggagagggaccaaggaaugacagcucccagcgaggggcuccgguuccucccgaagcaccucuuaaggugccaucauuuaguucuagguggcucaaguaauauuuuuauccccuagcacgggauuugccaaaacuacagaguguguggcaaagcugggguuuuagcggaggcuugucugcaguucaggugcaagggaaagaagcccuuguggauuguuauucaaaauuggaaaccagggccugaauauuuugggacugcuguaagucauuuauccgaggauaaucaccccagcauuccucucuucgagaacgauugugacagugaagugaagguuuaaucaccuuguaaacuguaaacauuuuaaagagaaaauuauagggccuauaaaagaauaugcugaguucccucauuuacccacuucagaggagcgugauuccuugauuccucauucuccagcugauuuaauugaccaaguguguagaaaaagcacacucaguuucuccugcuguacucacaacacacuuuugacaccugaugugugguguguggggauuuucccccaaacaucaggcaaacagucagcucugcaggggaugccaacuuggugcccuacaagucaauuccgaagcucucuacuuggagauagcaucaaaucacacaaguggagggcucagucucacaagacugugcccacuuucugugccaauggcaagccucagguuguuuuaccugugcuucugaccggccaccuauaaaucaaaguucccgugaccucccuccuuggcuuugauuaauuuggucacaaaacucaaggaaacauguuuacugguuuauuauaaaaguauuuuauuuuguguauuuauguauuuuuaauuuuagauucagaggguacauaugcaguuuuguuacauggguauauugccuuaucgugagguuuggguuucuaaugauuccguugcccaaacagugaacacaguauccaacagguaguuuuucaaccccuauccccccaccguccuuccccacucuuggacucuccaguguuuauuguugccaucuucgugucuguguucccaguguuuagcucccacuuguaagcgagaauaugcuguauuugguuuucuguuucuguauuaauucacuugggauaguggccuccagcugcaucuuuguugcugcaaaggacaugauuuucuucuuuuuuuauggcuacuauuaauauauuuuuaaagauacagaugaagugauauguaagacaagguguagagggaacgggucuggagcuuccaugcucugucuggggcaguggcgccaucucggcucucuucaaccuccaagggauucucauguuucagccucccggaguagcugggauuauaguguaugccaccacgcccagcuaauuuuuguauuuucaauaaagacgggauuucgccauguuggccaggcuggucucgaacuccuggggugugagccaccaugcccagccaaaaguucuucugaacuuuguccuucugagcuuuuaugcaggcuucauuauguagucagcauucauuaaaucauuggcuuuugguuacugaccuaaccuucagccccuccuuggagggucaggggugagacugaaaagucccaaccuccuacuaugacccucacccaucaugaagccaccuaggggcugccagucaccagucaucucauuagcauacaaaaagacgcugguuauuccaaggauuuuagaaauuguaugccaggaaaugggaaccaaacauacauauauuugacaguauuacaccaaggauucuguuucagcucuuucuacuauuuuucuuuuuuuuuuuuggagggggacagaguuuugcucugucacccaggcuggagugcaguggcucagucauagcucacugcagccuugaacuccuggauucaagugauccucccaccucagccuucccaguacaggugugugacaccaugccuggcuucauuccacuauuucuuaggaacagaauguauuuuaagguuguugguccuaaaucaaaagaguguuccauuuuuaagggcuuucuugagagcagugguuuucuaauuauucugaccuugaccuaaagaaagauuguacauaguugaucugugaucugaugcacccauauagagacaaaguuuuaugaaauaaucguuuacuguacaauuuuucuuuuaucuucuaucacauuagaaaauccuggugaguugaaggccaggcaugguggcucacgccaggauggucucaaucuccugaccucgugauccgccggccucccagagugcuuggauuacaggugugagccaccgcgucuugcccggcuuuuacucuuaaguuauaugggaaucuauuacagaguuugaaaaaaggagugaugugaucugggccuguguuuuaacgaggugguuucugguugcuguguggagaauagaugguagaaaaguaaagguaaagcaguguaggcugggaagaaucuuccuccagccuuuuggguucuguuucugggggcuugugaauuaaacugacaaaacagauuauuuagaguuuaugcaugcaagacauguacacacaggagugcucaguaauaguaacucaaagggggcgguuagaacuugaggcuuuuuuuuuuuuuuucguuuuugagaaaacaaguuccacucuuguugcccaggcuggagugcaauggugggaucuuggcucacugcaaucuccaccucccagguucaagcgauucuccugccucagccucccaaguagcugggauuacaggcaugugccaccacgccuggcuaauuuuguauuuuuaguagagaugggguuucuccauguuggucaggccggucuugaacucccgaccucaggugaucugcccaccucagcuucccaaagugcugggauuacaggugugagccacugcacccagccaaggcuuucuaauuuaguaggaaaaaggaagcugggagaaaggcuucuaugagaagaacaaauagguuucuuuaggaaagacaaguuuuuuuaggagaauaaauaggaaauacguuugugguaguacuuguuuaugcagguauggugggucuuuccagcuucuucaugaucuuaaaacugcccuggagagggacuuuauggcagccucguuucccagaaguugcugcuuuuagucagauaagagaagcucccagaaggcuuuuuuuuuuccucugcaucuguugaagcucagaugcuucagcuuaaaagcuuaaaauaaucuuuauaacaauucagggcuucuuuuuuuuuuuuuuuuuuuuuugaggcuaauuuugcauuuuuaguagagacaggauuucacuguguuggccuggcgggucuugaacuccugaccucaggugaucugccugccuuggcuucccaaagugcugggauuacaggcgugagccacugugccggccaacucagagcuucugaaugggucgcuacagcugugagaugggaacuuuugcgcuuaauccagaugagagaugauaguuguggcuuggacaaaggugauagcuaaggauacugugaaaauggucagauucuggauauauuuuaaggguagagcugauguacugacagauuggaugaggauuuugggaaaagggaaggcauucgggaugacuccagguuuugggcccaagcaacaggaagaauggaguugucauuuacugaaauagaaaaaugacauaacauauaguaggacagauuugucccacagauauuuacugaguaccugcucuguaaagauacaaaagauauaacguuguaaagauagucuccccuucgagauauuuacauucuuaagacaacuauagguaaguaaguuuauuaguuugccagggcuuuauaacaaaguaccacagaccgaguggcuuaaacccagugauuucuuaucucugaauucuagaggcuggaagucugggaugaaggugucagcaggguugguuccuucuaaggguggugagagagaaucuguaucaugccucuccccuggcuuuuuuuuuuuuugguuugcuggcagucuuugauguuccuuggcuuguagaucucugccuucacauggcauguggaauucucccuguguuguaagccuuuguccaaguuuccccuuuuuauaaggacacaguuauauugaauuagcugcucacucuacuccauauaaccucaucuuaacuuacuacaucugcagugaccaaguaaggauacauuuugaggaauugggcauuaggacuucaacauaagaauuuguggaggacaugccucugcaguguuuggccuauacuguaguuaagaauuggagacugagacuggcuggucaauuucccauugcuauugcaauuacaaauaauaauggcuaccacgauauauugagccugauaaauaugucaggcauuauacuagguucuuuauauuccugacaucaucucauucuuugcucaaucacccuguucgaguaggugguauuaugcucauuuuuacagaugagaaaacugaacuuuuuuagaauguuagcacccugcugcaaaccacacaaaauuaucauaaagugcacacaagauaccaucuauaaaaaaaugaagauuauuccugggaccauauuuuaagaccagaguuauccauuguuuacuucugcuaauucugaauuagcuuguccuuguaauaugacuugauaaugucacccccucagagcaauuucaagcaguuuccuaaucaagcauaaugacucaaauuauauccucucuuagcugggcaugguggugcuugcuuguacucaggaggcugaggccagaggaucgcuugagcccaggaguuugaugcugcagugagcugugaucacacaacuguacuccagcuugggcaacagagugacgccuugucuuuuuaaaacaaaacaaaacaaaggccgggugcauuggcucaugcauguaaucccagcccuuugggaggcggaggcgggcagaucacuugaggucaggaauucgagaccagccuggccaacauggugaaacccugucuuuacacaaaaauuagcugagcaugguggcacgugucuguaaucccuguaaucccagcuacuugggaggcugagguagaauugcuugaucccaggagggugagguugcagugagccgagauggcguuacugcacuccagccugggagacagagugagaaccugucucaaaaaaaaagaaagaaaagaaaaaaagaaauaaaauuauaucuucuuucauguaguguggucacuaacagauuuuagcagacuaaagaucuagguuacucuuuuuuuuugagacggagucucagucugucgcccaggcuggagugcaguggcacaaucuuggcucacugcaaccuuggccacccggguucaagcaguucuccugccucagccuccugaguagcugggauuacaggugccugccacugcacccggcuaauuuuuguauuuuuaguagagaugggguuucaccaucuuggccaggcuggucuugaacuccugaccuugugguccaccugccuuggccucccaaagugcugggauuacaggcgugagccaccacgccuggcccuagguuacucuuuaaaaaaaaggagguaaaguugacauaaaauuaaccauuucaaaauguuuagugggccgggugcaguaucucacgccuguaauccagcacuuucgguggccaguguggguggauugccugagcucaggaauucaagaccagccugggcaacaugacaaaacccugucucuacuaaaaaauacaaaaaaaaaucagcuggggguggcauugcacaccuguagucccagcuacuugggaggcuaaagcacaagaauugcuugaacucaggagguggagguugccgugagccgagauugugccacugcacuccagccugggcaacagagugagacugucucaaaaaaaaaaaaauaaaaaagcguauaguggcauuuaguacauucacaauguuuugcugccaucacaucugucuaguucgucgcccuaaagggaaauccuuuacccauuaaaccaucacucccauuucccuucccuucaaccccuaaucuucugucucuagauucacuuauucuggauauuuuauuauauaaaugcacuaauacaguaugugaccuuucaugucuggcuuuuuaaauaacuuugcaugauguuuucaggguucaccuguguucuaucauguaucuaucuauuaugucugaauaagccauuguauagauagaccaagucucacucuguugcccaggcuggagugcaguggcaugauuucagcucaaugcaaccuccaccuccuggguucaagcaauucuccugccucagccuccugaguaguuggggccacaggcaugagccaccacgcccggauaauuuuuguauuuuuaguagagaugggauuucaucauguuggccaggcuggucuugaacuccugaccucaggugaccugcccaccucagccucccaaagugcugggauuacaggugugagcugccgcacccagccagauauaccauauuuuuacuuaggccauauuuacuuaucaauuaauggacaguggguuguuuccacauuuuggugauuguaaauaguggugcugugaauauucguguacaagcuuuuguuuuaauagcaguuucaaacaaaacagcuauuggggucggguauauacuuucugggucauauggucauucuguauuuaacuuucugaggaaccugguuccucuugaauugagcuaaauggcccuugcuguuauuauuugucagaggguuuccauguaguguugcuuuauuuuuuuauuuuauuuuauuuuuuugagauggagucucgcucuguagcccaggcuggagugcaguggcgcaaucucagcucagugugagcuccgccuccuggguucaugccauucuccugccucagccuccugaguagcugggacuacaggcguccgccaccacacccggcuaauuuuuucuguauuuuuaguagagacaggguuucaccguguuagccaggauggucucgaucuccugaccuugugauccacccgccucggccucccaaagugcugggauuacaggcgugagccaccacgcccggcauguugcuuuauguuguaauaucagcuuugguaacuuggauucgcaguaagcagcaaguggaguuagguuuauauuuuucucauauuuuaaaacaaaugaugcucucagaauauaauuaacauuuauugaacuguuaaugcauuuuagguaguguugagugcucauuuaauacagcagagucugagggaggaaaauuccauuauugagcucauuuuacaaauggucaaaugggguuagaguacguaacuugcugggguaaaaagcggcagaaauaauauuuacuccagagcccguacuuuuaaccacuuccucccagccaugauucucugaguuaaaacuauaaagccugauuugccucgcuuucucuucugcgacaucugugucauaaaggaguauacugaaggcggucucaggugaccauggugugcucauuccagguuccaugccucugcagcggugccucauguuugcuguguaguugcuguccuaacaguaagaauuccacggugacucgccucauuuaugcuuucauucuccuccugagcacugucguauccuauaucaugcagagaaaagagauggaaacuuacuugaagaagguaagaaguaacagugcccuuaagguauugguuauuuuuauuuuuauauucugcaaaauucuaguuuuauuucgucguuguuaaucaaguugguuguaauuuggagauuuuuuacuuauauggggguguggucaaaacacagaaauaugaggacauuaguccuuuuccagaaauacagaaugaacaucugggcuccagucgaacaacugagagaaaacauuaaaaggguggcuccaaaacauuuucuuuccuuauguguuaaaggucgaagcaucuaaacuggacuaguucuucaccuuuggaaggacucagucguagcuggaaaaucucacaggaaaguggcacacagccucuucauccuaaaagggcaaagaagagagaccauauuuuuuugaaacuaagacucacucuguugcccaggcuggagugcagugacaugaucuuggcucacugcaaccuccgccucccugguucaagcaauucuccugccucagccucccgaguagcugggauuauaagcaugcaccaccaugcccggguaauuuuuuguauuuuuaguagagauaggguuuucaccaugcuggccaggguggucucgaacuccugaccucgugauccacccaccucggucccccaaaauacugggauuacagaugugagccaccgugcccagccgagagagcauuuuuauuuuuaaaaugcauguuauuuauacuguuugguaacaagauuguaaaugaauuggaagacaaagagaaaaauuccauagucagucuugcaguuguugaaguaguuaauuuucuaaauccaggcuuuccugcaguggguuagagucucugucuaaauguagauauucucguaacauugaaauugcuuuuuuccagauuccuggauuuugugaagggggauuuaaaauccaugaggcugauauaaaugcagauaaagauugugaugugcugguugguuauaaagcuguguaucggaucagcuuugccauggccaucuuuuucuuugucuuuucucugcucauguucaaaguaaaaacaaguaaagaucuccgagcggcaguacacaauggguauguuagauuuaugauuaacugguuacauuaugguguggcucuuccuucccuucagcaguuaauauagccauucugaugaaaucaauggaauauguaaaugaguggcucagaugcauuucugaucuauuaugcaugugaaauuguuuuaaugucauuuucaguuagauugcuguaacauggaggggauagggggucuugucuuuuuauuuucuucuauuaaauuccuuugcuucauguucuuagauuuuuauugaacaccuguuaaauaguugaagcacuaugcuagauacuacguacacacacacuuuuuucuuucuguuguuuaaagauaaacauguaccugauaaauuuaaacaguguacaaaagucagugaauauauaugugcuacugauuuacauauucuauugcuucugacuccugaccaccuuuuaccuauguuucuaauucucuccuuuuuuuuuuuuuuuuuuuguuuuguuuuuggagauggaguuucacucuugucacccaggcuggaguguaauggcgugaucucggcucacugcaaccucccccucccggguucaagugauucuccugccucagccucccuaguagcuggcauuauaggcaccugccaccaugccuggcuaauuuuuguauuuuuaguagagaugggguuucaccguguuggccaggcuggucuagaacucgugaccucaggugguccgcccgccuuugccuccugaagugcugggcuuacaggcgugagccacugugcccagccguauuucuaauucucaaagacugaauggcguuuuauaaacuugauguguauuauaauccccuuuuuacagauguaguaacugaacugcagagagguuaauaaauugucugagaccuguuaaccaguuggagguuggagcuaagauugaaacuuagaucuguccagcuccaaagccugguucuuuccacucugccauacaaggcagucauuaaagaucaugaacugaaaaucaggugccagugaugagcugugucauugugggcaagguaucugugcccuguguuguaaauauuugugauuacuuuucauccagaccuuaacaguuaauggcuguguguguaccuaacacuguuauuuuagaacucccagaaugcuagaaaaaugccuaccuuuaagugcuaaaaguagggagacucuaaauuuucaguuuucucugguaauaaaugugagugauuuaucuucuaggcuaauguuguccuuuaauugugugaaauauuaaaugaauuagccuauuaaaugaauagucaaaugaagaaaauaguccagacaaucauguugggaaaaaagcuauuaaguuauuauuuuugcauuucagaaaugaauuuuucucaguauaagggugaaacuuagcauuucauaaaugcauuuuuauauuuuaauagguuuugguucuucaaaauugcugcccuuauuggaaucaugguuggcucuuucuacaucccugggggcuauuucagcucagguaggguucaccauugaggggguuaauuuuaaacuauauaaacucuauagaugauugaguuaaagcuacauuuuaggccgggugcaguggcucacaccuguaagcucagcacuuugggaggccaagacgggcggaucaccugaggucaggaguuugagaccaaccuggccaauauggugaagcccugucucuacuaaaaauacaaaaauuagccaggcgugguggugcacgccugugauuccagguacucagaaggcugaggcagcaaaauugccugaaccugggaggcagagguugcagugugccaagaucgugccacugcacuccagccugggcgacagaucaagacucugucucaaaaaacaaaacaaaacaaaacuaccuuuuaauuacuguuuuuguagaacugacaaguaaaugagaugguauccgauuaauaugacuuaguaccugcaacucacuauauauauauauauauuuuagacagucucacucugucucccaggcuggagugccguggcacgaucucagcucacugcaaccuccaccuccuggguucaagcaguucucugcgucagucucccgaguagcugggauuacaggcgcccaccaccacgcccagcuaauuuuuguauuuuaggcagagacgggguuucaccaucuuggccaggcuggucuugaacucuugaccucaugauccaccugccucagccuccugaagugcugggauuacaggugugagccaccacgcccggcugcaacucauuauuaauauguggauuuaggucaggaggcauucacugcaccucucagauuuucuggaaccauauguuaaucuuuuggcaauaucuuaauaguuuguguucucacuugauggaauacaaagcuaaucagagagccugucaaaauaaggacuuacaacucuugugcuccccuaucucugucuuaaccuacuuccuaagcauggcaucaggugacaucuuuagauuucuacugugauuuaaaagaaaagacuuauaguaucauuuggaacucaggucccaggcuucccuuggcacaagcuaaaacauauuuuaaaaggucugaaacccaguagaaagcuuuuaagaaugccguugaguuuggaaucuugcuguacugcuggagacagaaugucuuuaccaccucugucuuguuuuaauugaaauccguucagaauguuggaucuucugaaauguuacucuaugguagagaauaacuuuguucucuugguucuuguagucugguuuguuguuggcaugauaggggccgcccucuucauccucauucagcuggugcugcugguagauuuugcucauucuuggaaugaaucauggguaaaucgaauggaagaaggaaacccaagguugugguaugcugguagguaucucuacucaccuauguuagccauacugcuacauuaagcacgguguacaauaaaaaucaucauuauagucccagcagcuauaguccucagggacagaaguccaaggugggagaauggcuugaauccaggaguucaagaccagucuaggcagcauauugagacuccaucuuuacauuagaaaaaaaaaauuugccaggcaugguggcauauaccuauaguccuagcuacucagcacgcuaaggcaggagaaucucuggaauccaggaguucaaggcugcaguaagcuaucaucaugccacuguacugcagccugggugacagagcaagacccugucucuaaaaauaauaauaacauuaaauaaaaggaaaaaaauccacaauuuccagaauuuggcucugaauuauaugcaucacuggaagaaaguagcacagauaauauaaauuguucgauuuucccaauuuauguauuuugagagucauaauuuaauuacauguguuuagauaaggaaaaacaguuauauuuagugacuuaguucugguuuugauaaccuuguuuccauggagaggaaacucagauggguucaacauaugggacagcugcccaccuacuuuaggcagauaggagugaguaguccuuauggccuuauucagagaggggccccauaccugcuaugaaaaacuuucuggugggaaaggggcacuuacaauuucuagagugauaaugggauuuaacaguagcuugcgaauauauuuuggcuauguuagagcacuuacuacuucauaauauacauuugcacacauuucugauuauuuccuuaggacagauucccagaaauagaagagucaaaguguaugaauauuuuaaaaugcuuucaguacauacuauugaauugcgcaguuuuauuuucauuugauuuaguuuuuuaaaauauuuacauguuuuuaaaaauacuauguuuaccauaaagacaaaugauagaacuuuauaaagacuaaaacaugcaaaucuccaccuaucugcaacccauuuuccuuuccagauguagccacucuugugaaccuuuauguauuuaugcauucaccuugcuuuuguauuuaaauguaaacaggauuguacuguauguuguuccaugacuugcucuuuucacuuccuacaugaugaauauccuuccuuaccagugaguguagguaugucuuacucauuuaaccugcauucaagcuccuggcauggaguuuacuguaagcugcaugguauuccauuccauacaauuccauggcauuccauagcggaguauaccauaauuuauuuaaccuuuacccuaguguuggucauuuaaauuguuuguaaugacaauuuuauuuuuaucuauuuuuuuucuuuuuuuuugagauugggucucacucucucacccaggcuggaguacaguggcacaaucauggcucacugcaaccucugccuuccuggcucaagcuauccaccucagccucccaaguagcugggacuacaggugcacaccaccacacccacacuaccacgccuacaccaccacgaccggcuaauuuuuguguuuuuuguagagacaggguuuugccauguugccggaacuccuggacucaaucgauccaccugccuugcccucccaaaguguuaggauugcaggcgugagccaccacacccggcuguuauuuucuuuaauucauuuuggaucauacaacucuagaagaauuuauugaguugcaaauuggucauacuuuacaguaacuaaguguagaaaaaucuuguauauucagaggugaaaacauuaagugugcuaguaacuuaauguacaucauuuaauuuuagacaugcaaaauucauugagauaaguagaaacuaguuuucuuaaucugggcuuugacuugaauacaaguuagcugagcucaucauucuugcaguuggucugaguguacuguaugugcuguuucauguuuucuaauuuucagagcuacacagcuaauuguuuuguuuguuguuugagaugggguuuuguucuguuguccaggcuggagugcaguggcaccaucucggcucacugcaaccucuaugucuugggcucaagcaaucccccugccucagcuucccaaguagcuggggcuacagccuuaugccaccaugccuggcugauuuuuguauuuuuuguagagacaggguuuggccauguugccugggcuggucuggaacucaggcucaagcaauccagccaccuuggccucccaaagugcugggauuacaggcaugagccaccauguucagccaacacagcuaauuguugauuuuuagugugaauggaaaagaccauuacuuuagauauuaaaaaauagcaaaugagccacuuuuccaguucagggacagucuuauuguuugugaugggaaauggauuuagauagccaauggcugcagaggaaaaaacugucauaaaaagauaccaguguguguauucuguuuuccucuaacaccauccuggcauggagcuugcugugaacugggucauuuugaggguaaaggaaucauuuagguuccuaagaaaagcucacaauacacauuaauuaacauauagguagcaguaaacucuagcuggaaugaucaaaugucugguaaucaacccaugaaaucaaaucagguaauucaggaagugaauucaguugcuugguggauuuuggaauuuaacaucaagccaauugaauacaaucuugauacuuuaaccuugagaccucuguaauuuuacuguaaauuaccccagaaaagugacauaaugucuccucauuuuuauauggaguggaagaaaauuggccuucauuauuaguuuauuauaguuguggucauucauauugguuucccuuucuccagcuuuacugucuuucacaagcgccuuuuauauccugucaaucaucugugucgggcugcucuauacauauuacaccaaaccagauggcugcacagaaaacaaguucuucaucaguauuaaccugauccuuugcguuguggcuucuauuauaucgauccacccaaaaauucagguaugauuguuuacuacuucuuucuccugugaaagguuuuuaauucuaagcuuaaaaucuagguacccuuucuuaugaauuuaugucuaaguuuauccacuugaacauuuuuccauauuauaaagucuucauaauucuauuucaugccuauaucauaauuaaaugaauuucacuaucauuaaaaaaaaacccagguaacuugaaaauuuauagugcuuuuuuuuuuuuuuuuuuuuuuuuuugagauggagucucgcucugucaaccaggcuggagugcaguggcacaaucucggcucacugcaaccucugccuccuggguucaagcaguucucugccucagccucccgaguagcugggaucacaggcagccaccaccgggccuggccaguuuuuguauuuuugguagagauaggguuucaccaucuuggccaggcugaacucuugaccucgugauccacccgccucggccucccaaggugcugggauuacaggcgugagccaccacgccuggccgggaaugagucuuuuuuuuuuuuuuuuuuugagacaaagucucacucuuguccccuaggcuggagugcgauggugcaaucucagcucacuacaaccuccaccuccuggguuccagugauucuccagccuuggccaggcgccugccaccaugcccggcuaauuuuuguauuuuuaguugagacgggguuucaccauguuggcaaggcuggucucgaacuccugaccucaggugauccacccaucucagccucccaaagugcugguuuuacaguugugagccaccgcauguggcugggaaugauucuuaugagucauuagccaagauauuuuaggggaauuaaacugaaaaauaauugauuuuaauauuucaaaacaaaacucaugcucuugaguucuaaauaccauaguuuaggcugggugugguggcuuaacgccuguaaucccagcacuuugggaggccaaggcggguggaucacuugaggucaggaguucaagaccagccugaccaacauggugaaacgucaucucuacuaaaaauacaaaauuagcuaggcgugggggcgcacaccuguaaucccagcuacuuggcaggcugaggggcaggagaauagccugaacccuggaggcggagguagcagugagcugagauugcgccauugcacuccagccugggcaauaagagcgaaacuccagcuuggcgugauggcucaugccuguaaucccagcacuuugggaggccaaggcgggcagaucaccugaggucaggaguucaagaccagcuuggccaacaugacgaaaccccaucucuacuaaaaguacaaaaauuagccgggugugguggcgggcacuguaaucccagcuacucaggaggcugaggcaaggagaaauuugaacccaggaggagguugcagugagcugagaucgcaccacugcacuccagccggggugacaaaagcgagacuccgucucagaaaaaaaagaaaaaaaaaccguuuaaaaaaauucauggaguuauagauaugaaauaugaaaauucuaucuagacaucaccuuuccuuuuaaaagugagaaaacagaagucucaaagaagugauaggccucucccagcuacuaauuaguugcagagcugaucuuagaucuuuucacuacaccaagggaguggaaaaucaaaguccuugugugaugcacaggaauuucuaggauugugaaaugcguugagaaccaguaguacuugcuuggucuuucuggguucuuuugcgagcuaacugaacagaagguuacuugucaccuuucaacucucaagaagaauccgaaaguucucaguuacugauaguugaauuaacuccagagaagugcacugcauuuuggaaagucagcccuuggcagucccugugccacuguuuuccuuuugauuccauaggaacaccagccucgcuccggccucuugcaguccucccucaucacccucuacacuauguaccucaccuggucagccauguccaaugaaccugguaagggaaugucaauaacacauucauuugauaaaaagaaaguaggaaaucagccuuuacauaguugguacaaaaacuagagcuagagcaaaugugaaacaagcaaacaaaacuuaaacguacaguguucacuguagguuuguagguauuuaccuuucacauuuuaguccccacaucuauugauagcuauuuauaacugacagucuaaagggucagaguccuuuagauggucuaggcuuuaccuaaccuaggcugagucaaacuaguuaagagcuguggucaagggcuuuggcccuuuguugugacugaauuuuaguuugaugucacaggcuguagaagaaacagcuguaggaaaucuccuuuuguaguuauuauaggauuguuucucaguaggauauucuaugggcuucuuuuaaaggaaaacaaugcagaccccccuuccaccaaugauaacuuauauuuuguucuuaaguaacuauguaaaaaccaaaauagagauaaacuucugugcuuaaaaccuugacacuuaaagaauuaaaaagauuugucaaacuacaaaaccaauaaaaucaauaaugauguuuaugaaauuugacagauucuguuguuguuuucuuuuuuuuuccuaauucugucauugauugugaccaaacguguuacuacugacugcuaaguuucagauuuuuuaaguaaagcauucccauguuucacaucaugacugaaugauauguagggaacuccucaaguucuuucuuggaacaagaugagcuguaaccaaggauaauacaaauuuucucauuuucagaucguuccugcaaucccaaccugaugagcuuuauuacacgcauaacugcaccaacccuggcuccuggaaauucaacugcuguggucccuaccccuacuccaccaucaaagagugggucuuuacuggauucagauaauuuuauuggacuguuugucuuuguucucugccucuuguauucuagguaaguuaaaagguacuuagaacaagauuuucauggagguugauaauaaagugaagaagcuguuuugcuuucaaaaagcagcaugagaaauuuaaaaacuucacucucuuuaaugaaaaguucuuuacuugcuucaguuacagagcuguguacauauauauuuuuuugagacagugucuugcucugucaccuaggcuggagugcaguggcaggaucucagcucacugcaaucuccaccuccuggguucaagcaguucuucugccucaggcucccaaguagcugagauuacaggcaccugccacuaugccuggcuaauuuuuguauuuuuaguagagacaguguuucaccauguuggcuaggcuggucucgaacuccugaccucaggugauccuccuuucucagccucccaaagugcugggauuacaggugugagccaccaugcccagccuguaguaaguuuugaaauuaggaaguaugaguccuccaaauuuguucuuuuucaaaauuguuuuggcaguuauggguccuuugcauucccaugugaauuucaggaucagcuugucaauuucugcaaaaaaauauguagcugggauuuuuauagggauugaguugaaucuguauagaccaaauuggggaguauugucaucucagcaauauuaaggcuuccagucugugaccaugaagauaccuuacugaagucuucuuuacuuaaaccauuuauuuaggucuuuaauuucuuucagugguuuauaguuaguuauuaguauacaaaucuuaaacuuauuuuguuuuuaaguguuuuauucuaaauacaauucuaaguauuuuauucuuuucgaugguauuauaaaugaauguauguuuucuuagcuuaacuuuuggguuguuuauugcuaguguauagagauaugauuggugacgaggcaugguggcucaugccuguauuucccacacguuaggaggcugaggugggaggaucgcuugcauccaggaguuugagaccagucagagcaagauaguaagagcccgucucuauaaaaauuagccaggugugguggugcaaucuguagucccagcuacuuggggaggugggaggaccaauugagcccaggaggucaagucugcagugagcugugauuguacuacuacaguccaccugggugacagagugagaccucaucucaaaaagaaauacaauugauuuuuguguuuuuuuuuuuuuuuuuuugaagagaagaaguguugcucugucauccaggcuggaaugcaguggugugaucauagcucacuacagccucaagcuccuggucucaagugauccucccaccucagccuccugaguagcugaaacuacaggcacacaccaucaugcccagcuaauuuuuaaucuuuuuaggaacagucuugcuguguugcacuggccagucuugagcuccuguccucuggcgauccucccaccucagccucucaaguaguugggauuauaggcgugagccaccacacccaguccugauuucuauauauugaucuuguauccugcaacuuuggugaacuuauuuauugguucuaauaguuugcauguguauguauuccauaggauuuccuauaaacaagaugaagucaucuacagauagagauaguuuuacuucuuuucuagucuggauaccauuuaucucuucuauuugcucuggcuagaauuuuacuacauuguuggauagaaauggugagaguaggauccuugucuuguuccugaucucagggggaaaguuuuuagucuuucacuguuaaguaugauguuagcucuggguuuuuuguuccuuuugucagccugaggaaguucuacuuugacuguuuuuaucauggaaagguauuggauuugugagauguuuuuucugugucuguugaaacgagcauguaauuuuuguccuguuuuuguauuuacauuuuuauucagucauuuaacaaacuuuuagugaacaucuguagugcuagaauuacauagacuaaggucacuguuaaggcauucuuugaauagcaaggaagauaggagugauaugugcaguggcagaaggaagccuaggaagcugugggaagucggaggagugucuuguaaccuagccagugaggggugaugucagggaaggccuuccagaggacaugacagcaagucagagaagugaaggaugaguaaguuaguuggaaggagguuggcacgugguaccuuccaaucauagaagcggcacuugugaagucacggaaacagacacagagagcauaguguguuuuaugaaacuccuaagcaauuaagccaucacaucaaguaguaacugaugacagugacgucagucuuaugaugacaggcagcaguucagaacuuuaagcaggaucuucagaaagcuuucagucuccaaaguaggaacagcucagcaguaagugucuuguauacaggccaguggcagcaguucauugucauggccccuuucugauuugucuuccuugggaucacuuuccagcauccgcacuuccacuaauagccaaguagacaagcugacccugucagggagugacagcgucauccuuggugauacaacuaccaguggugccagugaugaagaagauggacagccucggcgggcuguggacaacgagaaagagggagugcaguauagcuacuccuuauuccaccucaugcucugcuuggcuuccuuguacaucaugaugacccugaccagcugguacagguaggagacacagacaaaacagacagaagaccauaaaacccuuggauggccuauaaaaucucauccauuguccugaccucagaacccuugcucuuacccauauaaugaaguuggguuaaauacucuugacuuuauccccucuagcauuuaaaacccauuggaauucuuugcaaugcaaaucauugggagcucuuacagaguugaguuaauugagagagaaaaucaugacauaaagcaaucugacccaucuuuguucacuaauuuucuguguauagagauggccaugucagagcauucugguucccguaauaauguacuaaggaaggaaaguuucagggaggcuaucucaaucuagaccuuugccaguaacuaggaacauuuaaagaacuuugcccugauagggucuuucaugcuggcaagaagaaaagucauuugagaggcagagucaaugagcuguuuaguucuuggucauaagaacuaaaaauagcagcuuccucugguccccuucaacccuacugggggguagugccagccaaguuucacuggagaauuucuuggccuuggcuggggggcugcaggaggcugauagaagucagguagaccaggcuuuucuaccugacucucucuuguuuucuuagcccugaugcaaaguuucagagcaugaccagcaaguggccagcugugugggucaagaucagcuccagcugggucugccuccugcuuuacgucuggacccuuguggcuccacuuguccucaccagucgggacuucagcugaaccucugagugccaaggacaccacuggaacucacaaaggucuccuucaccgaaaacccauauaccuuuuaaguuuguuucaacuaaaauauuaagugaaugcuuugcaaguuugacuguaugcagguuuauaucagaaggugagauugaauaaugcuugaugcagaaucgaaacuucucauuuaucuguauauuauguuuacuucuaaggauauagcacaaagggaacauuuuuuguuuaaagugaacuacagcugugcugugaagagaguucuuuauaaagccuguagguucuuuuaacuuugguuuaaaauguaagauaggaaaauguuggauauuugaggccaugcuuaauauauuuauauugcaguauccuuuaaaagcaaaaaaaaaaaaaugcauuuauauuacaguuuuccucuaugaaaguccuuacuuauaugauacaagcacuguguuuugugcuuaaacucuucagcgggguagcaucaaaguucuuggggaaggaucguauaugugggucccuucccuagaagaaugguugcugauauggcuacugcuucuacaucuugaguuuuuuaauuuacuuuuuuuacacuguagcauugagacugcuugauucaagucuggugcuuugccagauguauuaauuuccauaaaugcuuugugaguuugguuaaaaugaagauucacuugggaaaacacugcagcuuuagucuguguuacuaucuuguuaugaguauguaaaaguaaaaugcaugugaauuuaucauauuugcacuaugaagguauuugguuaaaauacaaagacuuuuaagauuuuaaggcccuuucuuccaacagcuuuuauaguuagcagccauucuuuauuuucuggauagccagguuuuaucacgcuucuagucaggaugcuccuauuccuucuaaaaauuacggucugacuagugagcaaagucuugaauuuauucaaaaguccuaaauaccuucucuagguaagacacuugguagaugagagacggaaggcauugucaagaacc

SEQ ID NO: 191270 - RNA, 18344 nt, Homo sapiens
aggucucgcaggccccgcccccucgccgcggguucgcuguugggcggagauauucgccgccggcgcuugcgcccggaaggugugccgcaccacacgggggaggaaggaaggagcucccaacucgccggccuggccacgggauggcccccaaauucccagacucuguggaggagcuccgcgccgccggcaaugagaguuuccgcaacggccaguacgccgaggccuccgcgcucuacggccgcgcgcugcgggugcugcaggcgcaagguacgaccccggcccccaucucaccuccgggccugcuccuccaacucccgcaaccaccgcccgggccucgcgcggcggccagcaguccugcccggcccucccacccuuccagccccuuccgacuccggcauccuaccagaaacuuccucggcccuuucuuuccaccugcuuguuaacugcccuguuggcccccauccuaaguuauuuaggccucguucugagcccugagaagaaagcuaaacccuccucccccgcagcaauucauuuuucaguuaguauuuguugaguagcuguuauauaccgccuguguaacaagacacaaaaagucccuucucucaaggacagcgcauucuugugggggcgguggggaggacgugagucuuaagcgagucaguaaguaaacgagaccugugggauaaucaggguuaggaagaagacaaauagggugaugugauagaguugacuggagugggagaucaagggcaacaucuguaaagaagugauauuugaggugaugucuaaaugaugagaagccaagcgcacaagguuuucgguccugaagugaacugcaaugagaaaggcccccccuccaagacgauauaaacaugguguguuucaggggucaaagcauagugagccagggcagggaauaggaagacaugaggucaguuaggaaggcagacccuuauuuauuguggagguguuguaaacucugcuaaggaguucggauuucaugccaaacuggaagcuuggcaugaaagcugcuggaugggaagcuacuggagaguuugaaacagaagaauagcauauucuuaccaguucucccagcguccagcuuucgucagcauaccgcagaccuuugcccaaagccccuucuccagggugacuuaaucagaaacccucauugguuaaagccuugacuuuugaaaggagccuuggauccugguuucugugagucaccguucaguaccuauuucccuuugccgccuuccuuuuuuuccuuuucuuggcuagcaucucuugagugauuuaccaugugcuagacauuuuagacacgaucuccuuugaucuuuauuauggcccuguggauaaaaugcuuagaaaggaggaguccaagagaguuaaauuggcucccucgggguuacauagugaagacauggaagagccacgauuugaauauggaucuguuugacuuugaugcuaaguccaaauuuuuaaucauuuugcuagaccucuccucacauccucuccagauuucauucuuuuuuuuuuuuuuuuugucugcacuuuuugcaguuucaagccacuccuuugcccccuucuuuguucuagaaaacucuccuuuaggcccacuuccucauggcagccuuacuugaugaaguugcugaagaagcugagguauugauguugcugccauuuucauucaucucaccccagcuggucuggaaaagcuuguacauuuguauggguuaauucuggguccauagaaaagcuagccugguaucuagauuuagcaaggaccggaguuugguucugcugcugcuacagauuuccuagguaauuuugggcaagucucuugauuuaucugaucagucuucuugaucacgaagagagcucagggaacaggcuaacacaaugaacccuuccagcaagucuaugaagugauauccucaugugguaggugggcacgcaugaucagagggauggagugacuuguccggaucgcaggguugaugcccuuuccaccgcaccacugcuguuucugagcaaccguacucuggugacucaagauggauuacagguuuuggguacuuagcuccuuaagggcaaggauguauuuuacuagucuuuguacuuuccgucucugggccuggcaaaacaagaggggaaaacgcuuguuauuguugguauugaaugaaagauaucaaauaucaacauggcaacaggauacugagugaaaaaaguaaguugcagaaggauaggcaauaugaugccucuuaggaaaugcuuuaauagacauaaaaugguaucuuuccuguuaacacacacacacacacacacauauauauacauauacauauauauacauguacauguauacauauauacauauacauauauacauauauauguaaauguagaacaugcuugaaaauguuacauaccaacuucaggauuguacuggccucugugagucuggggagggagcacagggauaaggauggggauggcuggaguuuuagcuuaucaaaaaaauuuuuaaggguugggugccauagcucaugccuauaaucccaacacuuugggaggccaaagcgggaggaucacuugaggcuaggcauucaagaccaaccugggcaacacagugggacucugucucuacaaaaacuuuaaaaauuaacugggcuuggggguacacaccuguaguccuaucugcuugguaggcugagcugggaagaucacuugagcccaagaguuugaggcugcagugagcuaugauugugcuacuacacuucagccugggcaacagagggagacgcugucucuaaaaauuaaaaaaguugggaacuaauauaacgugcuaaaucuagugguggauucugagauaauggucuucuguauguuucaaaauuuucaaaaagagacccuguuuucaauucuuuuuaaaauaauggccgacacuaguggguaugaagugguugaaaauuaucuuuaaaaauaaagaucauuguugguugggcacgguggcucacgucuguaaucccaguacuuugggaggccgaggcaggcggauugccugaggucaggaguucaagaccagcuuggccaacauagugaaacccugucucuaccaggcgugguggcgagugccuguaaucccagcuacucaggaggcugaggcugaggcaggagaauugcuugaacccaggagguggaguugcagugagcggagaucgcuccacugcacuccaggcugggcaacagagcaggacucugucucaaaaaaaaauacguaaauaaagaucaugguggccacagugaaggacuugagccucugcgauuccugaggguaaggacugccuuagaagaaugucuaauaauucuccccaugggguagcuuaagacuuuuuccugauuaaguucucuguacucccaucacacccagcucaauuaucauuucccugacaaaguccucccuggcuugaccagguaaaacuagucucaugucuuucauggguguuuugugccccuacaacuuuuggucaauccauuuaucauacguuuaucaucuuguucccucccucccucccuuucuuuucuuuuuuuuuuuuucuuucuuucuuggauuuaaaugcuuuuuguaauaaaauacacaccuauccauccauuuauccacccaaacccaaguaguuacagcauggauuucuuugaggcagaagcuagcuauuucuuguuuaucuuuugucuguuaucaaguucagugcuggaaugagugaaugaggaaauacuugguucccuuugaauggcaaaaagcgcaguguccuucugucacauaagaaugacaaacacgccagcccagcagaccaacaagccugaacagguuauaguuaucucuacugccuuaacacaaggcccaaagagcucugaguuugaaauguauccuaaugcccugaggcacccauuuuccaaacugaucaucuuccccacucuaucugggcagguucuucagacccagaagaagaaaguguucucuacuccaaccgagcagcaugucacuugaaggauggaaacugcagagacugcaucaaagauugcacuucguaaguggccaaggguaauuuugggaugccugagggucucagaagaggaggcuggguuaaucuggcuuguuucuucuuuggaaggaucccaucaauuacaucugggacagauauuaagaaagugucacugaguuucaccaggucacugagaaugggagucuuuauuugguccuuauggcccgugacuugcaucuuuggagucuuggcucugcugccgaaaaaggagugggaugggcaguuagaagcaggccguaaagucuuugugcaauuugaaaccugggaauaagguggaguggcagaccaguaacuggcuugcccaggugcuuuucugggaugggaguaugugaggggaagggagcgaaggaaagaaggaggaauagagguuaauagauugucucagaaggagaaaggaaaaaaaugguauucaugaaugaccaguuuuagaggacacugaacaauguuucauaucucuuuuucuucaagccagucuaauauucuuuuaucaucauuaaacucucacauuuaccugaaauguguucucagaucugauguccucugacauugcuuuagauuccugcccuggugauagccaggagagcaggaggggugugagcauacucacagagccugugcugaauuaauuugugccaugccuugugccagauuucccucuuugaguguucacaaccaaucugugggguacgguuaccaugugucccaggccagaacuugguugcugaggguuggggcaguaaagugauuuaccugggucacauaguuagcagcagagguggaauucagacaccaccccaucugacuccaaagcuuguuuguuauucccacuagaccacaacuguaaaaaaacauaguagcaugaaagccaugaggcuuuuguucuugauuuugggggaacugaaacuaugaaaauugaugcaugugcacacacauuuaacaaaauucauguuucucugccuucuuucuccuccucacuucagucuacguugaaaaaucccuguucugagguuuggcguuuuuagccaugucucucggccagaaauuacuuccuguacgcugagugcuccagauaacccugccuggaagaaacuguagggaaacccugguggcucagcagccagccaguugacauuuuugccuccuauucuagagcacuggccuugguucccuucagcauuaagccccugcugcggcgagcaucugcuuaugaggcucuggagaaguacccuauggccuauguugacuauaagacugugcugcagauugaugauaaugugacgucagccguagaaggcaucaacaggugagcuccauucccagcagguggucuccacggcaacucccuguccuucuugauuggcugcgggccauugccuugucugucuucugaggggaucccuuuggcuacacuuaaaaaacucccgaugggcauguaggggaagcugagaaaggaaaaucugcuuuuuuauuuagcagguuuucagggagucaauuacuaagauugauugauugauauuugccuacaugugccucacaguaucuauguacacaguaauauuuauuguacacuguuuaagguguugugcccgguucagugggggauaccaaaaugagaaagagauacagaccccacuuaccuucaaagcgcuaacgcuaauuagaagaauaagacacaagcccaagcagcuaugacaagccuaaaaggauaugguuuguggacaugguucaguauauugcacugugaccaauccaagagguuccccaggugcaauuccuuucuggucucugagcaguuauuggcuuuuaucucauggauauugucauuuguauaacugaucauguuuccccucugcgugugcggcuagaaagccaaacacugcacuaauagcaaacccuuaacagggacuucaugguauguauuuagugcuuuauuucuggcuugacuugucugccagcauucuuuguuuucucuuugccuccuuuuuaacuuaucugauuccacaaaaucuaccaauuaugugacagacuuugcucuaggaccugggcugaugacugagacauaccucuuccugccgucauagaggucccggucucaaggaagacaccagucaguaauaggcaagcacaauacaacaugauaagcgccaugguaggaggcagcacagggggcucugaggccagaaaggagccaccuagcuagcugagagggagagggggaggccagagagagcuuuucagaggaggugagcuaagaaugagagauaugggguaggggguuagccagaagacagagcagcgugugcaaaggugagcaagugugacagaucacaggaauuguaagaagucgguuucacauggugcugcaggcaggagcucagcuugggacagguuggugaggccaagucacacaagacccaggguucagggcuuggacuuaauccugagcaagucagccuuuaugaaaaggucuuuagcaguggagcaacaugagcagauuuguauuuuagagaaaagcucuuugcugccauguugagggaugauaugaagggcaacagaauagaaaggagucaugcagcaauccaggggagaggguggagagaaaacaaugggaccagucaggggacauguaggaaguauaucaacaagcuuuagugguugcgggguaucgagaagggaggaauagaagaagacacucagauuauugacauucagucggaggugacugugggacauaagacuagagaucuaaguaggacgguuggguauuuacauggaacaaaggaagaaaauacaggccagacauaaggauuugagggucaucagcgcagagguggauuagggcugugagaaagaaaaagaacaucacagcuagugugaagaggauggagcuuugagaaacuccagcauuugagggacuuacagaggaacagcagcuagagaggugggaggaaacagggcauugaugucccaagggaaggaguauuucaagaaagauggagacaucauuagugucagguguuccaaggagcuuacauuaaagguuuggcaaugaagucaccgguggcucugauggaagcuggucagugggaucaggagccagagggcaaugcuuucagaaagucaggcuugaagagaagcuggggaguauaccugugauggcaagggguguccaguaugguuuuauuaggugaggaaagaguuaaagggacuuaaaugcugacgguuggaguuaguagagaggaaggaugaagaugugggagagggaggugcugccuggguguggucccugaaagaggcaagaggagaugggauccagagcuuagguggguggauuggucccauugucucuucuguugugacaggagagaaauaggaaggauugggcacccaggcagguagguuuguauuugggguaugaggaaguuugcucuaaaaaaggggaagggccagggaacagguuugaggagagcagagguuugaaauagcuuggccgccaggaaaacagccuagccagagacaucuuggaauuuguagugauacagucugugguuuuuauucuuguaauauaggaaacaugguuguaggagcagaaaaaguauacaguuagcauuauucacucauucaacacauaacugauugggccuuggugguugcuaggugacauaccaggugcuggagaucaguugacagaaugaacuuggucucuggguggcauuuuaagcugaaaucuaaagaauaaguuggaguuagccgggccuggaagguggcaaucuuuuuccaaaaugaaaaugguuguucuggguagaggaaaaagcaugugcaaagucuugaacagaaggaucagaagagaauguggcucacagugaagggggacaggaagggguggggaccagaucucacaugccacauuagccuagggaauugggaaccccugaggaguuguaagauuugagaaugacauaagcuuugcauuuuuuaaaaagccugagcauuaaacaaaugucaggugcuugcaugguuguguacuugauucauugauaaaauaugaaacaaaauguaugauucuuucuuggagaaacuauagucuuuuuggaucaugguuuaaguauccuuaacaagcaacagaucaccacuuuaaagguaacauaguuugaccaagcucaaggaaugucauggggacugaucugagaugguguuuauggguuccuguauugcacguguuggaggagcuaaagaggugguuccgaccagggggaggguggcagcucuggcucuucugaaaaggccuaccucccaugggugugugaaaggagaaauaucuucuugacccagcuggaaaccucccugcaauccugccuucuuuuccagaaugaccagagcucucauggacucgcuugggccugaguggcgccugaagcugcccucaauccccuuggugccuguuucagcucagaagagguggaauuccuugccuucggagaaccacaaagagauggcuaaaagcaaauccaaagaaaccacagcuacaaagaacagaggugagcugugacucccugcccagagucuugcaaucucccacuauccauuuucuuuagaguaguccugcaaaaauuggcauuguuuagcugaguuauaaaaauaaucuuaggaacaaaguauaaaacaaaauacaagucuucaccucuuagagacuguuuucucagcuguauagugagggugaugauaaagucuuccucacaaccaugaggacugaaugacauaagacauguaaaacucccagccuggcacauaggcaugcagugugaguucccuucucuuuccucugguagcacuugggauguaguacuuaggauguuuuugguugcaaaaacagaaagcucaacaugguaaacauaguauagggaauuuauuggcucauaaaacugaaaaauccgagagaauucaggcaagguuugcuccagcagcucaguauauuaacagacuaacuccauuuuucuguacuuaucacagcuuuauuuucuguugugcgucagcuuugucuuuggcaagcuucccuccuaguagcaaaauagcuauagcaguucccggccucacauccauaccccaugccucaugacccagagaaagaaagucuuucucugauagcucacuaggaaaagauaggauuuuuuucccccaaaaaacucuagcucacauauuuucucaaucauuuucucaaucuauucuggucuucauggucacaggccauucccugaaguacacaccauaaccggcggaugagauuuugugauuaggucacccugaggcaccugccccaccuccagaacuagagggugaugcuucccaggagcauguacacugugugaaucccuggagaagcaugaagaagagaaaggagauccaagcagccaaaaacaggagauuccucaccucaacuguaugaaaugaagaggccauuugucaggcacuaggaagcucuuuuaaugcuccaggggaauggucccagcccagcaagcuagggauucaggcuagaggugcagaagggaucagagauggagcccugccauguguaagugaccuauagguguuaggggaggacaagaguuacucaccuucuacaggagaaugccucucuggucauggguagcauucacucugguuugugggagccugguaaguguuccccacucuucucuaggaugaaaaugugcggugcuaaugaaccugauggcaucagugccauugauuucauucuuucaaucagugcaccuaccauugauuucauucuuuaaaucagugcaccuaccauugauuucauucuuucagggucacugagccauguguuccaagccauguguaugcuaagcagugugacacagaggacagucuuggcccucagggaacucucccucaguugagggacugagacauguaaacagugucuuaaaacacaaggaggaggaacaugugcuuuagagucuuaguguuugaggacuucaggauagaaacugacuuaagugcaugagggagucggggaaagacucagaagggguggcaauggagguggagccuugagcuggaccuugaagaaggucaucaggugggaaggaaggagaauccuuggcagagacaguggagagaguuggagaaugaaagugcauggggggaacaguaggaauaaggaugacugcagagugguguguugcagggugccagugaagcugaagcccuacuucaagagaaaccugugugcaugugcacagggagauguacccacaaauguucguagaagacuguaauagcaaaaaacaacuggagauaacccagaucuccauaaaugggagaauggacaauucagcuuugguauugcagcaaugaaaaugaaggagcugcaggucugugcaucaacacagaugaaucucagaaauauaacauuaaggggaaaaagaaaaaccaagucauaaaagaauacacagacuuauucuucuguaugaaguucaaaaacaaaguaaacagcaaaugaucuguggguacuguuguauauaguuauacuguuuaaaaagguggggaagaagcacagaauuggggauaauaguuuccuccagcaguggauugaauugaggaaggucccccaggacuucaaagguccuaguuauguucuuuuucuuaaaccaggcaaugaauucaggguguaaaccuauaaucuuacccuggucauaaauauuuaguauuuuauaaagauaguuuuaaaaauuuuugaaaagcagaugauauggagcugaggcuggaauaauuaauuggggccaagcagugaagggccugaacaccaaguugagcagcuuggauuucaccauguucccucugcuuccucuccuugaaggcuggagcagagcugcauguguuagaugagggaggauacucacaggcucagcccaaaccagaaaugaggaauagcaggcucuucuccccuuuucucauagcccagaagcuauaccuuuucuuuaccagauauuuguuuauuaguauuuauuuacuuauuguccugcuuuaaguuuauaguguguuccguacuuucuuacauacucucagauuugacccugaaaauagccaucuguggaauuaguauugcccuauuuuauuggugaggaaauugagguccaaaaguuagguaggucacacaagaucuuccagcuaccaagaggcagugccaaggcuagaaccuggguugcuuuuuaucauuuauauauuuuuaugugcaugcaaaaauguuuuuauaucaggauuccccaacuucuugaugaaaaacuguugaauugcccagaagcuauuaauugggggaagucauuaaucaggaaggaugauuuacagcaggggaggaaaucucugggagagaggauuguagucaguuuggaagggacgaugcugaagagaccucacugaucucaguugggugcugcuccaugguuuuuuuccucuucugaauuuguaucuagugccuucugcuggggauguggagaaagccagaguucugaaggaagaaggcaaugagcuuguaaagaagggaaaccauaagaaagcuauugagaaguacagugaaagccucuuguguaguaaccuggaaucugccacguacagcaacagguaucuccuauacagcugcuggccuggggcauuucaggacauuuguuccauagucuucucuuggacugcaaugggcccuucaucccuagcauuuagucaaguauguuauggcugaaaacaugcauccacguugugagcuagccaugaccaguggcauucauucucucaaaaggguagaaacugagggaugccaaaugguagccugggcuuuguuggccccuguccccagaauuuucauaagcaugcaauguaacuaaaagcagugugccugcucugcaaacacaacccuaacacaagucucuuagccuguccaccccaccacgcuacgcugcucccuacccuucuccaagacccuccuguuagaaauucuggcaccauuucugucugagaguacuggcccagaagccaaaaugugaaguaaccauugccuggcaugagagcaggaaggauggguacagucuagccugaaagguuagacuugugggccuguagaaaguccugcaccaggagcugccgucagugaccacugacugagaaccugggagccagggugcggucccuucacuguguaggagugauuguucuccaacaaugcucguauagguggucuuucuguuuuaguguuuagaaaauugaggcucagagaaggaaggguuuugcuuuaaacucagccagccaguaaauguuggcacaagaauuggaaucugacuucaacaagaucuuccuguuacuuuuacucucagaagcuugaaacauucagcaagagaccauaucaaaaccaaaugcuuaguauaaaacauuauaaaauguuagaaaucuguuuauccuucccuaccagcauacacauaucacucucuaguucaaaaaucuuggaucuaauauagacacauuguuccuuauuccaaacucuugagauaaaauguguuuuccagccacgguggcucaaugccuguaaucccaacacuuugggaggcugaggcuccgggaggaucacuugaggucaggaguuugagaccagccuggccaacacggcaaaaccccaucucuacuaaaaauacaaaaaaucagcugggcgcuguggcacaugccugugaucucagcuacucaggaggcugaggcaggagaaucacuugaacccaggaggcagagguuacagugagccaagauugugccacugcacuccagccugggugacagagcgagacucugucacaaaaaaaaaagaaguguuuuccauuuuagugagguaauauggucugaauuauguaacaccccagcagugucuggggcagcuugcagaaguuaauuauuaguauuucugccagugaaacuugaaaauuccauguucacaugggguggaauagagaaacuaaauagcuucaugucaguucagaucagguuuugcugcccaaugaguuggaaagagaacuuguaguuuuaaagcuuauauuuuggaauuuugcaccugugguuuuaugugguuuuauugcugauuggaccagaggggccacaauuugccaggcuaauuugaaaaagaagccugcagccuauuuguuccauauuuguguggcaucuucuaacuccucuaucucuggacccucuuucacauugcuuaccuuaugcugcuggacaccuccauuaacucauuuuucuggaucauuaccauauuuggagcuguguuuugucuuguuuagauacuguucuucaugcaggugucugugccacacuguuuuaauugcuuuugcuuuauaauaucuuauagggcuggucuuuucuucauucuucuuaaucagagcauuccuaguauuuucccauguuuguucuucuagcuaaagcuucggaucauuuuggcaaauuccaaaaaaugucuuguuggacagcuuuugguugugauugcauuggauuuauaauuuaaucuagaggacuaaugacaaaacaacuuucagccauuguggcuaacauuuuaucauguccuggaacgucuuggacauagucuaaugcuccaccucauguacgcccaucugaaugacacaaugcccaggcuuuggcuuacuuuggcucccuuugugcaggugacaucugagugcauagcaccuacaacuugccagcccugaaacagcugucauaagaaucucacuuguacucacaacaguucuucagcuuagaucauuguccuguguuaccuaaucaggcucagaaagaugaauuagugaccacaaaguuaaacaacuaguacaugguggcugagauuuaagccagaucuuugugacuccaaagcuuauuucccuuucacucacuuguguuauuucccaaccccuuuguaauuaaaacccuucugacuggauacaguuacuucauuuaccaaaagucaaggggguuuauuuuauugccugaaguuaugcauuuuguucaucuuaaauauagucuuuagaagucucacaugacccuauuaaucacauuucuauucugaagucacgauacacggugguuccucugcuucccagacacuuggcuauuucuuuaaauugccaagcccauugggaggaaacuuuaauuuccuuagaauuccucuauguuuagagguggcucaugccuguaaucccagcacuuugggaggcugaggugggcagauugcuugagguuaggaguuugagaccaggcuggccaacauggugaaaccccaucucuaccaaaaaauacaaaaguuagcugggcaugguggcaugcaccuguaaucccagcuacucgggaggcugaaguaggagaaucgcuugaacccaggaggcggagguugcagugagcuguuaucaugccacugcacuccagccugggugacagagugagacccugucuccaaaaaaaaaaaggaauucuucuguguucaaaguuuaaaacgggcuacuauucuaaaacuuggugauuuacaacaaccauuuuauuuugcuuguaauuuguggagucaggaauuagggaagggcaguucucauuuggggucucucaugcagggucagcaagaugguagcuggggcuggaauccucuaaagccuucuuccucgaaugucuggcagcugggcugccugacucaaauggcugggugauggaacugcuagagcaagcuggcaccucuuuccacuuucuuagcagccuuuucaugugugcugcugugagcuuccugagagcgugguggccucagaguaguuggcuucuucccugucaguucaaggcuccaagagcgaguguuuccagagaccaagguggaagcugcaaggccuauuaugaccuaaccuuggaagucacaucgugucccuuccucuguccucuguuggucagagcagucacagagccugcccgaauucaaagagagagagcagauacaccuccgccucucaguggaggauugccaaagaauuugugccugucuuuuaaguuguuacaagaagauuuuucucuccguuaauuuaugaauuccaugcaaucacaaaggacuaguagaauuuucuucuuuaaauucaugauaagucagaaaaaaaugagaacaacgacaugagagaaucugguguauaauaaagucuggggcaaagagagauuauuuaauaagagguguuggguuggccagguuagaguuaaacuugaauccuaccuugcuucuuauuuuaaaguaaguucugaguggaucacaguuuggaauguaaaaagcgaaaccauuaaguucuagaagaacacauggauuaacuaucuugcaguggggaagguauucuuaugugaagggaaaaaaauguuacagaagucguuaaaggaaaaguuagagaaguuugauuucaaaagauuaaaaacccuuauuaaagauguucagcuuuacccacaacuaagcagcuaaggcagugagauaguguuuuauuccauauuggcauacaugaaaauuuaagacccaaaguugguacaguuguaggaaaauaggcucugucaauaacuauucagcuuuuuuggaaagcauuuuggcaguaacaaucagauuuuauuucuuuuuuuguuuuguuuuguuuaagagauggggucucccuauguugcccaggcuggucucaaacuccugggcucaagugaccuucccaccuuggccucccaaagugcugggauuauaagcaugagccacugcaccuggccagucagguuuuaaaaugcauguaucuuuggauacagcagucccuugcacaaggauguucaucauggcaucacuuauuuacaaacuggaaacaaugaaaaauaccucuugauaggaaauugguaaaauaaauuaugcuacauccaacuuagugaauacccugcacccacugaaaacagugagguggaacagaugaacuuauguaaugagcgcccagacaucugacuguuuuguuuuuagugacugucuuuggagagaaggacuagaucugaaugaggaagauauauacacacaugcacuuuuuugaacccacagaugcagaauauauuguauggaugcacauaacuuuuuuccaacauuuuauuaugaaaauguucaaaauauaggaaaguugaaagauuuguacauugaacacccauagaccuaccaucuaaauucuacaauuaguauuauuacauugccuuaucacuauuuagccaucuguuggucuguauuauuguguuugaugcacuuaaaaguaaauugcaaacgucuuuacauuucaccccaugucagcauuauaucauuagaguucaguaguuguuggguuuuuuuuucccccuuaaaguagauaauuuuuuaaucugucaagggaaaaguuucaggaaaccuuuucuuugcuugaaagagcucaguauaggagagcgcaguacagcaugauagaacuagaugagaucaggaucuggagucccaugaacgaacgcccgccuauuugaauccugggucugccccuuaauacuggcgguaccuggcccaaguuccuuuacccuucugagccagcauguuucauccaugaaaagggcuaggauuguugugaggauuuaagaagacauaaaguaaccagcacagaguagguguucagcaaauuggagaucacuucucaaacuacugcguggcauguggguggcccauaagacgugacugaaaccucugaaauggucuuucccuucagagcacucugcuauuugguccugaagcaguacacagaagcagugaaggacugcacagaagcccucaagcuggauggaaagaacgugaaggcauucuacagacgggcucaagcccacaaagcacucaagguaaaaaaaaauccuggccaaaaggucccaacauagcuacagagauuuaugccagugucaccauuuacaggguguagccaagcugagacaauaucugcagcuuuuccuucucauccugggcccaggauaacucagagcaggccugugggcugggguuugaaaacacuuugcugccucagcagcuauccccaccccaguccgggaaccuucccccacacuccugucuuuucuucuauuaggacuauaaauccagcuuugcagacaucagcaaccuccuacagauugagccuaggaaugguccugcacagaaguugcggcaggaagugaagcagaaccuacacuaaaaacccaacagggcaacuggaaccccugccugaccuuacccagagaagccaugggccaccugcucugugcccgcuccugaaacccagcaugccccaagugagcucugaagcccccuccucaaucccuugauggccucccacccuguaagaggcuuugcuuguucaaauuaaacucaguguagucaaacacagacaugguuguugcaccagaaagguccccacuagagcuaagcgugaagcugaagcucugucccuauucccccagcccagcuagcugaucacaccaacagauccucaucagcaaagcauuuggcuuuguccugcccaagugggcugcagacugagugcugcccuuguagcuuccccagaccccaacucacugcaguucaucugaacaaccugagcuccugggccgggguggaaggagggggauaaaccuaaggcccugauccaaagcagccuguugagcugguucuccagggcugcagucucuccagguguacagcugcugucccugcccuguccuguccuugcacagucuccuaugucugagccccagugccuucuguucgggcccuccuuuggugggaaggcagagcccugacccuugaaugguuguccuugacucugugcugcugccuucugcagagaggcaccuaagcuguuuaaagagcccagugauuguggcugcuccuccuagaggugggagggggcaagaggccuccuuggucaguguccaugcuuucugggcagggacuugguuuuuuguuccaacaguggccuucuccgggcuucauaguucuuuguaauauguugaaguuaauuugaauugacugauuuuguugaacuguguguuuaagcuguugcauuaaaaagcuuucuucuacaucaauaucugcugugcuuucauuuaugccuuuucagcuuugcaccuggaacucuguaguaauaauaaaaguuauugcuuauugggcauuca

SEQ ID NO: 191271 - RNA, 19491 nt, Homo sapiens
uucaccaucuguguuuacuacaaacuguuuaauuguuucuuaucccaauaacuuuacaaauauagaaccacaugcuagucugggggugcugugcagugagucacuacaaacucgcucaggcacagcuuaaugccgcugagauccaucuaggagcagucccagcgguggccucagccacgugaggaagagggcuuuggaggagggcugccaaguguggccaggggacccggccucaggucuguggaggugcuucaacagcacgaugcucauucucuguccguagugucuccauauacuuucucaucuucuccaccauccaggaggguaggacaaaggauuucaauuccucuagcuucagauccaggcauccucuggaacagacauugaagagagaaguugggggaagugaggauguaggcccugccucauucuaggggcuauuuggaggcagggagaggagaaggggcaggagacccacugguuuuaccuguaaucaucacuggccgcaaggucccggauguccuccucgaugaggagguaggccugaggcaggagcaagggagaguggucauugccugauucauuucacuccaacucaguaacacuucauuaaacaucuguuuaauguaaggccugcuacuagguggaagcgggggaugcgguuuacaauuuaguacggaagaguaaguggggagggaugggaaugguuccuugagacaaucuuuuacuacaguagaugcuucauggaugggagaguagggacuggugacuuauuuauagccuucucuuuuaaaaaaggacccauuucucucuugaaugguguggugaaaauuaagaaaaaaaaaaaaaaaagaaaaaaagaaaaaaaaagggauccaccauugcuccuacaccuuuugguuaagaucaaguauacgaaaggacccaagguggguuauaacaaaauggcaagaaagccagcaaaauauauauggaaacaggaaaucaggaagaggaaaccaugugcucccucugaggacaaagauaacuugguuuugaacuuuguggcaaaauggaaaacaugauaaacugcucugcugucuaguaauuggccuguauuguacuggggccuguagaaaugcuuugucacaaugccucggucuacagugggugagggcccuuuugugaacuuaacauauaggaagagauauucaucauauuagaaagucuucugugggagacuuucuaauguuagggucaggaauaauuguguauuccuugaguaauuugucuacaucuuaugggcacuaugaaccauaacagaucagguguccaugaguggggccuacagcugaauuugccaacaucuguagaagugcacaggucucccaggucagcaauauaaaaaacacuuuuuuuuuuuaaagaacuacuuuuacugguggcuuaauuuuagguccugcccccacccccuaccaucuauuucuuauuuauguaauguugcauuuuaugugcaugaagcuuaccugaaaucuuuuuugaaguaaagcauaggcauaaauagaguaguaaaauaaaauaaaagguagcucucacugccagaaaggagauggcauaucaguuuguaaggcacuuagauucuaaaaggagcaguaccuguggugggagugagugaguccucaggugggggacauugugugugauggacaaagcccucaacaauaguuuuugaacacaugcaaugaugauuuuccuaagguugcuguuucauaugaucugagaacucuucaaguagagguaaaucuggaaggggcugccaagugugcaaacacauuucauugcuaacuccuacugacaaggguugcugccucaaguacuguguugagaaaagauucuauagcugugucugguggaagagugaucaaugagugaaaucugucagugggugcaguagugggaaaaaguaguacugugugucuuauaccugcuauuccuauggacagcuaauaguauccaaauaugugaucuuggaggcaugagguaaaagugugagggggcggaagggagaccuagggauagggaagggaaccugaagauuacaauuugcucuucagcaugaagaaauaggccuuauaagucucucuucucacacauuggugaggcuuuggaagucagauuuggagguaggcugucacccacagccaaaauccugguucccagguggggugggucacuggcaguggcacaaaugaauaaugcuuaccaucuugcccccuguugcccgcaugugaugcugcucagccagccagugcuuauccugggggucagcugcauacuguaaggaaugaaguuguaagaaaauuagccucggguaaggggcuuuucucauuuggucccagagcauacucuuggcccuugagcaguucuuaccaaaaguccuugucuccaagcgugguggacuuagagggcucacuaaucucuucagagaaagcuaagccaaccccgagggcagaccaugggacccaauucccagagacuuaguauacucccaauccccacccccuucucacaacaaagcaccccgggcaacuggugggacugauaacuauuauuuuagagcuuccucuuuuuaaaaaaugaucggagguggcuuauaacgucuguaauuauuauggugaccauaauaaaacaaaaaucgggacaccucauguacucucggacgcauaauagcaucaugguuaagaauucgguuuuggaguuacaaauaagguugguugguuuauugauugauugauugauugaucgauugagacggaguuucacucuuguugcccaggcuggagugcaauggcaugaucuugcuucaucacaaccuccgccuccuggguucaagcgauucuccugccucagccucccaaguagcuggcacuacaggcaugcgccaccacgcccggcuaauuuuguauuuuuaguagagaugggauuucuccauguuggucaggcuggucuugaacucccgaccucaggugaucugcccaccucgggcucccaaagugcugggauuacaggugugagccaccgugccuggcuguuuauuuauuuauugagaugacgucucgcucuguuguucagacuagagugcaguggcaugaucuuggcucaccgcaaccuccaccuccuggguucaagcuauucuucugcuucagccuugaauagcugggauuacaggcacgugccaacacacccagcugauuuuuguauuuuuaguagagaugggguuuugccauguuggccaggcugguuuugaacuccuggccucaacugauccacccacucagucucccaaaguguugggauuacagguaugagcuacugugcucaacccaaauaaggcuuaaauucugguuucuauucuagguugggcaccuagaaaccagaauuuaagcaccuuaaaaaaaaaaucgaggagugaagagaaacugauauauauauuuuuugagacagaguauugcucugucgcccagguuggagugcaguggcgugaucucggcucacugaaaccucugccuccuggguuuaggcaauucuccugccucagccucccgaguagaguagcuaggacuacaggagugcaccaccaugcccggcuaauuuuuguacuuuuaguagagaugggguuucaccauguuggccaggcuggccuugaacuccugaccucaggugacccgccugccucgggcucccaaagugcugggauuacaggcgugagucacugcaccuggcugagaaacuguguuuugcucucuacuaccuccuguguaucgucugaaucuuuuuaccacgggaauggguuuauauauuauuucuauaaucaaaacauuuaaaaaaggaaaagaauuugaauaaugccuucugaaggagagaaaaaugggcaaaagauauaacaggcagcuuacagaagaaauacaaauagauucuaaaugacugaaaagauacuuauaaucacuaauagagaauuuguaaaguugggccaggugcaguggcucaagucuauaauuccagcacuuugggaggcugaggcuguggaucaucugagcucaggaguuugagagcagccuggccaagauggugaaaccccaucucuacuaaaaauacaaaaauuagccgggcaugguggugggcaccuguaaucccagcuacucgggaggcugaggcagacaauugcuugaacccaggagguggaggaugcggugagcugagaucgcgccacugcacuccagccugggugacagagcaagacuccgucucagaaaaaaaaaaaugguuggucuaucacuauucucauuuuauacaggacaaaaacagacucagaaauguggaucaauucccagacuugagcuaguuaaaaaaaaagaaaaaagaaaaacaaauguggagccauuuguucaaguucaugcagcuaguaaaauaauggaaccaggccugaagccauacuuuaaaccacgcugaagugggaauucaaaguagguccaaaagcauauugauuuuggggaugauacaaacaaagcucuuggaggagguggaucuuaaagaauagucaggcagauaagggugggagagaaaggccacccaggcaaugggaauagcaagagugacgacauuaagagaggaaaacaaaggagccacugggcaaacuguuuaaguguugggacucgaggauaucagacuggagaagaagcgugagcagguaugccuuucaaagaacuugaaaacuugcacagaaugugguagagaaagcccgugauucugggaucccacagggcugugcaguucuggcaagaggugccaagccuuacguauaagugcaaaaaaccauguguggaacacacaugcacugcuauucuucuaaucuacuucgaugcucucgugacugauaaaauacaaaaucaucuaagagggugagugaguuuaugauuuccuccauuauucccucaaacaguggggaccaaaacauagcugcucucagaagaggaguacccucuuugaaaaggcacaggacccugccuugcuccaaacucuauuuuuuuuuuuuugagauggaguuuugcucuguugcccaggcuggagugcaauggugagaucuuggcucacugcaaccucugccuccuggguuuaagcgauucuccugccucagccuccugaauagcugggauaacaggcaugcgccaucaugcccagcuaauuuuuguauuuuuaguagagacgggguuucuccauguuggucaggcuggucucgaacucccgacuucaggugauccgccagccucagccucccaaagugcugggauuacaggcgugagccacugugccagaccccagaguuauuuuaaaaugcaaauaugagggcagugugaucucggcucaccacaaccuccgccuccuggguucaagcgauucuccugccucagccuccugaguagcuggaauuauaggcaugagccaccaugccagcuaauuuuguauuuuuaguagagacaggguuucuccauguuggucaggcuggucucgaacucccaacuucaggugauccacccgccuuggccucccaaagugcugggauuacaggugugagcucacgcaccuggcccaaacucuaauuuacagacaaccaaauaugguagugguuaagagcucaggcuuuggugaggacagaccuggauuugaauccugacucaccauuucuagcugaauaacugugggcaagucacucagccuuucucaaccucugauuguuucaaauuugugaaauaaggauggcaauacuuauuuuuuaagauaauauaagugugggauuuaaaacuguguuuggcacccaguaagcaugcaagcaaaguagcuguuauuacugaggcacagagguguugaguaaaucaugaaagggaaaggugaauggcagaggcacaacuagaacccagauguccugacuccaagaucaguguuuguucuaagcuucucugugcugaguggaguucccagucuacucccaaugcaauggccugcuuuccucccagcagucaccuaccuuaaagaggugugggugcuugauguagauucuuccucuggugccccccauccccagggcucugaaaaguaaaagccaaguggucaagauuccagaaaguguaguccuacuagugaacuccugagcuguuuccucaaucagugccaaagcucuuaaacuuacuuguuggcucgagaucccaacacaaaggugguagauucauucaggcgagcugggucccacugugcaaaaaauagagaagcucgugagggugaaguuuaaucugauggguaggacagaaacacuccucccccuacccuuuucuaacccuuccccuugucuauuauuuaaucaacaguugacccaagacacugaguacucacaauaugcuaggcccugucugugcuagauacuggggauaaagagaugaauaagauacagucucuguuuucuaggaugccaccaacauauguacagauaauuacaccauugugcgaugaggcaaggacacaagugagugcagggucugagggcugccgaggggaggguccagccaggaaggcuuccuuagagaggcauuucccaaguuaauucugaaagggugagcacaaguugggguaaagggggucaggaacaagggcauuccagacagggggcagcaugagcaaagacaggugagaggcagcuuggccugcuggagaaacuacuaguaauucugugcugcuaacagagagaguacaaauuagggaguggcagcugauggggcuggagagagaaacacagaggaguuggaggucuuaggagguuauguucaggggacugcauuuuauuucuucuguaggcaauggggaaucgcugaaggccucuaaacagggagugagagucagauuuccuuuaaagauagcuuagucuucuagcaauguggauaauggauuugaaggggcaagacuacaggcagggagagcaguuuagaggccgcugugauaaagcaguuggaaagcugcuaagggccugagcuagggcagcaguaaggaugaacagaaggaaauaggaacugcaauauauuuaagaggaagaauuguccaggacucgacuggguguagggagguaaggaagaggaggaggaggcaaagaugauuaagauaacgaauguaaagaagggcugugaggaaagauucuaauuucauguuuggauaugcugagucugaaaugccuaugaaacuuccagcagaguggucaagcagauaguaggauaaacaaguuuuaaaguagaaagaggcaugggauggacaaagagguaugggaguuuuagaacaugguggucccugaaaccauaagaguauauguuuuagauuauccagagaguuacuuuagauggagaagugggccaaggagagaauucuggggaacaaccauuuauauaagucacugcugaggaagaacucaggagagagagggaggcaacagaggcuaaugguugagagcacagacucuggugucagcgggucuuggguuugagacucagcucgaucacuuacgaguuaugugacuuugggcaagucuuaagugcauuaaguguauaagacaacugaauaaaauaauuuaugcccacagggaagcuggcagaaaaggaaacgccucauuuauagaaugguucacagaauugaucucauaaguuuguuauaaagauuaaaugagauggucuacacaaaagauuuaggacacugcccguuacauacuaaguauugaaucaguauuagugaccacuaacuccuauaaggagaaggcuucagcaaagacucaagcccucucuuuguuuugccucuaacuccaauuccuacacaggauccucucugaggccaguguggcuggagguggagaggggcagauggcucuggaauggugugcaugcacccuucgcccccugccccuuucccucaugguggguccuagagauagugggacuaucuccugggaucgugaucucugccaugcucacauaaucauaccuuggggccuucccggcgaauugguucacaggauuuugguuuccaucugcuuggaaggaaagaauaaaggugaauucuccaaggugagaccuaggacuaaaugccagcuugcugguggugguaggaguuccucacacacucucacuuuagcccuggacauccuccuucguggugacacauaagaggaggaacaaagggaaaaaaagcacuggacuagaagccauucuagcacuagcucugcucuuacauaguggcaugagcaacuccaagaaccucugaguggcaguuuucucaucugucaaaagagacaaaaacagcaacugcccuaccuaucuuguguuugugaggaauaaaacugcuucguguaggagacacaucuaagguaugacaguuaauacuagcccaucuacuaagccagcuguuccaaacuaaccccacgccccugaaccagaccaguguggcuuuauuugauuuaaauacugggcucccauguaaaguuuuguuugaaaaagauucugcugcuucagaauuuuuuuuaaaaagugggguuggggguugguugagggggaaggaaggaugaacaggcagaacacagaggauuuuuagggcacugaaagcacucagugugauacuagaaugguggaugccugucacuaugcauuugucuaaguucauguacaauaccaagagugaacccucauggaaacuaugcacucugaggaucaagacgagucaaaguaggcucaucaaauguaacaaauguaccacucuggugccugaugucgauaaugggggaggcugugcauguguagggucagggaguauacgggauaugucuguaccuuccucucaauuuugcugugaaccuaaaacugcucuaaaaaaauuaagucuuaaaaaaauauauauuugaaaaugaccgucuuggaggcaauguuaacgauaugacauuaggcaaguaauucucugagucuguuaucugaaaaauuaaugauaucuucuuuacaggguggcuauaaagauuaaaagguaaaguauguaacguauuuagaccagucauaagcauccaauauauacuaacaaugacaaaccucuggaguuuaaucuuucaucaagcugggccaaaccguucaggggguaaaacaauuuccuccucacuacccuccuuccucaccccuccaaccaggauaaccccccuccacgaugacuuaagcugauggaucugauuuugacaggcacagaacccuggacucuuuuccuucagggccccucucuccgucugcuccccuaugcucucaccacacuguuggucccuacucacaccaugccggcggcugcccggucgcuugacaggauguguccaggaggccguccuuuccucugccacaaaaaacagcugucagaggucugacccugugguuacuccccauaccccauuggcagguccagggucacuuggcagagaugguuuuccaaagagaucaaaugauguuugacagggacagggagaaaaacugccucucaugucuaggaaggcucaaaagggcuuugaggaagcccaguaccuugcggagugaagagccuuuuuugagagacagggucuuacucuguuacucagccuggagugcaguggcaugaucauagcucacuacagccuugaacuccugggcucaggugauccucccacugcagccucucauguagcuaggacgacagaaaugugccagcaugccuggcuaauuuuuuuuuuauuuuagagacagggucucacuauguuacccagacuggucucaaaacuccugagcucaagugauccuccccgcuuggccucccaaaguguugggauuacaggugugagccaccacacccggccugacaagccuuuuuucagccagaaaacaaaacaaggaaaugguuuaccuuuuuaggaagggggcuuccucgaugggcacauucuucuucugccugacggccacgcuaaaagaaaagggaagggagucaguggaaggccagugccugggagcugcaggucuucuggaguugcagaagacagcccuggacuacagcucuccagccccgcucugacccaggccaaagaagcccauccagcaugaugcugugugggccugguccuacaaauggaaguacauggaaccucccugggcccacauauuucacuugccucccagccugaaggaccucccgcuccaauacccgagaacacagugacucugaccuuuauuccuggaagcucaugggucaaucuggguauuacuuuuucuccaucugaaaagagcaguuuagccugaagggaaaaagaccaaguguuaccagucacuauuuugguggguaagcacacccuaccuacuuccuuuuuuuuuuuuggagacagagucuugcucuguugcucaggcuggagugcagcagcaccaucuuggcucucugcaaccuccaucuccuggguucaagugauucucaugccucagccuccaaaguagcugggacuacaggggugcgccaccauacccagcuaauuuuuguauuuuuggaagagacgggauuucaccauguuggacaggcuggucuugaacuccugaccucaagugaucggcccacuuccaaauauauauauauauauauauauauauauauauauauauauauauauauauauauauauauauuuuuuuuuuuuuuuuaaauugagauggaguuucacucuugucgcccaggcuggagugcaguggugcuaucucagcucacugcaaccuccgccuccuggguucaagcgauucuccugccucagccucccaggcagcugagauuacaggugcccaccaccaugcccagcuaauuuuuguauuuuuauuagaaacgggguuucaccauguuggccaggcuggucucgaacucuuaaccucaggugauccaccugccuuggccucccaaagugcugcgauuacaggcaugagccaccacgcccagccacacacauauauauauuuauaugcauagaaauagauaucuauuuuuaaaaaaacuugaauuaaugaucauggcuggaaaaauuaaaaaauguaaaaaagcaaaauaagaaaaaccuggaaucucauuacauaaacuacuauuaauguuucaauguaaauucuuccuugcuuuucccauguaaauacauacuguauguuuuuucaaacuaaauacauuaguauaacacauacuccucaguaagcugcuguuuuucuuuuuucuuuuuuuuuuugacauggaaucuugcucuguugcccagacuggaguacaguggugcgaucucggcugucugcaaucuccgccucccagguucaagcaauucuccugccucugccuccugaguagcugggauuacaggcgugcaaccacacccagcuaauuuuuuuuuuuuuuuuuuuugguauuuuuaguagagaugggguuuuaucacguuggcuaggcuagucucacacuucugaccucgugaucugcccgccucagccucccaaaguguugggauuacaggcgugagccagugcgccuggccugcuguuuuucuuuuaauaaauacugaguaccugggaccuaagugcuguggacacagcaguaacuaggacaagcucuuguggagcuuauaguuugugggugaucuggauaauaagcacagaaacaaacaagguaacuguggaucaugauagaugcugugagaaaaaaagaaaaaaacccaggcagaugugacagagaaccaccagaggggaagggcuacuuugcgggaauggccagggaaggccuugcucagaagguggccucugaguugagaugugaaggaggcuguaaaaaaagcugggcagaaguguuucagcagcagggaggagugcagaagcucaaaggugggaacaccuggcucauuugacaaagaaaaggauggaaugggcagaggggagauggugcagcagguggagaauuggguucacccgaccucugccaguggcauuugacagugcugagggcucccccuucuggaaacacucuuuucuacaggcuccuguggccacacuuccuguguuccuucuacuucucuggccguucuuucuuagccuucuuugcuggcuuuuccuucucaaucugguucuuuucccuauccucucucauuacauauucuaucugcucucaccuauucucacagcuucaauuaacaucuauaaaccacgauuccauaauucaacuguagacaaaagguuauccucugagcucuagacuuauauaccaaauagucugccccaugucuaugcuuggauggcucaaagcugcuaauccauaauuggauucaugcucuucuccuccaaacuuugucccuuuccagugaagggugaucaagucucaauguguaauuaugcacacauuuguugguaaucuaauucacaccugucugcuuaaguaggcuguuaaguucuauuagagcaggaagcuuguuuguucauuuaucauuuguuuguuccuucauuuacucaauaauucagcaaacucuguacacauacuaagagucauauuccagggcugggaauacaguggugaacaagauuaggccucaacucuuguaaagcucaagauuuuagcagagguaggagugcgaggggaagaccucucugauauuuaaacuaagaucugaagaaaagaaggagccggcuuuauagaguuaaggguagaguaccccagguacuaagaacagcaagugaaauggccuaagcuugugcuggaggagcagaaaggaguucagaacagccagaguauagucaauaaaaaagaggugagaugaaaugaaguuaaagaagcaggcagaagccagucgaggguaggcucugugggucaugguaaggcauuuuuuuuuaaauuauacuuuaaguuuuaggguacaugugcacaacaugcagguuuguuacauauguauacaugugccuuguuggugugcugcacccaguaacucgucauuuaacauuagguauaucuccuaaugcuaucccuccccccucccccaaccccacgacaggccccggugucugauguucccuuuccuguguccauguguucucauuguucaauucccacccaugagugagaacaugcgguguuugguuuuuuguccuugugauaguuugcugagaaugaugguuuccagcuucauccaugucccuaaaaaggacaugaacucaucacuuuuuauggcugcauaguauuccaugguauauaugugccacauuuucuuaauccagucuaucauuguuggacauuuggguugguuccaagucuuugcuauugugaauagugccacaauaaacauaugugugcaugugucuuuauagcagcaugauuuauauuccuuuggguauauacccaguaaugggauggcugggucaaaugguauuucuaguucuagaucccugaggaaucgccacacugacuuccacaaugguugaacuaguuuacggucccaccaacaguguaaaaguguuccuauuucuccacauccucuccagcaccuguuguuuccugacuuuuuaaugaucaccauucuaacugguguaagaugguaucucauugugguuuugauuugcauuucucugauggccagugaugaugagcauuuuuucaugugucuuuuggcugcauaaaugucuucuuuugaggagugucuguucauguccuuuggccacuuguugaugggguugcuuguuuuuuucuuguaaauuuguuagaguucauuguagauucuggguauuagcccuuugucagaugaguagauugcaaaaauuuucucccauucuguagguugccuguucacucugauggucauuucuuuugcugugcagaagcucuuuaguuuaauuagaucccauuugucaauuuuggcuuuuguugccauuccuuuugguguuuuagucaugaaguccuugcccaugccuauguccugaaugguauugccuagguuuucuucuaggguuuuuaugguuuuaggucuaacauuuaagucuuuaauccaucuugaauuaauuuuuguauaagguguaaggaagggauccaguuucggcuuucuacauauggcuagccaguuuucccagcaggaucaugguaaggcauuaagacuuuauucucccugcaacaggaaagucacugaaggguuuuuaaaauggggagugacaugaucuaauucaucuuuacggagaucagucuggcugcugugagaagaguggauuggaacuggguaacggugaauguaacucuggacugagauauaaaugugugaauuaugagcggcugaauuggcuuccaagccacaggacuagaugaaaacaccuaugaaaacagugagccaugaaagagaagggguuugaggacugaacuugggaaggcaccaacaguuagaggcggggggugagagagaagaguaggcaaugagguuggagcaaagucaaggcacucuagccaacagaggagcauuccaagaaacgcgaaaugauccauugugacagaugucacugagaagcugaguaaguugaggacaguuagggaccagaggguuugacaacacggaaguuacuagcgaccccgacaagagggguuccagugaaguaguggggacugaagcgaaaacaaagugaagagaaugaauaggaggugagaaagugagccagcgacuauuggcgaccuuuccugaugucucccuauaaaauggugauggcaacaauuccuccuaauaacagcagcugacacauguaaacagguucucuacuaucuugggaacagucauuuauagaccugaugucaugcuuccugaccacaccagagaggcagggaggcagcagggugcucauccccaugauaccaaauggggccaugauaacuugauccaccacgcaccugcaggggugagacagaucuuagcuauucuaauuauuaugugucuuaagccauuucuuuuuuuuuuuuugcuuugcuuuuaaaaauuuuuuucuagcucuauugauguauaauugauaaacagaaaugguauauauucaagguguacaaugugaugaauugacauagauauacauagugaaaugauuaccacaaugaaaucaaucaacacauccaccacuaccauuuuguguguggacacuuaagaucuauggucuuagcaaauuucaaguaaacaauagagauaaacuauagucaucaugcuguacaucagauugcccagaacuuguucaucuuauaacuaaaaguuuguacccuuugauuaacauccccccacuucuccccuccagcuacugccauucuacucucugcuucuaugaguuugcuaagucacaauuucuucaucuauaaaauaguaauuaaaagauaucuucuguacauaguuucuucugagacauaaaaaaaaauaaugcauuuauccugguaccugacauauaguagcuacuucccuuccuuucccugucagcaacagccucaagccuaucucaauauguggcuugcugggcauuccccaaaauaccacugaugacaagaucacauuucuuuuuuuguuuguuuuugagacagaaucuugcucuuucacccaggcuggaguguaguggugccaucucggcucaccgcaaccucugucucccagguucaagcgauucucgugccuauggcucccaagcagcuaggauuauaggcgugcaccaccaugcccagcuaauuuucguauuguuuguagagaugggguuuagccacguugcccaagcuggucucaaacuccuggccuugagugaucugcccaccuuggccucccacagugcugggauuacaugugugagccaccacguccggcuuaagaucgcauuucuuaucagaggcucgagagcuaaaccuugugccugcaucucuuguccccuuuggucucaccugcuccaggcagcuccgacaggcuuccuggaucagcugcucugcguccaccuccuccccaacauugucucgcacguucagugcugccuucuggaagaacuaggggagcacaacagaggacaaggucagaguccuguuaaugugcaucaaccugaaggaaacugaauauaaaauaagucuuuauccuagcuucauacagaagggaaaagugauuaugagcagggcuuugggaucagccagauuuagauucacauuucaggcuugaccuccucccuuuauucccccucuuacggauauaaucgugggggugcccaacagauugagguguaaauagugcaaaaaaucaggacgggcgcgguggcucacaccuguaaucccagcacuuugcgaggccgaggugggcggaucacgaggucaggagaucgagaccauccuggcuaacacggugaaaccccgucucuacuaaaaauacaaaaaauuagcugggcgugguggcggaugccuguaaucccagcuacuugggaggcuggggcagagaacugcuugaacccaggaggcggagguugcagugagccaagaccgugccacugcacuccagccuggcgacagagugagacucugucucaaaaaaaaaaaaaaaaauuuuuuuuuuuuuuuaguagagaugaggucccacuguguugcccaggcuguucucaaacuccuggccucaagugauccugccucggccucccaaagugcugggguugcaggugugagccacugugcauggccccaauaaugguuauauuauuaaacaacuaauaagaauacuuauuggacacuuguuaugucuggagcacagugcucagcacaguacauuuaagucacuucauccuuauaagaggucagcaaaaaaaaccacgugcgugacaagggcagauuuuaaaaaaaaaagguaucugaauuacccucaaggagggaauaaaauucuugggggauuaaaaauuugaaaacugaccaggugcccuggcucacaccuauaaucccagcacuuugggaggccaaggcaggcaaaucauuugaggucaggaguucgagaccagccuggccaacagugaaaccccgucucuacuaaaaauacaaaaauuagcccugcaagguggugggcaccuguaaucccagccacuagggaggcugaggcaugagaaucgcuggaaccugggaaguggagguugcggugaaucgauauugugccacugcacuccagccugggugacagagugagaaucugucucaaaaacacaaaacaaaacaaaacaaaaacaacaagaaaggaaaacuuuagauaucuguauguaggaaagagacagacuggugaugcaggcaaggacugggcuccucaugagucuuucuccuguuauuuuuuauccugugucccucucaccuucauguacuuguugaagacagucuggaucuccucguugaugcugggcugcaggacagcucggaggagauccauggagauggcaggaucugugaaacugcauucaggagggagacagggugagggggcaugucccaaacauauucuuucccagccuccccaguuaauuauggacauagaauuccuuaacaauacuagacagcuuuuauugaaaacuagcuacaugcucagauuuugugcaaaucacagaggcaugacuuuauuucuuucucauaauaacucuaugaagugcauauuauuuucaaaguuuuuuuuuuugagacggagucucacucuguugcccaggcuggagugcaguggcgugguuuuggcucacugcaaccucugccuccuggguucaagcaauucuccugccucagccuccuuaguagcugggauuacaggugugcaccaccacgcccggcuaauuuuuguauuuuuaguagagaccggguuucuccauuuuggucaggcuggucucgaacucccaaccucaggugaucugcccgccucagacucccaaagugcugggauuacaggcgugagccaccgcgcccggccaauuuuuuguuauuuuuaguagagacgggguuucuccauguuggucaggcuguucuggaagucccgaccucaggugauccacccaccucagccucccaaagugcugggauuacaggcgugagccaccgcgcccggcccaaaguguuuuuaugaaauauaauacuuauacagaaaagucuauacacuuuaaugaguaauuauagugaacauccauuucaccacuaucagcaucccaaaggcccaccuugugcucucucccuucccugacaugcauacuauuaaucccucuuuauaguugagaaaacgggcucaucagagucuguugaugagaacacaguugucugacuccagagccuguucucuuaaacuccaugcuaacugaccucuuuagagcccucaaccacagagccagugaaugugagggaucuuagguauuguuuauuccacaacccaucuccugugcccuuccccauuuuguacgugaguucagagaaggaagugacuugacuaguucaagaucacacagaguuacagaaucggagucuccucuuccucaguccugugcucuuucuaccggcuguagaucuccauagccuugugcacuggggaucccaaaucugccaugcaagccaguggcugggauauaagccccaugcagggccagccuuaccuuguugucaucugugagcggcggccccuccgcugcaccugccggugcuuuaucauuauguuccaaggguucuguggggaccaacggaacaaaugucacugcggccugugacacuggggugggguggagguggaggguggguaugaaguuaaaccuggacaucccugcuucucagauccgucaccaucucucccgccuuggggugggacgauaguuguaaggccuccuccacaaaagaggaacugaggaaguuuccugccuuaaaagucccgacccugccuucuggcacggcaggaggaagggaagcaguauuuaccgagggucaacucugugucaggugauguccggggcguuguacccgccuuuaucuucccaucccacaacaaguuuuaugagacagguacuaaucauuuccauuuuauagaagaggauccugggacucaggggguugacagagauggcccacgucaccuagcuaggagggcggcaccagaauuuaaauccaggucgucgggcugcgaaaacgccaacccccucugcagcuccagccuccgcguucucucgcccgcgggccagggucccaggagccccgaggccgugcccggccugagcccagaccucaccgggggcgcccucaccguaagaaccagcugccccgcugcgcccgcaucccccagcuccaagccgccccucucggccccgcuagguccccgcggcugcucggcgucgccaguggcucccauggcgcccccggcccccacaacuccgcuggacucugucaccggccggaaaguggcgccgugacgucacu

SEQ ID NO: 191272 - RNA, 4342 nt, Homo sapiens
aaacgcgggcgggcgggcccgcaguccugcaguugcagucguguucuccgaguuccugucucucugccaacgccgcccggauggcuucccaaaaccgcgacccagccgccacuagcgucgccgccgcccguaaaggagcugagccgagcgggggcgccgcccgggguccggugggcaaaaggugagugaugcggccuaccacucgccgggccugccaugcccuaggcauugguacccagagcaaagauuucuaggaccaccccccgccgccaccuccuggagcgggagaucugcgggugcaggagaacacaccaggagcucggggccuggcauuccccugggcaugggugucgagggcggagacuuccgggacucccaccuccuugcgcgggugagauucgagagaugggggacaggccaggagcucagaccgcucuuugagacucucccgaaggagaaugggaggguaggggcgcugccagacuccuucccuggugggccuagaugaagacgcucaaggacccucgugacuuggccgagacaggggaagggagaaguugagucgggcaaggaagagaugcuaaagccuggggaauuaagaacaugccagaaucaucccgagggagucuggaauuagggagggugaggacucgcuaggaucguccuguggaucuggugaguauacccugagcugagccugaccuuggugauguggggagccuccaugacggcucccccugagauucaggugggagaagaugcaccgucuggaggccuggcccauccagacucccagguaaccccgaauacucuuuuuucaggcuacagcaggagcugaugacccucauggugagugauuaagugcccagaaccccagccuuccauccaauuuucaguagccuccuuuuuuccgucagcuuuuuugcuagacauagggguaauguaauuugcucccuccugggaaagaaguucauacaccccaccuacaccauuucuuccagcagucccuccucccaauuccauccccccacacgaaguuaucucgaacacuucccugaagucauacaagacccucccuauccagugugucccuacuuccuagccccaaccaagcuuuacccacacccaacuccccgcccuucuugguauuucuagccuaugaauuugguugcuuuauuuuggaucagagugaugagauuaaggggaggcugggcgcgguagcucacaccuuauaaucccaacacuuuggggggcuaaggugggcggaucacuugaggucaggaguucgagaccagccuggccaacauugcaaaacccugucucuacuaaaaauacaaaaauuauccaggcaugguggugcaugccuguaauuucagcuacucgggaggcugaggcacaagaaucauuugaaccguggagacagagguugcggugagccgagcgcaccacugcacucuagccugggcgacagagugugugugugugucugucucugucuaucucucucucucaaucucucucucucucucucuauauauauauauauguaaauauauauuuuuuaguagagauggcauaaccccaucuauaucucauauauauacacauauauauguguguguguauacauauauauguguguguguguaugugagcauauauauauauauauauauauauauauaaaauuaaggggaaagcucacccacugaccuuugcuaugcccaaaaguguacuccacauuccaacaaauguguuuucuccccagaugucuggcgauaaagggauuucugccuucccugaaucagacaaccuuuucaaauggguagggaccauccauggagcagcuggaacaguaaguguagggcugggaugggugagugagucuggggaaaggugggaagugagauccaagugcgagcucugcuucaagccuuuggcggagcaagacacuccuccugugacuguuuacauucucugagccauguggccuuguucuuucccucugugcaauaaaggguggguuuaaagcagggcugccuaucuuagauguuuacauggggggacagacagcaaggaaauggaugaagugaggacuuuggccaauagggccagaucucaagaaggcagcuucccauugcugcagaucagguuuaagaugagucagaaguccaaaucugugccaaaucuaauuuuuacguauuagcaacuaauauucuuuuuuuuuuuuuuuugagacggagucucgcucugucgcccaggccagacugcggacugcaguggcgcaaucucggcucacugcaagcuccgcuucccggguucacgccauucuccugccucagccuccgaguagcugggacuacaggcgcccgccaccacgcccggcuaauuuuuuguauuuuuaguagagacgggguuucaccuuguuagccaggauggucucgaucuccugaccucaagauccacccgccucggccucccaaagugcugggauuacaggcgugagccaccacgcccggccagcaacuaauauucuaauugaacuaaagcacaggaugccaauuuacaauccuuagaccaaagagucacugaugucuccaccagauaagaggaaagcaucaggcuaggcauaguggcucacaccuguaaucucagcacuuugggaggcugaggcaggcagaucacaugagcccaggaguuugagacuggccugggcaacauggugaaacccugucucuaaaauaaaaacuaaacuaaaaaaacuuuuuaaaaaggcaguggggagcaucagaaccagcucaacaguuugucuacuguccggucccagagaaacucaagauucuagcaagccccuuguguggggcuuggguugggacaugaggcugcugcuggagcuuacucugcaacuguuucuccaaaugccagguauaugaagaccugagguauaagcucucgcuagaguuccccaguggcuacccuuacaaugcgcccacagugaaguuccucacgcccugcuaucaccccaacguggacacccaggguaacauaugccuggacauccugaaggaaaaguggucugcccuguaugaugucaggaccauucugcucuccauccagagccuucuaggaggugacuuuagagaccaccccuccccuccaugcaacuugggaaccugucaggacucccuggggucagccucuucuaccgccuugaccuucucuuucucuccacccacagaacccaacauugauagucccuugaacacacaugcugccgagcucuggaaaaaccccacaggugaguccucaguccuugagcccagggugaucccucccccaaccuucaaaggcucccucaaacaaaaggagcccagugacuugggaccggguugguuggggcaggguggagugucggcagcaacccacuucuguuucugccccagugcuccuauuugcuauaaaauagcaauuguuuuauagcagaauaaaaauguuuggcgauaaauaauuuugggaaauuauuggugagaccaaggcaggaggauagcuugaggccaggaauucaguagagugccuugccugugcccuccagucucacuggaagcaagcccuuccaggagagcugccuagaugggcagugcagggagaaugccgggcugggaaaccagccccuccuccaccuccuccgaccuuugcaucccugguccagcugccucuugcccaccuuaauucauccugggccaggcacaguggcucaugccuguaauccuagcacuuggggaggccgagguggguggaucacaugaggucaggaguuugagaccagccuggccaacauggugaaaccccgucucuacuaaauacaaaaaaaauuaaccggguauggugguaggcaccuguagucccagcuacucaggaggcugaggcaagagaaucacuugaaucuaggaagcagagguugcagugagcagacaucaugcuauugcacuccagcuuggucaacagagugagacuccaucucaaaaauaauaaauaguaaagauuaacucauccugucuccaucacucacugagaccugccuguucucuuccagcuuuuaagaaguaccugcaagaaaccuacucaaagcaggucaccagccaggagcccugacccaggcugcccagccuguccuugugucgucuuuuuaauuuuuccuuagauggucuguccuuuuugugauuucuguauaggacucuuuaucuugagcugugguauuuuuguuuuguuuuugucuuuuaaauuaagccucgguugagcccuuguauauuaaauaaaugcauuuuuguccuuuuuuagacaa

SEQ ID NO: 191273 - RNA, 4342 nt, Homo sapiens
uugucuaaaaaaggacaaaaaugcauuuauuuaauauacaagggcucaaccgaggcuuaauuuaaaagacaaaaacaaaacaaaaauaccacagcucaagauaaagaguccuauacagaaaucacaaaaaggacagaccaucuaaggaaaaauuaaaaagacgacacaaggacaggcugggcagccugggucagggcuccuggcuggugaccugcuuugaguagguuucuugcagguacuucuuaaaagcuggaagagaacaggcaggucucagugagugauggagacaggaugaguuaaucuuuacuauuuauuauuuuugagauggagucucacucuguugaccaagcuggagugcaauagcaugaugucugcucacugcaaccucugcuuccuagauucaagugauucucuugccucagccuccugaguagcugggacuacaggugccuaccaccauacccgguuaauuuuuuuuguauuuaguagagacgggguuucaccauguuggccaggcuggucucaaacuccugaccucaugugauccacccaccucggccuccccaagugcuaggauuacaggcaugagccacugugccuggcccaggaugaauuaaggugggcaagaggcagcuggaccagggaugcaaaggucggaggagguggaggaggggcugguuucccagcccggcauucucccugcacugcccaucuaggcagcucuccuggaagggcuugcuuccagugagacuggagggcacaggcaaggcacucuacugaauuccuggccucaagcuauccuccugccuuggucucaccaauaauuucccaaaauuauuuaucgccaaacauuuuuauucugcuauaaaacaauugcuauuuuauagcaaauaggagcacuggggcagaaacagaaguggguugcugccgacacuccacccugccccaaccaacccggucccaagucacugggcuccuuuuguuugagggagccuuugaagguugggggagggaucacccugggcucaaggacugaggacucaccugugggguuuuuccagagcucggcagcauguguguucaagggacuaucaauguuggguucuguggguggagagaaagagaaggucaaggcgguagaagaggcugaccccagggaguccugacagguucccaaguugcauggaggggagggguggucucuaaagucaccuccuagaaggcucuggauggagagcagaaugguccugacaucauacagggcagaccacuuuuccuucaggauguccaggcauauguuacccuggguguccacguuggggugauagcagggcgugaggaacuucacugugggcgcauuguaaggguagccacuggggaacucuagcgagagcuuauaccucaggucuucauauaccuggcauuuggagaaacaguugcagaguaagcuccagcagcagccucaugucccaacccaagccccacacaaggggcuugcuagaaucuugaguuucucugggaccggacaguagacaaacuguugagcugguucugaugcuccccacugccuuuuuaaaaaguuuuuuuaguuuaguuuuuauuuuagagacaggguuucaccauguugcccaggccagucucaaacuccugggcucaugugaucugccugccucagccucccaaagugcugagauuacaggugugagccacuaugccuagccugaugcuuuccucuuaucugguggagacaucagugacucuuuggucuaaggauuguaaauuggcauccugugcuuuaguucaauuagaauauuaguugcuggccgggcgugguggcucacgccuguaaucccagcacuuugggaggccgaggcggguggaucuugaggucaggagaucgagaccauccuggcuaacaaggugaaaccccgucucuacuaaaaauacaaaaaauuagccgggcgugguggcgggcgccuguagucccagcuacucggaggcugaggcaggagaauggcgugaacccgggaagcggagcuugcagugagccgagauugcgccacugcaguccgcagucuggccugggcgacagagcgagacuccgucucaaaaaaaaaaaaaaaagaauauuaguugcuaauacguaaaaauuagauuuggcacagauuuggacuucugacucaucuuaaaccugaucugcagcaaugggaagcugccuucuugagaucuggcccuauuggccaaaguccucacuucauccauuuccuugcugucuguccccccauguaaacaucuaagauaggcagcccugcuuuaaacccacccuuuauugcacagagggaaagaacaaggccacauggcucagagaauguaaacagucacaggaggagugucuugcuccgccaaaggcuugaagcagagcucgcacuuggaucucacuucccaccuuuccccagacucacucacccaucccagcccuacacuuacuguuccagcugcuccauggauggucccuacccauuugaaaagguugucugauucagggaaggcagaaaucccuuuaucgccagacaucuggggagaaaacacauuuguuggaauguggaguacacuuuugggcauagcaaaggucagugggugagcuuuccccuuaauuuuauauauauauauauauauauauauauaugcucacauacacacacacacauauauauguauacacacacacauauauauguguauauauaugagauauagaugggguuaugccaucucuacuaaaaaauauauauuuacauauauauauauauagagagagagagagagagauugagagagagagauagacagagacagacacacacacacacucugucgcccaggcuagagugcaguggugcgcucggcucaccgcaaccucugucuccacgguucaaaugauucuugugccucagccucccgaguagcugaaauuacaggcaugcaccaccaugccuggauaauuuuuguauuuuuaguagagacaggguuuugcaauguuggccaggcuggucucgaacuccugaccucaagugauccgcccaccuuagccccccaaaguguugggauuauaaggugugagcuaccgcgcccagccuccccuuaaucucaucacucugauccaaaauaaagcaaccaaauucauaggcuagaaauaccaagaagggcggggaguuggguguggguaaagcuugguuggggcuaggaaguagggacacacuggauagggagggucuuguaugacuucagggaaguguucgagauaacuucguguggggggauggaauugggaggagggacugcuggaagaaaugguguaggugggguguaugaacuucuuucccaggagggagcaaauuacauuaccccuaugucuagcaaaaaagcugacggaaaaaaggaggcuacugaaaauuggauggaaggcugggguucugggcacuuaaucacucaccaugagggucaucagcuccugcuguagccugaaaaaagaguauucgggguuaccugggagucuggaugggccaggccuccagacggugcaucuucucccaccugaaucucagggggagccgucauggaggcuccccacaucaccaaggucaggcucagcucaggguauacucaccagauccacaggacgauccuagcgaguccucacccucccuaauuccagacucccucgggaugauucuggcauguucuuaauuccccaggcuuuagcaucucuuccuugcccgacucaacuucucccuuccccugucucggccaagucacgaggguccuugagcgucuucaucuaggcccaccagggaaggagucuggcagcgccccuacccucccauucuccuucgggagagucucaaagagcggucugagcuccuggccugucccccaucucucgaaucucacccgcgcaaggaggugggagucccggaagucuccgcccucgacacccaugcccaggggaaugccaggccccgagcuccugguguguucuccugcacccgcagaucucccgcuccaggagguggcggcggggggugguccuagaaaucuuugcucuggguaccaaugccuagggcauggcaggcccggcgagugguaggccgcaucacucaccuuuugcccaccggaccccgggcggcgcccccgcucggcucagcuccuuuacgggcggcggcgacgcuaguggcggcugggucgcgguuuugggaagccauccgggcggcguuggcagagagacaggaacucggagaacacgacugcaacugcaggacugcgggcccgcccgcccgcguuu

SEQ ID NO: 191274 - RNA, 21550 nt, Homo sapiens
acuggauaauauggacugagugucauuuccccugucagauagcaaauacacccccuuccucuuguaacccggucaggccuaggguuccucccugaguuccagaauaggccacccaguuggggcggacccuuaaggcauucugggcccacgccugccuauaaacccucauagugugaccuuugaccccuggugugaucuugggcccgggcugggaccagccccuaguguggguugugggggcggccauggagcugggcagcugcuucaagaccuaugaggacuucaaggagugcuucagcgccuacaaaagggagaacaggugcuccuucauucucagggacugcgucuccguccgcuuccacaaccucaaccauggcaccuccauccgcgaagacauccuguaagggcgggcggggcggggcgggccaagaggguggggaggaggcuggaccuccggagggcugccuggaggaggaggggugcauaggcacgcauugggcugcguggccauucauucaacaggcacucauugagcaccugcugugugccuugugaagagagcuaagccuccacggccauugguuuuugaccacccacuccacuuucacuccauucacaggcuuuucuggaauuuauaacugcaguuucucccauuguuuugagcagcugcagcaacccaaauacaaaguauggcuuucauaaacggauaaaaacaccuuggcgauaauuuccuucaucagucuccucuuuacaaaacagucacauggucguuggaauguucguucauucauucauucaguuuuuaguucuuauauauuuguugaaacagggucucacucugucccccaggcuggagugcaguggcacaaucagcucacugagccuucaacugcugggcucaagcgauccucccaccucagccucucaaguaguuggaacuggaggugcacgccaccaugccuggcuaauuauuugauuuuguacagacugggucuuguuauguuggcuaggcuguucccagacuccuggacuaagcgaucuuucggcgucucaaaguguuaggauuacaggcaugagccacuaugccuggucuauucauucauuuuguaaaugguuuuugagcuccuuauauuaaccguuuucaaacacuuuccaugugccaggcaguguucucuaugcaugcuuuacccugcagggcuuuuuuuucagaauuauagauaaauguuauuuuuuugcauuugacagaugagaagauuugacagaugagaagucaggcuuagagguuaagacaggaguugaaaacucaaaugccuucagggauuaggugaaacaacccaauguaagaaaguuuuaacuuugaauuuuacuuuaagaaaaagaaugaugaaauagcaaccaacaccaggucuuugugcuagggacaacagaagugugaaaugggccaaauggagaguagaugccaucuaaucagcuccagcugauggcugccauaugaaaauaaagaucuaguguugccagaauuuugggcaagaguugucagaaauccacacuuuauguggauuuucccauuuaaaaaaauugaaucaguucaaauuuuaacucagagcaugcgggccaacucagaguuaaagcauauccgaguuugagacuuggauugagaugcucaaccaaagcuccucaauuagacagccaggcuauauucuuuccacuguucugaaguccagugcuaugcuggguauaggugacauaaagaugaauaaguguucaaacuauccccagagaacuaggauaaacuugaacucaagcaaacuggugugugauaaaugcuuuaaaaggaauguggaaaaaaaaaaaaaaaaagaaauguacggagaaagaaaugaaugacaaaugccugggaggugggggaagucuucacacuggaauugaugguuucccugggcugugaaugaauguagagugcuagaguagaucugugguuaauuacugaguaccauggaggcauuugaccagaaguugcugugcagaaggaccuacaggagcaaagacaaagauacaugaaagaagguuggcauguuagaguaacagugagggauaccauguuuggcaggagaugaagucauuugcagucuaagggucuuuagggaccauugugagguguuuggaccuuguccuuuauggguaggaccuugcuaagcaaugagaggaauacaaaaaaaaaaaaaaaaaaaaaaaaccacaguugcccguaaacacccuucaggaagaccaucucagguggcuagcacaagguguggcccauagcaggcauuaaauaauuauugaaugagugaguuaucaaguacuaaccaugugauucagggaaauaggugcugcgggaacucagaagagaaaaaucacugcgagcuagagacguaagagugaaagggaggcuugagcugggcccccaaagauggagagcugucagaagguguauugguuuucuguuugccacucuagugaauuaccacaaguuuaauggugcaaagcaacacaaauuuauuaucuuagaguuauuuagguuagaagucaggcacaggucuuagcaggcuaaaucaagaugucugcagggcuguauuucuuucuggagucccuggguaagaauccauuucccgccgggugcaguggcugaugccuguaaucccagcacuuugggaggccaaggugggcagaucacuugaggucagcaguucaagaccauccuggccaacauggugaaaccccgucucuacuaaaaauacaaaaauuagcuaggcgagguggcacaugcccguaaucccagcuacucaggaggcugaggcagcagaauugcagccgggagguggagguugcagugagccaagaucgugccauugcacuccagccucggcaacagagcgagacuccaucucaaaaaaaaaaaaaaaaaaaaaaaaagaauccuuuuccuuuccuuuuccaccuccuagaggcugcccaacacaccuugggucauggcccccuuccuccaucuucaaagccagcaguagcagguugagucaucacaucacucugaccuugcuucugucaucacgucucugacucccucuucugccucccucuuccacuuuuaaggauccuugugauuauauugggcccacccagauaaucccagauaauuucccuauuuugaagucagcugauagccaccuuaauucuaucugcaaccuuaauucuccuuugccauguaaccuaacguauucacagagucuaggauuaggacaaggacaucuucaagggaccauucugccugccacaagaagauuaauaaccuggagguaaaaauggugugagucaguacagacguaaacaugacgugcuucuauuagaaaacagugaugggcugggcacgguggcucacacuuguaauccuaauacuuugggaggcuaagacagggagauugcuugaaaugaagaguuugagaccagcccagacuauaauccugggcaacaaaaugagauccccgucuccacaaaacaaaauuuaaaauuaggggccagguuguggcagcucacacguauaauuccagcacuuugguaggcugaggcaggcagauggcuugaggccaggcauucuagaccagccugggcaacaugccaaaaccucaucuguacaaaaaauacaaaaaguagccaggcauaguggugugugccuguaguaccagcuacucuggaggcugcggcaggaggauugcuugaucccaggagucagagguugcagugagcuaugaucgcaccacugcacacuacauuuuagccugggcaacaacagaguaagauccugucucuaaaaaaaaaaaaaaaagcaagcagugauguauguuugcacgcacauacaaaagccaugaggagaccugcuuagcuagaaggaaggauuuaugcuggagcagcaggaaaggaaauuggaggguugauaagcagguugguggguugggauuuguuuuguuuguuuuaggagacaaggucucgcucuauugcccaggcuagaguacagugggagggucauaguuuacuguaaccuugaaauccuggccucaaguaaucuuacuaccucagccuccuaaguagcuaggacuacagguaugcacccccaugccaggcuaauuuuuuuuuuucaauuuuuuguguagagacagggucuugccauguugcccaggcuggucuugaacuccuaggcucaagcuguccuccugccucagccucccaaaguguugggauuacagauaugaaccaccaugcuggaccuguuuuuguuuuugaaggugaacaauuuuaaaaguguuuuugggccaggcacaauucaaucacuugaacccaggaggcggagguugcagugagucaagaucaugccacuacacuccagccugggcgacacagcgagacucugucucaaaauaaauaaauaaaaaguguuuuuguguuugagugguuaacauaauuaaaaauauuuucaaaaaguacagaagggacuaaaagggucaccuccacugcauuagcuuuugguuuuuuuugguuuuuuuuuuuuuugagagauggaguuucgcucugucgccaggcuggagugcaguggcgcgaucuuggcuccccgcaaccuuugacucccugguucaagcgauucuccugccucagccucccaaguagcugagauuacaggcacgcaccaccccacccagcuaauuuuuguauuuuuaguagagacaggguuucaccauguuugcgaggaaggucucaaucuccugacccggugauccacccgccucagccuccccugcugggauuacagaugugagccaccgugcccagucugcauuaucuuuuuuaucuauuuauuuauuucauuuuuauuuauuuacuuacuuacuuacuuauuuugagauggagucuugcucugucacccaggcuggagugcaguggugcaaucuuggcucacugcaaccucugccucccggguucaagugauucuccugucucagccucccaaggagcugagacuacaggcaugcaccaccacgccuggcuaauuguuguauuuuuaguagagacaggguuuugccauguuggcuaggcugguguugaacuccugaccucaaguuauacacccaucucagccuuccaaagggcugcgauuacagcugugaggugccacgcccagccuauguauuuauuuauuuuuauuuuuguagaggugaggucucacuauguugcccaaacugauauugaacuccuaggcucaagugauccucccuccucggccuuggaaagugcuaggauuacaggcaugagccacugugccuggcccacugcauuauuauauagaggcaaucagcguuaccuuccugagagauacugaggcugaacaaacaugucuuguauaugcauuugcaucuuuuuguuguuuuaacacaaguggcagcaugcuauuuagacauagccuucuguaccugcuguaccuggcucuucucacuuaccaauauaucuuggaaauuaugccaccguaugggcaauuugauuugacuuucauugauuuccuuguuuuuuuuuuuguuuguuuguuuguuuuuuuguuuguuuuuugcaguuguuaacuaaaaaguuacuccaugcuggugucuggagauacguuguugaaaaauauaaauugaaucucugcucuuguggagacaaauacuaaucuauaaucacagaaauaauaauuuccuuaaagugguaguagagcuccaaaggaaaaacccagggugcccuguggaggggugauggugacacuuauucugauugucaggaacagggugggggugcugguugacacccuaaaccaaugcaggcucuugcucagaaaaaacugucagcccugagauuuugcagauacuuuacaaagcacauucaccuuuauuaccugaccugguucucugaauaaccuugucagaggcaaauuuugcuguucccacuaaauuaguuaauacauguaaagugcuuacagcagugccuuguagauggaaaauaguccacaaauauuguauuguuuuacagauggggagacagagccaggagaagucaaacauuaagagacaaauaguuuagggccaggcgcaguggcucaugccuguaaucccagcacuuugggagaccagggcagacagaucaccugaggucaggaguucgagaccagccaggccaacauggugaaacccuuucucuacuaaaaauaaaaaaauuagccaggcauggugguacgugccuguaaucccagcuacucaggaggcugaggcaggagaaucacuuuaacccaggaagaggaggcugcagugagcugagauggcaccacugcacuccagccugagcagcagagcgagacucugucucaaaacaacagcauaaauaacugaaaauuagacccagccuauuuacugacagagcucuuaauuguuguacuuagccacugggcucuaauaguuuucuaaugucacuuguccauuuuucccucaacaaacuugugguaagaggcuaaguguuuaccaugggccaggaguacaaagaugagcuggaguacaaagaugaggaaauuguaggcuccaccccugaggacaauagcggacugagauagcuuaggaggcggugaauucaugagcagcacaggucuuuagcagaaacaaguugacugcugguugugauguuauaaaggacauucuuggaucauuuauugcaaacuggcucugugcagagcucacugucuugggcuuuuugagugauacgugggugucuugggggacuggaggguuggugggggaaauguuuuuaggagguaauuuaguacauguuucugcagccaaauacacauauuacuggguggucaggugagaugauauuaauacuuaugugaaaauguagacauaaaguuccuugauaagcaaaguaaagcaagugaacuaauuuaaagaaaaccauuuacagcuggauguugcucacgccuauaaucccaacacuuugggaggucgaggcgggcggaucacuuaaagucgggaguuugagaccagccugcccgacauggugaaaccaacucuacuaaaaauacauaaauuagccaggcacggugaugggcaucuauaaucccagcuacucagggggcugaggcaggaggaucccuugaacccgagaggcggaggcugcagugagcugagaucacgccacugcacuccagccugggugacagagugagacuccaucucaaaaaaauuuuugaaaauaauggugcagggccgggcgugguggcucacgccuguaaucccagcacuuugggaggcccagguggguggaucaugaggucaggagaucaagaccauccuggcuaacacggagaaacccugucucuacuaaaaauacaaaaaauuuauccaggcauguagccggggcgcaguggcucacaccuguaaucccagcaauuugggaggccgaggcgggcggaucacuugaggucaggaguucaagaccagccuggccaacauggcgaaaccccaucucuacuaaaaauacaaagaauagcugggugugguggcgcacaccugcaaucccagcuacuugggaggcugaggcaggagaaucgcuugaaccugggaggcagagguugcagugagccaagaucaugucauugcacuccagccuaggcaacaagagcaaaacucugucucaaaaaaaaaaaaaaaaaaauuauccaggccugguggcgggcgccuguagucccagcuacucagaaggcugaggcaggagaauggcgugaacccgggaggcggagcuugcagugagccaagaucgugccacuguacuccagccugggugacagagugagacuccauuucaaaaaauaaaaagaaaagaauagugcaaauauuauauggguggcuauggcagauguaaaggugauuggcaauucuuuuucuggaaaagcuggcccaaggguuaaaaggaagagcucuggagugaaagagacugccuuugcccuugaccuuggguaaaacuuaaccucuucacauaguuucauccuuuacaaaaugagaaggguguggcaaugauuaagaaaaauucagggcugggcgugguggcucaugcuuguaaucccagcacuuugagaggccgaggcgggcagaucacgaggucaggagauugagaccauccuagcuaacacggugaaaccccaucucuacuaaaaauacaauuagcugggcgugguggcaggcgccuguaaucccagcuacuccggagggugaggcaggagaauugcuggaaccugggaggcagagguugcagugagccgagaucacgccauugcacuucagccuggaugacagagugagacucugucucaaaaaaaaaaaaaaaagaaaaagaaaaaaaaaauucaggcuagggggcaugccuguuaucccagcacuugggaggccaaagugggaggauugcuugagcccaggaguucaagaccagccuggccaacauggugaaaccgucucuacuaaaaauacacaaauuagucgggugugguggugggcaccuauaaucccagcuacucagggggcugaggcaggaggaucauuugaacccggcagagguugcagugagcugagaucucaccacugcacuccagucuuggugacagagcgagacuccaucucaaaaaauaaaauugaaaauaauagugcaaauauuauauggguggcuauggcagauguaaaggucauugggaauucuuuuucuacaaaacuggccuaacgguuaaaaggaagagcucuggaguaaaaaagacccccccuugcccuugaccuugggcaaaacuuaaccucuugacacaguuucauccuuuacaaaaugagaaggguguggggaugauuaaggaaauucaggcuaggggcaguggcucaugccuguaaucccagcacuugggagaccaaggugggaggauugcuugagcccagaaguucaagaccggccugggcaacauagcgagaccccauuucuacaaaaaauaaauuaacuggucguggugacauguucuuguggucccagcuacucaggaggcugaagccggaggaucacuugagcccaggaguuugaagcuacagugagccaugcuugcaccacugcacuccuaccugagcaacagagacccugucucaaaaaaagagagaaagaagaaaaggaaaggaaaaugcucguagcaccuaaaacagugcucaguaaauguuugcugaagcuguaacuauaguauguaguagaaagugguaguuauuugaaagagagucaaagauacgugcucugggaauuaccacuaaaugaccaaaaguucacgucaaaaaaauaaaaucagaucaaguuagaaauuuuuuuuuuuuuuuuuuuuugagacagaaucucacucuugucacccaggcuggagugcagugacgcuaucucugcucacugcaaccuccgccuuccgaguucaagcaauucucgugccucagccuccugaguagcugggauuacaggugcccgucaccacgcccagcuaauuuuuguaguuuuaguagagacaggguuucaccauguugggcaggcuggucucgaacuccugaccucaagugauccacccaccucagccucccaaaguucugggauuacaggugugagccaccgcaccuggccagaaaaaauuuuauuaugcacacaaaagaacaguuggagauuagucagaugcuccagucacuguagugagggcaguguuaauaaagccuaaggaaggauuuugaccuuuuuugugauuggcuguuauacauuaacaaucuguuuacagccaguagagcuguucaaacuguuuugucuauaguugauuccuuuaauuuuacugaauuaugcugacaaggauguaaagcuuuguguucuguuuaugauugauuagagcuacauuucagggaaucaggauaucuuaaauuccggcuauguggcugugggcaguuggccuuggaguauaucuaaacuguggccuccacuuucauuuuucuugaaacauugcuaucaacugggaagaguaugugacuuuaugcccaguuuccccucucagauuuuuaugacgguuguuuuucuuuuuguuaugccauuugagggauugauguuucuuaaacuaugaaguacuuggcugucucucuccauugcuguucagguuaacagccaccauuuguaaacacuuuguuggagcucauuccuucucugcuaggaacuuuacaagaauugucucaauccuaccacaccuuuggcaggacccuuguuaucagaguuuucauuauccauguauccauaguuacaaggcuauauagaaaagcaaaagucaucacacaagaaucuugcuaacaaacuacuuauaaaauuagucacuacuuaaccaucccucugcuuaucccugccagucccauuaacauguuugguagucaauuucuggcugaugaagagauacauuaagcaucaagguaaugcaaauguaaauaaaacugacuguagacugaaauggcacaucucccaaaacuuguaggacuaggcgaaaucccugcaagugaugauagaaaaccuucagccuuauaccaguuaacaaaggaagaagggaaaucaacaaagaugaugagaugguaaaaacuugaaaaguagaggauuugccuaggaaaaauuaagcccuucggaaacuuaguaaagcuaaggaauauuuuggcaaaaccaucuuuuguauguugcaaaagugagacaggaaaugaaguauaguguuugggaauuuuuuuuuuuugagauagagucuugcucuccuguccaggccggagugcaguggugcgaccuuggcucacugcagccucagccuccugaguagcugggauuacaggcaugcgccaccacacccggcuaauuuuuguauuuuuaguagagacaggguuucaccauguuggccaggcuggucuugaacuccugaccucaggugauccacucgccucggucucccaaaguguugggauuacaggcaugaaccacugcaccuggccuaguguuugggaaaacuauacuaggaaaagaauaguugcuuuaagucauucuuugauuauucugagaauuggcauauagcugccauuauaaccuacuuuugcuaaauauaauaauaauaaucauuauuuuuauuuuuugagacagggucuuguuuugucaccccggcuggagugaaguggcgcaaucucggcucacugcaaccuccaccuccgggugcaagcaauucuccugccucagccucuugaguagcuaggauuacaggcacaagccaucaugcccagcuaauuuuuguauuuuuaguagagacaggguuucaccauguuggucaggcuggucuugaacuccugaccucaggugauccacccgccucggccucccaaagugcugggauuacaggcgucagccacugugcccggcccugcuaaauauaauauuaacuuuauaauuuuagucucauuuuccacccagaucuuguuuaucacuaucugggugguagugauaaaguuccacccagaucuuguuuaucacuauucccuaugaaauguuucuggguggccgggcgcaguggcucaugccuauaauccuagcaauuugggaggccaagacagguggauugcuugaggcccggaguucaaaaccagccuggccacauggugaaacccugucacuacuaaaaauacaaaaaauuagccaggcaugauggugggcgccuguaaucccagcuacucgggaggcugaggcaggagaaucacuugaaucugggaggcagggguugcagugaggcgagaucaugccacggcacuccagacugggcaauaagagcaaaacuccgucucaaaagaaaaaaaaaagaaaugugucuggguauguuuuuggcugcaauuagcugaaaacccugacucaaaauggcuuauugcagauacuuagaagcccagaggugggccuccaaaggucauugucucaguggccuggacucugcauuuuuccacucugccauguucaggucucagcuuuguccuuaggaaggcuccccauguggcacaaaugcaggagucacauccagaagaagaagccuuucuugccgggcgugguggcucacaccuguaaucccagugcuuugggaggcugagguggguggaucacgaggucaggaguucaagaccagccuggccaacaugaugaaacccccaucucuacuaaaacuacaaaaauuaaccaggcgugguggcgggcaccuguaaucccagcuacucgggaggcuaagccaggagaaucgcuggaacccaggaggcggagguuacagugagucgagaucuugccacugcacuccagacugggcaacagggcaaaacuccgucucaagaaaaaaaaaaaaaaaaagaaaaggccaagcgugguggcuguaauccuagcacuuugggaggcuaaggcaggcagaucacgaggucaggaguuugagaccagccugaccaacaugguaaaacccugucucuacuaaaaauacaaaaauuagccgggcacgguagcaugccuguagucccagcuacucgggaggcugaggcaggagaaucgcuugaacccgggaggcggagguugcagugagccaagaccgugccagugcauuccaaccugggugacagagggagacuccgucucaaaaaaaaaaaagccuuccuugguuuccugccaauuuccugucauguuucuuugucccgaauugggccaauauccaugcccauuccuaauacaauuaccuuaauugacuuagauuagcccugaagcauguagugaugugggggaggaaugacaacugaagaaaauagaaaagaagggacaaagguuguugaguuggcaaccaacaauuccuguuauagcuuuuuaaauuaauucacuuuaagugguacugauuauucauauuguuauuuccauguauagagagagaagaaauuggaggcuuagaggaagugaagugacuuguccaaggucacauagcuaaguggaauuuauuuuuuuuuuuuuuacuuuucugagacaaagucucacucugucgcccaggcuggagugcaguggcgugaucuugacucacugcaaccucugccuccuggguucaagugauucuucugccucagccacccgaguagcugagauuacaggugugcaccagcaugcccggcuaauuuuuuguauuuuuaguagagauggaguuucuccauguuggccaggcuggucaugaacucuuggccucaagugauccaccuaccuuggccucccaaaaugcuaggauuacaggugugagccacggcgcccagcuacuggaagucaugaugcaagcuguuguuugaaucaugaauuccaaacuuaaugagugcuagguugaaguuauuuuuuuucuguuucccuuaaucuucuauugagauauaacauguauugaagcacagacaucuuuugcaagaauucauugagcacuauaguuauauucaucuguacuuacugucucccugguaaaggcauaaacucccuucaagauggggacaugguuuuauacuuuccugaaucuccuuuagugcuuauaucuaacagcacuuaaccaggaucuggagggggucaaccagucuugcuuccuuccaaucuacucuguagauguuuguguuuuucuacuguaacuauagagguaaaggagccaaugguguuuccagugucuggcacauaauaggugcucuaugaaugucaaaugaaugacugaggcauaaaaaguucuuccuaugacauaaguaguauaauaggaagaucacugggauagaauuuucuuagaagacguggcuccuaguccuagcacuauuacucuuacugacuauaacuuuggacaagucauuuguuuaauuucaaacauuuacugaauucuguguaccaaauacuguacaaguuguucaaaaggcuacagagucucuacucucaaagucuagucaggggagagauuacacaggagugaaaccccaucucuacuaaaaaaaaaaaaaagaaagaaaaaaauagccaggcaugguggcaggcaccuguaaucccagcucuugggaggcugaggcagaagaauugcuugaacccaggaggcagagguugcagugagucaagaucacacuacugcacuccagccugggcaacagaacgaauaucugucucaaagaaaaaaaaaaaaagaaaaaaaaaguauguuuagagauccuuaaggaaguuuugaaccuauccaauauguugggagucaagaugaggaggguaaaaguaggaauucagagaaaggauaaauauuuugaaggaaggcagcauaaugguuaacuagucagacugcagacaaacaagcaguacaaaucccauguucccaggucuuagcuggaggauuaaaucccagauucucauccuugagaaccucuuuaagcuuguuuucccaucuguaaaauguagaugauaauagaauccuuuuccuacuguaaaaugaugcacauugggggcuucauguagccagauauauaauaaauccucaauacauguagcagugguaggggagaacuaaaagacuuguuaacauauuggauguaggugagaaagaagaaucaaaaagaauauccagguucccgcccugggaggggcagacauaaauggagccaggaaugguacaaggagcuuuguggugggcacucacuaguaccuuucuuuggaauagcucaacaaauguucacuaaguacacauaaagucaauauaacuugaugagcuagaguuaggcuaagauguugaguuagcagaagaguaguacccaacuaagggcuugaggaaggcuuccuagaaaagauaaugggugcacguaguccugaaggaugagcaaggcuugcgaggagggaagguaggaagggcauuccagacaaagggacaaacaugcacaaaggugagacagagcauggugaacacacaaaguuguaggcauuuugucuuucuaggacacaaaaaacaaggugaugaaaacaaggcuggagagacaagcggagaccacaaguggucaccccucacuggccucgcuguacuacuggacugcuccagcccuuccuggcccagagcuagagauggcaccacccccgcacugugcacacaauagguacagacacucucagccccaaaccccuccagccuguuacugugagacucacacauccuguuuucccaagcuugccccacagggugagcaaacuggaccagcuggauuagaguauuuggaaaagugcagguggaguuucuaggcuaugccacgucaggccagggggugagauuuuuuucccuuccccuggucuuugggcuggggcacucccugaggagggaggggugugacccaucccacccauuggugguccaugauccauucauccaguacaucauccauaagcaucugcugagccgggcgcaguugcucacgccuguaaucccagcacuuugggaggccgaggugggcggaucaucugaggucaggaguucaagaccagccuggccaacauggugaaaccccgucucuacuaaaaauacaaaauuugccgggcaugguggcgcaugccuguaaucccagcuacucgggaggcugacacaggagaaucgcuugaacucaggaggcagagguugcagugagucgagaucgagccaucgcacuccagccugggcaacaagagugaaacgccaucucaaaaaaaaaagcaucugcugaaggcacaguauuguguuagaggcuuggacuacccugaggaauaauaguccugacacuugaggacauccccauccaauuggaaaggcacuggauaaacaucuaagaaaaugucacaaggcauaaaagcuguaauaauaauagcuaacuuguauuuaggguaaacaaaaggcugaaucaggcuuuggacuaaauauuuugccuguggcucauuuaaucuuaauaacaaccauaagauuaucucauuuuaugaugaggaaacuguauacagagaggugauugacuugccuaagguugaacagcuuaugaguaguagagccaguauucaaauccagucagccuccaguguccccucucuuuagucauuagauauagugcuacccagagaaucugcuaagccuuauagauaaaugcuaugaauucagaggcaggagcaauuacuguggcuugggggcauccacaaagacuuucuaagguggugacaccugauuugggccuugaaacugguugaauagagauaagaaaagaacagauaaucaauuuaacugccguuguguuuugaaucaucacuuuaagccuagaaugacaaagcuggaaaagacccuaaauaucaucuagcccagugguuaucaaauuuucuuaggauguggacauuuuucuuuaaaugaaacaugaguagaagccagaugcaguggcucaugccuguaaucccaacuacuugggaggcuaaggugagaggauugcucaagcccagaaguuggacaccaaccugggcaacggugagaccuugucucaaaaaagaaagaaagaggccgagggcgguggcucacgccuguaaucucagcacuuugggaggcugacgcggguggaucacuugaggucagggguucgagaccagccuggccgacauggugaaacccugacucuacugaaaauacaaaaauuagucaggugcagugcugcaugccugucaucccagcuacucgagaggcugaggcaggagaaucgcuugaaccccagagguggagguugcagugagcugagauuacaccacuacacuccagccugggugacagagugagacuuuaauuucaaaaagaaagaugagcaguaaucuugucucuuaaaaaggaggaccaaacauucccuagccccaaaacauucccugaaaaguucaguugagaaccacugaucuaguccaauguccugggauccucgcuuuuaucuuugcuaucuggagaaggaagagacagcgguaguucccaaaagacacaaacaauggggacauuuuaaacgggaguaaccagcuaagcacucugcugcugcugcuugucuauuugcccucuuguccugccucagggugaauuguuggcagcuacaaauggcaaccaagagagaauggaguuggggcuuagaagugcgguagaggaauaugaagggggcuggaguuggagaggcucuuaaagaaagagcugacuauauugggacuggagaguuaauguaaaucucuucuugguucauggggauuuuguuguuauuguuuuuuuccccaugacacaacucucaggagauccugagaacacgugcccugauuugggggggguuuuaauuuuaacuuuuuuuuuuuuuuuuuuuuuuugacagagucucacucugucacccaggcuggagugcgguggcgccaucuuggcucacugcaagcaagcuccgccucccggguucacgccauucuccugccucagccucccaaguagcugggacuacaggcgccugccaccacacccagcuaauuuuuuguauuuuuaguagagacgggguuucacuauguuagccagaauggucucgaucuccugaucucgugauucacccgccucggccucccaaaguggugggauuacaggcgugagccacuguaccuggccaaaauuuuuuuuuaauuagagacagucucuugcuguguugcccaggcugaucucaagcaguccucccaccuuggccucccaaagugcugggauuacaggcguaagcuauagcacccagccuuccuucuuuccuuaauucuauuuuuuuuuuuguuuguuuguuuauuuguuugcuuuugagauggggucuugcacuguugccugggcuggaguacaauagcgugaucucggcucccugcaaccucugccucccagguucaagggauucuccugccucagccucccgaguagcugggauuacaggugccugccaccaugccuggcuaauuuuuuguauuuuuaacagagacaggguuucacuauguuggccaggcuagucucaaacuccugaccuugugaucugcccuccuuggccucccaaagugcggggauuacaggcaugagccaccaugcccagccuuccuuaauucuauuaauauaugaauccuuuucuuuuuuuuaaaaaaaagagauagacucuugaucuguugcuuaggcuggagugcaguggcacaaaucagagcuaacugcagccucaaacuccugaguucaagcaauccuccagccucagccucccgaguaguugggaccacaguugggaaccacuacacuuggcccuacuacggguuuuuccuguuuguuuguuuuuuguuuuuuuguuuuuuuguuuuuuuguuuugagacggaaguuugcucucguugcccaggcuggagugcaauggcgcgaucucagcucacugcagccuccgccucccggguucaagcgauucuccugccucagccucccgaguagcugggacuacaggcaugcacuaccaugcccggcuaauuuuguauuuuuaguagagucgggguuucuccauguugguagucaggcuggucuucaacuccugaccucuggugauccgcccaucucggucucccaaagugcugggauuacaggugugagccaccgcgcccagcuguuuguuuuuuugagauagggucucacucuguugcccaggcuggagugcaguggcaugaacauggcuuacugcagccuuaacuucccaggcucaagcgauccucccuucucugccuccugaauagcugggaccacaggaauacaccaccacaccuggcugauuuuuaaauuuuuuguagagccagggucucuccauguugcccaggcuggucucagacuccugggcucaagugauccucccaccucagccucccaaagugcugggguuauaggcaugagccacuguacccagcccccuucagggucuuaucuuuauaaggggugggggguggucagcaccuuucucauuguuaccucuaccuucccuagguaugugcaggugaaauuugucugcauucggacccaaucaaacaggaagagaacgcgggaggcagacaugugcccagcguacuugcuccuaagguacaacgagagacuagauagacuauuuaucagugaacuaaacacacagcacauacauggugacucuaaaguggcuaguccuggaggagacaccacuggcaaaucucaaaagacaaugugccugcagagacuccagccugugcagcccacaaccaaaaaagaccuugacacugccgagaagucccugguugagccaucguuuugccuagauaagguacaaguguccucaaagccagagcaggaaggcaucacuccuucugaccuggccaagauagcaaaagugaugaagaacuuucuuaagguagaugaggguuccauggcuuccuucagugugggugacagccagcaccuggaccggcucagcuuccagagcaguaagaugaccgaccuguucauccgcuucccagagaaucucuugcuacaccggguggagaacacccagggccacauccucuaugcuuucuugguggagaacaaggaacgagaaagucgaguggugcacuuugcugugcucaaggcggagacagucaccucuguggccaagaugcugagcaucuucacagaguucaacuccgauuggcccaaggucaagguggucuuuguggacccuucauuccauuaccgggcuauccugcaggagaucuuuccugcugcccgcauccuccuuuccaucuaccacacaacccgacucuuggagaagaaguugcaucguaguucagcaaauccauccuuuaaaaggcucaugaaggaagcccugcgggaggccguguuugucacuucugaagccagccugaaaaaucucugccagaugucccaggccguacuggaugaggaucucuucaacuuccugcaggcccacugguucaccugugaacugcugugguacaugcauguuaggaagggccugcuugcguguaacaccuacauggacagccuagacauugucaccagcaaggugucaagccucuuucgggaacagcagucgcugcuggacugcauccucugcuuuguggauuacauagacuucuuuaauaccaaaggcuugaagaacuugcccacaccuccucccaaauuaaagagagcucggccggcaagcaugccacugaaguccaagaaggcuuuuggaaucuguggagagagccuuaccagccucccugcagaagagaccaagccagacgcacagcagguacagguacagcagcagucacaagugccgcccucgcagguuggcaugcuggacaccuugcaccagaguggcucugaacuagccuacaagcugugccacaaugagugggaggugguacagaacuccacccaccugguggacauggcuggcucuucaguggacguucagcugcuagaggacucucaccagguuagcaaagauggcuguagcugcagcuguuccuuucaacaaugguaccaccugccaugccgacacauuuuggcucugcugcacaccagccagcagccgguuggugaagccauggugugccgccgguggcagaagaaguaccaguaccuccuugggcccaauggggagcuccaggaucgugguauggucccaaacacaggccagccugagaagcaaggacggaacgacaugauucaggaccuaagcagggaguuagcaaaccugcucaugcagaccgaggggccagagcuggaggaacgcuacuccacccugcgcaagauuguggauaucugggcuggccccucccagccaucugagcucuuucagcagccaggagacuuuaaggacgugggccgccucccuuuccucuggggaaagcaagaagaaggggagggauucccuccugcuacagcugugaugcauuauugaagcacuuuagcugaagcauuggaccacaaacacuucuccuuggaagugugagaguuuaaagugggcaggacauacuaggguuuagcauuuuagccaaugucuuccuagguggggcuaggaauauuguuacaguagagaggaagggaacuccacugugugacaguccuuucaaucugccccuuuucagcccuacuuuuggcauuccuugggagccucaguuguuguucaaggccaaaguuaucuccgugcugcaaggucacccucuuccucccccagccccugagaucagaucuuauuugcucugcaaagaugaaucccugccucagguuagggugagacaaaaucggucugguaaaagggccuguuuucagggacaaagggaaugaggaugaucuuuggcuguugcugcucuuuaugaagaaucuuauuuguaacuuuuuauucauauuaaaguuguuuuuaauaaaauuaaacaagggaa

SEQ ID NO: 191275 - RNA, 13745 nt, Homo sapiens
uuuccuucccucucccugggcuugggucucccacuuguccagacagcggccgggcuugucacggggcucugugcagccuuuuccacucucccggcugccagcgucccgccccguccccucccagcccccaagggaggaggggagagcugcagagaggaggaggggucggggaggccggcuuuauaaaggcggcuggaacaacccugcccgccagaccccgucgcccggauccccugagcugcccgccaucccacgugaccgcgccgccccccagcuccaccgcugagugaguuggggcgcgucccuaucccguucccagucccucgccgagccgcguggugcacugaagccggcguggggaggagagccgaugaaggagaacgcuaacaugggggcuccaggcagaaucucuaaugggagagauuuaggaccugagggagccgggagacccgggagcccacggucuggucggccaccuccucuccuccccgggcgcgaggccuaugagaccgcaagccacccuccaagaaugcgcgugcagucguugccguggcaacgugcaagccugcaugggcccaccgcuaaaggaaaggggagguuguugggggugugggggcugguccccuggagguccaaacucaucacgcggcgguagcacgagggaacugggaacguccccucccccgugucccaaauccucugggagccagaacgcaagucgcaucgccucucugagccucaguuuccacaucugccauauggaggcaagauuauugguuccaaguuccccgaagaguuaucuggaggguaacgauccaggcuaguucccacuuaugguuggacguccaaggaauggguuuaagcggcucagauaacuccugcgaccccaccccacccccaggcccgcucgccauggcccucuucggggcccucuuccuagcgcugcuggcaggcgcacaugcagaguucccaggcugcaagauccgcgucaccuccaaggcgcuggagcuggguaaggcgcaggggcagacagggacggacgggagcggacgggguuggggucgccccaacagugggcacgggagcuaaguaaggguuucucugcugcuucagugaagcaggaggggcugcgcuuucuggagcaagagcuggagacuaucaccauuccggaccugcggggcaaagaaggccacuucuacuacaacaucucugaguaaguggggggcggggccucgcgauccggggcggggccucggcgguggaggcggggcccgagaaaucucagggucucgggagacuggaggcugagugggauggggcguggccaaaucgaugaggcaagacuuaagaaaccggauggggccgaaaagauaaaggccaagccagucaucauaggcgggaccaggcagaugggcguggccuugaaaauguagagggggccaagaaggaagcaggaccaguggaugugaggcguggucgaagaacaacagaaagguggagucaaggaacuucccaauagaugagaguggagucucgggcacgggguggaguuaaucggagggguggagaaacugaaggcucuaaguaugguuuaggaugagggagggggaauaaggaauugagaugugagacggagcuuaggugauggaggcaaagugaacggacucuauuaaaagaccggguguagcaaccccagggugugggaggggagggggugcaagcaaacaagacuuuuuuuuuuuuuuuuucugagagggagucuuguucuguugcccaggcuagagugcaguggcgcgaucuuggcucacugcaaccuccgcaucccgaguucaagcgauuuuccugccucagccucccgaguagcuaggacuacaggcgcgugccaccacggucugcuaaguuuuguauuuuugguagagacggguuucacuauguuggccagacuggucucgaacuccugaccucaagugauccgcccuccucggccuccuaaagugcugggauuacaggcaugagccaccaccgcaccuggcaaacaaacaaacaagacuuuuaagcgauggggugaagcucauuuuuaacaccuggaucaggaagaccuccucucucagccacccaaguucaacuuugagccacccaagucuaaguugggcacuugagggacaauggaagaauucauuccacccacucccgcuuccccaggccuggacuugaaaggggagcagacaaauuuccugucguugggggaaguucccucuucuuggcccuggaucugacccugaggccuccuguagggugaaggucacagagcugcaacugacaucuuccgagcucgauuuccagccacagcaggagcugaugcuucaaaucaccaaugccuccuuggggcugcgcuuccggagacagcugcucuacugguucuuguaaggacccagcacccucaggggaguggagagugggucaggagggcuggaggugcuguggggcugugggcagcccccuuagccuuccugaguuuccguuucuucaucuguguaacagaaacaggcauaugcauuucauacgaguugauaggaagguuugguaggauguguggaaagaggugaaaccuuauuaagagguauggugaugcaugggggcacugaagacucaauugagcuccuaccuggagugaauauuaaccccccuggcagcuaugaugggggcuacaucaacgccucagcugaggguguguccauccgcacuggucuggagcucucccgggaucccgcuggacggaugaaaguguccaaugucuccugccaggccucugucuccagaaugcacgcggccuucgggggaaccuucaaguaagccccagccccaaccccagcucacccuuuucgagccccacagcucaucugccuagcgcaaugcaaagugcauaggccugggaaucagaccaacuggguccaaagcucagcucugucacuuccuggcugugugaacguggccaagucacugaagcuuggugccucaauauccucauuuuauaagauccuauuuuauaagaucguugucaggauuauuuguguugguauauguaaaaaauauuuagaacaaggcuggcugugguggcucaugccugaaaucccagcaauuugggaggucugggcgggcggaucacaagguuaacagaucgagaucauccuggccaacauggugaaaccccaucucuacuaaaaauacaaaaauuagcugggcgugguggcacgugccuguagucccagcuacgugggaggcugaggcaggagaaucgcuugaacccgggaggcggagguugcagugagcugagaucgugccacugcacuccagccuggugacagagcaagauuccaucucaaaaaaaaaaaaaaaaaaaaauuuagaacagcaccuggcauaugauaaauguauauuuaagugcuggccacuuagauaagaguaacugugaggacuaucugauaugcacauuuggccauguacuggauucucaauaauugguaucucuaaauaauaauaacaaaaauaauaauuuuuuuuuugagagggagucucacugugucacccagccuggagugcaguggcgccaucucgguuuacugcaaccuccaccuccuggguucaaacgauucuccugccucagccucccaaguagcugggacuacaggcaugcaccaccaugcccaacuacuuuuuuuguauuuuuaguagagacaggguuucgccauauuggccacgcuggucucaaacuccugaucucagguggucuguccgccucggccuaccaaagugcugggauuacaggccugagcaacugugcccggccuauuuuuuuauuuuugcugcugagaaggggauauuguucuuguucuggaagaggaugggggagagaagaugauggauuauaaccugguguugguacacugucaguauuauuuauucaucaaacaaaguguaugccagucccugaggaugcaggaaggagcucagagccuaucuggagcaaaaaacauuugauaucagggccuggagagaaggacuaagaaaaugcuuuggggauucagaggaggggaaucugggaagacugccuggaagaggaagcaucugagcucagaugggaaaauacagaguaggaaugcagagggcggaagggagggcaucaguaagccgauggauguggggaugcucagaguggguuugaggcaauguggguggauucauuugacugaugggaccagagaguaggucaggaggucuugagaauuagacuggagagggaauuugggccugguucuuggaaaaccuacguggaggagcuguuauucaggcugaagcugaggacuccuacugccacuauuucccuagucacugauuucuccuggaccuggacugggguggaggcagguucugggcucauccggccucuccucuccucacaggaagguguaugauuuucucuccacguucaucaccucagggaugcgcuuccuccucaaccagcaggugugggcagcgacaggucgcaggguggcaagggugggcaugcucucacuuugagaaggcccugacucuggcucccaccucgcagaucugcccuguccucuaccacgcagggacgguccugcucaacucccuccuggacaccgugccuggugaguugguggcgggugagucugggugugcagcugucaugcagcaccucagagcaggccccuuccgagcccugcuguugaacaguccuggguucaaauguggccccuggagcugacuuguugugcgauuuugggugaagugcucauuucugucugggcaaagugcuuguuuccucacuuggcuggcagugccuccuccugggguugcugugaggauuaucugagagaauaguugucaagguccucaauaugugcaugcugaucacuggcaucccauuugucuucaucaccuagcaucuaauaggugcucaauuaacaugaauucccuuuuucuuuuucuuucuuuuuuuuuuuuuuuugcacggagucuuacagucucacucuguugccaggcuggaguccaguggcgcgaucucagcucacugcaaucuccaccucccggguucaagcaauucuccugccucagcaucucgaguagcugggacuacaggcgugcaccaccaugcccaacuaguuuuuuguguuuuaguagagacgggguuucaccauguuggccgggauggucucgaucuccugaccuccugaucugcccaccuuggccucccaaagugcugggauuauaggcaugagccacugugccuggccaugaauucccuuuuucuaagccaugaccucugucuacuguggggcaaagguauuuucccaucacaccuaacacacaggcaugggaagcgaaggaggagguaggagaaaccaagggaaaggaaccucaugccaucuuuuuuuuuuuuuuuuuuuuuugagauggagucucgcucugucacccaggcuggagugcaguggugcaauccuggcucccugcaaccuccaccucccaggaucaagcgauucuccugccucagccuccugaguagcugggauuacaggcgcccaccaccaugcccaacuaauuuuuguauuuuuaguagagacgggguuucaccgugguggaccaggcuggucucgaacaccugaccucaggugauccgcccgccuugaccucccuaagugcugggauuacaggugugagccaccaugcgcggcccccccaugccaucuuguuuaguuauuuuuuugaaaccucuauagugguaguaauaauaauaacuaacauuaaugagcaccuaacuacacaccaggcccuaagugcuuuccacauaaaacuaauuugacccucaugacaacccugugaaggauguauccucauuuuaugggugggccucugagccuggagagguuaagcaccuuaucccacaucacacagccgugagugacuugagccccuuccugcagugcgcaguucuguggacgagcuuguuggcauugacuauucccucaugaaggauccuguggcuuccaccagcaaccuggacauggacuuccgggugagcugcuugggcugguguaugaccucugacuuccuaacaagaccucuuucucugcuaaguugcaagauuuuacuucuuaaagcacagcucugaugaggccacucccauuacugagaaugcuauggcucccuguuacuacagaauuagguucagccuccugggucuggcauuugagccccuguuaaucuuaccuggccccaccuuuuauaucucauccuguuucuuugcagcugcucuuucccaaauuggacccuggcuucccaccucagggccuuugcucaugcacggccuuuccccaacucccccgaaggagcuggacauaaauuucuauacaaauaaucucauuucauucucucacaacccugugagucagguacuaacaucauccuaauuuuaggaauguggagacuuacucauagaggugacgucacuugcccaaggccacauagccaguguguagccacuaccuuuggucucccagaggaguauagcaguuucagagugcagacucgggagcuagaaucagucgggugcaguggcucaugccuguaaucccaauacuuugggaggcccaggcgagaggaucgcuugagcccaggaguuugagaccagcuugggcaucauagugagaccuccuucucuacaaagagaaaaagaaugccugaaguucaaauccuagcucugccacugacuagcugcacggcccuaagcauaaguuuucaguuggccaguuuccuaacauguaaauggaaauaaucuaguaagaaaacacacguuguuaugcagauuaaagaagucgaucuaugugaagagcuuagaguacuuggcaaagaagcaugaguaugcacaauauauguaaacaguagcuguuguuacugccucuagcuuucaaggcccacucagaugucaccucuucccugaaaccuuuccugacccucccuccuccagucugacgggcucgcccccugguagcagguguccuccuuccaaugccuuuuaagagaugugcuugugaauccuccaagaacagcagcuggguucccaccauccccccacagugccuagcacggggcugggagacaccugcugucaguccaggugccaggccagucugccuugacccugacugugaaugccccaccccagggggccuucuucccccugacugagaggaacuggagccuccccaaccgggcaguggagccccagcugcaggaggaagagcggaugguguauguggccuucucugaguucuucuucgacucugccauggagagcuacuuccgggcgggggcccugcagcuguugcuggugggggacaagguaugucauggccuguuugugggaugggcaagagaaggucugugacagagcucacucccucacuccugauuccccuguucaggugccccacgaccuggacaugcugcugagggccaccuacuuugggagcauuguccugcuggugagugcuggcgggggcagggauagggccaccugcacaccagugagaccaaggaggggugcagguggggcccccaguggcagccacgcagacagggcccuggccucuugucuguggccaaucccccucgccuugucauggcuguuccugucugugaagcggucugcuccuuccugcuccuuccugccccaucuccuucgcagagcugcugugaggauuagugagaacccaagcuuugcaagugugagggcuuuaauaauaauucacauauacuuuuguuuauuuguguauuggggaggagaguaagaguuacacauuuuauuuauuuuuuuuuuugagacaagagucucacuuugucacccaaguuggaaugcaguggcacaaucuaggcucacugcaaccucugccucccagggcucaagccauccuccugcuucagccucuugaguagcuggaauuacaggcuugugccaccacaccccgcuaauuuuuauauuuuguugagacagaguuucauuauguugcucaggcuguccuugaacuccugggcucaagugaucacccauuuuuggccucccaaagugcuaggauuacaggugugagccaccgcaccuagcagaauuacaaauuuuaaaagaaauaauucagucauuaucaucauccaauuuauggcagggcagggucucuauugucagacugccugggcuucaagccuaguucugaaacugaguaacuacauaaccucuacaaguuacuuaaccuaucugugccucaauuuccccaucucaaaaauggggauauggcugggcaugauggcucacgccuauacucugagaacuuugagaggucaagguaggaaaauugcuugagcccaggaguuugagaccagccugggcaacacagugagacacugucucuauugaaaaauaaauuuuuagucagaucuuuuuuuuucgguggggggacaaagucucacucugucacccaggcuggagugcaguggcgcaaucuuggcucacugcaauugaaccucccggguucaagcaauucucugccaugacgacucagccugaaaaauaaauuuguaaaaaauaacaacaacaaaauuggcaguaauaauaucggccucacaugguuauuaugagguuuaaaggaaccaacacauauacaguguuuagaaucauguuuggugaagauuaggcaguugcaucuuauaguauuccuucacugccuauagaagaaggcauagcaguuuagagaaagaagauauggccaggcacgguggcucacgccuguaaucccaacacugugggaggcugaagccggcagaucacuugagcccaggaguuugagaccagcaugggcaacauggccaaaccccgucucuacgaaaacacaaaagcaaaaaccaaaacaaaaaacaaauacaaaaauaagccaggcgugauggcaugaaccuguggucucagcuguucaggaggcugauguggcaggauaauuugagcugaggagguugaggcugcagugagccgugaucaugccacugcacuccagccugggcaacagagacccugucucaaaaaaaaaggagagagagagcaaaaagauauggcaagggguuugggugugguggcucaugccuguaaucccagcacuuugggaggccgaggugggcgaaucacuagccuggccaauauggcgaaaccccguuucuauuaaaaauacaaaacuuagccgggcauggcggcaggugccuguaaucucagcuacuugggaggcugaggcgggagaaucgccugaaccugggagacagaguugcagugagccgagauugugccacugcacuccagccugggcaacaaagugagacuccauaucaaaaacagaagacauggcaagggcugagauacuaaugcaaaaaggacauccacaaagagucuggauuggagauagaccugaauauugagauguauuuaggaagcagaaagagaagaacacauuccuguuucuuuguguggcaaaggcaugaaggcuagaugcagaugugagaguuuuggaagccagagcucccucuguauuugcaauaugagaguccccagaggacagaagcugcaccugccuuccuuccccuucuucccugggggcuccaaaggaaauggcagggacuugacccgccccugcugcucaucccccagagcccagcagugauugacuccccauugaagcuggagcugcggguccuggccccaccgcgcugcaccaucaagcccucuggcaccaccaucucugucacugcuagcgucaccauugcccuggucccaccagaccagccugagguccagcuguccagcaugacuaugguacgggucccagagugggggcugcuggcugggggucagggaaaaaugggcuguggguuacugaccuucugggucaguaacauccuccuccccauguuccugcaggacgcccgucucagcgccaagauggcucuccgggggaaggcccugcgcacgcagcuggaccugcgcagguaggcaggcgcacuucccugcaccucagugauuggaggacaaucacaccuguccacagggauguugcgcuuaaaguacagugauaccuguaagccacugagagcuggggucugucuuuguuaaugcaugccaaagugcuuugguaaagucugacuccucugcauucucacaugucccagaggcaggcagggcagguauuaugagagaugaacaaauggguccagcaauguuaaauaacaugcccacagucacacagcaaagaucagaacauggguuuugacaaaaaccucagcacaacacagcuuugugaccuugaggccauuuuaucuuuuuuaaaaauguuauuauucuuuuuuuuuuuuuuuugagaaggaguuucgcucuuguugcccaggcuggagugcaauagcguggucuugacucacugccaccucugccucccggguuuaggcaauucugccucagcuuccugaguagcugggauuacaggugugcgccaccacgcccggcuaauuuuugcauuuuuaguagagacaggguuucaccauauuggucaggcuggucucaaacuccugaccucaggugauucaccugccccggccucccaaagugcugggauuauagguaugagccacugugcuuggccuuauuuuauuguauuuauuuauuuuugagacagagucucacucuguugcccaagcuggagugcaguggugcaaucauagcucacugcagccuugaccuccugggcucaagugaucguccagccucagccucccgaguaacugggacugcaugcaugcacuaccaugccugacuauuuuauuuuuuguagagauggggucucacuuuguuguccaggcuggucuccaauucucgggcucaagugaucgucccaccuuagccucccaaagugcuaggauuacaggcgugagccaccgcacccagcccauuuugucuuucuaggccucauuuucuccauguguuuaauacaggcaaaaguagcaucugccuucuagggcugugcuauccaauaugguagauacuagccacaugugacuauuuacauuuaaauuaauuauaauuaaauaguuuuucaguugcacuaagccacauuucauuagccacauguggcuagugacuaccauaguagacggugcagauacaaaacguuucacagaaaaucugacuggacagugcuguucuaagguuaaaggagauaauguagguuaggacccuagguucuagaggcagcuucugacacuuuccagcugugugacuucaggcaaauuacuuaaccuugcagggccucauuuuccucaucuauaaauuagugcaaauccuaauagugcccacuccuugggcuuguuuugaggacuaaaccaguugguacuguauuuuaaaacaguuuacuaauauuaacuuuuuaaacacguuggcugggugcaguggcucacaccuguaaucucaacacuuugggagaccaaggcggguagaucgcuugaggccaggaguucgauaccagccugagcuacaaagugagauccugucucuacaaaaaaauuuaaaaguuaguuggucauagugaugcacgccuguggucccagcuacuuggaagccugaggugggaggcugacuugagcccuggaggucaaagccacagugaguaaaauuacaccacugcccuccagccugggcaacacagugagacgcugucucaaaaauaaauaaaaauaaaaaaagaaaauaaauaugcuuagugucugacaggaacuaagcaaugugaaguuuuguuacauaaaauaaauaacaccugcaaagcuaccagcagaagucuggcacauuagaagugcucaauaaaggccgggcgugguggcucacgccuguaaucccagcacuuugggaggccgagacgggcggaucacaaggucaggaaauccgagaccauccuggcuaacacggugaaaccccgucucuacuaaaaacacaaaaaauuagcugggcuugguggcgggcaccuauagucccaguuacucgggaggcugagccaggagaauggcgugaacccgggagacggagcagugagccgagaucgcgccacugcacuccagcgugggcgacacagcgagacucugucucaaaaaaaaaaaaaaaaaaaaaaaaaaaagaggugcucaauaaauaaaaaguagcagucuuggagaaaaggagacccaaguggcagcaaugacugccccgaggauaccuggaaaguuguagcacuuggaaaggugccuaggugggcaucugagccugcaacucagacaccucuggcagguaggccuggguggccugaggaaggggagcuuccaggcuuccugcccacagggcuccuuucuuucccgcagguuccgaaucuauuccaaccauucugcacuggagucgcuggcugugaguggggaagggugggugggcugggcuggguucgugagauccugacccucaccaucccccccuccucauauaacugcucaccugcgggcagcuaaaggcaaacccaacccugacucacugcccuguuuccgcccucgccccucccagcugaucccauuacaggccccucugaagaccaugcugcagauuggggugaugcccaugcucaaugguaaggcuggggugugaggauggaggaagaaaggaggggugaacugggcgggcccagacugagcggggugcucccacccacagagcggaccuggcguggggugcagaucccacuaccugagggcaucaacuuugugcaugagguggugacgaaccaugcggugagugggggcaggauggggaaggagggagggccuuccccucucucuauagcuccccagugcccuccauuaccugaccccagcucccccauuaccagucgccccucccauuuuaaucuuagacuccuaaaagccguugcacacacugugacuucuuggagcacucuucucccaucccaauaccuacuaauuguucaggucuuagcucagaggucaccuccuccaagaagcccuccuugacacccauagucuacacuccuacagccucauuuuaacaccuugacauggaauuauccauuagauugaguuccugaaagacaaacacucugucucuugaucucuaaacucuggccucaauaacugaaugaauaaaugaggcuccccucuccccaacacagggauuccucaccaucggggcugaucuccacuuugccaaagggcugcgagaggugauugagaagaaccggccugcugaugucagggcguccacugcccccacaccguccacagcagcugucugagcccucaauccccaagcuggcagcugucauucaggaccccaaccccucucagccccucuuuucccacauucauagccuguagugcccccucuaacccccagugccacagagaagacgggauuugaagcuguacccaauuuaauuccauaaucaaucuaucaauuacaguccguccaccaccucccugugggcuguccugagcucuguuggguuccugggauggaaucagugcaucauaaagggcauucuuuaagcagagaaggggccaggccaccccauucaggaacugcugcgggaauaaagugcuaacuugcccccagg

SEQ ID NO: 191276 - RNA, 50649 nt, Homo sapiens
ucaggcucgcugucgcgccauuuugccgggguuugaaugugaggcggagcggcggcaggagcggguagugccagcuacgguccgcggcugggguucccuccuccguuucuguauccccacgaggugaggcgcggggcgugcacggccuaccagaguggcucuuggggcccagcugaggaagggaugaggcgcucccgguacuaacgagcgcuagggagugagaaccgcgccucugggcgagagcggaaugugggcccgggguucggguggugcgcucaggcaaggucuucggcuucccuagggagcgcuugccgcgccucgcggcauccuaggucucuggcccaggugcggcgaccccagggccugugagggcugagggcaacugaggcgcggccuaacgcgagccugcggauugcccgcccuuuccucuccaucacggcgcugauuggcugcgccgccgccucuccgcucgggaaggccgcuccuuauuggucgcgcucgcauguccauucucugcgacgguggcugcuagccgcgcgagcugagugugcggcggcgaggccugcccgggcggggacugcgggcgcguggagcugcggcugccucgcgucgucccuugcccuaacucuagugaagcccccgaacucacccuucucuaaccucuguacuuguaucccugacuguaaaacgggcaucgugaucucacuuugcugaauuguuugugagaauucuagucgguacacccgggacauagaaauccccuguaacgcggguugggggaggguucccucguuuugggagaaacgcugugcuguggugguucggagcauagacuuuggaauuagaucgccuggguucauuccagacguagccucucguuagggguguaacuugaggcuggucaccucaucucacugagccuccauuuccuuagcugcaaaaugggguuaauaacagaaucuaccucggaaaguggcuuugaggaugcgcugaguuauuuaccgugguuuacaaagguucccugggagcugacgguuguuuauucaucucucccacccaucuuucuccuuagccaguguggcuuucuguuucuuccauauuccaggguuauuccgauuuaaaauuauuugcacaugccuuuuguuugcuggggaaguaccaacauuuuugcaaggcaggccgccucucccaaguuucccucaccuuaggccuccccuaaccaaccucuucuuuuguuuucuuuuucuuuuucuuuucucuuuucuuuuuuuuuuuuuuuuuuuuuuuuuuuugagagagagagucucgcucugccucccaggcuggagugcaguggcgcgaucucgacucacugcaaccuccgccucccggauucaagcgauucuccugccucagccucccgaauagcugagacuacaggucugagacuacacgccaccacacccggcuaauuuuuguauuuuuauuagagacgggguuucaccauguugaucaggcugucuaaucaaccugucuaggaccuuucucccauggcucuccaucaacaucaccugguuuuaguuacuucauagcauuuacuaacacuuacuuauugcuuacuuguuaucuuucucaacugcuagaauguaagcuguuugagagcaaggaccuugucugucuugcuuacuucucucucccuggugggugccaucccaccugugcuugccacaugguagaugcacaaguauuauucuuccuuggaggcacagaaggggacccuuuagucuuggauuccaccaauugcucuuuuucucaccuugggcccacauagucauaucuuuggccuuucucugugugugucucucucuuuuuuuuuuuuuuuuuugacaugcuuucagaggauccuaauggaccucgucucuccgcuccuacaacccuuuaucuuucacuucuuaccaucagugcaagggaagucucucuccccuucugauuacuucugcugguuggggucugggacaggauuggauggaugcaagagcagugcucuaguuuuggaauuaauuuguuucuuuauucauuuaauaacuuuauugagcauccacuuaaucucugggaauauagugaaaaaacaaaaauggacaaggucccuucccuugaggaccauguauucucgugggcgaaagaaaaaacauuagauaauuucagauagugacagaauuaugugacaggugaagaaggcuuuucugaggaggugacauuuggguagagaccagccauuaaaaggugaggggcagaacauuccagguagagggaauagaaggcucaaggcucaaggacaggaaccggcuuggaauauugaaauauuuaaggaauaucuuagguuccuagaguguuacaugaagaagggagaaauauccaggacccggaucauagaaggcuuuguaggcaauguaaggaguuuggauuugauucuaagugguauauuccuaugguuagaaagcagaggguagguugagguguugggauauguucuucaugugugggugccagauaguuuucauucauuggaucucuuucccucuucccaaauguaaggccucgggaaugguucucuaauguguugaggacauaucuaagaaaaaggcagacaucuuggaucagcuuaugucacagaugucugugagauggcuuuggaaaacaaagcuuuuauuccagaaaucuccaccuguaauugagggccugugggaagaugcuagacuuaggucuggccauucauucaacaagaagaacuuggaaauuuagaugucugccauaacugauuuauugugaugcuuuuuuaaguuucuuaauuguguauugguagagauuuccaaagauaguuacguggagaaagaaaaguaucacccccucauuuaaaggugauaaaaaugaauucuuaucuucucccucccuuuuuuuuuuggagacaccaucucacuguguugccugggcugaccugggcucagucuauccuccuaccucagccucccgaguagcuaggacuacaggcgugcaccaccacacucaacuaauuuuuauuuuuuuuuuguagagauggcaccauguugcccagguuggucucaaacuccuggacucaaccaaucugcuuaccuuggccccccaaagagcugggauuacaggcaugagccacccuacuuggccaaaaugaauguuuuguuucuaguuugagucauuuuuagaucaguaacacuuuuugcauuuauauauugcuaauauuucagagugucaaaguaccuuuacuugugguugcauaagauaauuagagcuugaucuuguugauaauuaugaauaccuguaaaauguucucuaaaagucccugauuucucuuauuuucucaaauuaaggauaagcuuagaauucgguuuuauagacuauaucugcaaggcgauauaaaaaggauuuguugacaaauaguuccuuaaagaauauucccaaagaauaaacuuuggaaggccaaggugggcggaucacuugagcucaggaguuccagaccagccugggcaacacuggaaccaugucuacagaaacaacacaaaaauuagccaggugugguggugugugccuguagucccagcuacuugggagguugaaguaggaggauggcuugagcccaggaggcagagguuucagugggccagaauuacaccacugcauuucuccagccuagguaacagacccagacccugucucaaaaaagaguauuaagauucugggaucuauguaguauuuuaacuuugagggauuauaacaugcauauuuauauaaccccucacuuuuuuuuaaacuuaaaaauaguccuacccuagcaucucaacuuaaucauuuuagguuucauucuauuaugugguuuuauuuauuuauuuuuauuuuauuuuauuuuauuuuauuuuauuuuuggagacaggguuucacucagucacccauacuggacugcaguggcaagaccucagcuuauugcagccuagaccucccgggcucaagcaauccuccugccucaacuucccuaguagcuaggaccacaggaggguaucaccaagcccagcuaauuuuuuuuuuuuuuuuuuuuuuuuuuugagaugggaguuucacuuuuguugcccaggcuagagcuagagugcaauggugcagucuuggcucauugaaaccucugccucccggguucaagcaauucuccugucucagccuccugaguagcugggauuacaggcgcaugccaccacgcccggcuaauuuuuuuuuuuuuguauuuuuaguagagacgggguuucaucacauuggucaggcuggucucgaacuccugaccucagaugauccgccugcuucggccucccaaagugcugggauuacagacguaagccaccgcgcccggccugagcccagcuaauuuuuaaaauuuuuuguagagacaggaucucacuauuguugccaagucuggucuugaacgguccuuggggucaagugaucgucccaucuccaccucccaaagugcugggauuacagaagugagccaccuugcucagccuguugugguuuuagaaucuagaagguuguguccaccucuuucuguuugacacagucaaccaaccaaaauaaagaugaagaauaauauuuuugauggaaacaucaaagguaucuagcuuuuuaaaauaguacaacaaauauauaacgggugcucaucacuauuguaaggcucuagggagagagcagugaacaaagcacaaagucccuacuaucaguggaguuuacaaucuagugaagagagaagcacaguaaaugacaaaagaaauuaauaugccugauaaaauguacuuggaaaauaguagaguaagggcauggagaguaacugaggugaaugcucuuuuagauaggauggugcagcaaggcaucucugaaaaaaagaugacauuugaaaagaguccuuccaggccgggcacgguggcucaugccuguaaucccagcacuuugggaggcugaggcggcagaucaccugaggucaagaguuugagauuagccuggccaacacggugaaaccgcaucuuuacuguauauaaaacucagccgggcgugguggcacgcaccuguagucccagcuacuugggagguugaggcaggagaauugcuugaaccugggaggcggggacugcggugagcugagaucacgccacugcacuccagccugggugacagagcaaagaccccugucuccaaaaaaaacaagaguccugaaugagaaugaagugggcagugcaaaccuuguagcuuuccgugugcagagcucugcaggcagaaggaaugguaaguacagaacccugaaacaaaaguaaaaucacuggcauguuugaacagguaauacaggauaaauuuuaucuuuuuucagagacagagucuuacucuguugcccagauuggaaugcaauggcaugaucauagcucacugcagccuuaaaauucugagcuuaaccaguccuucugccucagccuccagagcagcugagacuacaagugcucgccaccaugccuggcuaauuuuuauuuauuguagagacagggucucacuauguugcccacgcuggucuugaaauccuagccucaagugauccuuccgccucggccuuccaaagcgcugggauuacaggcaugagccauucugccaggccagaacaaaucuaaaaauucacuuucuugaaguacuuuugaauaaacaaauuuaauuguggcaguuaaguuggucauuuguucaucugacauucaugcaacugaguucccacauuauguuggggcugcuaaugauugaucugaagggauagucuccagucuugacuggaaacucauguuuugcugggugacugacauguugugacuuauccuuuaguucauacaacaaaugcuuacuaaauauguacugugugccagguaaugcugaagguccugagcauacagacgaaagucccugcccucaggagcuugcagucuaguguguguaugagacgacaaagaaguuuauuucaaaugaggguaauugcuaacacaguaaaacaaggaugauguagaugguaaucguagaaggccuuuuugaagaguugacagugggcugagugcugaaugguguccauuaucaaauuagaggaugagcauuauuauggucagggagaacucuuguggccaguuuguagaacagaaggcuuuugugccuggaauguagcaagagccaggaggagguaggagaugaggucaguagauaccagauugcuuagacccugcugugguaagggauuuggugguggugguggugguggugguuguuuuggagauagggucucacucccauugcccagucuguagugcaguggccugaucacaacucacagcagucucaauuugcuggaucuacaggugugugccaccacaccuggcuaauuuuuuguauauuuaguagagacagggucuugcuguguuagcccaggcuggucugaagccggcugaagcaauccaccugccuuggccucccaaaaugcugggcuaacaggcggcagccacugcaccuggccaggaguuuggguguuuaagacaaguaauuaugaggaaucuaaggaguuuuaguugagaaauauacaaaugcuagagaaacauaaugaagaaagugaaaugcagauuuauuaagaaguguauuuuuaaaaaucaagaaaauaagcccugugugguggcauaugccuguagucccagcuauuccagaggcugaggcaggaggauuguuugagcucaggaguuagaauccaaucuggacaauacagugagacccccugucucucuuuuuuuuuuuuuuuuuuuuuuuuaaagacaaaauagaucuguaaaucugccccugcacccuccccacccaaguuucuaacaaucugccuugcaugaauccccaaagguagaauaaauuugcauauggcaaagaaaggccaauuuccuuuaacucagauacacugauguuaaugauuuaacuugaccacagcaaacuaacuuuuuuuuuuuuuuuuuuuuuuuuuuuugagacugcguuucucucuuguugcccaggcuggagugcaauggcgcaaucucgccucauugcaaccuuugccucccagguucaagcaauucuccugccucagccucccaaguagcugggauuacaggcaugugcuaccaggcauggcuaauuuuuaguagagacgggguuucaccauguuggccaggcuggucucaaacucuugaccucaggugaucugccccucucagccucccagagugcugggauuauaggugugagccaccacaccuggcccaaacuuucaugauuucauaacugauccaccauuucaauacagaaaaaaggaauaggaaaauaaauggauuaaaucauugcuuuccaaaguguguucuauugaaaaggaguucuauagccaaauaaugggagagacugggcaauccucccaccuuagccucccaaguagcuaggacuacagggccacaccaccacgcccggcuaauuuuuuguauuuuuaguagagaugggguuuugccauguugcccaggcaggucuugaacuccugggcucaagcgaucgucugccucagccucccaccaguggagacucuggauuaauugaugugaaccaguaacuuugugaguuuaaagugcuuuguauugugaaucuccaaaguggggcaggauauaauguguagcauuuuccaaacuugugauauaaaaaaccauaaaggguauagccucucaauagauuguaugugugguuuaaugggacuugauuuucacaccuauagaguggaacaccuggauuagagggagugauuagguagguggugggaucuacucagucagaacauuagcuuccugugauaaacacauuuucuaauuaaggggaaggacugcagcauguagaauacagauaauucucuuuagaagguugggguuucuggcuguuggggagugcccugcauaagcacagcauuagauaauauuuucuuauuuucuggcuccccaccgcucaguuguccucuggcugcccucuuuucacaucagccuuucuauuguguugugagugcuuucacucuuggucagccgucugucauuuccaccuaagaggcagccuuggguaauagaaagaggguagaccuacggaguuggacugauuuaaaucugaucuuuauuuauuaaccauauauaguuaauauaugucaaccugagugcccuucuuuguguguaaaaucauuguguggaauaaaugauaugaagccuaugaaaacaucuagcaucgugugccugguucauacaugugacacuucccccauucugcaaaccauuaccagcccaaagguccucuacuccacuuucauuacauuuuuacccacuuaagaaaaccuucaugacuuccccauacauuaaaucauggcacucuucagccaaguauggaggaaccuauaugaucuggucuugaucuccuagcccacuauucucucuucccaucucuguuacuuugcucucacaauucauuuuggcagaugcgcccucauccuacuuugccuauucagauacacauauuuuucaagguucagcucaaggcucaggcucugggaaacucuuggauggccacauaaccccgugacucccuucuuaauuuucuaacguuuaaggugcugucuuugugauucauuuggcacuucagaggacagauguuucagaauuugggauuuuuuuuggaugcauguacuguggauuauacaacauccccaguggggcuugggguagcacccuguaaucaaacguauugauauuucuuuagugaaacaaauuugcauacuaagugagauaaaucuauguugauagccucaggcaguucaggcugguuuugcugccaagugaguuugccacaaacuuguuaaaaaacaaacuuuuaaguuuuuuuauuuuuggauuucaucacuuuaguaaaggguauauaggccuguacuuggcauuucaguugugucuugucuucugaacuauuacagaagcuccuucuaggacaggaacuugauugcauauugucauaggcauuuuaaaaauaaaugggucccgguauggugggucaugccuguaaucccaguguuuugggaugccgaggcaggaaaauugcuugaggucaggaguucaagaccagccugcgcaauauggugaaaccccaucucuacaaaaaauacaaaaauuagccaggcaugguugauugcgccuguagucccagcuacucaagaggcugaggugggagguuggggcuugagcccuggagguugaggcuguggugagcuaugaucaugccccugcaguccaaccugggccacagagcaagacucugucugaaaaaauaauaaaauuuuuuaaauuccuuacuguaaauguauaauagauaugugauuguaagauuagaaaaguaugaagagaauaaaacucuccuuauaucuaucaccgagauguuaucacuguucuacauuuuggaguguguuuuuuguuuucuucuauaugugaaguuuuuuuucauaauuugaauuaugauauccuugaacuuuuuccacugaccuuuuuuacauuuuacaaaaauuguguguuuaguuuuuuucuucuuuuucauagaagccucugguuaauuuggugcaugauuucccugaaagggcuccacuuucccaucuacauguggcuauauaucuaaaagcugccuaauggaaucuaagcauaaguggaguuuucuaaaaucgcuuuuuuuuuuuuuggagacaaagucucgcucuuucugaggcuggagugcaguggcacaaucuugguucacugcagcuucugccuccagguucaagcgauucuccugccucagccacccaaguaacugggauuacaggugcaugccaccaugcccggcugauuuuguauuuuuaguagagacgggauucaccaugcuggccaggcuggucucaaacuccugaccucaggugauccaccccccucagccucccaaagugcugggauuacaggcgugagcaaccgcgcccagccuaaaauagcuuuauugaaguacaauuuacauacuauaagauuuauccauuuuaagugaacuguuugggaaauguuaguaaauuuauguagauuaugcaugugucaccacaguccaauuuuagaacacucugucacccccaaaaaguucccucaguuugcaccuaauuuuaucgucucaccaacaaguuggagaccauaaagcucaauugauaagauucccaggauuugugaucuguugguaaucaugcacaucugacacuuguacucuguguaugugcuguuucuguguguuuuuucauuuuccuuuuaauugaguggguucagacuccuuuuuuucccauuuuuaauggacaaaauuguauauauuugugguaugcauguuuugaaauauguauacauuguauaauggcuaaaucaagcuaauuaacauauuacuucacaugcuguguguguguguguguguguguguguguguguguguguggugaaagcacuuaaaauauacccaguaauuuucaaguguacaauacauuauuauagucaccuuguuguacaauaaaucucuugaacuguguauuucuuagccuauguuguuaguaguuaaaucgacguaggccauuuaguuagcuuaaaauuugugggcugggcacgguggcucacgccuguaauccuagcacacugggaggccaaggcaggaggaucacuugaguccaggaguuugagaccagcuugggcaacauugugagacccugucucuacaaaauuuuuuuuuuaauuugucaucuguuagaugugaaguuuuuuggucaguuauaagcauauuaugugauuuaguuuuguuuaagcuuuaaauaugaaaacuucuagaaucauaaucuuagcugucaucuucugaacucuagaauuuaucucccuagaugcaaauucuuagcacuuuguaguauuugcgauuacauguuguacaugaaggaauuucuuguuucuuuaaucucagaacuuuaugugggauauuuauuugcuguuuaaaauuuuaauuucucguuguggggccuuuuuuuuuuuuuuuuuuaagacaggucuugcuccaucacccaaguuggagugcaguggcaccaucucagcucacugcaaccucugcccccaggcucaagacaucuucccaccucagccuuccgaguagcugggacugaaggcacccacuaccaugccuggcuaauuuuuuggguugguugguugguuuguuuugagacggaguuuugcucuuaucgcccaggcugcagugcuauggugcgaucucagcucacugaaaccuuugccucccggguucaagcgauucuccugccucagccucccaaguagcugagauuacaggcuccugccaccauguccagcuaauuuuuguauuuuuaguagagacgggauuuuaccauguugaccaggcuggucucaaauucuugaccucaggugauccgccugccucagccucccaaagugcugggauuacaggcaugagccaccaugcccggcuucaauuuuuuuguaguuuugguagagauggggucucacccuguugacaggcuggucucuuaacuccugagcucaagcaguccacccaccucagccucccaaagugucgggauuuacaggccugagccacugcccgggcuccuuauggggcuucuuuaauaaguuccuccagugauuuuuuuuuucuuaaccuuuauuagcccuuucccauagcauuaaaucauauaaacuucuuggugacuucgagcaguccuucagcuuuuuuuucuaugacuaucuuuuugaaauuuugggauuuuuuuucaucucccuuaucacaaaauugucucacuauuguuuuugggggaaaaggcacaucucauuugcuggacucuugucucagagucagguuuacugcccauauaaaaaacaacagauggaugacuuucagagagaauaacccauaauauaaacggauuucuuuaaauguaaaucacuuuuuccguaagugaccaguuauccaaaccuuauuuuauauuuuagauccuauagcaauggaacucagcgaugcaaaucugcaaacacuaacagaauauuuaaagaaaacacuugauccugauccugccauccgacguccagguaaagaaaauaaacguuuuuugguugauuaauuccuucaggacaggugagagaaaccuauguauuaucugccuccuuauaaauauauuuuaaaaaauucauacuuggguucucaagcguaguuuauaaguguuacagcugcuauaccaugguguguuguuucuuuuuugaguaaaauagcuuuuauuuggcaucuucugggauuaaaaaguacuaguuuucggauaaaaaguacugacauguuuagaaugcuuugucuuugaccuuuuccaaaauacccacuuaaaacaugccugcuuuaggccggaugcgguggcucacaccuguaaucccagcacuuugggaggcugaggcaggcggaucacgaggucaggagauggagaccauccuggcuaacacggugaaaccccgucucuacuaaaaguacaaaaaauuagccgggcgugguggcgggugccuguggucccagcuacucaggaggcugagucaggagaauggcgugaaccccggaggcagagcuugcagugagccgagauugcgccacugcacuccagccugggcgacagagcaagacuccgucucaaaaaaaaaaaaaagccugcuuuagagauaaaauaauuagggcauagaaaggagaguaauugccuaaaaagugauuaagugaaugaagccaaguaaucaguuacugucucuuaauuuuaauuuucuauuggguuugauuuaacuaauauauuuuaagaccuagagcuuuuuuuuuccuuccugaaucugaccagauuccauuaaaaacguagaauuaaaauauugaacucagguguucacaggacucagcuguuaaguuaaaugagggagauaggccaaguggagacugguaauaucaggagaauacaugcccugauuaaguggcaaguacuuuuuggaacuagcuaauuuuggggauucagacuaguuuugcaagaucagauuuccaguuuugcuugaaaaauaaggauauuuauaugaagugcccucauuuuuaaauguuagcaaguaacuucaaaagauuuuggggccgggugcgguggcucacgcuuguaaucccagcacuuugggaggccgaggugggcagaucacgagggcaggagaucgagaccaucguggcuaauauggugaaaccccuucucuacuaaaaaauacaaaaacuuagcugggugugguggcacacaccuguagucccagcugcucaagaggcugaggcaggagaauugcuugaaccugggagguggagguugcagugaguugagauugcgccacugcacuccagccugggugacagagcgagacguagucccaaaaaaaaaaauauuuugaaacacagccaggguugguggucacgccuuuaaucccaguaauuugggaggccaaggcaggaagaucccuugaguccaggaguucgagaccagccugggcaacaaagcaagacccugucucuacaaaaaauuuaaaaauuagccaaguguggugaugugugccuguauuccuagcaacuggggaggcugagacaaaagcuucacuuauacccaagaggucggagcugcagugaguuaugaucaugucagugcacucuagccugggugacagagggaaaucuugucuuaaaaaaaaaaaaaaaaaggccaggugcauuugcucacgccuguaaucccagcauuuugggaagccaaggcaggcggaucaugaggucaagagaucuagaccauccuggccaauguggugaaacccugucucuacuaaaaauacaaaaauuagcugggcgugguggugcacggcuguagucccagauacuugggaggcugaggcaggagaauugcuugaauccaggaagcggagguugcaguuaaccgaggccacugcacuccagccuggugacagagcaagacuccgucucaaaagaaaaaaaaaaauuggacaggcacauuugcucacgccuguaaucccagcacuuugggaagcccaggagggcagaucaccugaggucaggaguuugagaccagccuggccaacauggugaaacccugucuuuacuaaaaauacaaacauuagccaggcaugguagcaugugccuguaaccccagcuacuugggaggcugaggugcaagaaucgcuugaacccaggaggugaagguuccagugagccaagauugcccaacugcacuccagccuaggugacagagugagacuuugucucaaaaaaaaaaaaaauugaaauacagugcaagccaaacuacuucugggccagauauaucuugugagcagucaguuauugauccuugauaugggccauauuaaaaugcucuugaccuguuucuucaaaacuuaccaaugugcaugcucauagaggauguuggaaggguuccaugaggaagagaauguguguuauauauuauguaugaugacuagaaucaugaacauguuaaugcaucuauccucuucuagaaaagucuuugugauuuuugagaggaaaaauuaguuuauuaguguauaaagaaguaauguguuccuggauaaagggaaguuaauggcucuaaucuuuaaucuucuuagacuuucaaagaaagcuguugccaacacuauuaaaaauuuuuuuuuuuuuuuuuuuuuuggagacggagucucccucugucgcccaggcuagagugcaguggcgccaucuuggcucacugcaagcuccgccucccggguccacgccauucuccugccucagccuccugaguagcugggacuacaggcgcccgccaccaugccuaccuaauuauuuguauuuuuaguagagacaggguuucaccguguuagccaggauggucuccaucuccugaccucgugauccacccgccucagccucccaaagugcugggauuacaggcaugagccaccgugcccgguggaaaaauuauuauuauuauuuauuuauuuauuuauuuauuuauuuauuuuugagacagagucucacucuugcccaggcuggagugcaguggcgccaucuuggcucacugcaagcuccaccucccggguucaccccauuguugugccucagccucccgaguagcugggacuacaggcgcccgccaccacacccggcuaauuuuuuguauuuuuaguagagacggguguuucaccagguuagucaggauggucucgauuuccugaccuugugauccacucgucucggccucccauagugcugggauuacaggugugagccaccgcacccggcaauuauuuuuuuuuuaauaaugugugaggcaagaguucuguugcuuuauguauucaggacagaguauaaaaauaaucugguauuucugggaaguuaggaacauagcauuucucagggaucgagacugacugacuagacugacucaacuagaccuuuugagacuccuugagugcgcagaaacauaugcaugugaauauugugauaaguugaaagaaaugaacacagaaaggaacagacucaaacucacuuccuggauauugauuacaauuuaggaaagagacuuggcaauuuauaugggcuuuuccucaaaucauggauguaguguguugcccuguacaaaaugcuggcuacuaaguggaggaaacaaauuguucuguacucauauaaaaccauaguauguccccuccugaaaaacauuuuucaguuuaacaaucuucauccuucaagaaagacaugauaagcacaaagcaaggagaguuugaaaauaucagugaaacucuugggacucagucagaaagagggaagguguuaaaugauacaugaaauuaauuuuucaaaaaauauuggaauauuggguguugcccuaugaagccaaagguagaaaaaaauuaagagaaauacuguacugccaucacaugugaucauuaaccuaggaaauuuaucccagaauguaaucuggguugaaaaucuauugguaaauuuuuuggauaaauucauugcugguauuaagaaguuuuuagguuuuuuuuuaguucgacaagaaagcuuagggcugguaagguaaaauaaggacugcacuaaaacuuucaguagugaagccuagcugugugaucuugaacaaguuacuuaaccuuagugccuugguuuuuuaaaugcuaucuacuuuucuggguaauagugacaacuaaaugaaauuuuauaauuuuacauauauaauauauauguaaaucguuggacccauuuggcuaauaauaauauauuaggaugaauugacucauuugcucuucaucacuagccuauaaaagaaauauuacuacuaauaguacuaauaauacuccuuucugaaauaagaccuggguauaugaagucuugaagccacuuaaucugccugggaagcagcuucucuugcagaugagaugaucauccaauuaggccacuguauagguuugugagaaucaugugaguuaauugaugguaaaguuauuugaaaacugaagcauuauauaaguuuaauguaacauauauaauccacuuaauagauaagaaaagugaggcccuguagacccacaaauaaccuaaucuuuucucuuuuuuugauuuuuuuuuauauauauauauuugauauauauaagguggaaagauuuuuaucuuagucuuuuaacaugaaaauucuuuuacagcugagaaauuucuugaaucuguugaaggaaaucagaauuauccacuguugcuuuugacauuacuggagaagucccaggauaauguuaucaaaguaugugcuucaguaacauucaaaaacuauauuaaaaggaacuggagaauuguaaguauuuugugaauacauaauuuaauacccuguauguuuauaagguuuauauaagcaguguucuucaaagauaaggcacgugcuuguagucccaacuacucuggaggcugaggcggaaggaucacuugaguccaggaguucaaggcugcagugagcuaugauugcaccacuguacucuagccuuuuagugacagaaugagaccuugucucaaaaaaaaggauucagauauggaucaaagauaaaauuaaacaggacccuuuuccaaagcuucuguuauuucauuugaauuuauauaaauuuguccagcuucauaccucggguugcuagggagugagacuuggucuuaaucuccauuauguuuggaauuuaugcuuuacucaccgccuacugaagagacauugugggaagacagucugaauaaaugaagugauuucugauguuggaaaaauaaagcugagaagaaaucagauacauaaaacauuugcagaaugcaaaauaauuuagauuucaacuuuuugauaagguauuuugcccuaugucuugugggauauguauauauauacuaauuuugagauuaaaccuauuuuauaacagguuuaaugauuaguaaauuauaaauuaagaaacaggcauuuuuuuuccuuagcuuaggacagugauucucaacugggggcaguuuggcucaccaggggacauuuggcaguauauuuggagacaucauagcuggaggauugcuacuggaaucuaguggguagaggccagagaugcugcuaagcauccuacaaugcacaagauagcuuuccacaacaaagaauuaucugagccaaaaugucagauugagaaagccuggcucaugauagagaaaaagaugaggcuuuucuauagugauagcaguuaugauguuacaaaguauuagcaguugacaaaaaucaucaguuuaucuaaaaagucaacuuuaaacugcucaaaaacaucuuagagucuuacuuuuuuucucauuccauaaaagagagaguaaauauuguuuuaagccuguaugauuucucaaguaucaccaugagugguaaagaaaucuuagaggccgggcuugguggcccaugccuguaauuucagcacuuugggaggcugagguggguggauugcuugagcucagcaauucaagaccagcuugggcaauaaagugagaucccaucuuuccaaaaaauacaaaaauuagcgaggcauaugguggugcacggccuguagucccagccauuagggaggcugagaugaggggaucacuugugccugggaggcagagguugcaaugaacugagauggugccacugcacuucagcuugggcaacagugccagacacugucuuuuaaaucucagaauguuuaaaaguccaucucuacugguagacaugccagcccucucccucuauuuugauuuguaaaacuagugagacuuaacagaaucucuuugggugauauaaucuaggaugcauucuaacuaguaauggucaagaaauuuucacagagggcuggguaugguggcucacaccuguaaucccagcacuuuaggaggcucagaugggaggauugcuugaggccaggaguuggagaccagccuggacaacaaagugagaccccucuucucuacaaaaaaauuuaaaauuagccagguguggucguguguggugugcaucugugguccuugggaggcugcagugggagggauugucuugagucugggaggugaaggcugcagugagccaagguuuugugcuacccuccagccugggugacagauggaaacccagucucaaaaaaaaaaaaagaauaaaaaaaauuggaaagauuuuuguucuaaagugagaguuaaauugaagcuuuugaggauguguauggauuaaguagcauauaucuguaaagauuuuaauuauguguccugauuaguuuacauaugaaaugaaaaaaaaauuuuuuuuuuuuuuuuuuuuuuuuuuugagagggagucuugcucuguugcccaggcuggaaugcaauggugcgaucuuggcucauugcagccucugccucucagguccaaaugauuguccugccucagccuccugaguaguuaguguuacaggugcccaccaccauguucagcuaauuuuguauuuuuaguagaaaugguuucaccauguuggccaggcuggucucaaacuccugaccuugagugagccaucgcaccuggccuaaaauggaaauuuuuuuuuuuuuuuuuuuuuuuuuugagacagagucacucuuguugcccaggcuggagugcagcggcaccaucucggcucccugcaaccuccaccuccuggguucaagcaauucuccugcuucagccucccgaguaacugggauuauaggugccugccaccauguccggcuaauuuuuguauguuuaguagagacaugguuucaccauguuggccaggcuggucucaaacuccugaccucaggugauccaccugccuuggccucucaaagugcugggauuauaggcgugagccacugcgcccagucuaaaauggaaauucuuaauuggcaucaaggaguaagggaaguucacuaauuuguauguaaaauauuugcauuugggaggcaauguacguuuuucugggaaaaggauucacgcugucaucagauuauugaaggaaucugugacccauucauguagagggaaacugaagaaagaccaaaccuuccucuauuuguuuucuuagaaaauuaguaaauaaaaaaacaguuauguuuuaccuaaaaucauguggacaugaauguggauuuuguguuacuuccucaguuacugcuuugcuuuuagguugaagaugaaccaaacaaaauuugugaagccgaucgaguggccauuaaagccaacauagugcacuugaugcuuagcagcccagagcaaauucagaagcagguaaugucgcuccacuuuuuagaugggcuccucuguaaagcucugaucuaauuaaucuuuuccucuccuaguuaagugaugcaauuagcauuauuggcagagaagauuuuccacagaaauggccugacuugcugacagaaauggugaaucgcuuucagaguggagauuuccauguuauuaauggaguccuccguacagcacauucauuauuuaaaagguauugaugcauagauucauguuuuuaaaauacuuucuaaaguuuuauuugcuuguguaaacaguuguguuuuugugacuguugucauuccuuugaaucugaucaucuuggaaugagagcagaaguuucuguauugcguuuguuucuucucaacuaggauguuuauuucauauugcucuauuaccugugaaauacuuagucuugauaaacugcuugaucccuuuaaaaagaaaacuggcugggcaugauggcucacaccuauaauccuagcacuuuaggagggcaaagugggcggaucaccugaggucaggaguuugagaccagccuggccaacaugguaaaaccccgucucuacuaaaaauacaaaaaaaacuagccaggcauggugguaugugccugucaucccagcuacucaggaggcugagacaggagaaucacuugagccugggagguggaggcugcagugagccgagaucaaaccacugcacuccagccugggcgacagagcgagacuccgucucaaaaaaaaaaaaaaaaaaaaaaaaagaauucccuuugaauuucggaauuucggaaacccaucuauucauagauguccaaucagcaucucuccuugaagaccuaaagugaguaaauaaaaaaaacuuguaaauuuaucuguuuuaccuuaauuuucuagauaccgucaugaauuuaagucaaacgaguuauggacugaaauuaagcuuguucuggaugccuuugcuuugccuuugacuaaucuuuuuaagguauggaaugcaucuuggugauauuuuuaaauuaauauuuuaaauugcuugaauguuuguauacauguuaagagaaugcuuugaaagcuuauuugauagauaauguuuagagcauuucuuuugaaaaauuucaaaccuacacagaaauagagaugcuauagugaacucccaucuauuauuacacaaauuuaaugguuagcaacguuuuauuuucucuguucccuuucuuaggaauguuauaaaagcaaaucccaagcaucauaucauuucacccaaguauuuuaaaguaugugucucuaaaggaagaaauacauauuuuuauuugacuauguuuggaguuuaauuaauuauauauuuauacauuauuuuacaguuuacaggauacuuuccugaauguguucuugguguuugugaaaauccuauaagauuuaaagaaauauauauauacuuuuuuucuuuuuucuuuuuuaaagacagggucucacucucauugcccaggcuggagugcaguggggcaugauuauagcucacugcagccucaacuacccaagcucaggugauucucccaccucagcauuccaaguagcugggacuacaggugcacacuaccaugccuggcugcuuuuucucuuuuuuuuucccucucucuuuuuuuuuuuuuuuuuuuuuuuuugagauggaguuucgcucuugcucacugcaaccuccgccucccggguucaagcaauucuccgaguacacugggauuacagccugugccacugggccuggccaguaaaaccuguuaaucgcauuuagaauaauaaagaauuggaaacaaccuaaauaccaaguggcagaugaauuguuuaauaagagcauauaaagauaguuuuguguaauauauuuuuauauaugcacagauugggaagacguaguucagaauauuaacacuggacuuuuuagugccauuaugaacaguucaaaaauacauacuuuaaccuauuuuccacaaucucuuaagugacuguauuauuuaaaagccaaggcugggcaugguggcucacgccuguaaucccagcacuuugagaggccgaggcgggcggaucacgaggucaggagaucgagaccaccauggcuaacguggugaaaccccgucucuacuaaaaauacaaaaaacaaaaacaaaauuagccgggcgugguggcaggcaccuauagucccagcuacuugggaggcugaggcaggagaauggugugaacccaggagguggagcuugcagcgagccgagauugugccacugcgcuccagccuggacgacagagcaagacuccgucucaaaaaaauaaauaaguaaaauaugaauagucucagcuuagugcaaggcuguuucacuaagaucagcaugcuggguuuaugaugcacuaaaaccauguugcuaaauuccuuuccaaggccacuauugaacucugcaguacccaugcaaaugaugccucugcccugaggauucuguuuucuucccugauccugaucucaaaauuguucuauaguuuaaacuuucagguaaguucauuugauuucuugcuuuugguucuuacucuuugauuuuaaauagaguuuucuuucuguuugauaaagacuucuuugccagcauugauuuuucugaaagaaaagguuuuuucugacucuauuuaucuauaguguucuguucuacaguaguucuuucagaugcuaaugagauguuucauggaaaaaagcaguauucucuuauaucuaguagguuagcaaaaccccacauccuaacucacucuuggagagucacccuguacacuguuuuacugguggcauuaagaagcuagauuucugaggccuuccucuuucguucauuuauauggguauuaacauuuggggaaucauguuuugguuagggguugcuguccagcuuauacaaaaugacuuuuauuggaagccauaugagggagacaaaagacuugaaguaccagacuuugaaagggguaggaacuaguaguauuucagaggaaacauagccacagggcuauagcagggaaugccuaguuacccuguugcuacugagauaguggccuccaaucauucuuucuguucuuaaucauuaauucaagauucaggaccaagaaagggguguuaauugguacaaacuguugcuauacugcgaugcaaggagggccuagcccauucauuguuuguagccaguaccuggacuuaccuucacaacaugaauaaacucauagugguagggaaagcauuccccaaaaggaaauuggguuguuuuagcuagaauaggagaugaacagcccaaaaggacaugucccacaucaguguucagcuggauagcaguuugagaaguucuuacuuaaaugaguacuacuauuuuugcuuacaccuuuugaauucugagaagucagguuuaaugaagcucuugagaacuugucuggcagggagaccaaggaaagaggcauaaucuacccucaggggacuuguacccucauuaagaaggcaguacuaugccacaagaaaucaguaacuaaaagacaauuaguuuaucugccuugguggucaucuuacaauaaacguaguucagaaaagaaaggggauguauuaguaugcacugagcuugagcuuuguaaggaaagucuucauauagucuuagcugaaccuugaaggaagauuuagauuaggaugagaacuagagguggcaucauuuauagcauacaaacagaggcagaagucagaaugcuuuaugcagcugccagauguagcuggagcagagaauucuugucagaauagguaaugcucaggcugugaagccuguguauaaaauguuuuguccacgugguaagggaacuuauaaaagugguguucuuaauauuuuaaucaaaaguuucaagucaguguuuauucuguaggaucucccugaauuuuuugaagauaauauggaaacuuggaugaauaauuuucauacucucuuaacauuggauaauaagcuuuuacaaacugauguaaguauuuaaaauguugccugaguggucuuuuucuuucauuaagaguuauuuggcuacagucuggaaaccuauuuacucuugcauuguuaaaagauaaaauuucaauacuguaauaauauuugauucuauuugauguuacauguuugguguguguaguauacagaauuacucuuaucaugggcuuggcuuaagccauaguguacauauaaggcuguuucauuacauuauugaaaguaggucuuuaaaguagugacauuauggauauuucaugaaauaaaauuauuuuucauugaagauacuaagaaaacuuaaaacucuauaaugguagccccuuuuuaaaaaucaucuggcuaggcauggugguucacaccuguaaucccagcacuuugggcggccaagguggggaggaucccuugagcccaggaguucaagaccagccuuggcaauguaaggagacccccaucacuacaaaaaauaaaaauaaaauuagccagauguguuggcucaugcuaauggucacagcuacucagaaggcuuaguugugaggaucccuugaccuugagcccaggagggcaaggcugcaaugagcugugaccaugccacugcacuccagccugggagacagagggagaccucgucucagaaaaagaaaaaauuauccacagcucgagaaagagagaaaaugguaaaagauuguaauuuguaaauauuucugauauggguuuuauauuguguacuuuuaaacauauaacacuuauucugugcuacucauuuguuaauauauuuaugaccuucuuuccgaagagacaaaagacaaaauauuaaaaauauuucaauaccaaauaaacuaaaaauuagaauuggugauucaaaucagguuuuaagagugggguacagaaagaaauuguuacuaucguuguacaacagauuuugucucagaguuugacuauauuaauaggaacuuuaaaagauguagcucucauaaaauaauuauuucaguccaaugggagggaaaaacacuccuucagaaaacaaaacuuuucuucacacaaaagucacaaggaaauuuuuuggauagaauucuuacaaggaccuuuuugcccaguuaaccaugugcuaccuugugcuacuauuuaugccuuaaguaaucagugugagggaguuuugguuuuggcuuugguuuuuguucuuacucugaugucuucccuugucucacucugucaccaaggcuggagugcaguggcaugaucaugacuuacugcagcuucgaccucccugggcucaagugauccucccaccucagccucccaaguagcagggacuauggguaugcaccaccaugcccagcugauuuuuuuuauuuugggggcuugcuguguugcccaggcuagacucaaaacuccugggcuuggcccgucgcaguggcccacgccuauaaucccagcacuuugggaggccgaggccauccuggcuaacacggugaaaccccgucucuacuaaaaaaaaaaaauacaaaaauuagccgggcgugauggcgggugccuguagucccagcuacuugggaggcugaggcaggagaaugacgugaacccaggaggcggagcuugcagugagcugagaucgcgccacugcacuccagccugggcaacagagggagacugcgucucaaaaaaaaaaaaaaaaaaccacuccuggccucaggccauccuccagccucagccucccagaggguugggauuaccggcgugagccacuacacucagccagaauauacuguuugaaucuaauacggaaauauuuuguaauucagcaacuuauuugaaagacuuggugaaaagauuggugguggcauagcuguaguuuacaauaacugauuugauuuggauuuaauugauaaagagucuaguucaggaauuucaguuacuccucuuacuuauguuagcauuagaguuguauguuggaguuuuuguuuucuuuuaugugaggaugaagaggaagccggcuuauuggagcucuuaaaaucccagauuugugauaaugccgcacucuaugcacaaaaguacgaugaagaauuccagcgauaccugccucguuuuguuacagccaucuggaauuuacuaguuacaacgggucaagagguuaaauaugauuugguaagaugaugguggagacaaauaauuaaaagacauucucucccuaucuccuccaagaaauaagcuguugaguuuugcuuuuaaaaauauucuuguuuuuguguuuuguuccaguugguaaguaaugcaauucaauuucuggcuucaguuugugagagaccucauuauaagaaucuauuugaggaccagaacacgcugacaaguaucugugaaaagguuauugugccuaacauggaauuuagagguaauuauggcaaaaguauauuaguauaaaucuacuaagucuguguuuguuuuuuguaacauauucagucuaauucauuuauuacuggauaaaacuuguaugucauuuauuucuuauuuucuaaaccaagacagaaaauguaguaucuguaaugaguuuuguugugcccugugaggguuuucucauggaaauauuaaauaagacuucaaaaauuccuuuacacuaagaagauaaacuaucuggaauuucuauuuagagaaagaauuugauuuuguuucauuuauuauuucaaugaauuuuuagcuggcuuuauuuauuuauauauuuauuugagacaggggucucgcucugucacccaggcuggagugcagugaugcaaucuuggcucacugcaaccuuagccucccaggcucaagugauccuccuaccucagucuucugaguagcugggaccacaggcacacaucaccaugccuggcuaauuucuuguauuuuugguagagacaggguuucaccauguuguucaggguagucucaaacucuugagcucaagcaguccacccgcuuuagccucccaaagugcugggauugcauuucugagccaccucgcccagaaauagcuguuuuuaaacaaucgacuugagaauagaaaugauaacuuuauaaauacaagguugaagcccacuuaguuugugcuuaagguuaaacuauagugcuaagagccuauauuuauaaaauguauguccuuguucuaacaguugugaagaacaaguaaugaaggugggagggauuguguuuuuuguuuuggggacagggucucacugugucacccaggcuggagugcaguagcacaguuauggcuuacugcaaccucaacuucccaggcucaagucauugucccacccuggccuccugaguagcugggacuacagacgugcaccaccaugcucagcuaguuuuuuauuuuuuauaaagaugggggucuuccuauguugcacaggcuggucucaaacuccuagcuucaaacaauccuucugccucagccucucaaagugcugggauuacaggcaugagccaccaugccaggccaagauuuuguuuuauaucaaaauaguuauuagaucagugguuuucaaauuacaucuggaacaaaauaaggaaauuaaggacaauauagcgugagauuuuauuuccuguuguguuuucauaaaaauauguuuaaaggauaaaucuucuggcugggugugguggcccauaccuuuaaucccaacacuuugggaggcugaggugggaggaacacuugagcccaggaguuaaagaccagccuggccaaaauggcaaaaccuuaucucuacaauaaauaaauuaguuggguaugguggcaugggccuguggucccagguacucaagcagcuuaggugggaguuuugcuugagcucaggagguggaggcugcagugagacaugaucauacaacugcaguguguguguguguguguguguguguguguguguguguguguagacuuuuuuuuuuuuuuaauuuauaugauaaaaauagagaugagaucucgcuguguugaccaggcuggucucaaacuccugggcucaagcgauccucccauuucagccucccaaagugcuagguuacacgcgugagccaccaugccggccauuucugacauuguccacucuacuuauuuguuguugaaaugacuuuaaugaaauaauagugauuaaaauuagguuguugguauuuuaauguucuuauuuggugaaauuaaaaguuagcauucugauacugaucccuaacauuuuugacaguugcagguauaauccaauucuggggaaacugucacauuagaacaagugagccuaucucauaguugugugaauuaccuaauaccucaccuuucaggguagcauuugcugcucuagauaaugauuaagaguauaugaaguagucaucugaugggaacgaauucuuugcuguagaacaaggcaguuuuacauacucuucugcauucucagcuguaaaguacagugacgucuuuuggaguguuaucugaaauaucaucucuccuuguagcugcugaugaagaagcauuugaagauaauucugaggaguacauaaggagagauuuggaaggaucugguguguaucuugguuuuuuaguuacuagucucuuagcaagccaguuuuaaggugguucucuuucuaguaaaugggagaagugggauugagaauaagaguguuuuuucagcgggcuuucauugagaacuguugucuuucuucaacuugucuuaaaaagcucuuauaugaccugaaugaaaauaucaaaaguugaaucauuugucuguucuuacauaguauuuaucaaaauucugugauucugugaccucuuuaguuucauuuugauuuuguauuucuugggggcgggaauguuuuuuucauuguuuguguugcugauagcuauuggguggcccuuuguuuuucguucuuuuuuuuccguuuuacaaucguagccaaauuauuccaggcaauuuguuuucuuauaaauuggaucagcuuguuggugguuguuuuuuuuccccauaauauauuuucuuuucauuucauagauauugauacuagacgcagggcugcuugugaucugguacgaggauuaugcaaguuuuuugagggaccugugacaggaaucuucucugguuauguuaauuccaugcugcaggaauacgcaaaaaauccaucugucaacuggaaacacaaagaugcagccaucuaccuagugacaucuuuggcaucaaaagcccaaacacagaagguaaauauuuuuaaugugguuuuguuucuaaaacagacaucagugacacccacacaagucaaaaagaaauaacgucucugauaauagagcuuacucugccagauaaccuauucugauuaagauuuauauaaucucugaagauggcuuuauguugauguauugagcacuuaaguuucuuauagaccagaaaauugauagauggccacacuuguuaccuuagcugagacccgcuguaucaaauaugcuuaacuuaaacuuagcuguucuuuaauugaggaaaguuucuuuauugucuauuaguauagucuuauuuuacauuuuuauauuuuugagauggagucucacuuugucaccaggcuggagugcaauggcgugaucucagcucacugcaaccuccaccucccgaguucgagcgacucuccugccucagcgucccaaguaacugggauuacaagugugcacuaccacaccuggcuaauuuuuguauuuuuaguagagacaagguuucaccauauuggucaggauggucucaaauuccugaccucgugugauccucacaccucagccucccagagugcugggauacaggugugagucaccgugccuagacaguauagucuuauuuuauauuuuauacauaagcagguuguguuuuguuguuguuguuuuguuuuguuuuguuuugagacggaguuucgcucuuguugcccaggcuggagugcaauggcacgaucuuggcucaccgcaaccuccguuugccggguucaagugauucuccugccucagccucccgaguagcugggauuacaggcaugcgccaccacccuggcuaauuuuguauuuguaguagagaugggguuucuccauguuggucaggcuguucuugaacuccugaccucaggugauccaccugccuuggccucccaaagugcugggauuacaagcaugagccaccaugccuagccuaagcaguucauguuuugaagugucccucucucucuuuuuuuuuuuuuuuuuuuuuuuuuuugagacguugucuugcucugucauccaggcuggaaugcaauggcaacaucucagauuacugcaaccucugccucccggguucaagcaauucucaugccucagccucccgaguagcuagaauuacaggugcaugcaacuacaccuggcuaauuuuuuguguuuuuaguagagacgggguuuugccauguuggccaggcuagucuugaacuccugacuucaagugaucuacccgccucggccucccaaagugcugggauuacagccgugagcuccuguacacagccaguacagucucauuuuauacauaagcaauuuguauuuugaaguguucaucuccauuuuaacaugguuuucuaaaauugccugaauuucuaaugugauagauauauacagguauuuuguuauuuuacuauguuaugaauuugcuuuucagcauggaauuacacaagcaaaugaacuuguaaaccuaacugaguucuuugugaaucacauccucccugauuuaaaaucagcuaauggugaguugugaaauucuugcuuuuuuuacagcuugccacacuauaccugaauucaaaaaacagcuuccuauccuuguucccuuuuguucuuuuuuuuuuuuuuuuuuucuuuugagauggugucuuacucuguuacccaggcuggagugcaguggcacagucucugcucacugcaacuccugccuccuggguucaagcgauucuccugccucagcuucccaagcagcugggacuacaggcacguaccaccaugcccggcuaauuuuuguauuuuuaguagagacgggguuuccccauguuggccaggcuggucucaaacuccugaccucaggugauccaccugcgucggccugccaaagugcugggauugcaggcgugagccuccaugcccugccuauuauuucuuuuauugaauaaaaucucaaaugguuuccccagaucuuguccaugugaaauuaauuauugauaaagaaaauauugcuugauuaggaggaaaauaggaauaaauacaacuaaacuguaacucagcuuugcuaccuaguguauaaauaaggauuauacauuggcuuccuuuucuuuuuuauuugaaagacgaauucuuaaaaauuggaguacauuucaaaguacuagaaaauugauaaauauuaaggauaucuuuuggccgggugcgguggcucacaccuguaaucccagcacuuugggagacugaggcgggaggaucgugaggucaagagauugagaccagccuggucaaaauggugaaaccccgucucuacuaagaauacaaaaacuagccgggcgugguggcgugugccuguaaucccagcuauuugggaggcugaggcaggagaaucgcuugaauccaggaggcagggguugcagugagccgagaucgugccacugcacucuagccugggauacagagcgagacucugucucaaaaaaaaaaauuaaggauaguuucugauguuuaugaauguauugaucuagauccagauauauuccuuuuuaaaaaaaauauuuuaauguaggaaauuuauguacacccaaaggugaagagaauauuguaaugagcucccaugugaccaucauuuagcuucaagaauuauuaacauuuggugaucuauuccuuucauuaauuuauuucccuacccacuagaauaauguaaagcaaauuccagcuagagagacauguuucuaauucagaauagcuucacuucugggaauguagguagacaugcucaccgaugcaugguccagcucauuuuuacucaauuauguaauauguguuccuuagucaugaaacaggcauggggaaaaauaaaaucauuuauaauccuaccaaaauuaaugacuaaauaguaaaucauaauauaauuaacugugcuuuaauuacuugacauuuuaucuuuuuuuauaacucugaugaugucacuaauuuggaaguaaugauccuuaccacuuaaguaacuguggcuuucuguuuuuuuauauagugaaugaauuuccuguccuuaaagcugacgguaucaaauauauuaugauuuuuagaaaucaaguaaguagcuuuuuauuuguuacacgccacuuaaucucuuuaagaguuuuauuauguaccaccuucucaucuacugugcagucauuuuauauccacaucuaacaaaauuaacaaugauuucuuuauaacuuagaauuuuagaccaugcuuaauuuuccucagaugucuuuuugcaauaauaguaauagaauugggaucuagauaauguccacacauugcuuacaguugauugugucuuaagucucuuaauuuacaauagagagguccuucucugccacuuuuuguuugagauggagucucauucugucacccaagcuggagugcaguggcaccaucuuggcucacugcaaccucuaccuccuggguucacgugauucuccugucucagccucccaaauagcuaggauuacaggcaccugccaccacaccuagcuaauuuuuuguauuuucaguagauccgggguuuccccauguugaccaggcuggucucaaacuccugaccucaggugaucuguucaccucggccucccaaagugcugggacuacaggugugagccacugcacccaacugccuuccuuuccuuuuauuuauuuauuuaaaaaaaauuuuuuuuuauuuuuuugagacggaucucacucugucacccaggcuggaaugcaguggccugaucucagaucacuguaaccucugccuuccggguucaagugauucuccugccucggccucccuaguagcugggauuacaggcaucugccaccacgccuggcugauuuuuuguauuuuuaguagugaugggguuuccccauguuggccaagcuggucucaaacuccugaccucaggugauccaccagccuuggccucccaaagugcugggauuacagcugugagccacugcaccuggccucuacccuuucuuaugcuuguuguuggagaaaacacucauuuaucuuagagacuuucucacauuuuacuuuuggcugauugcaccuugaaucucucaguauucaagggguauugguuccaggacgccugaauaucccaaaauugaugaauacuuaggucccacauuugggccugcggaauccucauauaugaaaagccagccuuccacauacagauuuuacaucccaggaauacuguguuuucuauuugcauuuggucuaaaacaaauccagccaggcaugguggcuugugccuguaaucccaacacuuugagaggcugaggcaggcagaucauuugaggucaggaguucaagaccaccuuggccaacaugacgaaaccccaucucuacuaaaaauacuagcugggugugguggcacaugccuauaaucccaucuacucgggaggcugagacaugagaaucacuugaacccaggaggcgaagguugcagugagccaagaucaugccauugcacuccagccuggacaacagagcaagacucaaacccguguuguucaagggucuccugaaguuuauguugucccucuaguccccauauuucuauauugguaaaucugggggcuugauuagacuuagauuccuuggucgggggugacacaagaaagcaucauagguauacuuucuguuucauuuuaucaggauauacacaauaucugguuguuuuguuuuuuuuuauuuuuuuuguuuuuuuuuuuuugcucacugcaagcucagccuccuggguucacgccauucuccugccucagcgucccaaguagcugggacuacaggcgucaggcaccaugccuggcccugguuaucaauuuuuaaugauguuaagacagaucaguggauucagaugaaggagaacguuacauugucaacauuuuuuaaauagcauuuuaaaaauugagauauacuuuauucuuuuuuuuggagacggaguuucgcucucguugcccaggcaauggaacgaucucggcucaccgcaacaugcgucucccgaguucaagcgauuuucuugccucagccuccugaguagcugggauuacaagcauccaccaccacgccuggcuaauuuuguauuuuuaguagagacgggguuucuccauguuggucaggcuggucucgaacccccuaccucaggcgauccgccugccucggccucccaaaaugcuaggauuacaggcaugagccaccgcgcccggccuuauucauuuauuuuugagacaaagucuuacagucuguuggccagucuagagugaacuacuacaaucauagcucaaugcagccuuaaacuuguaggcucaagugacccuuuugccuaagccucccugaguagccaagacuauaggugugugccacaccaccuggcuaauuuuuuauacuuuuuacuuaguuuauuguuucuuucuuucuccuucuuuuuuuuuuuugagagguaguuuugcucuguugcccaggcuggaguacaguggugugaucucggcucacugcagccuccaccucccagguucaagugauucucuugccucagccuccugaguagcugggauuacacgugccugccaccauacccagcuaauuuuugucuuguuagaagagacaggguuucaccauguuggccagacuggucucaaacuccugaccucaggugauccaccccugccucggucuccgaaagugcugggauuauaggcgugagcuaccacgcccggcccauuucuuuauuuuuugaaacagggucucguucugucgcccaggcuggagugcagugacaugaccacagcucacugcagccuugaacuccugggcucaagcaguccucccacuuucagccucccgaguagcuggaacccaggcacgugccaccacacccagccauauugcauuacuuuuaaaaaaucaauugagaaaaauuauagagaauaccugcuuccccaguuagaguauguuggaauuuugccaaucuuaaaugguaucucauugcaguuuuaauuuacguuuguuuuauuuugaguucaguuaagcaucuuuccacuugaaggguccauuuucauuucuuuucggugaacugugaauucaucuucuuuugcccauuuuucuaucugauuauuggucuuaauuuuuagagaacguguaguuuuucuucugauucugaaugccuaggucacuuuaauuguacugagaaaaaaaucaaaacuugcacucaucuuauuucuuugaugucuuugcccaguaacaauggugccaucuugcaaaauauuuuaaacacacaagcaggaauaaaacaauaugaugauuacugaaauaauccucacaaaucuuaaaacuccaggccauauuuauguauacauacauauacaauggagguauuccaggugcucccugcccagucagucccuuucucucuauagguaauuacuguagugaauucgguguauuugacacccauggaagugcuuuucuuacgcuuucacuacgcauuuauguuucugcaaaaauuauuuaguauuauguagguuuuaauuuuuuuuuuuuagauggagucuugcucuguugcccagguucaagccaugcuuuuuuuauacuuucacuauguguuuauguuucugcagaaauuauuuaguaugcuguagguuuuaauuuuuuuuuagauggagucuugcucuguuacccagguucaagccauucuccugccucagccucccaaguagcugggacugcaggugcccaccaccacgcccagcaauuuuuugguagagacaggguuuugccaucuuggccaggcuggucuugaacuccugaccucaggugauccacccgccuuggccucccaaagugcugggauuacagucgugauucaccacgccuggccuagguuuuaaauuuuuguuuguauaaaugacaucauacuauggguuucauuuuucuguuuuuuguuacuuguuuguuuugagacggagucuucgcucugucgcucagugcaguaacacaaucaagucaugcaguggcacgaucuuggcucacugcaagcuucaccuccuggguucaugccauucuccugccucagccucgcgauagcugggacuacaggcuaccgccaccaugcccggcuaauuuuuuuuguauuuuuuaguagagacgggguuucacuguguuagccaggauggucucgaucuccugacguugugauccgcccgccuuggccucccaaagugcugggauuacaggcaugagccaccgugccuggccuuuucuguuuuauuuugagaaugaggucuugcucuguugcccaggcuggagugcaguggugcgaucauagcuuacuucagccaggaaauucuggacucaagcgauccuccugccuuagccucccuaguugaugggauuacgggcaugcuccaccguacccaccuacaucaugacuguuuguccuuaacaucuuuuuuuuuuucuuuuuucuuuuuuuuuucugagauggagucuugcucuguugcccacgcuggagugcaguggugcagucucagcucacugcaaccuccgccuccuggguugaagccauucuucugccucagccucccgaguagcugggacuacaggcgcaugccaccacgucuggcuaauuuuuuguauuuuuaguagagguuucaccauguuagccaggauggucuugaucucaugaccucgugaucuacccaccucggccucccaaagugcugggauuacaggcgugagccgccacugcgcccggccuaacaucauuuuugaguuauucauuuagugccuaaagcgauccagcuaccucagccucucaaguugcugggacuacaggaauucacuaccaugcccagcuaauuuuuuauuuaauuuuuucuuaauagagaugaggucucacuauguugcccaggcuggucuugagcuccugggcuuaagcaauuguucuaccuuggcuuccugaaguauugggauuauagacaggaaugaaccaccacacccaggaggcuuuucuaguuuagacuaaugaauguuucaaauuuagagguuuuuaaugaagauuguucucguauuuguugcuuuuugggggugggaagagaacaaaaaaugagacacaaaaagguuaaauaacuuuuucaagaaauaucugcuagugaugauucuuaaguuuggugaaaucuuagucuccuucucugugauauuauuauuuuaugguauguugauuuaucugcaagauguuauccucauaguuuugugcucugaaaaggagaauuuagaaaguggaaauugaaccauuaugugcaagugaaaguuuugguuucugggcagcagcaucuccuauuauaacagagcuuaaaaauagcaaauuguucuuuaaaucaacagguccuucucuuccaauugucuuuuacucaaauauggaaucauugcauuuagagcauguauauuauuguguuuuuuaggugccaaaagaacaucuuuuagucucgauuccucucuugauuaaucaucuucaagcugaaaguauuguuguucauacuuacgcagcucaugcucuugaacggcucuuuacuaugcgagggccuaacaaugccacucugugaguauuuuauucuaaaguuuuuuagccugggguaggggcuguacugugcuggucaaagauaucugaauguuuucauaauuucacuagugggaaaacaaaugucugcuuucuauuccuuuauacucuguuucauucuaaaagcauuugaggcugcuuacuaaaauaggugcauuaugacaauacaauuuaauaaacuggagccaaggaaaguaacugagauaaaguuaauaaacagaaaugugugucaaaggauccuauauaguaguccaagaaacuccaaauuuuauuuggagucucuuagcagccagggcaaagagggaaacuugggaaguuaaaauuuucacagggucuaugagauaaaaguuaaagcagagaauacuguacaauaguaguaguaguguucucagcaacaaucauguaacaguuauuuucauguggcuauuugcguaaggucacuuauuucugagauaugaccuaaccgaaugaaaguaauucacuggggaccaagaaaauaggucuucuggccugaaccaggaugaaauguagaggaauggauggucugcaugucuuucaggccacuauucaacaguauuauuucuugaaaugagcuuuggguaagagauggaaaacaguucuagguucuuuccuucaucaagaacuugaaguacagauacucucaguggccaauuaaggguagaaaggacauccuuugaggugagucaagccaguaccuaucuucaggcccagaauuuaugcagaaaacaguucugaaucuuggcuccaccuccaaaaacaaaauaaaugacagaguccccugagauucugaguucuuucucagugguaauagauauaaaccagggacaacuguuucaacuucagauguuguuggguuuagcuggcuuuuugguucaguuguguuugguucucgaugugccuucuuaggagccuaacaugagcacauguaaaaaaauuauuuuccuaaacugucuaucaauugucaguggugggagauggcucaguuuuaugcugagaagggugacauagugguugccaaggguaaucugcagugacaagcucaagaguugguagugacugaaagcuguuuuuucaucuauagcuuuacagcugcagaaaucgcaccguuuguugagauucugcuaacaaaccuuuucaaagcucucacacuuccuggcucuucagaaaaugaauauauuaugaaagguaggcuguuucccuggugugcagacuacagguauccaaucucagauuguaagggugagcacucugaguuauacuucagguuauacagucuaugaaccagauaauguuuaccaaguaguaaguuaguuuagauauuucaaaaugaaaaacauuaucuuguuuacuacuaacaauaauuuuuuuuuuuuuuuuuuuuuuuuuuugagauggagccuugcucuguugcccaggcugaagugcaguggcuugaucucagcucacugccaccucucccuccuggguucaagcgauucuccugccucagccucccgaguaacugggauuacaggugcacuccaccaugcccgguuaauuuuuguauuuuuaguagagacaggguuuugccauauuggccaggcuggucucaaacuccugaccucaaauaucugcccgccucagccucccaaagugcugggauuagaggccacugcaccuggccaacaguaaucuuaauuugauauggaacuucucauuacagaaaauguagcaaagcccuuuuuuccuucccuagauugaguuucuuuaaggcaaagaagagaucaugcaacguuuauuaacugcaugcucaccuagguaggggugaaaugugggugccugugguagacucugcacaaaucgugucuucuuacguacugccaaggacacaggcagcuguauccauccacaggcugguguauccauccaccaggcacuacauuaguugaguguccuggugccagcucugaauuuagagauagucucaguguuuuucacuguugcaucccaaaagccuagcacauuggguuguaggaagcacuuuucagagaaacucccugaucuuuucagucuggaucagaaauccuagaguggauguguguaucuggguguauguuuccaacacuauccuucccccaacaaugauguauaauuguguaauuauuguuguuuaauguccuuuuuuuuuuuuuuuuuuuuuuugagauggaguuucacucuuguugcccaggcuggagugcaauggcacaaucucagcucacugcagccucacucuccuggguucaagcgauucgccugccucagccucccgaguagcuaggauuacaggcgugugcuaccaugcccagcuaauuuuguauuuuuaguagagacaggguuucugcauguuggucaggcuggucuugaacucccgaccucaggugauccacccgccucagccucccaaagugcugggauuacaggugugagccacugcgcccagccuuaauguccauuucuaugagagcggcuaacuagucuguaaucuucauuacuguguuuuuaggguauguaagaauacacaguauguaauaccuucucuguacgguuguaugagugaaugaaauaauucugcgccagccuaguggaggagcaccaauuuauccucuagcccuuuuaacccaggucagggaaggauuuucucuaggaagugaucucuaagcugagauaugaccuaaccgaacguuaggugugagggauagguagcaaucuguugaaggguggaugagucuuugacuccaguagaggaggaaacaugaugugcagaguucaggaggcaagagcagauagcuuucuguccuuuaugcuuggcauguauuuggggcucugcuuaguaaacauuuauuuuagaaauguuauuuguggaaagagagcuuuuauacauuuuuagcugacaaauuuauuuuucucccaugcuuccuauuuuuaacccauuuauggucuuuugagcaauauuuuugcaauuuggacucuguggcuuuacauguauuuuuagaauuuuuuuaggcuccuaaucucuuuuuuugagggagguggauaggcaguuuucucuucaguuuccuguaguuugugaucauguuuccuuuaggcuagggcuaaacauuuucugaugcugguuucuuuuucuuuuucuuuuuuuuuuuuuuuuuugagagagagagggagucucgcucugucucccaggcuggagugcaguggcaugaucuuggcucacugcaaccuccacuucccagguucaagcgauucucaagccucagccucccgaguagcugggacuacagacgugcaccacauaccuggcuaauuuugcuauuuuuaauggagauggguuuugccauguuagccagguuggucucagacucuagccucaagugauccgccagccucggccucccaaagugcugggguuacaggugugagccaccaagcauggccucugcuacugauuucuaagagaaagagaccccaaacaguucucucucagacucaccugcuccauucaugucagcucacuguuucuuccucuuagucaaccucuuuaauuauuuuuuaaaccuugagccuucuagaaauacucaguauuucccagcuaaauuuuguugccaacccguccuaauuuuaaaaggaagggaaauuuagauuauuuuuaaauguagagagcuaucucgggguugucuaagcaucuuaaaauuuaguugaugaauuagugcgcuuuuuuccccccagucgcucucuuauucugaaguuuaacuaaacucuauuuguuuuugcuguuuuuguauuuuacagcuaucaugagaaguuuuucucuccuacaagaagccauaauccccuacaucccuacucucaucacucagcuuacacagaagcuauuagcuguuaguaagguaauagagccaauuuugaaagugggguuccuuuuuuauuugcuccaaacuguuugggccucagaacucuuuggcauuacgugaagcuuuagagaaggucugugaauucuuccugaccagccacuaauggacuuuucugaaagugugggcaugcuguuagauuggagacguaauagcagucaccuuuaagugugugcuagaagcuugaauacauuuucauucucauuacaaaaguaacauguuuauuguagaaaaagaaagugcagaugauccaaaauuaccuuaaauggaguuaaguaggcuuugcacuaaauggauauaaaagaggcugucuggacuucuaugaaaugaugauuaaaauccuuuguguugucuuuucuuccuuacucuuauuucucaaaaggaaaguucacucugaucaaaauuuuacagauacuuagauucauguuuauuaacacuaaauuuuagaaaauaaauccguuuaaggcugacagaauuccuuuuuagaugcuauucuugaucuuaugagaauuagaucaauucauaggaaguguuggagggauuuuggagaacagagugauuauuauucaacugaguuagggcuaagggucuuuggacuacuuagggccuugagggauggagcggggagggaacccaagucuccgccucccauauguauuaccaucucauguucugauugaguuagauuuguaugcuaguagccuuccaagaacuuguuuaaagaaaaaugggguuuuguugcuuaaaaagaacauaaaaaacuacucauuugggggauuaucaguaaguagacauagacauugaggcccacagaaguuaaggcuaguggcauuacuaggacuuaguauuucuucucugcgagggcacgugggcuuaagacaaguuacagcucugggaucugagguuuguauaagcaacucuguaacucugaaguauuuuuuucaugguggacuuugggccauuuaaaaaaaaauucaaaugaacaagcacuaggguauaauugguguuuuuuucuuaauuuugauuuuuaaaaaauaagauggccucuauuuuaaauguguuuuauaaagguuagguguggauuauuagcauaauuagguuuuuuuuuuuuaauuucagaacccaagcaaaccucacuuuaaucacuacauguuugaagcaauauguuuauccauaagaauaacuugcaaagcuaacccugcugcuguuguaaauuuugaggaggcuuuguuuuugguguuuacugaaaucuuacaaaaugaugugcaagguaaguuaacggaaauuauuuucuuuguaauggaauaaaauuaacauggcuauaaaaugcagcccaccuaagcgaugugggccuuuugugucagucauuccuucugaagcucacagcucuguuuuuacuuuuaucaacagaauuuauuccauacgucuuucaagugaugucuuugcuucuggaaacacacaaaaaugacaucccgucuuccuauauggccuuauuuccucaucuccuucagccagugcuuugggaaagaacaggaaauauuccugcucuagugaggcuucuucaagcauucuuagaacgcgguucaaacacaauagcaagugcugcagcugacaaaauugugcgucagguuuugauauaacuguaauuuuauaaaguagcuuggagaaacuggggauggcagauguuugaaauuuuuuuauuuaaaauaaauuuaaggcugggggcaguggcucaagcccaccacuuugggagccucuagugggaggaucccuugagccgaggaguuuaagaccagccuaggcaacguggugagaucuaucucuacaaaggaaaaaaaagcuuuuuaauuaguuggacacaguggagcaugccuguggucccaucuacuugggaggcuaaggugagagggucgcuugagcccaggaguuuaaggcugcagugagccaugaucucaccauugcacuccauccugggcaacagagcuagacccugucucuuaaaaaaaauaauaauaauaauaacggaaauaauuaguagaaaauguuaugguauguuuuaucagaauucuguauccuuuaguuauuuauauccaugauggaaaauuuuaaaaacagagccaaacagguugauuuuaagaacuuaacuuuggucgggcgugguggcucacaccuguaaucucagcacuuugggaggccgaggugggcagaucaccugaggucaggaguucaagaccagccuggccaacauggcgaaaccccgucucuacuaaaaauaaaaauuaggugggugugguggcacgugccuguaaucccagcuacucagaaggcugaggcaggagaaucgcuugaaccugggaagcagagguugcagugagccaagaucgccccauugcacucuagccugggcaacaagagugaaacuccgucucaaagaaaaaaaaaauuacuuuaauggcuacgcgggaggaauuguuccccauauguuucagaaauaauuaaagagaaaaggauagauuauuacaguaugaacucuguuuuaagacauauaucauguuuaacuuuucgaauaauuauuccuguuaaccauuuucuguuggaucucauuucuuaacagccuggguuacuaggugucuuucagaagcugauugcauccaaagcaaaugaccaccaagguuuuuaucuucuaaacaguauaauagagcacaugccuccgugaguaugacuagaacuuugugcauuuauuuagaaauuuuguuaggugcucagaaaaguccuaaauuuauauuguugauuuuuuuuaauucuuuagugaaucaguugaccaauauaggaaacaaaucuucauucugcuauuccagagacuucagaauuccaaaacaaccaaguuuaucaagaguaaguaaaaucaucuggauguucuacagaaguaaugaaagaagguagcuaaaacccuuagacuuuaugguugcagauacauuuuuuauccguuuuaaacuuuaugcaaaaaauacuuggccacguguggagguucaugccuguaaucgcagcacuuuggguggccaagggaggccgaucgcuugagcucaggaguucaagaccagccugggcaacauggcgaaacccugucccuacgaaaaguacaacaaaauuagccaggcaugguggcaugugccuguagucgcagcugcuugggaggcugaaguaggagcaucaccuaagucccagagguugaggcugcagugagccaagauuacacccacugcacuccauccuaggugacagagugagacccugucucaaaaaaaaaaaagaaaauauuguaagggccuggugcaguggcucucaucuguaaucccagcacuuugggaggugaaagugggaguauuccuugaguccaggaguuaacgaccagccugggcaacaugguaagacccugucucuacaaaacagccaagcaugguggugugugccuguagccccagcuacucaggaggcugaggugggaggaucacuugacccugggaaguuaaggcugcgugagcugugaucacgcuccugcacccagccuaggugauagagugaaaccuucucacaagaaaaaagaaaauauuuuaagauguuuguguucuccaaacauuaaguuaguguuagucauauuguguuccagagguugguuuaugguuggauaccaaaacauuuuuucaguagagagaauauuauaaggaaauauaaaucaaagagagacagcauguaaaggucuaugacagaaagacaaguuuucuauuuacuagaaggcagguauugaugccacagccuuuggauguuaaugauuaagcauagguuuauuuugcagacuuaucaguuaccaguuuagugcgugaguucucuaugcugauauucugcaucuucuuucaacagguuuuuuagucuuuauuaauuuguauugcauaaaauauggggcacuagcacuacaagaaauauuugaugguauacaaccaaaguaaguuuguuuuuauuauuuuuuaaaggaagaaaauguuuugacuuuuuuuuuaguacaaaucaguaucucugucuuauagaugaugaugugguucuugguauggagauagugucuaugguuuucaaaauauucuuagguauugggaguaaagaaaaaguaauccuggcccagcaugguggcucacgcccguaaucccacacucugagaggcugaggagggcggauuuagcucaggaguuugagaccagccugggcaauauagugagacuccaucucaaaaaaagaaaaaacacccuggaaucauuguucuaauccucuagauuagaggaccaucuacucuacacacuggcauucuccacagccaguguucuauauuauguuaaauggucaguguugucuccaggagccugccuuauuaaaacuaacagcagaaaacaccacauguucucacucauaggugggaauugaacaaugagaacacuuggacacagggcggggaacaucacacucuggggccugucgugggauggggggcaggggaagggagggcagagggagggauagcauuagcagaaauaccuaauguaaaugacgaguuaaugggugcaguaaaccaacuuggcacauguauacauauguaacaaaccugcacguugugcacauguacccuagaacuuaaaguauaauuaaaaaaaaaaaccagaauuuuccuucccccuuuuuuaaaaaaucgugcuaauccauaucguuccaauuuuaguauaugugcugcuaaugcaaacacagcagaauuuuucaaaugagaaauacuuaggaccaauaaauuaacuuuguuuuugacuuaucugguauauaugcaaagaauguauuuagguggcauuucccauuaguagggaauaaaacaauuauaacgauaagauaaagaacaacucuuagggaaaauuucuucggggacaguuagaucccuguaccucaguuaugucucaaaaauucuacauugacuaaaaaaugaauuacucuggaaaggagaccagaaaacauggcuuccggcaguaggggauuuugaggaaaucucaugcacugcuagugggagccugaauuagccugaucuuucuagagagcaaaauguaugcacuuuuuauccagagcauuagaauugccauacccuuugagccauauuuccacuucaaagaauugguucuauuaacgcauaaacugaggauuuugcaucauuuagaauuacggaaaacuucacuucuagcauguuugcaacaacauagaaugauuggccgaauuauuuuaaauagccauuagcauuuauguaccugcagguauguaagcaaagacaguugggaagcuuauaacccaaaaauguuaaaacuaguuguuucuggguggugggaugauuccuuuuuucccuccuugcuccucucucuuuuuuuuuuuuuuuucuuuuuuuuuuuugagacuggccagguguaauuuuuaaagaaaaaagcagagagggccaggaaugguggcucacgccuguaauccuagcacuuugggaggcugaggcagguggaucaccugaggucaggaguucgagaucagccuggccaacacaaugaaaccccaucucuacuaaaaauacaaaaauuugccgggcgugguggugggcaccuguaaucccaccuacucagggggcugaggcaggcaaauugcuugaacccaggagguggagguuguagugagcugagaucacaccguuccacuccagccugggcaacaagagcgaaacuccgucucaaaaaaaaaaagaaaagaaaaagauuauggcauuuggcuacaggguagaggugugaugggguuuuuuuauguuuugacuuucagucucuucagaugaucaaaaacagcagucuuguuauuuaguaauuuaucauauucauaagaaguaacuaacaucuaagcauuuuacuauuucauuauagugauaaucuaauauuaaguugauuuauuuugcuuuaauagaauguuuggaaugguuuuggaaaaaauuauuauuccugaaauucagaagguaucuggaaauguagagaaaaagaucugugcgguuggcauaaccaaauuacuaacagaaugucccccaaugauggacacugaguauaccaaacugugguaaguacuucauuuuaauauuuuuguaaguuacagcuuccuucccauaugacugcaaaauuaacaaagcuuauucucuugggggccaagagaaucuuggucugaucucagcuucuccacaaucagauccaagacaugauuucuggauccuucugggcuuagaaugaucuuguuuccugcuucuuuuucagggggauucauggaccccuuuaagagucugaucuaggugaucucuaagacaauuuuaugacagaagcccaacuaaacugacuuaucuuuaaggggaagaacugaauaagccaagaaaagaaccaucuuaauuucaaagguccccuuuuauucuugagacuaugagucuguaauuuugugucucugagcaauugcugguuuuaagucuuccgaguauuuucuugaccuuuuuaucucuugcuuucuuccaauccaggacuccauuauuacagucuuugauuggucuuuuugaguuacccgaagaugauaccauuccugaugaggaacauuuuauugacauagaagauacaccaggauaucagacugccuucucacaguuggcauuugcugggaaaaaagagcaugauccuguaggucaaauggugaauaaccccaaaauucaccuggcacagucacuucacaaguugucuaccgccuguccaggaaggguaaguguguugucaaagaacucugugauaaauggagacuuuaaugggagggcaaaaggauaguaguaguucuggugucuguuuucauuggugggcguaauaaaacuaaaucucauugaguuacagcaagcuuauuuucuuuaauuaaaaacacugagcccuuuuuuucuuguauuauguacuacaaauauauuuuaagugaauggauuuaggagugagaacaaaggaggaaaaaucccuucaauagaaauguaauaaggcuguauaguugcauuuugucagcacuuuauaauaagaguuuauuucccagaucgaaguaauccaucuauuauuaaaaugugguagcauuuuuuuauuuuuauuuuuauuuauuuauuuuuuuagacagggucucacucuuauccaggcuggaaugcaguaguacgauuauggcucacugcagccucaaccucccagguucaagugauccuacugccugucagccuuccaaguagcuaggacccacuaugcccagcuaauuuuuuauuuuuuuguggagacagggucucccuauguuguucagguuggucucaaccuccugggcucaagccauccuccucccucagccucccaaagugcugggauuacaagugugagccuggacacaguuauuuuuuuuuaauugcagcauacucagaaauuaauagaucauggcauaaaccuaauaaugacuguauaguugcauuuugucagcacuuauuauagaguucuuacauguuaccugauaaaauauauauuuuucaagccagacacagugguuuaugccuguaguucuagugcuuugggaggccagggcugcagugagcuauuacagugccacugcaauccagccugggcaacagagcgaggucccguuucuuaaaaaacauauauguguguggcguguguauauauauguauauauauuuuuucauuguauuauuacggagacuuucaaacauauauagaaagagcauaaugaagccugcaugugcccagcuucaauaauuaccaauaucuugccaguuuuguuucguuucuccuuuuauucucuguauugagcaagucuuagacaucauacguuucacgcguaaguaccuuauucuacaucauuaaccaguaaggacuuuuuaauuaaccacaauaccacuaucacaccuaauaauaguaauuccuuauggaucuuuucuuuagaccuauuuuugaaggcauaaaagcaguugaguuucuggagaauuuuuggauggugauuaaugacuugacuggcugcucuucccagagcuguggcagcucucccguagaagaugggguuuguauuggcgcaccaagaucuccaacagccaguguguguuucccaucucuuguagguuccaucaauggugagcaccagccugaaugcagaagcgcuccaguaucuccaaggguaccuucaggcagccagugugacacugcuuuaaacugcauuuuucuaaugggcuaaacccagaugguuuccuaggaaaucacaggcuucugagcacagcugcauuaaaacaaaggaaguucuccuuuugaacuugucacgaauuccaucuuguaaaggauauuaaauguugcuuuaaccugaaccuugagcaaauuaguugguuugugugaucauacaguuauguggguggcuucuaguuugcaacuucaagggacaaguauuaauaguucaguguauggcguugguuuguguugagcguuugcacgguuuggauaaucuuaaauuuugacggacacuguggagacuuucuguuacuaaauccuuuuguuuugaagcuguugcuauuuguauuucucuuguccuuuauauuuuuugucuguuuauuuacgcuuuuauuggaaaugugaauaaguaaagaauuacuuguguuacuugccaagcagugcacauuucauaguuucaaaucuguaaucagcaauaaaaauccuaaaauauguaccuaa

SEQ ID NO: 191277 - RNA, 50649 nt, Homo sapiens
uuagguacauauuuuaggauuuuuauugcugauuacagauuugaaacuaugaaaugugcacugcuuggcaaguaacacaaguaauucuuuacuuauucacauuuccaauaaaagcguaaauaaacagacaaaaaauauaaaggacaagagaaauacaaauagcaacagcuucaaaacaaaaggauuuaguaacagaaagucuccacaguguccgucaaaauuuaagauuauccaaaccgugcaaacgcucaacacaaaccaacgccauacacugaacuauuaauacuugucccuugaaguugcaaacuagaagccacccacauaacuguaugaucacacaaaccaacuaauuugcucaagguucagguuaaagcaacauuuaauauccuuuacaagauggaauucgugacaaguucaaaaggagaacuuccuuuguuuuaaugcagcugugcucagaagccugugauuuccuaggaaaccaucuggguuuagcccauuagaaaaaugcaguuuaaagcagugucacacuggcugccugaagguacccuuggagauacuggagcgcuucugcauucaggcuggugcucaccauugauggaaccuacaagagaugggaaacacacacuggcuguuggagaucuuggugcgccaauacaaaccccaucuucuacgggagagcugccacagcucugggaagagcagccagucaagucauuaaucaccauccaaaaauucuccagaaacucaacugcuuuuaugccuucaaaaauaggucuaaagaaaagauccauaaggaauuacuauuauuaggugugauagugguauugugguuaauuaaaaaguccuuacugguuaaugauguagaauaagguacuuacgcgugaaacguaugaugucuaagacuugcucaauacagagaauaaaaggagaaacgaaacaaaacuggcaagauauugguaauuauugaagcugggcacaugcaggcuucauuaugcucuuucuauauauguuugaaagucuccguaauaauacaaugaaaaaauauauauacauauauauacacacgccacacacauauauguuuuuuaagaaacgggaccucgcucuguugcccaggcuggauugcaguggcacuguaauagcucacugcagcccuggccucccaaagcacuagaacuacaggcauaaaccacugugucuggcuugaaaaauauauauuuuaucagguaacauguaagaacucuauaauaagugcugacaaaaugcaacuauacagucauuauuagguuuaugccaugaucuauuaauuucugaguaugcugcaauuaaaaaaaaauaacuguguccaggcucacacuuguaaucccagcacuuugggaggcugagggaggaggauggcuugagcccaggagguugagaccaaccugaacaacauagggagacccugucuccacaaaaaaauaaaaaauuagcugggcauaguggguccuagcuacuuggaaggcugacaggcaguaggaucacuugaaccugggagguugaggcugcagugagccauaaucguacuacugcauuccagccuggauaagagugagacccugucuaaaaaaauaaauaaauaaaaauaaaaauaaaaaaaugcuaccacauuuuaauaauagauggauuacuucgaucugggaaauaaacucuuauuauaaagugcugacaaaaugcaacuauacagccuuauuacauuucuauugaagggauuuuuccuccuuuguucucacuccuaaauccauucacuuaaaauauauuuguaguacauaauacaagaaaaaaagggcucaguguuuuuaauuaaagaaaauaagcuugcuguaacucaaugagauuuaguuuuauuacgcccaccaaugaaaacagacaccagaacuacuacuauccuuuugcccucccauuaaagucuccauuuaucacagaguucuuugacaacacacuuacccuuccuggacaggcgguagacaacuugugaagugacugugccaggugaauuuugggguuauucaccauuugaccuacaggaucaugcucuuuuuucccagcaaaugccaacugugagaaggcagucugauauccugguguaucuucuaugucaauaaaauguuccucaucaggaaugguaucaucuucggguaacucaaaaagaccaaucaaagacuguaauaauggaguccuggauuggaagaaagcaagagauaaaaaggucaagaaaauacucggaagacuuaaaaccagcaauugcucagagacacaaaauuacagacucauagucucaagaauaaaaggggaccuuugaaauuaagaugguucuuuucuuggcuuauucaguucuuccccuuaaagauaagucaguuuaguugggcuucugucauaaaauugucuuagagaucaccuagaucagacucuuaaagggguccaugaaucccccugaaaaagaagcaggaaacaagaucauucuaagcccagaaggauccagaaaucaugucuuggaucugauuguggagaagcugagaucagaccaagauucucuuggcccccaagagaauaagcuuuguuaauuuugcagucauaugggaaggaagcuguaacuuacaaaaauauuaaaaugaaguacuuaccacaguuugguauacucaguguccaucauugggggacauucuguuaguaauuugguuaugccaaccgcacagaucuuuuucucuacauuuccagauaccuucugaauuucaggaauaauaauuuuuuccaaaaccauuccaaacauucuauuaaagcaaaauaaaucaacuuaauauuagauuaucacuauaaugaaauaguaaaaugcuuagauguuaguuacuucuuaugaauaugauaaauuacuaaauaacaagacugcuguuuuugaucaucugaagagacugaaagucaaaacauaaaaaaaccccaucacaccucuacccuguagccaaaugccauaaucuuuuucuuuucuuuuuuuuuuugagacggaguuucgcucuuguugcccaggcuggaguggaacggugugaucucagcucacuacaaccuccaccuccuggguucaagcaauuugccugccucagcccccugaguaggugggauuacaggugcccaccaccacgcccggcaaauuuuuguauuuuuaguagagaugggguuucauuguguuggccaggcugaucucgaacuccugaccucaggugauccaccugccucagccucccaaagugcuaggauuacaggcgugagccaccauuccuggcccucucugcuuuuuucuuuaaaaauuacaccuggccagucucaaaaaaaaaaaagaaaaaaaaaaaaaaaagagagaggagcaaggagggaaaaaaggaaucaucccaccacccagaaacaacuaguuuuaacauuuuuggguuauaagcuucccaacugucuuugcuuacauaccugcagguacauaaaugcuaauggcuauuuaaaauaauucggccaaucauucuauguuguugcaaacaugcuagaagugaaguuuuccguaauucuaaaugaugcaaaauccucaguuuaugcguuaauagaaccaauucuuugaaguggaaauauggcucaaaggguauggcaauucuaaugcucuggauaaaaagugcauacauuuugcucucuagaaagaucaggcuaauucaggcucccacuagcagugcaugagauuuccucaaaauccccuacugccggaagccauguuuucuggucuccuuuccagaguaauucauuuuuuagucaauguagaauuuuugagacauaacugagguacagggaucuaacuguccccgaagaaauuuucccuaagaguuguucuuuaucuuaucguuauaauuguuuuauucccuacuaaugggaaaugccaccuaaauacauucuuugcauauauaccagauaagucaaaaacaaaguuaauuuauugguccuaaguauuucucauuugaaaaauucugcuguguuugcauuagcagcacauauacuaaaauuggaacgauauggauuagcacgauuuuuuaaaaaagggggaaggaaaauucugguuuuuuuuuuuaauuauacuuuaaguucuaggguacaugugcacaacgugcagguuuguuacauauguauacaugugccaaguugguuuacugcacccauuaacucgucauuuacauuagguauuucugcuaaugcuaucccucccucugcccucccuuccccugccccccaucccacgacaggccccagagugugauguuccccgcccuguguccaaguguucucauuguucaauucccaccuaugagugagaacaugugguguuuucugcuguuaguuuuaauaaggcaggcuccuggagacaacacugaccauuuaacauaauauagaacacuggcuguggagaaugccaguguguagaguagaugguccucuaaucuagaggauuagaacaaugauuccaggguguuuuuucuuuuuuugagauggagucucacuauauugcccaggcuggucucaaacuccugagcuaaauccgcccuccucagccucucagagugugggauuacgggcgugagccaccaugcugggccaggauuacuuuuucuuuacucccaauaccuaagaauauuuugaaaaccauagacacuaucuccauaccaagaaccacaucaucaucuauaagacagagauacugauuuguacuaaaaaaaaagucaaaacauuuucuuccuuuaaaaaauaauaaaaacaaacuuacuuugguuguauaccaucaaauauuucuuguagugcuagugccccauauuuuaugcaauacaaauuaauaaagacuaaaaaaccuguugaaagaagaugcagaauaucagcauagagaacucacgcacuaaacugguaacugauaagucugcaaaauaaaccuaugcuuaaucauuaacauccaaaggcuguggcaucaauaccugccuucuaguaaauagaaaacuugucuuucugucauagaccuuuacaugcugucucucuuugauuuauauuuccuuauaauauucucucuacugaaaaaauguuuugguauccaaccauaaaccaaccucuggaacacaauaugacuaacacuaacuuaauguuuggagaacacaaacaucuuaaaauauuuucuuuuuucuugugagaagguuucacucuaucaccuaggcugggugcaggagcgugaucacagcucacgcagccuuaacuucccagggucaagugauccucccaccucagccuccugaguagcuggggcuacaggcacacaccaccaugcuuggcuguuuuguagagacagggucuuaccauguugcccaggcuggucguuaacuccuggacucaaggaauacucccacuuucaccucccaaagugcugggauuacagaugagagccacugcaccaggcccuuacaauauuuucuuuuuuuuuuuugagacagggucucacucugucaccuaggauggagugcaguggguguaaucuuggcucacugcagccucaaccucugggacuuaggugaugcuccuacuucagccucccaagcagcugcgacuacaggcacaugccaccaugccuggcuaauuuuguuguacuuuucguagggacaggguuucgccauguugcccaggcuggucuugaacuccugagcucaagcgaucggccucccuuggccacccaaagugcugcgauuacaggcaugaaccuccacacguggccaaguauuuuuugcauaaaguuuaaaacggauaaaaaauguaucugcaaccauaaagucuaaggguuuuagcuaccuucuuucauuacuucuguagaacauccagaugauuuuacuuacucuugauaaacuugguuguuuuggaauucugaagucucuggaauagcagaaugaagauuuguuuccuauauuggucaacugauucacuaaagaauuaaaaaaaaucaacaauauaaauuuaggacuuuucugagcaccuaacaaaauuucuaaauaaaugcacaaaguucuagucauacucacggaggcaugugcucuauuauacuguuuagaagauaaaaaccuugguggucauuugcuuuggaugcaaucagcuucugaaagacaccuaguaacccaggcuguuaagaaaugagauccaacagaaaaugguuaacaggaauaauuauucgaaaaguuaaacaugauauaugucuuaaaacagaguucauacuguaauaaucuauccuuuucucuuuaauuauuucugaaacauauggggaacaauuccucccgcguagccauuaaaguaauuuuuuuuuucuuugagacggaguuucacucuuguugcccaggcuagagugcaauggggcgaucuuggcucacugcaaccucugcuucccagguucaagcgauucuccugccucagccuucugaguagcugggauuacaggcacgugccaccacacccaccuaauuuuuauuuuuaguagagacgggguuucgccauguuggccaggcuggucuugaacuccugaccucaggugaucugcccaccucggccucccaaagugcugagauuacaggugugagccaccacgcccgaccaaaguuaaguucuuaaaaucaaccuguuuggcucuguuuuuaaaauuuuccaucauggauauaaauaacuaaaggauacagaauucugauaaaacauaccauaacauuuucuacuaauuauuuccguuauuauuauuauuauuuuuuuuaagagacagggucuagcucuguugcccaggauggagugcaauggugagaucauggcucacugcagccuuaaacuccugggcucaagcgacccucucaccuuagccucccaaguagaugggaccacaggcaugcuccacuguguccaacuaauuaaaaagcuuuuuuuuccuuuguagagauagaucucaccacguugccuaggcuggucuuaaacuccucggcucaagggauccucccacuagaggcucccaaaguggugggcuugagccacugcccccagccuuaaauuuauuuuaaauaaaaaaauuucaaacaucugccauccccaguuucuccaagcuacuuuauaaaauuacaguuauaucaaaaccugacgcacaauuuugucagcugcagcacuugcuauuguguuugaaccgcguucuaagaaugcuugaagaagccucacuagagcaggaauauuuccuguucuuucccaaagcacuggcugaaggagaugaggaaauaaggccauauaggaagacgggaugucauuuuuguguguuuccagaagcaaagacaucacuugaaagacguauggaauaaauucuguugauaaaaguaaaaacagagcugugagcuucagaaggaaugacugacacaaaaggcccacaucgcuuaggugggcugcauuuuauagccauguuaauuuuauuccauuacaaagaaaauaauuuccguuaacuuaccuugcacaucauuuuguaagauuucaguaaacaccaaaaacaaagccuccucaaaauuuacaacagcagcaggguuagcuuugcaaguuauucuuauggauaaacauauugcuucaaacauguagugauuaaagugagguuugcuuggguucugaaauuaaaaaaaaaaaaccuaauuaugcuaauaauccacaccuaaccuuuauaaaacacauuuaaaauagaggccaucuuauuuuuuaaaaaucaaaauuaagaaaaaaacaccaauuauacccuagugcuuguucauuugaauuuuuuuuuaaauggcccaaaguccaccaugaaaaaaauacuucagaguuacagaguugcuuauacaaaccucagaucccagagcuguaacuugucuuaagcccacgugcccucgcagagaagaaauacuaaguccuaguaaugccacuagccuuaacuucugugggccucaaugucuaugucuacuuacugauaaucccccaaaugaguaguuuuuuauguucuuuuuaagcaacaaaaccccauuuuucuuuaaacaaguucuuggaaggcuacuagcauacaaaucuaacucaaucagaacaugagaugguaauacauaugggaggcggagacuuggguucccuccccgcuccaucccucaaggcccuaaguaguccaaagacccuuagcccuaacucaguugaauaauaaucacucuguucuccaaaaucccuccaacacuuccuaugaauugaucuaauucucauaagaucaagaauagcaucuaaaaaggaauucugucagccuuaaacggauuuauuuucuaaaauuuaguguuaauaaacaugaaucuaaguaucuguaaaauuuugaucagagugaacuuuccuuuugagaaauaagaguaaggaagaaaagacaacacaaaggauuuuaaucaucauuucauagaaguccagacagccucuuuuauauccauuuagugcaaagccuacuuaacuccauuuaagguaauuuuggaucaucugcacuuucuuuuucuacaauaaacauguuacuuuuguaaugagaaugaaaauguauucaagcuucuagcacacacuuaaaggugacugcuauuacgucuccaaucuaacagcaugcccacacuuucagaaaaguccauuaguggcuggucaggaagaauucacagaccuucucuaaagcuucacguaaugccaaagaguucugaggcccaaacaguuuggagcaaauaaaaaaggaaccccacuuucaaaauuggcucuauuaccuuacuaacagcuaauagcuucuguguaagcugagugaugagaguagggauguaggggauuauggcuucuuguaggagagaaaaacuucucaugauagcuguaaaauacaaaaacagcaaaaacaaauagaguuuaguuaaacuucagaauaagagagcgacuggggggaaaaaagcgcacuaauucaucaacuaaauuuuaagaugcuuagacaaccccgagauagcucucuacauuuaaaaauaaucuaaauuucccuuccuuuuaaaauuaggacggguuggcaacaaaauuuagcugggaaauacugaguauuucuagaaggcucaagguuuaaaaaauaauuaaagagguugacuaagaggaagaaacagugagcugacaugaauggagcaggugagucugagagagaacuguuuggggucucuuucucuuagaaaucaguagcagaggccaugcuugguggcucacaccuguaaccccagcacuuugggaggccgaggcuggcggaucacuugaggcuagagucugagaccaaccuggcuaacauggcaaaacccaucuccauuaaaaauagcaaaauuagccagguauguggugcacgucuguagucccagcuacucgggaggcugaggcuugagaaucgcuugaaccugggaaguggagguugcagugagccaagaucaugccacugcacuccagccugggagacagagcgagacucccucucucucucaaaaaaaaaaaaaaaaaagaaaaagaaaaagaaaccagcaucagaaaauguuuagcccuagccuaaaggaaacaugaucacaaacuacaggaaacugaagagaaaacugccuauccaccucccucaaaaaaagagauuaggagccuaaaaaaauucuaaaaauacauguaaagccacagaguccaaauugcaaaaauauugcucaaaagaccauaaauggguuaaaaauaggaagcaugggagaaaaauaaauuugucagcuaaaaauguauaaaagcucucuuuccacaaauaacauuucuaaaauaaauguuuacuaagcagagccccaaauacaugccaagcauaaaggacagaaagcuaucugcucuugccuccugaacucugcacaucauguuuccuccucuacuggagucaaagacucauccacccuucaacagauugcuaccuaucccucacaccuaacguucgguuaggucauaucucagcuuagagaucacuuccuagagaaaauccuucccugaccuggguuaaaagggcuagaggauaaauuggugcuccuccacuaggcuggcgcagaauuauuucauucacucauacaaccguacagagaagguauuacauacuguguauucuuacauacccuaaaaacacaguaaugaagauuacagacuaguuagccgcucucauagaaauggacauuaaggcugggcgcaguggcucacaccuguaaucccagcacuuugggaggcugaggcggguggaucaccugaggucgggaguucaagaccagccugaccaacaugcagaaacccugucucuacuaaaaauacaaaauuagcugggcaugguagcacacgccuguaauccuagcuacucgggaggcugaggcaggcgaaucgcuugaacccaggagagugaggcugcagugagcugagauugugccauugcacuccagccugggcaacaagagugaaacuccaucucaaaaaaaaaaaaaaaaaaaaaaaggacauuaaacaacaauaauuacacaauuauacaucauuguugggggaaggauaguguuggaaacauacacccagauacacacauccacucuaggauuucugauccagacugaaaagaucagggaguuucucugaaaagugcuuccuacaacccaaugugcuaggcuuuugggaugcaacagugaaaaacacugagacuaucucuaaauucagagcuggcaccaggacacucaacuaauguagugccugguggauggauacaccagccuguggauggauacagcugccuguguccuuggcaguacguaagaagacacgauuugugcagagucuaccacaggcacccacauuucaccccuaccuaggugagcaugcaguuaauaaacguugcaugaucucuucuuugccuuaaagaaacucaaucuagggaaggaaaaaagggcuuugcuacauuuucuguaaugagaaguuccauaucaaauuaagauuacuguuggccaggugcaguggccucuaaucccagcacuuugggaggcugaggcgggcagauauuugaggucaggaguuugagaccagccuggccaauauggcaaaacccugucucuacuaaaaauacaaaaauuaaccgggcaugguggagugcaccuguaaucccaguuacucgggaggcugaggcaggagaaucgcuugaacccaggagggagagguggcagugagcugagaucaagccacugcacuucagccugggcaacagagcaaggcuccaucucaaaaaaaaaaaaaaaaaaaaaaaaaaauuauuguuaguaguaaacaagauaauguuuuucauuuugaaauaucuaaacuaacuuacuacuugguaaacauuaucugguucauagacuguauaaccugaaguauaacucagagugcucacccuuacaaucugagauuggauaccuguagucugcacaccagggaaacagccuaccuuucauaauauauucauuuucugaagagccaggaagugugagagcuuugaaaagguuuguuagcagaaucucaacaaacggugcgauuucugcagcuguaaagcuauagaugaaaaaacagcuuucagucacuaccaacucuugagcuugucacugcagauuacccuuggcaaccacuaugucacccuucucagcauaaaacugagccaucucccaccacugacaauugauagacaguuuaggaaaauaauuuuuuuacaugugcucauguuaggcuccuaagaaggcacaucgagaaccaaacacaacugaaccaaaaagccagcuaaacccaacaacaucugaaguugaaacaguugucccugguuuauaucuauuaccacugagaaagaacucagaaucucaggggacucugucauuuauuuuguuuuuggagguggagccaagauucagaacuguuuucugcauaaauucugggccugaagauagguacuggcuugacucaccucaaaggauguccuuucuacccuuaauuggccacugagaguaucuguacuucaaguucuugaugaaggaaagaaccuagaacuguuuuccaucucuuacccaaagcucauuucaagaaauaauacuguugaauaguggccugaaagacaugcagaccauccauuccucuacauuucauccugguucaggccagaagaccuauuuucuugguccccagugaauuacuuucauucgguuaggucauaucucagaaauaagugaccuuacgcaaauagccacaugaaaauaacuguuacaugauuguugcugagaacacuacuacuacuauuguacaguauucucugcuuuaacuuuuaucucauagacccugugaaaauuuuaacuucccaaguuucccucuuugcccuggcugcuaagagacuccaaauaaaauuuggaguuucuuggacuacuauauaggauccuuugacacacauuucuguuuauuaacuuuaucucaguuacuuuccuuggcuccaguuuauuaaauuguauugucauaaugcaccuauuuuaguaagcagccucaaaugcuuuuagaaugaaacagaguauaaaggaauagaaagcagacauuuguuuucccacuagugaaauuaugaaaacauucagauaucuuugaccagcacaguacagccccuaccccaggcuaaaaaacuuuagaauaaaauacucacagaguggcauuguuaggcccucgcauaguaaagagccguucaagagcaugagcugcguaaguaugaacaacaauacuuucagcuugaagaugauuaaucaagagaggaaucgagacuaaaagauguucuuuuggcaccuaaaaaacacaauaauauacaugcucuaaaugcaaugauuccauauuugaguaaaagacaauuggaagagaaggaccuguugauuuaaagaacaauuugcuauuuuuaagcucuguuauaauaggagaugcugcugcccagaaaccaaaacuuucacuugcacauaaugguucaauuuccacuuucuaaauucuccuuuucagagcacaaaacuaugaggauaacaucuugcagauaaaucaacauaccauaaaauaauaauaucacagagaaggagacuaagauuucaccaaacuuaagaaucaucacuagcagauauuucuugaaaaaguuauuuaaccuuuuugugucucauuuuuuguucucuucccacccccaaaaagcaacaaauacgagaacaaucuucauuaaaaaccucuaaauuugaaacauucauuagucuaaacuagaaaagccuccuggguguggugguucauuccugucuauaaucccaauacuucaggaagccaagguagaacaauugcuuaagcccaggagcucaagaccagccugggcaacauagugagaccucaucucuauuaagaaaaaauuaaauaaaaaauuagcugggcaugguagugaauuccuguagucccagcaacuugagaggcugagguagcuggaucgcuuuaggcacuaaaugaauaacucaaaaaugauguuaggccgggcgcaguggcggcucacgccuguaaucccagcacuuugggaggccgagguggguagaucacgaggucaugagaucaagaccauccuggcuaacauggugaaaccucuacuaaaaauacaaaaaauuagccagacgugguggcaugcgccuguagucccagcuacucgggaggcugaggcagaagaauggcuucaacccaggaggcggagguugcagugagcugagacugcaccacugcacuccagcgugggcaacagagcaagacuccaucucagaaaaaaaaaagaaaaaagaaaaaaaaaaagauguuaaggacaaacagucaugauguagguggguacgguggagcaugcccguaaucccaucaacuagggaggcuaaggcaggaggaucgcuugaguccagaauuuccuggcugaaguaagcuaugaucgcaccacugcacuccagccugggcaacagagcaagaccucauucucaaaauaaaacagaaaaggccaggcacgguggcucaugccuguaaucccagcacuuugggaggccaaggcgggcggaucacaacgucaggagaucgagaccauccuggcuaacacagugaaaccccgucucuacuaaaaaauacaaaaaaaauuagccgggcaugguggcgguagccuguagucccagcuaucgcgaggcugaggcaggagaauggcaugaacccaggaggugaagcuugcagugagccaagaucgugccacugcaugacuugauuguguuacugcacugagcgacagagcgaagacuccgucucaaaacaaacaaguaacaaaaaacagaaaaaugaaacccauaguaugaugucauuuauacaaacaaaaauuuaaaaccuaggccaggcguggugaaucacgacuguaaucccagcacuuugggaggccaaggcggguggaucaccugaggucaggaguucaagaccagccuggccaagauggcaaaacccugucucuaccaaaaaauugcugggcgugguggugggcaccugcagucccagcuacuugggaggcugaggcaggagaauggcuugaaccuggguaacagagcaagacuccaucuaaaaaaaaauuaaaaccuacagcauacuaaauaauuucugcagaaacauaaacacauagugaaaguauaaaaaaagcauggcuugaaccugggcaacagagcaagacuccaucuaaaaaaaaaaaauuaaaaccuacauaauacuaaauaauuuuugcagaaacauaaaugcguagugaaagcguaagaaaagcacuuccaugggugucaaauacaccgaauucacuacaguaauuaccuauagagagaaagggacugacugggcagggagcaccuggaauaccuccauuguauauguauguauacauaaauauggccuggaguuuuaagauuugugaggauuauuucaguaaucaucauauuguuuuauuccugcuuguguguuuaaaauauuuugcaagauggcaccauuguuacugggcaaagacaucaaagaaauaagaugagugcaaguuuugauuuuuuucucaguacaauuaaagugaccuaggcauucagaaucagaagaaaaacuacacguucucuaaaaauuaagaccaauaaucagauagaaaaaugggcaaaagaagaugaauucacaguucaccgaaaagaaaugaaaauggacccuucaaguggaaagaugcuuaacugaacucaaaauaaaacaaacguaaauuaaaacugcaaugagauaccauuuaagauuggcaaaauuccaacauacucuaacuggggaagcagguauucucuauaauuuuucucaauugauuuuuuaaaaguaaugcaauauggcugggugugguggcacgugccuggguuccagcuacucgggaggcugaaagugggaggacugcuugagcccaggaguucaaggcugcagugagcuguggucaugucacugcacuccagccugggcgacagaacgagacccuguuucaaaaaauaaagaaaugggccgggcgugguagcucacgccuauaaucccagcacuuucggagaccgaggcagggguggaucaccugaggucaggaguuugagaccagucuggccaacauggugaaacccugucucuucuaacaagacaaaaauuagcuggguaugguggcaggcacguguaaucccagcuacucaggaggcugaggcaagagaaucacuugaaccugggagguggaggcugcagugagccgagaucacaccacuguacuccagccugggcaacagagcaaaacuaccucucaaaaaaaaaaaagaaggagaaagaaagaaacaauaaacuaaguaaaaaguauaaaaaauuagccaggugguguggcacacaccuauagucuuggcuacucagggaggcuuaggcaaaagggucacuugagccuacaaguuuaaggcugcauugagcuaugauuguaguaguucacucuagacuggccaacagacuguaagacuuugucucaaaaauaaaugaauaaggccgggcgcgguggcucaugccuguaauccuagcauuuugggaggccgaggcaggcggaucgccugagguaggggguucgagaccagccugaccaacauggagaaaccccgucucuacuaaaaauacaaaauuagccaggcguggugguggaugcuuguaaucccagcuacucaggaggcugaggcaagaaaaucgcuugaacucgggagacgcauguugcggugagccgagaucguuccauugccugggcaacgagagcgaaacuccgucuccaaaaaaaagaauaaaguauaucucaauuuuuaaaaugcuauuuaaaaaauguugacaauguaacguucuccuucaucugaauccacugaucugucuuaacaucauuaaaaauugauaaccagggccaggcauggugccugacgccuguagucccagcuacuugggacgcugaggcaggagaauggcgugaacccaggaggcugagcuugcagugagcaaaaaaaaaaaaacaaaaaaaauaaaaaaaaacaaaacaaccagauauuguguauauccugauaaaaugaaacagaaaguauaccuaugaugcuuucuugugucacccccgaccaaggaaucuaagucuaaucaagcccccagauuuaccaauauagaaauauggggacuagagggacaacauaaacuucaggagacccuugaacaacacggguuugagucuugcucuguuguccaggcuggagugcaauggcaugaucuuggcucacugcaaccuucgccuccuggguucaagugauucucaugucucagccucccgaguagaugggauuauaggcaugugccaccacacccagcuaguauuuuuaguagagaugggguuucgucauguuggccaagguggucuugaacuccugaccucaaaugaucugccugccucagccucucaaaguguugggauuacaggcacaagccaccaugccuggcuggauuuguuuuagaccaaaugcaaauagaaaacacaguauuccugggauguaaaaucuguauguggaaggcuggcuuuucauauaugaggauuccgcaggcccaaaugugggaccuaaguauucaucaauuuugggauauucaggcguccuggaaccaauaccccuugaauacugagagauucaaggugcaaucagccaaaaguaaaaugugagaaagucucuaagauaaaugaguguuuucuccaacaacaagcauaagaaaggguagaggccaggugcaguggcucacagcuguaaucccagcacuuugggaggccaaggcugguggaucaccugaggucaggaguuugagaccagcuuggccaacauggggaaaccccaucacuacuaaaaauacaaaaaaucagccaggcgugguggcagaugccuguaaucccagcuacuagggaggccgaggcaggagaaucacuugaacccggaaggcagagguuacagugaucugagaucaggccacugcauuccagccugggugacagagugagauccgucucaaaaaaauaaaaaaaaauuuuuuuuaaauaaauaaauaaaaggaaaggaaggcaguugggugcaguggcucacaccuguagucccagcacuuugggaggccgaggugaacagaucaccugaggucaggaguuugagaccagccuggucaacauggggaaaccccggaucuacugaaaauacaaaaaauuagcuaggugugguggcaggugccuguaauccuagcuauuugggaggcugagacaggagaaucacgugaacccaggagguagagguugcagugagccaagauggugccacugcacuccagcuugggugacagaaugagacuccaucucaaacaaaaaguggcagagaaggaccucucuauuguaaauuaagagacuuaagacacaaucaacuguaagcaauguguggacauuaucuagaucccaauucuauuacuauuauugcaaaaagacaucugaggaaaauuaagcauggucuaaaauucuaaguuauaaagaaaucauuguuaauuuuguuagauguggauauaaaaugacugcacaguagaugagaaggugguacauaauaaaacucuuaaagagauuaaguggcguguaacaaauaaaaagcuacuuacuugauuucuaaaaaucauaauauauuugauaccgucagcuuuaaggacaggaaauucauucacuauauaaaaaaacagaaagccacaguuacuuaagugguaaggaucauuacuuccaaauuagugacaucaucagaguuauaaaaaaagauaaaaugucaaguaauuaaagcacaguuaauuauauuaugauuuacuauuuagucauuaauuuugguaggauuauaaaugauuuuauuuuuccccaugccuguuucaugacuaaggaacacauauuacauaauugaguaaaaaugagcuggaccaugcaucggugagcaugucuaccuacauucccagaagugaagcuauucugaauuagaaacaugucucucuagcuggaauuugcuuuacauuauucuaguggguagggaaauaaauuaaugaaaggaauagaucaccaaauguuaauaauucuugaagcuaaaugauggucacaugggagcucauuacaauauucucuucaccuuuggguguacauaaauuuccuacauuaaaauauuuuuuuuaaaaaggaauauaucuggaucuagaucaauacauucauaaacaucagaaacuauccuuaauuuuuuuuuuugagacagagucucgcucuguaucccaggcuagagugcaguggcacgaucucggcucacugcaaccccugccuccuggauucaagcgauucuccugccucagccucccaaauagcugggauuacaggcacacgccaccacgcccggcuaguuuuuguauucuuaguagagacgggguuucaccauuuugaccaggcuggucucaaucucuugaccucacgauccucccgccucagucucccaaagugcugggauuacaggugugagccaccgcacccggccaaaagauauccuuaauauuuaucaauuuucuaguacuuugaaauguacuccaauuuuuaagaauucgucuuucaaauaaaaaagaaaaggaagccaauguauaauccuuauuuauacacuagguagcaaagcugaguuacaguuuaguuguauuuauuccuauuuuccuccuaaucaagcaauauuuucuuuaucaauaauuaauuucacauggacaagaucuggggaaaccauuugagauuuuauucaauaaaagaaauaauaggcagggcauggaggcucacgccugcaaucccagcacuuuggcaggccgacgcagguggaucaccugaggucaggaguuugagaccagccuggccaacauggggaaaccccgucucuacuaaaaauacaaaaauuagccgggcauggugguacgugccuguagucccagcugcuugggaagcugaggcaggagaaucgcuugaacccaggaggcaggaguugcagugagcagagacugugccacugcacuccagccuggguaacagaguaagacaccaucucaaaagaaaaaaaaaaaaaaaaaaagaacaaaagggaacaaggauaggaagcuguuuuuugaauucagguauaguguggcaagcuguaaaaaaagcaagaauuucacaacucaccauuagcugauuuuaaaucagggaggaugugauucacaaagaacucaguuagguuuacaaguucauuugcuuguguaauuccaugcugaaaagcaaauucauaacauaguaaaauaacaaaauaccuguauauaucuaucacauuagaaauucaggcaauuuuagaaaaccauguuaaaauggagaugaacacuucaaaauacaaauugcuuauguauaaaaugagacuguacuggcuguguacaggagcucacggcuguaaucccagcacuuugggaggccgaggcggguagaucacuugaagucaggaguucaagacuagccuggccaacauggcaaaaccccgucucuacuaaaaacacaaaaaauuagccagguguaguugcaugcaccuguaauucuagcuacucgggaggcugaggcaugagaauugcuugaacccgggaggcagagguugcaguaaucugagauguugccauugcauuccagccuggaugacagagcaagacaacgucucaaaaaaaaaaaaaaaaaaaaaaaaaaagagagagagggacacuucaaaacaugaacugcuuaggcuaggcaugguggcucaugcuuguaaucccagcacuuugggaggccaaggcagguggaucaccugaggucaggaguucaagaacagccugaccaacauggagaaaccccaucucuacuacaaauacaaaauuagccagggugguggcgcaugccuguaaucccagcuacucgggaggcugaggcaggagaaucacuugaacccggcaaacggagguugcggugagccaagaucgugccauugcacuccagccugggcaacaagagcgaaacuccgucucaaaacaaaacaaaacaaaacaacaacaacaaaacacaaccugcuuauguauaaaauauaaaauaagacuauacugucuaggcacggugacucacaccuguaucccagcacucugggaggcugaggugugaggaucacacgaggucaggaauuugagaccauccugaccaauauggugaaaccuugucucuacuaaaaauacaaaaauuagccaggugugguagugcacacuuguaaucccaguuacuugggacgcugaggcaggagagucgcucgaacucgggagguggagguugcagugagcugagaucacgccauugcacuccagccuggugacaaagugagacuccaucucaaaaauauaaaaauguaaaauaagacuauacuaauagacaauaaagaaacuuuccucaauuaaagaacagcuaaguuuaaguuaagcauauuugauacagcgggucucagcuaagguaacaaguguggccaucuaucaauuuucuggucuauaagaaacuuaagugcucaauacaucaacauaaagccaucuucagagauuauauaaaucuuaaucagaauagguuaucuggcagaguaagcucuauuaucagagacguuauuucuuuuugacuugugugggugucacugaugucuguuuuagaaacaaaaccacauuaaaaauauuuaccuucuguguuugggcuuuugaugccaaagaugucacuagguagauggcugcaucuuuguguuuccaguugacagauggauuuuuugcguauuccugcagcauggaauuaacauaaccagagaagauuccugucacaggucccucaaaaaacuugcauaauccucguaccagaucacaagcagcccugcgucuaguaucaauaucuaugaaaugaaaagaaaauauauuauggggaaaaaaaacaaccaccaacaagcugauccaauuuauaagaaaacaaauugccuggaauaauuuggcuacgauuguaaaacggaaaaaaaagaacgaaaaacaaagggccacccaauagcuaucagcaacacaaacaaugaaaaaaacauucccgcccccaagaaauacaaaaucaaaaugaaacuaaagaggucacagaaucacagaauuuugauaaauacuauguaagaacagacaaaugauucaacuuuugauauuuucauucaggucauauaagagcuuuuuaagacaaguugaagaaagacaacaguucucaaugaaagcccgcugaaaaaacacucuuauucucaaucccacuucucccauuuacuagaaagagaaccaccuuaaaacuggcuugcuaagagacuaguaacuaaaaaaccaagauacacaccagauccuuccaaaucucuccuuauguacuccucagaauuaucuucaaaugcuucuucaucagcagcuacaaggagagaugauauuucagauaacacuccaaaagacgucacuguacuuuacagcugagaaugcagaagaguauguaaaacugccuuguucuacagcaaagaauucguucccaucagaugacuacuucauauacucuuaaucauuaucuagagcagcaaaugcuacccugaaaggugagguauuagguaauucacacaacuaugagauaggcucacuuguucuaaugugacaguuuccccagaauuggauuauaccugcaacugucaaaaauguuagggaucaguaucagaaugcuaacuuuuaauuucaccaaauaagaacauuaaaauaccaacaaccuaauuuuaaucacuauuauuucauuaaagucauuucaacaacaaauaaguagaguggacaaugucagaaauggccggcaugguggcucacgcguguaaccuagcacuuugggaggcugaaaugggaggaucgcuugagcccaggaguuugagaccagccuggucaacacagcgagaucucaucucuauuuuuaucauauaaauuaaaaaaaaaaaaaagucuacacacacacacacacacacacacacacacacacacacacacugcaguuguaugaucaugucucacugcagccuccaccuccugagcucaagcaaaacucccaccuaagcugcuugaguaccugggaccacaggcccaugccaccauacccaacuaauuuauuuauuguagagauaagguuuugccauuuuggccaggcuggucuuuaacuccugggcucaaguguuccucccaccucagccucccaaaguguugggauuaaagguaugggccaccacacccagccagaagauuuauccuuuaaacauauuuuuaugaaaacacaacaggaaauaaaaucucacgcuauauuguccuuaauuuccuuauuuuguuccagauguaauuugaaaaccacugaucuaauaacuauuuugauauaaaacaaaaucuuggccuggcaugguggcucaugccuguaaucccagcacuuugagaggcugaggcagaaggauuguuugaagcuaggaguuugagaccagccugugcaacauaggaagacccccaucuuuauaaaaaauaaaaaacuagcugagcaugguggugcacgucuguagucccagcuacucaggaggccagggugggacaaugacuugagccugggaaguugagguugcaguaagccauaacugugcuacugcacuccagccugggugacacagugagacccuguccccaaaacaaaaaacacaaucccucccaccuucauuacuuguucuucacaacuguuagaacaaggacauacauuuuauaaauauaggcucuuagcacuauaguuuaaccuuaagcacaaacuaagugggcuucaaccuuguauuuauaaaguuaucauuucuauucucaagucgauuguuuaaaaacagcuauuucugggcgagguggcucagaaaugcaaucccagcacuuugggaggcuaaagcggguggacugcuugagcucaagaguuugagacuacccugaacaacauggugaaacccugucucuaccaaaaauacaagaaauuagccaggcauggugaugugugccuguggucccagcuacucagaagacugagguaggaggaucacuugagccugggaggcuaagguugcagugagccaagauugcaucacugcacuccagccugggugacagagcgagaccccugucucaaauaaauauauaaauaaauaaagccagcuaaaaauucauugaaauaauaaaugaaacaaaaucaaauucuuucucuaaauagaaauuccagauaguuuaucuucuuaguguaaaggaauuuuugaagucuuauuuaauauuuccaugagaaaacccucacagggcacaacaaaacucauuacagauacuacauuuucugucuugguuuagaaaauaagaaauaaaugacauacaaguuuuauccaguaauaaaugaauuagacugaauauguuacaaaaaacaaacacagacuuaguagauuuauacuaauauacuuuugccauaauuaccucuaaauuccauguuaggcacaauaaccuuuucacagauacuugucagcguguucugguccucaaauagauucuuauaaugaggucucucacaaacugaagccagaaauugaauugcauuacuuaccaacuggaacaaaacacaaaaacaagaauauuuuuaaaagcaaaacucaacagcuuauuucuuggaggagauagggagagaaugucuuuuaauuauuugucuccaccaucaucuuaccaaaucauauuuaaccucuugacccguuguaacuaguaaauuccagauggcuguaacaaaacgaggcagguaucgcuggaauucuucaucguacuuuugugcauagagugcggcauuaucacaaaucugggauuuuaagagcuccaauaagccggcuuccucuucauccucacauaaaagaaaacaaaaacuccaacauacaacucuaaugcuaacauaaguaagaggaguaacugaaauuccugaacuagacucuuuaucaauuaaauccaaaucaaaucaguuauuguaaacuacagcuaugccaccaccaaucuuuucaccaagucuuucaaauaaguugcugaauuacaaaauauuuccguauuagauucaaacaguauauucuggcugaguguaguggcucacgccgguaaucccaacccucugggaggcugaggcuggaggauggccugaggccaggagugguuuuuuuuuuuuuuuuuugagacgcagucucccucuguugcccaggcuggagugcaguggcgcgaucucagcucacugcaagcuccgccuccuggguucacgucauucuccugccucagccucccaaguagcugggacuacaggcacccgccaucacgcccggcuaauuuuuguauuuuuuuuuuuuaguagagacgggguuucaccguguuagccaggauggccucggccucccaaagugcugggauuauaggcgugggccacugcgacgggccaagcccaggaguuuugagucuagccugggcaacacagcaagcccccaaaauaaaaaaaaucagcugggcaugguggugcauacccauagucccugcuacuugggaggcugaggugggaggaucacuugagcccagggaggucgaagcugcaguaagucaugaucaugccacugcacuccagccuuggugacagagugagacaagggaagacaucagaguaagaacaaaaaccaaagccaaaaccaaaacucccucacacugauuacuuaaggcauaaauaguagcacaagguagcacaugguuaacugggcaaaaagguccuuguaagaauucuauccaaaaaauuuccuugugacuuuugugugaagaaaaguuuuguuuucugaaggaguguuuuucccucccauuggacugaaauaauuauuuuaugagagcuacaucuuuuaaaguuccuauuaauauagucaaacucugagacaaaaucuguuguacaacgauaguaacaauuucuuucuguaccccacucuuaaaaccugauuugaaucaccaauucuaauuuuuaguuuauuugguauugaaauauuuuuaauauuuugucuuuugucucuucggaaagaaggucauaaauauauuaacaaaugaguagcacagaauaaguguuauauguuuaaaaguacacaauauaaaacccauaucagaaauauuuacaaauuacaaucuuuuaccauuuucucucuuucucgagcuguggauaauuuuuucuuuuucugagacgaggucucccucugucucccaggcuggagugcaguggcauggucacagcucauugcagccuugcccuccugggcucaaggucaagggauccucacaacuaagccuucugaguagcugugaccauuagcaugagccaacacaucuggcuaauuuuauuuuuauuuuuuguagugaugggggucuccuuacauugccaaggcuggucuugaacuccugggcucaagggauccuccccaccuuggccgcccaaagugcugggauuacaggugugaaccaccaugccuagccagaugauuuuuaaaaaggggcuaccauuauagaguuuuaaguuuucuuaguaucuucaaugaaaaauaauuuuauuucaugaaauauccauaaugucacuacuuuaaagaccuacuuucaauaauguaaugaaacagccuuauauguacacuauggcuuaagccaagcccaugauaagaguaauucuguauacuacacacaccaaacauguaacaucaaauagaaucaaauauuauuacaguauugaaauuuuaucuuuuaacaaugcaagaguaaauagguuuccagacuguagccaaauaacucuuaaugaaagaaaaagaccacucaggcaacauuuuaaauacuuacaucaguuuguaaaagcuuauuauccaauguuaagagaguaugaaaauuauucauccaaguuuccauauuaucuucaaaaaauucagggagauccuacagaauaaacacugacuugaaacuuuugauuaaaauauuaagaacaccacuuuuauaaguucccuuaccacguggacaaaacauuuuauacacaggcuucacagccugagcauuaccuauucugacaagaauucucugcuccagcuacaucuggcagcugcauaaagcauucugacuucugccucuguuuguaugcuauaaaugaugccaccucuaguucucauccuaaucuaaaucuuccuucaagguucagcuaagacuauaugaagacuuuccuuacaaagcucaagcucagugcauacuaauacauccccuuucuuuucugaacuacguuuauuguaagaugaccaccaaggcagauaaacuaauugucuuuuaguuacugauuucuuguggcauaguacugccuucuuaaugaggguacaaguccccugaggguagauuaugccucuuuccuuggucucccugccagacaaguucucaagagcuucauuaaaccugacuucucagaauucaaaagguguaagcaaaaauaguaguacucauuuaaguaagaacuucucaaacugcuauccagcugaacacugaugugggacauguccuuuugggcuguucaucuccuauucuagcuaaaacaacccaauuuccuuuuggggaaugcuuucccuaccacuaugaguuuauucauguugugaagguaaguccagguacuggcuacaaacaaugaaugggcuaggcccuccuugcaucgcaguauagcaacaguuuguaccaauuaacaccccuuucuugguccugaaucuugaauuaaugauuaagaacagaaagaaugauuggaggccacuaucucaguagcaacaggguaacuaggcauucccugcuauagcccuguggcuauguuuccucugaaauacuacuaguuccuaccccuuucaaagucugguacuucaagucuuuugucucccucauauggcuuccaauaaaagucauuuuguauaagcuggacagcaaccccuaaccaaaacaugauuccccaaauguuaauacccauauaaaugaacgaaagaggaaggccucagaaaucuagcuucuuaaugccaccaguaaaacaguguacagggugacucuccaagagugaguuaggaugugggguuuugcuaaccuacuagauauaagagaauacugcuuuuuuccaugaaacaucucauuagcaucugaaagaacuacuguagaacagaacacuauagauaaauagagucagaaaaaaccuuuucuuucagaaaaaucaaugcuggcaaagaagucuuuaucaaacagaaagaaaacucuauuuaaaaucaaagaguaagaaccaaaagcaagaaaucaaaugaacuuaccugaaaguuuaaacuauagaacaauuuugagaucaggaucagggaagaaaacagaauccucagggcagaggcaucauuugcauggguacugcagaguucaauaguggccuuggaaaggaauuuagcaacaugguuuuagugcaucauaaacccagcaugcugaucuuagugaaacagccuugcacuaagcugagacuauucauauuuuacuuauuuauuuuuuugagacggagucuugcucugucguccaggcuggagcgcaguggcacaaucucggcucgcugcaagcuccaccuccuggguucacaccauucuccugccucagccucccaaguagcugggacuauaggugccugccaccacgcccggcuaauuuuguuuuuguuuuuuguauuuuuaguagagacgggguuucaccacguuagccaugguggucucgaucuccugaccucgugauccgcccgccucggccucucaaagugcugggauuacaggcgugagccaccaugcccagccuuggcuuuuaaauaauacagucacuuaagagauuguggaaaauagguuaaaguauguauuuuugaacuguucauaauggcacuaaaaaguccaguguuaauauucugaacuacgucuucccaaucugugcauauauaaaaauauauuacacaaaacuaucuuuauaugcucuuauuaaacaauucaucugccacuugguauuuagguuguuuccaauucuuuauuauucuaaaugcgauuaacagguuuuacuggccaggcccaguggcacaggcuguaaucccaguguacucggagaauugcuugaacccgggaggcggagguugcagugagcaagagcgaaacuccaucucaaaaaaaaaaaaaaaaaaaaaaaaagagagagggaaaaaaaaagagaaaaagcagccaggcaugguagugugcaccuguagucccagcuacuuggaaugcugaggugggagaaucaccugagcuuggguaguugaggcugcagugagcuauaaucaugccccacugcacuccagccugggcaaugagagugagacccugucuuuaaaaaagaaaaaagaaaaaaaguauauauauauuucuuuaaaucuuauaggauuuucacaaacaccaagaacacauucaggaaaguauccuguaaacuguaaaauaauguauaaauauauaauuaauuaaacuccaaacauagucaaauaaaaauauguauuucuuccuuuagagacacauacuuuaaaauacuugggugaaaugauaugaugcuugggauuugcuuuuauaacauuccuaagaaagggaacagagaaaauaaaacguugcuaaccauuaaauuuguguaauaauagaugggaguucacuauagcaucucuauuucuguguagguuugaaauuuuucaaaagaaaugcucuaaacauuaucuaucaaauaagcuuucaaagcauucucuuaacauguauacaaacauucaagcaauuuaaaauauuaauuuaaaaauaucaccaagaugcauuccauaccuuaaaaagauuagucaaaggcaaagcaaaggcauccagaacaagcuuaauuucaguccauaacucguuugacuuaaauucaugacgguaucuagaaaauuaagguaaaacagauaaauuuacaaguuuuuuuuauuuacucacuuuaggucuucaaggagagaugcugauuggacaucuaugaauagauggguuuccgaaauuccgaaauucaaagggaauucuuuuuuuuuuuuuuuuuuuuuuuuugagacggagucucgcucugucgcccaggcuggagugcagugguuugaucucggcucacugcagccuccaccucccaggcucaagugauucuccugucucagccuccugaguagcugggaugacaggcacauaccaccaugccuggcuaguuuuuuuuguauuuuuaguagagacgggguuuuaccauguuggccaggcuggucucaaacuccugaccucaggugauccgcccacuuugcccuccuaaagugcuaggauuauaggugugagccaucaugcccagccaguuuucuuuuuaaagggaucaagcaguuuaucaagacuaaguauuucacagguaauagagcaauaugaaauaaacauccuaguugagaagaaacaaacgcaauacagaaacuucugcucucauuccaagaugaucagauucaaaggaaugacaacagucacaaaaacacaacuguuuacacaagcaaauaaaacuuuagaaaguauuuuaaaaacaugaaucuaugcaucaauaccuuuuaaauaaugaaugugcuguacggaggacuccauuaauaacauggaaaucuccacucugaaagcgauucaccauuucugucagcaagucaggccauuucuguggaaaaucuucucugccaauaaugcuaauugcaucacuuaacuaggagaggaaaagauuaauuagaucagagcuuuacagaggagcccaucuaaaaaguggagcgacauuaccugcuucugaauuugcucugggcugcuaagcaucaagugcacuauguuggcuuuaauggccacucgaucggcuucacaaauuuuguuugguucaucuucaaccuaaaagcaaagcaguaacugaggaaguaacacaaaauccacauucauguccacaugauuuuagguaaaacauaacuguuuuuuuauuuacuaauuuucuaagaaaacaaauagaggaagguuuggucuuucuucaguuucccucuacaugaaugggucacagauuccuucaauaaucugaugacagcgugaauccuuuucccagaaaaacguacauugccucccaaaugcaaauauuuuacauacaaauuagugaacuucccuuacuccuugaugccaauuaagaauuuccauuuuagacugggcgcaguggcucacgccuauaaucccagcacuuugagaggccaaggcagguggaucaccugaggucaggaguuugagaccagccuggccaacauggugaaaccaugucucuacuaaacauacaaaaauuagccggacaugguggcaggcaccuauaaucccaguuacucgggaggcugaagcaggagaauugcuugaacccaggagguggagguugcagggagccgagauggugccgcugcacuccagccugggcaacaagagugacucugucucaaaaaaaaaaaaaaaaaaaaaaaaaauuuccauuuuaggccaggugcgauggcucacucaaggucaggaguuugagaccagccuggccaacauggugaaaccauuucuacuaaaaauacaaaauuagcugaacaugguggugggcaccuguaacacuaacuacucaggaggcugaggcaggacaaucauuuggaccugagaggcagaggcugcaaugagccaagaucgcaccauugcauuccagccugggcaacagagcaagacucccucucaaaaaaaaaaaaaaaaaaaaaaaaaaauuuuuuuuucauuucauauguaaacuaaucaggacacauaauuaaaaucuuuacagauauaugcuacuuaauccauacacauccucaaaagcuucaauuuaacucucacuuuagaacaaaaaucuuuccaauuuuuuuuauucuuuuuuuuuuuuugagacuggguuuccaucugucacccaggcuggaggguagcacaaaaccuuggcucacugcagccuucaccucccagacucaagacaaucccucccacugcagccucccaaggaccacagaugcacaccacacacgaccacaccuggcuaauuuuaaauuuuuuuguagagaagaggggucucacuuuguuguccaggcuggucuccaacuccuggccucaagcaauccucccaucugagccuccuaaagugcugggauuacaggugugagccaccauacccagcccucugugaaaauuucuugaccauuacuaguuagaaugcauccuagauuauaucacccaaagagauucuguuaagucucacuaguuuuacaaaucaaaauagagggagagggcuggcaugucuaccaguagagauggacuuuuaaacauucugagauuuaaaagacagugucuggcacuguugcccaagcugaagugcaguggcaccaucucaguucauugcaaccucugccucccaggcacaagugauccccucaucucagccucccuaauggcugggacuacaggccgugcaccaccauaugccucgcuaauuuuuguauuuuuuggaaagaugggaucucacuuuauugcccaagcuggucuugaauugcugagcucaagcaauccacccaccucagccucccaaagugcugaaauuacaggcaugggccaccaagcccggccucuaagauuucuuuaccacucauggugauacuugagaaaucauacaggcuuaaaacaauauuuacucucucuuuuauggaaugagaaaaaaaguaagacucuaagauguuuuugagcaguuuaaaguugacuuuuuagauaaacugaugauuuuugucaacugcuaauacuuuguaacaucauaacugcuaucacuauagaaaagccucaucuuuuucucuaucaugagccaggcuuucucaaucugacauuuuggcucagauaauucuuuguuguggaaagcuaucuugugcauuguaggaugcuuagcagcaucucuggccucuacccacuagauuccaguagcaauccuccagcuaugaugucuccaaauauacugccaaauguccccuggugagccaaacugcccccaguugagaaucacuguccuaagcuaaggaaaaaaaaugccuguuucuuaauuuauaauuuacuaaucauuaaaccuguuauaaaauagguuuaaucucaaaauuaguauauauauacauaucccacaagacauagggcaaaauaccuuaucaaaaaguugaaaucuaaauuauuuugcauucugcaaauguuuuauguaucugauuucuucucagcuuuauuuuuccaacaucagaaaucacuucauuuauucagacugucuucccacaaugucucuucaguaggcggugaguaaagcauaaauuccaaacauaauggagauuaagaccaagucucacucccuagcaacccgagguaugaagcuggacaaauuuauauaaauucaaaugaaauaacagaagcuuuggaaaaggguccuguuuaauuuuaucuuugauccauaucugaauccuuuuuuuugagacaaggucucauucugucacuaaaaggcuagaguacaguggugcaaucauagcucacugcagccuugaacuccuggacucaagugauccuuccgccucagccuccagaguaguugggacuacaagcacgugccuuaucuuugaagaacacugcuuauauaaaccuuauaaacauacaggguauuaaauuauguauucacaaaauacuuacaauucuccaguuccuuuuaauauaguuuuugaauguuacugaagcacauacuuugauaacauuauccugggacuucuccaguaaugucaaaagcaacaguggauaauucugauuuccuucaacagauucaagaaauuucucagcuguaaaagaauuuucauguuaaaagacuaagauaaaaaucuuuccaccuuauauauaucaaauauauauauauaaaaaaaaaucaaaaaaagagaaaagauuagguuauuugugggucuacagggccucacuuuucuuaucuauuaaguggauuauauauguuacauuaaacuuauauaaugcuucaguuuucaaauaacuuuaccaucaauuaacucacaugauucucacaaaccuauacaguggccuaauuggaugaucaucucaucugcaagagaagcugcuucccaggcagauuaaguggcuucaagacuucauauacccaggucuuauuucagaaaggaguauuauuaguacuauuaguaguaauauuucuuuuauaggcuagugaugaagagcaaaugagucaauucauccuaauauauuauuauuagccaaauggguccaacgauuuacauauauauuauauauguaaaauuauaaaauuucauuuaguugucacuauuacccagaaaaguagauagcauuuaaaaaaccaaggcacuaagguuaaguaacuuguucaagaucacacagcuaggcuucacuacugaaaguuuuagugcaguccuuauuuuaccuuaccagcccuaagcuuucuugucgaacuaaaaaaaaaccuaaaaacuucuuaauaccagcaaugaauuuauccaaaaaauuuaccaauagauuuucaacccagauuacauucugggauaaauuuccuagguuaaugaucacaugugauggcaguacaguauuucucuuaauuuuuuucuaccuuuggcuucauagggcaacacccaauauuccaauauuuuuugaaaaauuaauuucauguaucauuuaacaccuucccucuuucugacugagucccaagaguuucacugauauuuucaaacucuccuugcuuugugcuuaucaugucuuucuugaaggaugaagauuguuaaacugaaaaauguuuuucaggaggggacauacuaugguuuuauaugaguacagaacaauuuguuuccuccacuuaguagccagcauuuuguacagggcaacacacuacauccaugauuugaggaaaagcccauauaaauugccaagucucuuuccuaaauuguaaucaauauccaggaagugaguuugagucuguuccuuucuguguucauuucuuucaacuuaucacaauauucacaugcauauguuucugcgcacucaaggagucucaaaaggucuaguugagucagucuagucagucagucucgaucccugagaaaugcuauguuccuaacuucccagaaauaccagauuauuuuuauacucuguccugaauacauaaagcaacagaacucuugccucacacauuauuaaaaaaaaaauaauugccgggugcgguggcucacaccuguaaucccagcacuaugggaggccgagacgaguggaucacaaggucaggaaaucgagaccauccugacuaaccuggugaaacacccgucucuacuaaaaauacaaaaaauuagccgggugugguggcgggcgccuguagucccagcuacucgggaggcugaggcacaacaauggggugaacccgggagguggagcuugcagugagccaagauggcgccacugcacuccagccugggcaagagugagacucugucucaaaaauaaauaaauaaauaaauaaauaaauaaauaauaauaauaauuuuuccaccgggcacgguggcucaugccuguaaucccagcacuuugggaggcugaggcggguggaucacgaggucaggagauggagaccauccuggcuaacacggugaaacccugucucuacuaaaaauacaaauaauuagguaggcaugguggcgggcgccuguagucccagcuacucaggaggcugaggcaggagaauggcguggacccgggaggcggagcuugcagugagccaagauggcgccacugcacucuagccugggcgacagagggagacuccgucuccaaaaaaaaaaaaaaaaaaaaaauuuuuaauaguguuggcaacagcuuucuuugaaagucuaagaagauuaaagauuagagccauuaacuucccuuuauccaggaacacauuacuucuuuauacacuaauaaacuaauuuuuccucucaaaaaucacaaagacuuuucuagaagaggauagaugcauuaacauguucaugauucuagucaucauacauaauauauaacacacauucucuuccucauggaacccuuccaacauccucuaugagcaugcacauugguaaguuuugaagaaacaggucaagagcauuuuaauauggcccauaucaaggaucaauaacugacugcucacaagauauaucuggcccagaaguaguuuggcuugcacuguauuucaauuuuuuuuuuuuuugagacaaagucucacucugucaccuaggcuggagugcaguugggcaaucuuggcucacuggaaccuucaccuccuggguucaagcgauucuugcaccucagccucccaaguagcugggguuacaggcacaugcuaccaugccuggcuaauguuuguauuuuuaguaaagacaggguuucaccauguuggccaggcuggucucaaacuccugaccucaggugaucugcccuccugggcuucccaaagugcugggauuacaggcgugagcaaaugugccuguccaauuuuuuuuuuucuuuugagacggagucuugcucugucaccaggcuggagugcaguggccucgguuaacugcaaccuccgcuuccuggauucaagcaauucuccugccucagccucccaaguaucugggacuacagccgugcaccaccacgcccagcuaauuuuuguauuuuuaguagagacaggguuucaccacauuggccaggauggucuagaucucuugaccucaugauccgccugccuuggcuucccaaaaugcugggauuacaggcgugagcaaaugcaccuggccuuuuuuuuuuuuuuuuuaagacaagauuucccucugucacccaggcuagagugcacugacaugaucauaacucacugcagcuccgaccucuuggguauaagugaagcuuuugucucagccuccccaguugcuaggaauacaggcacacaucaccacacuuggcuaauuuuuaaauuuuuuguagagacagggucuugcuuuguugcccaggcuggucucgaacuccuggacucaagggaucuuccugccuuggccucccaaauuacugggauuaaaggcgugaccaccaacccuggcuguguuucaaaauauuuuuuuuuuugggacuacgucucgcucugucacccaggcuggagugcaguggcgcaaucucaacucacugcaaccuccaccucccagguucaagcaauucuccugccucagccucuugagcagcugggacuacaggugugugccaccacacccagcuaaguuuuuguauuuuuuaguagagaagggguuucaccauauuagccacgauggucucgaucuccugcccucgugaucugcccaccucggccucccaaagugcugggauuacaagcgugagccaccgcacccggccccaaaaucuuuugaaguuacuugcuaacauuuaaaaaugagggcacuucauauaaauauccuuauuuuucaagcaaaacuggaaaucugaucuugcaaaacuagucugaauccccaaaauuagcuaguuccaaaaaguacuugccacuuaaucagggcauguauucuccugauauuaccagucuccacuuggccuaucucccucauuuaacuuaacagcugaguccugugaacaccugaguucaauauuuuaauucuacguuuuuaauggaaucuggucagauucaggaaggaaaaaaaaagcucuaggucuuaaaauauauuaguuaaaucaaacccaauagaaaauuaaaauuaagagacaguaacugauuacuuggcuucauucacuuaaucacuuuuuaggcaauuacucuccuuucuaugcccuaauuauuuuaucucuaaagcaggcuuuuuuuuuuuuuugagacggagucuugcucugucgcccaggcuggagugcaguggcgcaaucucggcucacugcaagcucugccuccgggguucacgccauucuccugacucagccuccugaguagcugggaccacaggcacccgccaccacgcccggcuaauuuuuuguacuuuuaguagagacgggguuucaccguguuagccaggauggucuccaucuccugaccucgugauccgccugccucagccucccaaagugcugggauuacaggugugagccaccgcauccggccuaaagcaggcauguuuuaaguggguauuuuggaaaaggucaaagacaaagcauucuaaacaugucaguacuuuuuauccgaaaacuaguacuuuuuaaucccagaagaugccaaauaaaagcuauuuuacucaaaaaagaaacaacacaccaugguauagcagcuguaacacuuauaaacuacgcuugagaacccaaguaugaauuuuuuaaaauauauuuauaaggaggcagauaauacauagguuucucucaccuguccugaaggaauuaaucaaccaaaaaacguuuauuuucuuuaccuggacgucggauggcaggaucaggaucaaguguuuucuuuaaauauucuguuaguguuugcagauuugcaucgcugaguuccauugcuauaggaucuaaaauauaaaauaagguuuggauaacuggucacuuacggaaaaagugauuuacauuuaaagaaauccguuuauauuauggguuauucucucugaaagucauccaucuguuguuuuuuauaugggcaguaaaccugacucugagacaagaguccagcaaaugagaugugccuuuucccccaaaaacaauagugagacaauuuugugauaagggagaugaaaaaaaaucccaaaauuucaaaaagauagucauagaaaaaaaagcugaaggacugcucgaagucaccaagaaguuuauaugauuuaaugcuaugggaaagggcuaauaaagguuaagaaaaaaaaaaucacuggaggaacuuauuaaagaagccccauaaggagcccgggcaguggcucaggccuguaaaucccgacacuuugggaggcugagguggguggacugcuugagcucaggaguuaagagaccagccugucaacagggugagaccccaucucuaccaaaacuacaaaaaaauugaagccgggcaugguggcucaugccuguaaucccagcacuuugggaggcugaggcaggcggaucaccugaggucaagaauuugagaccagccuggucaacaugguaaaaucccgucucuacuaaaaauacaaaaauuagcuggacaugguggcaggagccuguaaucucagcuacuugggaggcugaggcaggagaaucgcuugaacccgggaggcaaagguuucagugagcugagaucgcaccauagcacugcagccugggcgauaagagcaaaacuccgucucaaaacaaaccaaccaaccaacccaaaaaauuagccaggcaugguagugggugccuucagucccagcuacucggaaggcugaggugggaagaugucuugagccugggggcagagguugcagugagcugagauggugccacugcacuccaacuugggugauggagcaagaccugucuuaaaaaaaaaaaaaaaaaaggccccacaacgagaaauuaaaauuuuaaacagcaaauaaauaucccacauaaaguucugagauuaaagaaacaagaaauuccuucauguacaacauguaaucgcaaauacuacaaagugcuaagaauuugcaucuagggagauaaauucuagaguucagaagaugacagcuaagauuaugauucuagaaguuuucauauuuaaagcuuaaacaaaacuaaaucacauaauaugcuuauaacugaccaaaaaacuucacaucuaacagaugacaaauuaaaaaaaaaauuuuguagagacagggucucacaauguugcccaagcuggucucaaacuccuggacucaagugauccuccugccuuggccucccagugugcuaggauuacaggcgugagccaccgugcccagcccacaaauuuuaagcuaacuaaauggccuacgucgauuuaacuacuaacaacauaggcuaagaaauacacaguucaagagauuuauuguacaacaaggugacuauaauaauguauuguacacuugaaaauuacuggguauauuuuaagugcuuucaccacacacacacacacacacacacacacacacacacacacagcaugugaaguaauauguuaauuagcuugauuuagccauuauacaauguauacauauuucaaaacaugcauaccacaaauauauacaauuuuguccauuaaaaaugggaaaaaaaggagucugaacccacucaauuaaaaggaaaaugaaaaaacacacagaaacagcacauacacagaguacaagugucagaugugcaugauuaccaacagaucacaaauccugggaaucuuaucaauugagcuuuauggucuccaacuuguuggugagacgauaaaauuaggugcaaacugagggaacuuuuugggggugacagaguguucuaaaauuggacuguggugacacaugcauaaucuacauaaauuuacuaacauuucccaaacaguucacuuaaaauggauaaaucuuauaguauguaaauuguacuucaauaaagcuauuuuaggcugggcgcgguugcucacgccuguaaucccagcacuuugggaggcugagggggguggaucaccugaggucaggaguuugagaccagccuggccagcauggugaaucccgucucuacuaaaaauacaaaaucagccgggcaugguggcaugcaccuguaaucccaguuacuuggguggcugaggcaggagaaucgcuugaaccuggaggcagaagcugcagugaaccaagauugugccacugcacuccagccucagaaagagcgagacuuugucuccaaaaaaaaaaaaagcgauuuuagaaaacuccacuuaugcuuagauuccauuaggcagcuuuuagauauauagccacauguagaugggaaaguggagcccuuucagggaaaucaugcaccaaauuaaccagaggcuucuaugaaaaagaagaaaaaaacuaaacacacaauuuuuguaaaauguaaaaaaggucaguggaaaaaguucaaggauaucauaauucaaauuaugaaaaaaaacuucacauauagaagaaaacaaaaaacacacuccaaaauguagaacagugauaacaucucggugauagauauaaggagaguuuuauucucuucauacuuuucuaaucuuacaaucacauaucuauuauacauuuacaguaaggaauuuaaaaaauuuuauuauuuuuucagacagagucuugcucuguggcccagguuggacugcaggggcaugaucauagcucaccacagccucaaccuccagggcucaagccccaaccucccaccucagccucuugaguagcugggacuacaggcgcaaucaaccaugccuggcuaauuuuuguauuuuuuguagagaugggguuucaccauauugcgcaggcuggucuugaacuccugaccucaagcaauuuuccugccucggcaucccaaaacacugggauuacaggcaugacccaccauaccgggacccauuuauuuuuaaaaugccuaugacaauaugcaaucaaguuccuguccuagaaggagcuucuguaauaguucagaagacaagacacaacugaaaugccaaguacaggccuauauacccuuuacuaaagugaugaaauccaaaaauaaaaaaacuuaaaaguuuguuuuuuaacaaguuuguggcaaacucacuuggcagcaaaaccagccugaacugccugaggcuaucaacauagauuuaucucacuuaguaugcaaauuuguuucacuaaagaaauaucaauacguuugauuacagggugcuaccccaagccccacuggggauguuguauaauccacaguacaugcauccaaaaaaaaucccaaauucugaaacaucuguccucugaagugccaaaugaaucacaaagacagcaccuuaaacguuagaaaauuaagaagggagucacgggguuauguggccauccaagaguuucccagagccugagccuugagcugaaccuugaaaaauauguguaucugaauaggcaaaguaggaugagggcgcaucugccaaaaugaauugugagagcaaaguaacagagaugggaagagagaauagugggcuaggagaucaagaccagaucauauagguuccuccauacuuggcugaagagugccaugauuuaauguauggggaagucaugaagguuuucuuaaguggguaaaaauguaaugaaaguggaguagaggaccuuugggcugguaaugguuugcagaaugggggaagugucacauguaugaaccaggcacacgaugcuagauguuuucauaggcuucauaucauuuauuccacacaaugauuuuacacacaaagaagggcacucagguugacauauauuaacuauauaugguuaauaaauaaagaucagauuuaaaucaguccaacuccguaggucuacccucuuucuauuacccaaggcugccucuuagguggaaaugacagacggcugaccaagagugaaagcacucacaacacaauagaaaggcugaugugaaaagagggcagccagaggacaacugagcgguggggagccagaaaauaagaaaauauuaucuaaugcugugcuuaugcagggcacuccccaacagccagaaaccccaaccuucuaaagagaauuaucuguauucuacaugcugcaguccuuccccuuaauuagaaaauguguuuaucacaggaagcuaauguucugacugaguagaucccaccaccuaccuaaucacucccucuaauccagguguuccacucuauaggugugaaaaucaagucccauuaaaccacacauacaaucuauugagaggcuauacccuuuaugguuuuuuauaucacaaguuuggaaaaugcuacacauuauauccugccccacuuuggagauucacaauacaaagcacuuuaaacucacaaaguuacugguucacaucaauuaauccagagucuccacuggugggaggcugaggcagacgaucgcuugagcccaggaguucaagaccugccugggcaacauggcaaaaccccaucucuacuaaaaauacaaaaaauuagccgggcguggugguguggcccuguaguccuagcuacuugggaggcuaaggugggaggauugcccagucucucccauuauuuggcuauagaacuccuuuucaauagaacacacuuuggaaagcaaugauuuaauccauuuauuuuccuauuccuuuuuucuguauugaaaugguggaucaguuaugaaaucaugaaaguuugggccaggugugguggcucacaccuauaaucccagcacucugggaggcugagaggggcagaucaccugaggucaagaguuugagaccagccuggccaacauggugaaaccccgucucuacuaaaaauuagccaugccugguagcacaugccuguaaucccagcuacuugggaggcugaggcaggagaauugcuugaaccugggaggcaaagguugcaaugaggcgagauugcgccauugcacuccagccugggcaacaagagagaaacgcagucucaaaaaaaaaaaaaaaaaaaaaaaaaaaaguuaguuugcuguggucaaguuaaaucauuaacaucaguguaucugaguuaaaggaaauuggccuuucuuugccauaugcaaauuuauucuaccuuuggggauucaugcaaggcagauuguuagaaacuuggguggggagggugcaggggcagauuuacagaucuauuuugucuuuaaaaaaaaaaaaaaaaaaaaaaaagagagacagggggucucacuguauuguccagauuggauucuaacuccugagcucaaacaauccuccugccucagccucuggaauagcugggacuacaggcauaugccaccacacagggcuuauuuucuugauuuuuaaaaauacacuucuuaauaaaucugcauuucacuuucuucauuauguuucucuagcauuuguauauuucucaacuaaaacuccuuagauuccucauaauuacuugucuuaaacacccaaacuccuggccaggugcaguggcugccgccuguuagcccagcauuuugggaggccaaggcagguggauugcuucagccggcuucagaccagccugggcuaacacagcaagacccugucucuacuaaauauacaaaaaauuagccaggugugguggcacacaccuguagauccagcaaauugagacugcugugaguugugaucaggccacugcacuacagacugggcaaugggagugagacccuaucuccaaaacaaccaccaccaccaccaccaccaccaaaucccuuaccacagcagggucuaagcaaucugguaucuacugaccucaucuccuaccuccuccuggcucuugcuacauuccaggcacaaaagccuucuguucuacaaacuggccacaagaguucucccugaccauaauaaugcucauccucuaauuugauaauggacaccauucagcacucagcccacugucaacucuucaaaaaggccuucuacgauuaccaucuacaucauccuuguuuuacuguguuagcaauuacccucauuugaaauaaacuucuuugucgucucauacacacacuagacugcaagcuccugagggcagggacuuucgucuguaugcucaggaccuucagcauuaccuggcacacaguacauauuuaguaagcauuuguuguaugaacuaaaggauaagucacaacaugucagucacccagcaaaacaugaguuuccagucaagacuggagacuaucccuucagaucaaucauuagcagccccaacauaaugugggaacucaguugcaugaaugucagaugaacaaaugaccaacuuaacugccacaauuaaauuuguuuauucaaaaguacuucaagaaagugaauuuuuagauuuguucuggccuggcagaauggcucaugccuguaaucccagcgcuuuggaaggccgaggcggaaggaucacuugaggcuaggauuucaagaccagcgugggcaacauagugagacccugucucuacaauaaauaaaaauuagccaggcaugguggcgagcacuuguagucucagcugcucuggaggcugaggcagaaggacugguuaagcucagaauuuuaaggcugcagugagcuaugaucaugccauugcauuccaaucugggcaacagaguaagacucugucucugaaaaaagauaaaauuuauccuguauuaccuguucaaacaugccagugauuuuacuuuuguuucaggguucuguacuuaccauuccuucugccugcagagcucugcacacggaaagcuacaagguuugcacugcccacuucauucucauucaggacucuuguuuuuuuuggagacaggggucuuugcucugucacccaggcuggagugcaguggcgugaucucagcucaccgcaguccccgccucccagguucaagcaauucuccugccucaaccucccaaguagcugggacuacaggugcgugccaccacgcccggcugaguuuuauauacaguaaagaugcgguuucaccguguuggccaggcuaaucucaaacucuugaccucaggugaucugccgccucagccucccaaagugcugggauuacaggcaugagccaccgugcccggccuggaaggacucuuuucaaaugucaucuuuuuuucagagaugccuugcugcaccauccuaucuaaaagagcauucaccucaguuacucuccaugcccuuacucuacuauuuuccaaguacauuuuaucaggcauauuaauuucuuuugucauuuacugugcuucucucuucacuagauuguaaacuccacugauaguagggacuuugugcuuuguucacugcucucucccuagagccuuacaauagugaugagcacccguuauauauuuguuguacuauuuuaaaaagcuagauaccuuugauguuuccaucaaaaauauuauucuucaucuuuauuuugguugguugacugugucaaacagaaagagguggacacaaccuucuagauucuaaaaccacaacaggcugagcaagguggcucacuucuguaaucccagcacuuugggagguggagaugggacgaucacuugaccccaaggaccguucaagaccagacuuggcaacaauagugagauccugucucuacaaaaaauuuuaaaaauuagcugggcucaggccgggcgcgguggcuuacgucuguaaucccagcacuuugggaggccgaagcaggcggaucaucugaggucaggaguucgagaccagccugaccaaugugaugaaaccccgucucuacuaaaaauacaaaaaaaaaaaaauuagccgggcgugguggcaugcgccuguaaucccagcuacucaggaggcugagacaggagaauugcuugaacccgggaggcagagguuucaaugagccaagacugcaccauugcacucuagcucuagccugggcaacaaaagugaaacucccaucucaaaaaaaaaaaaaaaaaaaaaaaaaaauuagcugggcuuggugauacccuccugugguccuagcuacuagggaaguugaggcaggaggauugcuugagcccgggaggucuaggcugcaauaagcugaggucuugccacugcaguccaguaugggugacugagugaaacccugucuccaaaaauaaaauaaaauaaaauaaaauaaaauaaaaauaaauaaauaaaaccacauaauagaaugaaaccuaaaaugauuaaguugagaugcuaggguaggacuauuuuuaaguuuaaaaaaaagugagggguuauauaaauaugcauguuauaaucccucaaaguuaaaauacuacauagaucccagaaucuuaauacucuuuuuugagacagggucugggucuguuaccuaggcuggagaaaugcagugguguaauucuggcccacugaaaccucugccuccugggcucaagccauccuccuacuucaaccucccaaguagcugggacuacaggcacacaccaccacaccuggcuaauuuuuguguuguuucuguagacaugguuccaguguugcccaggcuggucuggaacuccugagcucaagugauccgcccaccuuggccuuccaaaguuuauucuuugggaauauucuuuaaggaacuauuugucaacaaauccuuuuuauaucgccuugcagauauagucuauaaaaccgaauucuaagcuuauccuuaauuugagaaaauaagagaaaucagggacuuuuagagaacauuuuacagguauucauaauuaucaacaagaucaagcucuaauuaucuuaugcaaccacaaguaaagguacuuugacacucugaaauauuagcaauauauaaaugcaaaaaguguuacugaucuaaaaaugacucaaacuagaaacaaaacauucauuuuggccaaguaggguggcucaugccuguaaucccagcucuuuggggggccaagguaagcagauugguugaguccaggaguuugagaccaaccugggcaacauggugccaucucuacaaaaaaaaaauaaaaauuaguugagugugguggugcacgccuguaguccuagcuacucgggaggcugagguaggaggauagacugagcccaggucagcccaggcaacacagugagauggugucuccaaaaaaaaaagggagggagaagauaagaauucauuuuuaucaccuuuaaaugagggggugauacuuuucuuucuccacguaacuaucuuuggaaaucucuaccaauacacaauuaagaaacuuaaaaaagcaucacaauaaaucaguuauggcagacaucuaaauuuccaaguucuucuuguugaaugaauggccagaccuaagucuagcaucuucccacaggcccucaauuacagguggagauuucuggaauaaaagcuuuguuuuccaaagccaucucacagacaucugugacauaagcugauccaagaugucugccuuuuucuuagauauguccucaacacauuagagaaccauucccgaggccuuacauuugggaagagggaaagagauccaaugaaugaaaacuaucuggcacccacacaugaagaacauaucccaacaccucaaccuacccucugcuuucuaaccauaggaauauaccacuuagaaucaaauccaaacuccuuacauugccuacaaagccuucuaugauccggguccuggauauuucucccuucuucauguaacacucuaggaaccuaagauauuccuuaaauauuucaauauuccaagccgguuccuguccuugagccuugagccuucuauucccucuaccuggaauguucugccccucaccuuuuaauggcuggucucuacccaaaugucaccuccucagaaaagccuucuucaccugucacauaauucugucacuaucugaaauuaucuaauguuuuuucuuucgcccacgagaauacaugguccucaagggaagggaccuuguccauuuuuguuuuuucacuauauucccagagauuaaguggaugcucaauaaaguuauuaaaugaauaaagaaacaaauuaauuccaaaacuagagcacugcucuugcauccauccaauccugucccagaccccaaccagcagaaguaaucagaaggggagagagacuucccuugcacugaugguaagaagugaaagauaaaggguuguaggagcggagagacgagguccauuaggauccucugaaagcaugucaaaaaaaaaaaaaaaaaagagagagacacacacagagaaaggccaaagauaugacuaugugggcccaaggugagaaaaagagcaauugguggaauccaagacuaaaggguccccuucugugccuccaaggaagaauaauacuugugcaucuaccauguggcaagcacaggugggauggcacccaccagggagagagaaguaagcaagacagacaagguccuugcucucaaacagcuuacauucuagcaguugagaaagauaacaaguaagcaauaaguaaguguuaguaaaugcuaugaaguaacuaaaaccaggugauguugauggagagccaugggagaaagguccuagacagguugauuagacagccugaucaacauggugaaaccccgucucuaauaaaaauacaaaaauuagccgggugugguggcguguagucucagaccuguagucucagcuauucgggaggcugaggcaggagaaucgcuugaauccgggaggcggagguugcagugagucgagaucgcgccacugcacuccagccugggaggcagagcgagacucucucucucaaaaaaaaaaaaaaaaaaaaaaaaaaaagaaaagagaaaagaaaaagaaaaagaaaacaaaagaagagguugguuaggggaggccuaaggugagggaaacuugggagaggcggccugccuugcaaaaauguugguacuuccccagcaaacaaaaggcaugugcaaauaauuuuaaaucggaauaacccuggaauauggaagaaacagaaagccacacuggcuaaggagaaagaugggugggagagaugaauaaacaaccgucagcucccagggaaccuuuguaaaccacgguaaauaacucagcgcauccucaaagccacuuuccgagguagauucuguuauuaaccccauuuugcagcuaaggaaauggaggcucagugagaugaggugaccagccucaaguuacaccccuaacgagaggcuacgucuggaaugaacccaggcgaucuaauuccaaagucuaugcuccgaaccaccacagcacagcguuucucccaaaacgagggaacccucccccaacccgcguuacaggggauuucuaugucccggguguaccgacuagaauucucacaaacaauucagcaaagugagaucacgaugcccguuuuacagucagggauacaaguacagagguuagagaagggugaguucgggggcuucacuagaguuagggcaagggacgacgcgaggcagccgcagcuccacgcgcccgcaguccccgcccgggcaggccucgccgccgcacacucagcucgcgcggcuagcagccaccgucgcagagaauggacaugcgagcgcgaccaauaaggagcggccuucccgagcggagaggcggcggcgcagccaaucagcgccgugauggagaggaaagggcgggcaauccgcaggcucgcguuaggccgcgccucaguugcccucagcccucacaggcccuggggucgccgcaccugggccagagaccuaggaugccgcgaggcgcggcaagcgcucccuagggaagccgaagaccuugccugagcgcaccacccgaaccccgggcccacauuccgcucucgcccagaggcgcgguucucacucccuagcgcucguuaguaccgggagcgccucaucccuuccucagcugggccccaagagccacucugguaggccgugcacgccccgcgccucaccucguggggauacagaaacggaggagggaaccccagccgcggaccguagcuggcacuacccgcuccugccgccgcuccgccucacauucaaaccccggcaaaauggcgcgacagcgagccuga

SEQ ID NO: 191278 - RNA, 75029 nt, Homo sapiens
acuuccugccgggcugcgggcgccugagcggcucuucagcguuugcgccggcggcugccgcgucucucucggcucccgcuuccuuugaccgccucccccccccggcccggcggcgcccgccuccuccacggccacuccgccucuucccucccuucgucccuucuuccucucccuuuuuuccuucuuccuuccccuccucgccgccaccgcccaggaccgccggccgggggacgagcucggagcagcagccaggugaggcggccgggccgggccgggccugguggggcccucgcgggcgccgccgcgguggggaggugggcggcggguggggccuaggccucggcgggcccgcgcaccccuccgccuucucccgggccucucucuagcccgcggggccuucccggaggaggcggguccucuugcguucccucgccucggggcgcccugaggccuggccccgggcgcccccauccccuccagcccucaccggugccacaaacaggugcugcggccgccuuuccucgucccgcauggcgcgcgcggggaugccgaaguuauucccggggcuggggcgcaggcgggggggggggggggucccugcuucagguccccgagggcuggagccucucagugucgccggcccaggucuguagcuuagugguuaagagcacggcccagguguccaaaacgggugccgaacccggcucugccccguuaggcaagacacuuaaaaagucuuugugucuugguuggaaaaggggcugcuaauaccgucccugccucuuaagguucagugaaauggggcguguaaagcgcuuaucagagugccagacccacagcgugucccaguaaaccgucugcauaauuuauuagcgugauaugaagguauaauuuaaugggcagaguggauagaaguugaccuaccuauccguuuggguuucuuagaggcugcaguguuccgcgugcccauguccagagccagggcauuguuuucaguuguuaacaucugaaaggggcguacgcuuaauugggacacuguaguugacagucuguaaacgauggaugcuguuucuuuccaucuccgcuuaggcaacugcaggauauucaccaucucccgcaggaugagcaaccuguccauuucuccccgccccgccaucauccagcuucuucuugucauuccauuucugggaaaguugcuggcagaagcuucccuugaguugagcaaaccuaucuagagcacuugcuguguguugggcucugaagggggguguacggagauggaaaaauuugucugucuugucuugcucuacaccucgauaaguuuuuuuucacggaagcuuugcuuauauucaccccucccuguuggcugacuuuccuuuuaagcccuugccccgccuccguguugcaguauugcuuguguggaaguuuucuucuguuccgcgaagauacgugcuucagucuguucugccacuguucuucggcuguguggaaguuuuuaaggucacacuucucuucugcuuguagcuuucauuguuaagagcgugguggaguuaaaucagguucccgguugauuuuggcguuucaggaauccgugcuuaccaaguguaaauugcauugcuacuuguugagguaaaaacuaaaaauacaguuggaguguagagggagcaguuucgguuauccuggugacaggugggauuuuuagaacagcaacuuuacuaaaacauacuggguuuuuaaaaauucuguacuuaguuuuauagguguacucuaaggaaaugcaacuuauggguguucaauuuuauaugaguaaggaguguguguuuaccugagugauccuccuguaucuuaggauuguuuuaggcauuaaauuuccuuagugaacugaaacuauuuugauuuauacccaucucuuaacacacaugcggcaaaguggccuccuuguuuuugacauuuuccuagaauuuucugacagucuuaccauuguuuguaauuuaaaauguuuguuugaauuuuuuuuuuuuuuugagacagucucacgcugucgcccaggcuggagugcaguggcgcgauuucggcucauuucaaccucugccacccugguucaaaagauucucccgucucagccucccgaguagcugggauuacagacgcccgccaccgcgccguguuaauuuuuguaguuuucguagagacgggguuuugccauguuggccagacuggucucgaacuccuaaccucgugauccacccuccuaggccuccauaagcagguuaggcgcgguggcucacgccuguaaucccagaacuuuugggaggccgaggcggguggaucacgaggucaggagauggagacuaucucuugagccuggugugguggcgggcgccugcagucccagcuacucccgaggcugagacaggagaaucgcuugaacccgggagguggagguugccugggcgacagagagagacucucuccaaaaaaacaaaacaaaaaaaacacauaagcaaacaacuauacaagcaguauaaagcaugucuaauacugccauaucacaauggcauauuucaauagggaaaugguauuuuaaauaccauuuuuuaaaaaccuuuuauucuggaaaacaugcgaaacucgaauaguauggagaaccccauguguuagucacucacuuagcuuugacaauuauuaacucauagccaaggucgguuuuguuucauguuguauccccccacacaaacuagauuauuuugaaacaaaucuuaaacauugugucacaacauuagcgauuuugacuuuuaccagauugccccagauuaaggucacaaaauuuacuuuuaguagaauaauaguucucauuuuuguuuguugggcuucccuucucuguuuauacaugauuucuguacagcagaaaagaagaagaaaauuaacucuugauccaaugccuucagcuccucaaaaucaaaauacaaccuugcugcuuuauuguguacaaaagcaaaaauucuugagcuauuaaugacuauaauugaaaagcgaacaaauacagauuuccccaguccuguuuuggcagagaccugccuuuuaacccacuuuaauagagauaacuuugugucaaaguuaaacuacaguuaauaauucauaaugaaaacuuaaaauguuucuuuacaguaguuguguaaagauacugcuguuaccuuagguuaagaauuaagcaaaagauaaucuucuaacauagaauuguuuuccaaagugcccccgucugcccuauuuccaaauaacaaauuuagcaaauaugaaugaaaccuuaauuuuugugaauaguaugaaaucacagcauaaguguucacguuuuucuuucuugugucuaaaggaucucucuuacaauggaaguugacaggaauauuauaaauauuauaaaugucuuuguugcauaacuuucaaauuucuggucgugaauaguuuucagcuuuuaggucuguuauuugaguuuuguagguguacuuugagcuugaucagguacaguggaaauguuacauguuauguuuuaguuaugacuaccuggaagauggggaaagauacaccucuuaaaauugauuuaggaaagaaacgccaauuuaguaucugggaaaggacacaacacauuuuuaaaaauguguagugcuucccauuaagcuuaacguaaaacuuuuaagcauugagaauuguuaccauaaauauaguuucuugagaauaaguugcucucuuuuagguuucagccagaaaguccauguauauacagauuacagcagguccuugaauaauguuguuucaagauaauguugagaaaaaaaacugucuguggaguuuacacguucucccuaucccugcauggguuuucucuggguacucuugauuuccucccacaucccaaagcugugcacgugagguucacugguguguggagcuguguguguaagugugagugcuuucugcaguggauguccuguccaggacugguuccggccuugcacccuaagcugcugagauaggcuccagccaccccaacccugaacuggaauaagugguaaaaaaaaaaauuuuuuuuuuugagauggaguuuagcucuugucacccaggcugcagugcaauggugcagucucggcuuacugcaaccccaugccuguaaucccagcacuuuuggaggcugaggugggcagaucaccugaggucaggaguuggagaccagccuggccagcauggcgaaacccugucucuacuaaaaauaaaaaaaauuagccgggcuggguggcgggcaccuguaaucccagcuacucaggaggcugaggcaggagaguugcuugaaccugggaagcagagguugcagugagcgguuaucgugccauugcacuccagccggggcaacaagagcaaaaguacuucucaaaaaaaaaaaaaaggcauguauacuucacauuuauuucaguguuuaauauucgaaguguuuggucuuuauuuaaaaguuuggugauauuuuucugaugagaaauaugcccuagaaccuaacucuuguuuguaucaauaagcguguguuagucggaagucucaguuuccaagaaccuaccccuuauguuaagagaggauuuacuguauuuuaaguuuagaaauggccaugacucauggaacucuccuccauccccauucuaaaguccagaucauugauaucauucuggguguuaucaaaauggauacugcuucauccagucucucuccccaauaccacaagguagucucaguuuguggggcaacuuucuuugagccuuuuuacuggauugaguaagaguguaauucaguauaaagaugaaacuuucaugaaaaggguaucuuuuugugggauuccacaagucaaucccagaguuugucgcccaggcuggucuugaacuccugagcucaagucaucuucccaccucagccuccuuaguagcugggauuauaggcagaggccuuguuuucaugagccucuaaauuggaucuucuuauuugaugugauacccagugacacagaauuguucaauuugaggaaauauaaauuccuccccucucaaauaagagcuuuggaguugcuuuucucucagaaugggauuuuagagcuuucaaaaauguuuagagaauuuuaugacagauuuguuucacacuagaccuauaacagguuauuuuacauugacuucuggugauggagacauuugugguugaaaugcuucucguguaauuuucuacaugagcuuuucuuuaaauaaaacuucaccagagucaaggcuguauaccauuugugcuguuccaaaaaauauaaauugccaguuaucaguugaacuaugagaggacauguuaguugcuaugguuauuuacccccaccauuuuauuaugaaaaauuucaaacauauaacaaaguuuaugaaguuuuauuguacaucucuuuagauaccaucuacuuucuauuuuugccucccuguuucauggugcugaacaccgucuacuauuuuuuuuuuuuuuuuugagacggagucuggcucuguuacccaggcuggagugcaguggugugaucucggcucacugcaagcuccaccuccuggguucaugccauucuccugccucagccucucgaguagcugggacuacaggugcccgccaccaugccuggcuaauuuuuuuguguuuuuaguagagaugggguuucaccguguuagcuagaauggucucgaucuccugaccuugugauccgcccaccucggccucccgaagugcugggauuacaggcgugagccacugugcccggcauaccuucugcucuuugucaugaacauuuuaccauacaguauuaugaagcuugaauaauguuggccaaauccauuguucucaccugcuaaggagauaauaggauuauaaauauauagcuguguugaucuuaucaaaugccacgggauggaugggcuuggauaucugucuuguugacagcuuaaugcucugaacuagaaaaccuuacugcagagaaaaguaauauuuuuaaagugguaaaaugggaauuacugcaaauagcuuaauuuguuuuuuaaguguuuacauucccauacuggugaauaagguugauguaacagugauuuaugucaccagauaaauggaaguagagaaaaauuucugcaggcuguuaauugcuguauauuuucugggauuacauauguuuauuuguuaaagaaguagacucagggaacucccucaaaguauauuuacuggaagcaaaaguggaaaaaucuauuugagaaaguguuugcuuucgauuaaaaauuagucuucugaauaucaaaucuguaacccaucuggcaucuguuuaaucuggaaucuaauuugggaaagaagugugaugacuauguggguuuauaacaguaauggaagcaaaacuggccauuuuauuaugauagaaauuuugugucaugucucccagacaauaaaggcuaagaaaaucuauuuaaauacauuggggucuuuuccccugaaugaacaugauugcugaggguuaaaccuucauuagauugccucugcuuuuuuuuuuuuuuuuuuuuuuuuuuuuuuuguugagauagucuugcucuguugcccaggcuggaaugcagagguaucaucucggcucacugcaaccuccaccuccuggguucaagcaauucuccugccuuagccucccgaguagcugagacuacaauugagcaccaccacgcccggcuaauuuuuuguauuuuuagcagagaugggguuuugccauguugccuaggcuggucucgaacuccugagcucaggcaauccgccugccuuagccucgcaaagugauaggauuacaggcuugagccacuguucccggccuugccccuauacuugauguagcuacagaacugguugcucagugaguggguugguuuuagucagcauauucucugauccuauuuaaaauuuuuuacaaguggaguguugcuguaaguuuuauagauguuuauguguaaggacagguuuagugaauuugcuggauaauaauauuuacugcuauugagcucuuaccaugugccagguuagaauuacagggugaaaguuauuuuaugcagaaaaggaauuaaaaggucagguugaauuuaccuaauaauauaaaaguugcaguucauuuagcucuuuccuugaaccaaagaaaaggguuucuuagacccuuuauguuguauuucuaauacucauaaacaucuuugcagcguaaagcucauaauaauugcugaggaugcugaugcgcuuccgaggggccagauaacuggcucagaguccugaggcaccaaguauuaguucuagagcacaggcuggucuggcuccaaagucaguguucuuuccacugaaccaugcuuugucucuaaauuaugcuuaggugcuuuuuguuuaggauaauugauucugcuugucacugguggcccuccccugacucuccccaccgcagcagcuaggaugaauuuugcucauuagaacccuagaucaauuugaaagaaagucugguuaaguaauagucuuuuagauggacccuugaaauagcuuuccaguuuacuuuuauuuguuaugucaaauuaagcuaaaacuuaaagcugauccacagguuuguguguggggaggggcugucuuauuaaccuuuguguuaaaggaggccagcuccuaaauuacugcuaucgugugucaucagguuuguuaaaaauugcuggcaugguggcccacgccuguaauuccgucacuuugggaggccaaggcaggcgcaucaccugaggucaggaguucgagaccagccuggccaacauggugaaaccccaucucuacuaaaaauacaaaaauuagcuggguguggugguacgugccuguaaucccagcuaccccgggggcugaggcaggagaauggcuugaacccgggagguggaguuugcagugaccugacaucgugccgcugcacuucagccugggcaacagagcaagacucuguauccagggggggaaaaaaaaaaaaagaacuguaguccagguuguugcuaaaaaaaaaaauucauuucuucugaauucuaacauucugcuuuaguggaaaugaguuaacuaagcuuccaauuaacuuuauaggauaggugcugguuguccucuuugcuuccuagcccuuucuaacaucccucuuguggcuaauacuguugggaguauuuaguacagcuuccuguuuggaauugaacugcuuccugaacaauuuuguuuuacuuuuguuugaaacggugaucugaaucagaagcuucuuugguauuccaccugggcagucuucucuuaugguuagucuugaaaggcuggaucagugaaauuaaaucugccuuuggaugugagcuuuuagugaaauggugucugaaguuccauuuuguguuuaaccucaacugaggcuacccuguagucuguaaugacauagcaugucucauuaaucacuaauagguguuggaaauaccccuuggcaugaagugagcagauaaugcugcuuacauugucacuauauuagcucccuucagagaugagcuuuaggaucuaacuagaucuugucugauucucuccuaucuuugcuguuuugaaauccaugccuucuauagauuacaauuaacugaggcaugaauuuucuacccuugcagauuccacccugauucaaauagggccauugucugcugaagccauugugauuuuaugcagaaugcuaggcaguccuuuccucugucagaaagaacaauuuauauguaauaauaagucucauuaugcuuggaagcuuauuuuccuuguugcacaauugaaccaaccugcucaugaaagcuccaugacccuuuaccuagaugacagucaaauauaguuaggcaaauaaguuuccuuuugguuugucauugaguaaaccuuugcaaccuguaauguuuagcaagugacuacuucuguauaguaauuuuccuuuuaguugagaauuuauucaagcaccaaacauaaaaaagaauaaaagugaaauaagcuuucuuuugcauaagggacuuucuauaauuugcuacuuuuuaucuucuuuuuuuuuuuuuugagguggaguuuugcucuugucgcccaggcuggagugcaguggcgugaucucggcucacugcaaccuccaccucccagguucaagcgauuuucccacuucagccucccgauaagcugagauuacaggugcguaccaccaugccuggcuaauuuuuuuuuuuuuuuuuuagauggagucuugcucuaucgcccaggcuggagugcaguggcgcgaucuugacucacugcaagcucugccucccggguucacgccauuguccugccucagccucuggaguagcugggacuacaggugcccgccaccaugcccagcuaguuguuuuuuuuuuuuuuuuuuuaguggagacgguguuucaccguguuagccaggaugauuuugaucuccugaccuugugauccacucgccuuggccucccaaagugcugggauuacaggcgugagccaccgcgcccggccaugccuggcuaauuuuuauauuuuuauuuuauuuuauuuuugaagcagagucucgcucuguuacucaggcuggagugcagugacccaaucucaguucacugcaaccucugccucccggguucaagugauuguucagccucagccucccaaguagcugggauuacaggcaugugccaccaugccagacuaauuuuuuuuuauuuuuaguagagacaguguuucaccauguuagccaggcugaucuugaacuccugaucucaggugauccaccugccuuggccucccaaaguguugggauuacaggugugagucacugcgccggccuaauuuuuguauuuuuaguagagaugggauuucaccauguuggccagccuagccucaaacuccugacuucaggugauuggcccaccuuggccucccaaagugcugggauuacaggccugagccacggugccugguuuaguaugcauucuugacuggggaaaauugcagugguaagugugcacuauauagauauauugauaaugaucaugauggcuuuggauuaucuuuugaaauuggaggauuucaaaaaauagauuugcauauggaaaugugcauuuuuguugguuuuuugagauggagucuugcuucauugccuaggcuggagugcaguggugcacucagggcucacugcagccucaaucuucuggucucaagcaguccucccaucucagccuuccaaguagcugagacuacaggugcaugccaucaugccuagcuaguuuuaaacuuuuuggagagauggggucuuccucuguuuccuaggcuggccuugaacuccugggcucaagcaguucugucuuggccucccaaaguguugggauuacaggcgugagccaccacaccuggccaaaacaugaauguuuguaugaaucucagcuaucacuguguaaaaguauuugagauccaaaugacugcuguauuucuccccucucucucucucuucuuucuuugcuaaguugaugaugguuauuuuuuagcauugucuuuaugucugacucuaacagcuccuuuuuccguucuuauauuuagcuuuuuuuauguguguuuuaaaauuuuuuuuuuguuuuugagacggagucucacucugucauccaggcuggagugcaguggugugaucucggcucacugcaagcuccgccuccugaauucaugccagucuccugccucagccucccgaguagcugagacuacaggcgcccgccaccaugccuggcuaauuauuuuguauuuuuaguagagacgggguuucacuguguuagccaggauggucucgaucuccugacuucgggaucugccacccucggccucccaaagugcugggauuauaggcgugaguccacaugcccggcccuuaaauuuuuaaauuuuauuuuaauagagacagggucuugccauguugcccaggcuggucucaaacaccugagcucaagcgauccaccugccucggccucccaaagugcugggguuacaagcaugagccaucacaccuggccuuuauuuuuuacuucugcuuugggcuagaaaacugaacacccugggccaggugcgguggcucacgccuguaaucgcagcacuuugggaggccgaggugggcggaucacgaggucaggagaucgagaccagccuggcuaacauggugagacccaucucuacuaaaaauacaaaaaauuagccgggcaugguggcaugcaccuguaaucccagcuacucgggaggcugaggcaggagaaucgcuugaacccgggaggcggagguugcagugagcggagaucacgccauugcacuccagccugggcaacagagcgagacucugucucaaaaaaaaaaaaaaaaacuagacacccugcuucucagaauaggggauagggaauuuggaaacaaaacaaaaacuagacacccaaacuuacaaaaauuguucaacauagaaaacuucuuggcucaggugaggccccuauugguaaaaggcaugggcuauguuagaaggucuuugguauuugggcugcucagaggccuuuuucaguucccauucaugccagucuuugaauagcugagauauuagaacaacugagcucuagacuggaaaguuguuaguauaauauacuaucuaugaaaagaaccugagcuguuaaaauaccagaaaauaaacuagagcucaugauuuauuucuggaaucaaucagacaaugaacagcaauuuuuuauugccuguuaagccauaguagcagugagaaacugaaacaagcaaaaacacuuaguguuguaagaauguauaaaagcaucucaagguaagaaauucuguguuacuacugacaacuaccauuuaaguugaggaaccucuagauaaaucagaccgcagaauuugagaauuaaacucaaauucuguaauguaaaguucacuucuaaaaaugauuaugauuuggacuuauuagagauaaugugcuuuuuucauauucugcaauuuaauaugccacuauuuauguacccaaugccuuuugguaaaauuuuccauaaaauuguauuugggucaccaagcauaugccaacgacauuuacgaauaaagugguagguauaaagggaaagaaaacacagguuugaaaaucagucuuaugugaucggacgauauguaauguacaguuccuuuuaaaaagcauuauugccgggcgcgguggcucacgccuguaaucccagcacuuugggaggccgaggcgggcggaucacgaggucaggagaucgagaccauccuggcuaacacgaugaaaccccgucucuacuaaaaauacaaaaaauuagccgggcgagguggcgggcgccuguagucccagcuacuugggaggcugaggcaggagaauggcgugaacccuggaggcggagcuugcagugagccgagauugcgccacugcacuccagccuggacgacagcgagacuccgucucaaaaaaaaaaaaaaaaggcauuaugagguugggugugguggcucaugccuguaaucccagcacuuugggaggcugagguggguggagcaccugaggucagguguucgagaccagccuggacaacuuggcaaaacccugccauuucuacuaaaaauaaaaauaaaaaaauuagccaggcgugguagcgggcaccuguaaccccagcuacucaggagucugaggcaggagaauugcuugaacccgggaggcggagguugcagggagccgacaucacgccacugcacuccauccugggggacaggguaagacuccaucucaaaaaaaaaccugaacaaacaaagccuaaacauuaugagauauucauauuacucucaucagggaauaauugggacuggaaaaggaaaguucugcugucucuuauaaaugugucucugcaaaauauucuucacccagcuuccaggcaauugugucuuuuuuuuuuuucccagaggagucucacucuguggcccaggcuggagggcaguggugcgaucuuggcucacugcaaccucugccuccugcauucaagccauuuuugugccacagccucccaaguagcugggauuacaggccugcgccaccaugccuggcuaauuuuuguauuauuuauuuauuuucuuugagacggagucucgcucuuuugccaggcuggagugcaguggcgcgauccugagucacugcaaccuccaccucccagguucaagcgauucuccugcuucagccugccaaguagcugggacuacaggugugccaucacgcccagcuaauuuuuguauuuuuaguagagauggguuuccccauguuggccaggguggucucaaucucuuuuuuuuuuuuuuuuugugacggagucucacucugucacccaggcuggagugcaguggugcgaucucugcucacugcaagcuccgucucccggguucacaccauucugccucagccucccaaguagcugggacuacaggcccccgccaucacgccuggcuaauuuuuuguacauuuaguagagacggaguuucaccguguuagccaggauggucucgaucuccugaccucgugauccacccgccucggccucccaaagugcugggauuacaggcgugcgccaccaugccuggcagucucaaucucuuaaccucguaauuucccaccucggccuuccaaagugcugggauuacaggcaugagccaccaugcccagccuaauuuuuguauuuuuaguagagaugggguuucaucauguuggccaggcuggucuugaacuccgggucucagguggucugcccgccucggccucccaaaguguugggauuacaggccaugagccaccaugucuggccgcuugugucuuuugaagacucuacugcaugcugccucaaaccaugacgucaugccuucagucuucccuacuuguaaauuauagguuuccccaaaacuugagcaguaugucuucaguuucagagaaaagaccuacccuacuaaauuauuauuauuuuuuauuuuccagaguuuauuaaccacuuaaccucucagaacugaacaaagacaacauuguuccuggaacgcccucuuuuuaaaaaagguacauauaauuuggcuuuauaauuucuggccuguugauaaucagugguacuuuugaauucuuuaaugaguuguguggagaaugauuuuuacuucuggcuauaauauuagagaaacaaauuuuaugcaguuugaauuucaucuuuacucuugauuuaauuagaaaguaaguacaggaaaaguuauuggcaagaauguaaagccuauguucuuuaaauauagagacaugagaauugaugacugaagcugucauuaaacaugacuggcucaauaagcuucuuggucauaguaucuuuuguaguuugcuuuuuuuaaaaaaacccuuugauuucucagauuguuuauguuaaacaugauuuucaaacucauagaacgaauuuagcauuguuuucuauugugagauaggguuacgaaucaagcuucguugaccacuagcagcuugugaacauucagauaaaaaaggaguuuucuaagaguguucaagauuuucuggucuuuugucagggcaaugcaaaauacacuauguggguuaauacugcuuccugcuuuuaacacuuucccucuagaagcugaaagcacauugcuguaccauaucucugagguaguaauuaguagacaaguuaaccuacuuugaggaugaggaaauggaagcauaaggaaauuauugaaguuguacaaagcucagugaaugguuuuaaacucaccacacuggauuuguauaaugcuuuucuuuucuuucuuucugaaacggaguuucgcucuuguugcccagguuggagugcaauggcgccauguuggcucaccucggccuccuggguucaagcaguucuccugccucagccucccaaguagcugggauuacaggcgugugccaccacaccuggcuaauuuuguauuuuuaguagagacaggguuucaccguguuggucaggcuggucucgaacuccugacaugaggugauccacccaccuuggccucccaaaguguugggauuacaggcgugagccacugugcccggccuaaugcuuuucuuuuuaaagaauuguauuaucggcugggcgcaguggcucacgccuguaaucccagcacuuugggaggccaaggugggcggaucaagaggucaggagaucgagacccuccuggcuaacacggugaaaccccgucuuuacuaaaaauacaaaaaacauuagccagguguuggggggcgggagaauggcgugaacccgggaggcagagcuugcagugagccgagauuguuucacugcacucuagccugggcaacacagcgagacuccaucucaaaaaaaaaaaaaauguauuaucaugccucaggauuccuuuaguguuuugacucagugauugcuacaagugaggcuuugucaaauauccuauuauaaaguguuuuggggaaacugaggcacaggggaguggauugccaagagcugggaguggaauugaaagcuacaucucagaaguuugaucugauuuaacauuguugguugcuacuuagcagcaagggugguuucuuagaaacugagucuuggcacuggucuguuuugcaugaagauggugguaaaugcagucguguuucuagguagauggcacaugguuacagauuacaguuucccuuuucugaaaggaaaagccuguuaaccauuauguugaaccaagccccuucauagucaagaaaauaucacacagaacuacuuuuaaaagucuccagcagaucaugaacagguauucauuuuuauuguguuaaaaguuuucuauguuuguauaaguuuagauuaaaaacuguuuacaaauguaugugcuugaauuuuguuauuuuugagaaugucuccuagagaaggagagacggaagcuugauaaaguuuuaaaacuagaaaagaaaauaaggcuuauaguuuuuuaggcuauagagguaaauuguuuuucacuuuagcauggugugauggguuuucuaggaugaaaauaaugaaaaucucuuuuaggaaguguuucuuuaagcagaccaucugaccucccaacuguuacauuuguguggaaagaaaguccuccauugcccauggcauugggccaagugugagacagggaccacauucagucucacuuguauugcaagugcaaagauccugaacagccuggguuguuuccaggcauuauuuuugguuaauuuuacugucuugcaagugagugugccuccucagggcuaaucucugucuuugucuugagcaucagguacuuagugauuuguuucuuuuuuuuuuuuuuuuuaaaguaguuuggucauauuucuuuucaaaaacguuuuauuauugggugauuuaguauauauaggccugcuauuggacauuauuugcuugacauugaccuuaaagcggucauuuuggaaaugauccuauaagacgauagugauugacaugcuucuguacuagcgucugcccugccugcagguauuuggauaauguuuggagucaaugaauuacuauuuuggggggcugggagggagaaguaaugguggagagugaguuuacuuucagaaaacauucaaccauauugcagcaagaaagaugugucagaaaagaaucuuagaaauaacugguauaggcugggugcgguggcucacgcuuguaaucccagcacuucgggaggccgaggcaggcggaucacaaggucaggagauagagaccacggugaaaccccgucucuacuaaaaauacaaaaaaaaaauuagccgggcgugguggcgggcaccuguagucccagcuacuuggagaggcugaggcaggagaauggugugaaccuggcaggcggaacuugcagugagcugagaucgugccacugcacuccagccugggcaacagagcgagacuccgucucaauaaaaauaaauaaauaaauaacugguauaaggaaugauguggguauuuuagguguauuuaaaggcuauugaaaaggacuuuauuuuguagaaaaagugguuuauuccuugauguuuuuuaauugaccaaguuucucugggaguggagccucucaacaaacuaaagagaacagaauaauagauuuacaugugauugcugaaagaugucgucuugugucuuugaggaagaguuuaacacacagauccuuuccagcauuuaagaaugugcaaucugccauuuauggguucacauguaauagaugcuuaauaaguuuuuguagacuauugagugaauauauuuuagaauugcuauugcuuuauaacagcgaggcacaggagugcuccuuuguaucuguauauccaucuuacaucagauuuaccaaaggacuugcaaggggagacauuuagugaaauguuugugaugaucugaaaaggaggcuucuccagaauugggaugacuucuuuccuucuuuuuuuuuuuuuuuuucccagacacaucuuguuuggaaauaucacuuauuaugaaggagacugauauguugauuaaacaaaaguauagcuacugcauuauaaguuguguuaauccgguuuaaaaauuacuuauuaaaaauguuuuucuggcugggcacgguggcucaugucuauaaucccagcacuuuguugaggccaagacaggcggaucacuugaggccaggaguuaaagaccagccugaccaacauggugaaaccccauuucuacuaaaaacacaaaauaauuagccagguguggugguacacaccuguaguucccgcuacucgggaggcugacacaggagaaucacuugaaccugggaggcagagguuacggugagccaagaucgugccacugcacuccaaccuggacgacagagugagacugucuccagaaaaaaaauguuuuuccauaauugcuuaaguauuucauaguacaaagauuuaacagucuguaaguugaaaguggauaagacuaaccauguauuaguagcacaagauaauuaaaagacuaagcacgauugcagauaguucuguaaaccauuucuagaagggucugccuucuuguauauuaaaucacucggacugugcucaguauggucuagucuugguagguucacugcugagugcugaauacacauuuugugaccacuuuuuaguacaucauguauaauuuaaaaaaaacuuucguagcgcucaugugcccagauucuccuucaccacaacccauagaaacuauuuggcacuuguaaaacgguaacugccagccaaagcaagauucuguuuuuaugagaagauuuuuguguuaccaagccaaucuuaagaaccaggaggacauggaauuaaggaaucuuuuaaaagaaacaccuauaacucuaucauuuugcagcuuguauuauggugcuuauguaugcuauguaaaauuagggcuugagccuaagaugaguauguuuuguugaucuggugucuaaagcccuucaaauagggaaagaaccaggagaugaaagguccucaucugugugggaggcagaaaggcaggaaaauggcagcacaacacaauucacaguaagagguguuuuccagcaccagcgagaucugaagaaucuuugcguuucaaacuucucaaccuaauuuuacuguguauaaaauaguguuugucucuaagaagacucuaacaaaacauuuugaucucucaaguccuuaauuuaccugguggaaaacaauccuuaaagacagguuuaaaggaaaagacuuauuugcauuuaaggacuuagucuucaggacaguacuguugagcaacagguuuagaauuuacacagaaguucuauuuccaaaguuccacaguuccuugaaggcugcuaugaacuauaucuauaucaguaaugaaaaacuuaauuuguuccuugaguuaugugggcaaaugauauauuuucccccauucaucacugugaugucuguuccggcuucucuuugggagaggagcaucuguuugggugcuaaaacauuagcaucaggccaggcgcaguggcucaugccuguaauccuagcacuuagggaggcugaggcaggaggaucacuugagaucaggaguucaagaucagccuggccagcauggugaaacgcugucucuacuaaaaauacaaaauuagccggguguggugguacacgccuguaauccuaaguacucgggagacuaaggcaggaaaaucgcuugaacccagaaggcggaguuugcagugagcggagaucacaccacugcacuccacccuaggcaacagagcgagacugucucaaaaaaaaaaaaaaaauuagcaucuauuuuuuagggccuuucgagauagaaaggggauuuucuuuuccugucuaagaauauaagcuacuuguuacauuaguaagauuguauuguguggguuaguauaugugugcuuguaacaguaucccuggcuccucuauccacuaaauaucaguagguuccccauucugcacacugguugugacaaccaaaaaaugucuccagacauuggcagaugucuccugggggaacaaaauugcucccuuuugagaaucacuaccuuagaugcucuguucaggcuuaaauaagacacauaaaaauuuuaaacuagcaggugacuaauaauuugugaguauuguuuguugcauuuucauauuuaucauguuggaaauuuaaauuuaccuagucuuauuuggagaguuuaacuuuuuuuuuuugguuuguuuuguuuugaacuacauauuucaaccaacuguuagauguuaaguccuuuaagugaauuuaaggguaacauuuuugaggcagucuuaauuuaaaaagccuauuccuuucucagcuucuagaaaacuuacauauuuaugacugacuugagcagagugcggugccucacacuuguaaucccaggacuuugggaggcugaagugggcagaucaccugaggucaggaguuugagagcagccuggccaaccuggcgaaaugcugucucugcuaaaaauacaaaaacuagccaggcaugguggcucaugccuguaauccuagcuacuugggagacugaggcaggaaaauugcuugagcccaggaggcagagguugcagugagcuaaguuugcaacacugcacuccagccugggcgacaaagcucugucucggaaaaaaaaaaaaaaaauuaaaaauuuaucacugacuugaaauccuggcagucagccugcuuuagagaacauuaaccaaaaaucccuugguccacacccuuucuaaauuuaggcauucauucagagucuuaaacucuaagagccacucaggacacaguuggguugcucuuucugggauggggguagauucuggagcagauacuuuacuccuagcucauuuuuugaccuugagaccugugguugguguugugaagucguacauacacaagugacuuuuuuguuuuaaaaagugcucucaagauaguuuacaaaaagcaggaaaaggaggagugagugaauaaaugaagagaggggaagagaggaggaaaaaaguguuucuauuuuagcagcugacggaaaaaaaacccaaugaaauaaggucauagcugacuucugaaugguucuggacuuguuucuugacacuggcgacuugucuucuaagaccauuauguagaucuucaauggaacgccucuguuauuuuguucugauucugaaaguaaaaaggaacaacugcacucuuggggaauuuuguugaauaagguaauacuuaugccucugcuauccagagucacauuucgcuugaguuucuuuugaguuuugcaguccuuuuugcucucaguaagagagaauguguuaggacuccucaaguagcuuaauugcucuggucauucaucucuuucuugaggaccagcuuuaaaaaucauuuugauacuuaaaaaaaauuaaaguaacuguuucuuuauaauagaacuucuaauuaguugguuugcugguuucugcauugguuggcuauuuccugagagaccugucauuucuguucuuuguugccacugguuauuuuuaaguacuuugacucauuaaaaacauuuucagcuuuuaaaggauggccaugaaaaugaacacaacuguccuuauuuuugucucgugaagaaauuuaauguauuuagaaguaaugccuucauuauucucuuaauuuacaauaugaaguaaacaagcuccagugcucccccacccaaccacaccaguaaaauugccagucuaaaauccauuccugucuucuucaucuccacuuuugcuuuuaauaguauaaauucucuaguauggucuuuguuacucacaucacuucucaggaucugugagccuggguaggguugugauaguuuccuuguuuggguucuauaauuaaaugagaccucaaacaagccuuuuaggaaaacaauacaucucucaucaccauaaagaaaaagaaacagcagaaguauccuaccuuccuucugucaacuuaaggcccuaagguugucagucugagccuugguccuuaagaggaagcaguguucacauucaccuguuccugguaugauaaaccuaguuugcuuucaguuucuuguaauuuugagaccagaaagaaaccuuacugugccccaauuacuauggaaaccucuccauacuuucaaauuugcauuuuugaauguaagcuauaguuugcaauucuuaauacucaccaauaaauauuauacccuacugauucucuuuguauaaugaauaugcagagcacacagguauuguaaaucacuuaaaaaacacugugggaaagucacaaggccaagaaacuuacuguauaccaaggagaaacauauuucgaauaaaucaacauagcuacaugcuaaauggagcuauuuucauaagucaguaggugacaccauuuugacugaauauuggcaauuacauaucuccucuauaauuuaccuuuuuauuuucuuucccuuacaacuuuuagguagaacuuuagacuucauagcacugaauuaaccugcacugaaagcuguuuaccugcauuuguucacuuuuguugaaagugaccaugucucaaguucaagugcaaguucagaacccaucugcugcucucucagggagccaaauacugaacaagaaccagucucuucucucacagccuuugaugaguauuccuucuacuacuagcucucugcccucugaaaaugcagguagacccauucaaaacucugcuuuacccucugcaucuauuacauccaccagugcagcugcagguaagcauaugaauccaagugucuucuauuucaaauguuuucuuacccuguuuucugaucugauagguugcagauuuagggagcucucacauuuaccuucaaaaagcaaaagaaaguaucaccacccacacuucuuuaucccagauauagaacacugguuguguaagggguugacaggggccucaguugacagacgauuguagguugugagaaagagaauugaaagcugaaaacuacucacacuauaaagccucaucuguuaaagagcgguggcuggcagaaagaauugagcaguaaauaccaccuuggauauucaucguuguaugggauaauucugcauuuaaaauuauuucccagaacaagccaggugccguggcucacgccuguaaucccagcacuuugggagguugaggcagguggaucagcagaggucaggaguuugagaccagccuggccaacauggugaaacccugccucuacaaaaaauacacaaacuagcugggcuuggugaugcacgcccauaacagcuacucaggaggcugaggcaggauaauugccugaacccuggagguggagguugcagugagcugagacugugccacuucacuccagccugggcaagagggagacacugucucaaaaaaagaaaaaauaggccgggcgcgguggcucacgccuguaaucccagcacuuugggaggccaaggcgggcagaucacgaggucaugaguucgagaccagccuggccaauauggugagacuccgucucuacuaaaaauacaaaaaauagcugggcaugguggugcgugccuguagucccagcuauucgggaggcugauauagaagaaucacuugaacccaggaggcagagguuguagugagcugagaucauggcacugcacuccagccugggcaacaaggcaagacuccgucucaaaaauaaauaaaaaauaaauaaauaaaauucccacaacugacgaagagcucuuaaaucuacauaagccuucuuuuugaauguccguaagauuuuaucccaagcaagggggcagccagauuuacuagaaagcaaaaaaguacauugacauuuauuuauuuuuauuuuuguuuugaacaaguaaguuuaagucuggaagguuccagaaguaguuuagaaaucauaaugaggaucaauuagaaauggaauaaagaagcagaguuuuuuuucucuucuuuccuuucuuaucucucguuuguuucacggggucucuauugccuaggcuggaguacgguagugugagauuaugguucacugcagcaucaaccuccugggcucaaguggauccuccugccucagccuccugaauagcuggauuauaggugugagcuacaaugcccaaauuuauuuucuuguuaaaauuuucugcgucauggccaggcguggugguucacaccuguaaucccaguacuuugggaggccgaguggggagauugcuugagcccaggaguuggagaccagccugggcaacauggugaaaucccaucuauacaaaaaaaaaaauacaaaaauuggcugagcuguggucccagcuacuccagaggcugaggcaggagggucacuugaguccaggaggucgaggcugccaugagcuguaauuauaccacuguauuccauccagccugggagacagagcgagacccugucucaaaagaaaaaaagucuccuucuuggcuggcaaggugguucacaccuguaauuucaguguuuugggaugccuauuuauuuauuuaugagacagagucucacuuuguugcuuaggcuggagugcaguggugugaucuuggcucacugcaaccucuggcuccuggguucaagcgauucuccugccucagccucccgaguagcugggauuacaggugccugccacuacgcucggcuguuuuguauuuuuaguagagaugggguuucacuguguugcccaggcucaucuccaacuccugaucucaagugaucagcuugccuuggccucccaaauugcuggaauuacaggugugagucauugugccaggcugcgaggccaauuuaaaaauuagcugggcuugauggugugcaccuguugucccagcuacuugggaggcugaggcaggaggauugcuugagcccagaaguuugaggcugcaaugaacugugaucgugcugucuuacuccagccugggcaacagacugagacugacucaaaacaaaaaguauagaaacauucaaaucugauaauuaggaaaaugaacuaaagguaccuugccgguugcaguggcucaugcccauaaucccagcacuugggaggccaaggcagguggaucaccugaggucuggaguuugagaccagccuggccaacauggugaaacccugucucuauuaaaaauacaaaaauuagccagguguagcggugugugccuauauucccagcuacuugggagggugaggcaggaaaaucgcuugaaccugggaggcagaggcugcagcaagccaagaucaugucaccgcacuccagucugggcaacagagcgagauuccaucucaaaaaaaaaaaaaaaaaaaaaaaagguuuaaacacuugaaaaauaccuaaaaauauuauagacaagaaacuaaggcuaaagaaagaaaaccuaaaaccaauauucuuaugaauaggagacagggucugacuagaaaaaaaaagggaguggggauaauaaauaaaaacaauauucugcuucccaacacccucccugcaacauggcaagaccagugaaauaaauggggugucagugucaauuuuuuuuuuuuuuugaaauggagucucgcucugucgccgggcuagagugcaguggcacaaucuuggcucacugcaacuuccuccucccggguucaagcaauucuccugccucagccuccugaguagcugggacuauaggcacacgccaccaugcccagcuaauuuuuguauuuuuaguagagaugggguuucaccauguuggccaggaugguuucaaucucuugaccucgugauccgccuaccuuggccuccuaaagugcugggauuauaggcgugagccaccacauccagccuaguauguggguauuucuauaccagaguuaccuuauaacaaagucuuuucauccccuuccuugugccuguuuccuuucaguuuccuccuuugucuucucauuuccuuuacuuuauaaaucuguuuuuuuuuuuuuugagacggagucucgcucugucgcccaggcuggagugcaguggcauggucucggcucacugcaagcucugccucccggguucacgccauucuccugccucagucuccugaguagcugggacuacaggcgcccgccaccaugcccggcuaauuuuuuugguauuuuuaguagagaugggguuucaccuuguuagccaggaugguuuugaucuucugaccucgugauccgccugccucggccucccaaaguguugggauuacaggcgugagccaccaugucuggccuauaaaucuguucuuagaguguuugcuucucccacucagcugcguggcaucuuccaugccacccccacaauuccuuggacugguucaccagauagcauucuugauuuuuuguaguccuggagagauguuauuuuccccauauuugccaugugagacucucuuaaaaggaaaaggcacagacuguuuccguccucugggauuuauugcuuuuucuucuaaugaauucugguguccaaauccuauugacuuuguaaaacuccugcccaccaacaucauuuuauuuuauuuauauaauuguuagaaauagauaaggucugaggauggcagccuuuggagaaaagacuagaggaugcccaggaaugagaguuucacuguauggaagaugacaaguguuguuugagagaugguaguggcauguugaguuuagcgaaauaaugggcgggguacagcuggcggcuguuucaguaaccagugucugcucagaagaccuuguauuccaguugguuuuaauagcagugauucaucugauuucaaaucuugcuugccugccauggguuaguuacuccccugacuucacucucuuuugaagacacacccucuccuagauuaccuggcuucaacugguucagaaaagacccuaguugcgucuucucugggaguguacuccuggaaugauuugcaguuuuguaucauggcugccuacauuuguagaccuuccauuuguuuuuccucuauuuucauaucccuaggagaauaguagucuuauauacugcuaguugacuucagugcucuuaacguuuucacuuccuucucauguggcgaaccccauagagaaaaaucccaguugugucuugugaaugaguuaguuuguuucagcaagauccagcuugaguauaggcuuuugugugagcaagguccagcucacuguaagguaaauauuguccauacugcuugugcauuuauaacccaccuggaauguucucuauuuuuuauacucuugaaaguggugcuguaauucaaaauacauguuuucaaacugaugagguugucuuaaacaaaaacuauacuuagacaagauuauagauuuuugaaguugcuucuuuuuucauccuugccaaugggucaaagaaaauauguguugcuuuuuggaauauuuggguuuuaguuuuuuuagagucuuucuuugccgccuaggcuggagugaguggugugaucaugucucacugcagccucgaccucccaggcuuaagcaauccucccaccuuggccuccugaguagcugggaccucaggugcaugccaccacgcccagcuaguuuuuuuuuuuuuuaauucuuuguggagaugaagucucacuauguugcccaggcuuguuuugaguugcugggcucaaacaaucugccugccuuggccucccaaaaugcugggauuacagguguuagccaccccgccuggccauauuuugcuuuuaaaacuccaaauaguguaugguuguuugggauucugaacagagacaauucucaagcaccugugauugauugcccguaaguuuuccagcuuugggccaccucuugucugcagcuuacuucuggcuccucuccugcuuguuugcacaaggaccuuagggcagggagaagaggugaugggaaaacaguuuuuucacuuguuagcaaucugggcaaaagguuugaagaugcaauugccuggcuaauuuugcauuuuaguagagacgggguuucaccauguagucucaaagugaguauuuuguauugucuuugguuucaguuauccuugucauuccccuuaucuuagagaaugaaagucugacuauaauuuuaaaauuugcuaaucauuauucaagaauucagucuuuuuagaacauggaaaggaaaaaaauaauucagucuuugaaacuuguuuguuaucuguauuaacagcacauucuggaacuuaauucuugcauaucuggaguuaacuuuuuucccaaccaucuaaggacacggagauacggaguugucuuuugcagcuguagcguaagaugauauaguaugagagauaaggaauugacgcugucuguuucugauccuaaccuugcagcaaagauaauauaauuaaggaugaguuauuuaucucauuuugccucauuuuccuucacacgcaaaccucaagccuugaauaaaaucaaguguuucuuuucauuugacugaaaguaacauaaggcacaaacaugaauagucaccguagcauaauacgguucaguugccuuugaagucagacacaucuagguuugagucucagcuuguuacuagcugugugaucuugugcaaguuacuacuuuuuuguugucguuguuuccucauguguaaaacagggauaauacccaccaaauagguuuauugugagaauuaaaugagagcauauauguuaaccuguggagcacaaugccuaguaaaugcuugagaaaugguagcuguaauucuggcuacuuggguagcugaggcaggauuaagcauuuaauuaagcauuuaagaaaaacaguauuuaccacucacacaaaacuagcuuaaaaauguuguuuuaaaacauaauucuauuugaaaugugucuuuauagacacauuuaggcaacuagggacugggagcaguggcucaugcuuguauucacagcacuuuggaaggccaaggccgacagaucacuugaggucaggaguuugagaccagacuggccaacauggugaaacccuguaucuaccaagaaacacaaaaauuagcuggaugugguggugcgcaccuguagucccagcuacucaggaggcugaggcaggagaaucaccugaaccugggaggugggggcugugaugagcugagauggcaccacugcauuccagccugggugacagagugagacccuuuaucaaaaaauaauuaauuaaaauaaaaauagaagucagucauuuuucuauaacuguuguauuuccucuccaggauuuuuuugcagaccuuaacuucgggauucccuuuauuaacuuuuuauuauauuuuggcuaaugcacuuucucacuugaacuuuuaauaauuuagguaguuuggcuguguguucaucucuaaccgcauauuuucuuuuuacccacaaguuguucaaagaggagaaguuguucucucuugggugauuuagauuauuugaaaaaucaagagaugugguauacuuuugguucuaucaaaaccaagauucuagccuugcuacaccaacagaaugcagcagaguggcagguagcaccggauggggaaaguccuagagaaaggcaagacgguucacgagaauaacuuuguguguuuuuuuuuuuuuagcuuuuuccccuucagcauuuauccaugagacaaucaccaagaugacccagggauuguacugcguugcaggcuucugccauuugaccuuccugccugccaggguuuugaguucaugcuguuguuuguacuuaaaugaguagccugauggacugcagaacauauaauaaaggagaccccugauguccugaugugugaagugucaagggggguaaaggauuauuuauuuauuuauuuauuuauuuuugagauggagucucauucuguggcccaggcuggagugcaguggcgcgaucugcugggauuacaggcaugagccaccgcgcccggcuuuuuuuuauuuugaaauggagucucuguugcccauacuggagugcaguggugcaaucuuggcucacugcaaccucugccucccggguucaagugauucuccugccucagcuacccaaguagcuggaauuacaggugcaugccaccacgccuggcuaauuuuugcauuuuuaguagagaugggguuucacuauguaggccaggcuggucucgaacuccugaccucaagugaucugccugccuuggccucccaaagugcuaggauuacaggcaugagccacugcaccuggccaauaaaggauucuuuguuuuuuuccuuuaguggaagccgugcacugagggaauccuaaaaguaagaccuacaagaaaaaucagcuaugaaggcaaguugccucaccccuuaaggcaccaaauuuaaaugaccuagacauacugaaauccagguuucccuuguaaauuauuuguaagugagauaaagugauauucagugauuacaucagaagaauaaaagcuucaauuaauuuuuucuuuuuuugagacggaguuuuacucugucaucacccaggcuggagugccauagcguguucucggcucacugcaaccgcaaccucccggguucaagugauucucuugccucagccuccugaguagcugggauuacagacacguacuaccacacguggcuaauuuuuguauuuuuaguagaggcagggucucaccauguuggccaggcgggucuugaacuccugaccucaggugaucugcccgccucugccucccaaagugcugggauuacaguugugagccaccacacccggccgcuucaauugauuuguuaaauuccaaaguagugaaucucaaaucuuuggggugcaucagaauuacuuugagaacuuaauaaaaauagaaacgcucaugccuuaaauccuaucacuuuggaaggcugaggcgagaggaucacuggagcccaggaguuuaagaccagccuaggcaacauagggagacccugccuccgcaaaaauuaaaaaauuacccagguaugggccgggcaugguggcucacgccuguaaucccagcacuuugagaguccaaggcgggcaguucacaaggucaagagaccaagaccauccuggccaacauggugaaaccccaucccuacuaaaaauucaaaaauuagcugggcgugguggugcaugccuguagucccagcuacucaggaggcugaggcaggagaaucgcuugaaccugggaggcggagguugcagugagcugagaucaugccacuacacuccagccuggcgacagagcaagacugucucaaaaaaauaaaaaaaaaaaauuagccaaguaugguggugugugccuguagucccagcuacucaggagguugaggugggaggauuauuucaacccaggaggcugcagugagcuaugauugugccauuugagcuccagccuggacagcagagcaagaccccauuucaaaaacugaaaaaaagggugguuauguuuucaaacaagagcccacaaacacauugcagcaucaaaacaaacauugucuuaauuugugugaaguacugcuguguguuuaaaucaaguuugcaaaauaucuuucaugagaaguaauuggaagagaauuuugaggcuggacguggugggucaugccuguaaucccagcacuuugggagacugaggcagguggaucacuugaggucaggaguucgagaccagccuggccaacauggugaaacccugucucuacuaaaaguacagaaauuagccgggcaugguggcaggugccuguaaucccagcuacucgggagacugaggcaggagaauuucuugaacccaggagguggagguugcauugagccaagaucacaccacugcacucuaaccuggggacagagugagacugugucucuuaaaaaaaaaaaaaaauuucagugcauacacacacaaucucuuuuuuuuguuguuguuuauaaaaaacaacaaaaaaggauaagaaggggaugacaggaugaauuaucaagauaagaccaggccucuuaaaccaugaccauagaaaguguucaagguucaagugacauauuacagucaaugucagguuucaugaauuugagagcucacacuuuucauuucuaggaauuuacaguacugcugacacuuggaaaucagcaauggggagcugagugaacugguauuaaaaaggucaaacacacagcugcugcuaaagcuuuggagggaacaaaauuuccuaagcccauagucagcccuuuugguagcgaaggaaggaauccaggucuuaugcaugggccaaacagguaccuuucaaaagugugucuagagguaccauguaguauguauaugaaugguuucuuaacuuguugauuuugaaagcacagauucuacacuaccagugacaaaugcuuauuuuuuaggaauccuuaaccucauuguaaagcagugguuuccaaucuaugaugccuuaacgccugacaaucuggaaaggcggucauaggaaggauggcgggugaccagauaauuucaaagauuuccgaaguuuaaugaaaauauauuuuugauaagaguguauagauuagcaagaauauaaguuuaauuuagagucacaucaagucagugugguaauauugauuguaauuuuguuggucagaagugcuuauugccaguuguaugucucuuaguuauuaaaaagaaugagaaaaauguaaauauuacuuaaauacaagccagcagguaguaucuccucagacaaggagcccauucagggagcauacuaaucaagaaggcauggcuggugaaggguuggggaucagugaccuggaggcugugucauuaauggcuguuuuagcagagacccccucacaugcaugaagucaucccaggucuucguauguaggaaggaaucugggaaguuaccagucacaucuuucuuguuacuuuugauuucuuugcaguauacuuucuucauguuuauucucuauugcagacaaauucuguggaucagagcugcucuuaaaaugauucagacuguacuuaaaaugcaauuauaugaauuuuguaaaaaauauaauucuaaugcaaggaagagagagaucuguaauucauguggcccucugugcaaaccccaaagauauucuuauagauuugauucaugcauuaaauuuaguugaaccaguuauaguacagaaucaggucuuuuuuauuucucucuauauacauccuaaagaggcauuuuaaaguggauuuuuaugugcauuuagauuuugccauuucuaguguucuguuuuugauaugaaaguguuguuuuuaaauauugugcacugacacuaaucuuuccaggcugguuuucuuuuuaaaugguuuuuaaagguuuauggauuggaugaacugaaagaaaaaaaaauuggaaaaugaauagcauguauuuucugaaguugauaauuuugagauaacuuguuguguaugaaaauggaacucauuuucguagcaaguaugaccacaggucaaauucauuagaaaugucaagaauggaaauaccugaauauuuugugggccuugugugacuucugugaagagaauuggguugccaccuccucacugauuuuucaccuuuaaguugcacaucauguuguauuguaacucuuugagugugcuuuguguuuuuugaacuccucuggggcaggaauuguguuucuuuuuuuuuuuuaagacagaguuuugcucuuguuuccucaucuggaguacagugacgcaaucucgacucacugcaaccucugcuuccuggguucaggcgauucuccugccucagccuccugaguagaugggauuacaggcaugcgccaccaugccuggcuaauuuuuuguauuuuuaguagaaacgggguuucaccguguuagccaggcuggucucgaacuccugaccucaggugauccacccgccucggccuuccaaagugcugggauuacaggugugagccacccucacugcaagguccgccucccagguucacaccauucuucugccucagccuccugaguagcugggacugcaggcacccgccaccaugccuggcuaauuuuuuguauuuuuuaguagagauaggguuucaccauguuagccaagauggucucgauacccugaccuugugauccuccugccuuggccucccaaagugcugggauuacaggcgugagccaccacgccuggccaggaauuguguuucuuaagcuuagcacagugcuuugcauccaguuaguaauguaauaaaugcaucguucaauacuguguacggacauacuucugagugcaagccaauaauccuguaaaucaguacaaccaagguuauauugauuaaguauucucaaacaguaaaacaauuuggacauuuacaugggauuuuuuaaucgugaaauuugauguguuuuggaacuuauuucugacagcuguaccauauagcuuucacugauaaugucuuggguuaaauuguggcuccucugguaacccucagaguagauuuugugcugucgacuguguauaaauaucuagaaaucacagcauauucuuggauuuccuugucugaugccuagcagugagccacccagguccuuuuauguaaaguaucaugaauccaauuagcagaaagcaugcuauuacauuuuauuuuagugaguaucauucucauaccagaaaaaaacaguucuuugucgauucuuucuugcagaaagcauaaccccuacuguagaacuaaaugcacugugcaugaaacuuggaaaaaaaccaauguauaagccuguugacccuuacucucggaugcaguccaccuauaacuacaacaugagaggaggugcuuaucccccgagguauguguuuuuuuuuuuuuuuuuuuguaaaauacaggagaaaacgugucugaucuuuuacauaaaccaguaccucuagauuguggagggaguaaugauuugguuugggccugccaaguguugaaguuggucuuaauuacucuugugccuuugugccccucccccgccuuuucuuuuuuuucuuucuuucuuuuuuuuuuuuuuuuuuuuuuuuuuuuuuuugagacagagucuugcucugucacccaggcuggagugcaguggugcagucucggcucacuguauccucugccuccuggguucaagugaggaggcugucucagccucccgaauagcugggauuacaggcaccugccaccacgccuggcugauuuuuuuuuguauuuuuuaguagagacgggguuuugccauguuggcugggguggucuugaacuccggaccucagaugaucugcccaccuuggccucccaaagugcugggauuacaggcgugagccaccacaccuggcugcgccucuuuuuuuuuuuuuuaauucauugagacagggucuccguauguugcccagacuggucuugaacuucugggcucaaggaguccuccugucuuggccucccgcagugcuaggauuaaagugugagccaccacacccggcccuuugugcuucuuuuuuuuuuuuuuuuucugagacggagucucgcucuguugcccaggcuggagugcaguggcaugaucucggcucacugcaagcucugccucccggguucaugcuauucuccugccucagccucccaaguagcugggacuacaggcgccugccaccacacccggcuaauuuuuuguauuuuuaguagagacgggguuucaccuuguuagccaggauagucucaaucuccugaccucaugauccgcccaccucggccucccaaagugcugggauuacaggcaugagccaccacgcccggcuccuuugugcuucuuuaacuacugcucuuggguagggccugagcauauuucuugcuggcaguguggcuugugcccucaagcagccuggcuaaagauaacccuuguaacugcuuuguguaacugaaucauauuuaaacaugauucccauagcaucaugauuccugcaagacaaugauucccagcauuuguagauuaccugauuauuggguacuuuuugacuuuugaacuugugcguuuuguaaauagcuuuggugcaauaaaauauuaauugaaaccugaaaaugccauggauuaaaaaucuucugcuggcaguaauaagacauuaguggaggccaggugugguggcucacgccuguaaucccagcucuuugggaggccaaggcaggcggaucaugaggucaggaguuugagaccagccuggccaacauggugaaacccugucucuacuaaaaauacuaaaaauacaggcaugguggcaggugccuguaaucccagcuacucgggaggcugaggcaggagaaucgcuugaacccaggaagcggagguugcagugagccgagaucgcaccacugcacuccagccugggcaacaagagaaacuccaucucacaaaaaaaaaaaaaaaaaaaagacauuaguggauagaugaugagcaaaauggaauucuucauuucccugcucucuguugggggauagucauuuuaaaaauauaagcuaugaaauggauaagaaacuggguucugcuagggaaauggauaagaaacuggguucugcuagguaggcuacagcuuauugggauuucuugaaaugaggguccuuuugaaagacuugugcauuaaaauucccagccuccuauuggagacaugcaaauuuaaagcuaagguuugagaaggcagagcaagccaaguuuuugucucagccaaagccuaauucauuuuagauuuugucagugcagguuagugugauaaacucauaauuuauaagccauuguauuuugugagauguaaguuuggauugcuaaacacucuuugcuuauacuguguagcaauucuaauccaguuuaagcuuuuaugaaaucucuggauauauugaugaagagugauuagcaucaaacacuaaugugaguaggaucgugaugaaggaaauacuugcauuugccagagaguguauaggugacuuaucaacuugagacuguaauuugccuaaccuccuuuuauuucuagguacuuuuacccauuuccaguuccaccuuuacuuuaucaaguggaacuuucugugggaggacagcaauuuaauggcaaaggaaagacaagacaggcugcgaaacacgaugcugcugccaaagcguugaggauccugcagaaugagccccugccagagaggcuggaggugaggaguugagcccaggcucccugacgcuucgacaggguaggaggguaguggggagaugucaccgcacauuaucuuuucuaagaaggcacauugacagcuguccauaauuuuuauuugaaugccuccaagauuuuaugcucuguagcuuucuugcuuuuuacuccuuuuuuccuuuuaaaauuucuuaacaagaaagucaguugccuucuuuuucagucuguagcaugguuuugagugacaugauacggugugaacacguuagaaaguuugugauucaguugaguugugaagaacauguauggaugaagucuucggugcucaagauuaugcuugccagaaucuacugugauauauggguaccagguuagaggauuuucugaagcuguuuuuuaccagccacucuugauuauauagaagcgccaguuaccuuuugccucauaacagaccaucauagaauuuagugaugguuuaaacaucuccaggcauuuauuuugcuuaugagucugugauugaggcugggcuuggcaaggguguagcuugucuucguuccacacagcuuugguugaaguggaucugcacggggccggaggaucugcuuuuaagguggcucacucacguggcugguaaguuggugcuugcugucagcuaggagcucagcuggggguucuggccccaggaccucaguucaucccugggugaccuauggaaggauugcuuauacuucuucauguuaugguggcugguugccaagaguaagcauccuagaagaugggaaauggaagcagcugccaguuucuuaaggcuuaggcucagaaaucacagcaucgugucugccauauucuacaggucaagcagucauggagcccagauucaaaggaaggagauauagaaugucacuuagaaaaaaaaaauugagguggcugggcgcaguggcucacgccuguaaucccagcacuuugggaggccaaggcggguggaucaugaggucaggagauugagaccauccuggcuaagauggugaaaccccaucucuacuaaaaauacaaaaaauucgccgggcgugguggugggcgccuguagucccagcuauucgagaggcugaggcaggagaauggcaugaacccgggaggcggagcuugcggugagccgagauugugccacugcacuccagccucagggacagagcgagacucugucucaaaaaaaaaaaaauggagguaaaaauuauauaaccuaaauugacuauuguaaguguacaauucaguggauuuuaguacguucacaauauggagaaucccauuuccagaugaugaaaggauugucaaagaauuaggggccauguuuuaaaaccaccaugauaggaaaaggauuuuaacauuuuugugacuaaauagcaauauaauucuuagggaaucaguaacuccaugccauugaggggucaaagcauuagugaauaucuuuggccaggcagaaucuuaucacagauagagucacaaagucuagaagaaguccagugaauugaaaacauugagauuucauaauucuguuuaaucacaacaggaaaugccaccugaaaauaucucuggguagcauuugacuuuucuucaccaggaaacauguucacaaagaacaggaggauccugcacagaacagugggcuaugugaugagagguguagacccgaguggaccuugggcagggugccugcugagucuguuguauccagcugccacccagggugacccaacuugggcuucauggcuggccgcacaggagcgauuuguuuuucuuuuguuacgcugcauuuccauuuuccgcuauaaucaccuauucuaacagaugaucuguuuccagggcucacuaaggaccaaaucaaagaaaaugaggcuguaacuaaaagaggaggauuuagugaaguuaaaagaaugagcuuuucaguggugagauuuguuaaaacaccaaaaagguaguguaauuugaguuauuuuggaggcuuuucagcuuuuuacuugacuguugcuaaucuaauuggagucagauggaguagguauuucuaguccuuccagccaauaguugaugaacaauugcuggacacugcuauauggcuuuucugcaucacaaucacuugagaaguuaaaaaaauaaauucuaggcccaaccccgggauucuaaugcaauagguguagggugagacccaggaaucuggcuuuugcuuuuguuguacuugcuuggggguguguguguguguguuuugagacagucucucccugcuuuuguuguucuugcugguguguguguguguguguguguguguguguguguguguguuuugagacagucucucccugucacccaggcuggaguguaguggcaugaucuugguucacugcaaccuccaccuccuggguucaagcaauucuugugcuucagcuuccugaguagcugggacuacaggugcucaccaccacgcccagcuaauuuuuguauuuuuaguagagaugggguuucacuguacugcccaggcuggucucaagcuccugagcucaggugaucugaccaccuuggccuuccaaagugcugggauuaugggcaugagccaccauaccuggccauguuguuguuaaugagcucuuggagugauucugagguauggucaagguuggggaaccacagaucuaagagcugucagcacuuccccagcaguuccuccccuugaguccuccaugagagugaucacaguauugcuacaaaggauaagugccuguugguguuucugagucucccgccuucacucacuagagcagcguugguuggcacaguccugagggcagcggcuguuguagacauguucuucugggcugaguuuucaccggguccuaugaaaucucugaggagcuuugcugggagugguguuuaaaucuacuugugcccuuuggcguuucuucucuaugccccuuuucuagcucuguagaguuggaaguagagaccgugccugucagaaauggcuuaaagacuggccuuagccagugaagugaagagucauuaauucagaaaagacuuauuugaaguacuagaugaauaucccuuacccuaaacgcuugcgacuagaaguguuuuggauuucagagcuuuuuuugauuuuggaauauuuccaucauacguaaugggauaucuugggaaugggacccaagucuaaacaugaaauuuauuuguguuucguauacaccuuauacagaaagccugaauguaauuuuauuuuuuucuuggggguauugaauaaacuguuuugacugcgacacguugcaugaggucauguacggaauuuccacuuguggcauuguguugguguucaaaaaguuugauuuuuggagcauuuuagguuuuggauuuuugaauuaggaaugcucagccugcaauaagugaaacacuuggccucuuucguaaaugugcugcccuugauuuuaccaggcucucugauagcaggcaguaggggaauaaagagagacaguuuuaaaagauaacuuuuuuuuucuuaaaaauagugcauauggacuauaaaaaauuuuaaauucaaaaacaaggaacaaugaaugauuuauaaauuuaccacuugcggauaaucacuguaaccauuugguguauauucacugacaagcacauauacaaguaaauacagaugccuaucuauuucauaaaaauggcaugacaguguacaguaaccaccuuuuuucacugauguguauaucuugaauauguuacgucauuuacuuaaaauuccuuggaggacccaaauucagcacacaccuaagcacuuucuaauggcuacaaaauguuccacuaugugaaugcacugcuuuauuuuccaacagggacuugauuauuuagguuguuugcauuuucccucuuauaaaaugggucgggaagaacaucguugcaguuaaagucuuuguccacgguccuagaaguggaauugcugaaccagcggguaugcauggugguacauauggccaaguucuccacagaaagagggugccauuuuacaaccugcugacaggccauaagcagcccgucuguccacagccugccagcauuggaaaugaucauuuuaaacaaauugucaguuuagcuguggcauauuuguggagcaugugauugugugguggaucagugcaucuucucuagaagauaugcaguaaagccagcgcuugcugucuacagggcaggcauagucugggcccuccaugccaggcgcugugcuagacccugaguugaaacagucagcgccaucccuuuuccugugaacuuagucaaauggagcugccagacauuaacauuaauaucagcaaaaagugcauuuagugcaaggauggaaaaaugacaagaauuagaagaacguaaaguaucucauuuagguuggaauaaugguggugaguucagagcagucuuuucagaggaagagacauuucggcugauacuaaagaucagcaaagggcagggacaguguaugcccagagagggaguggcaguugcaaaggccccaaguuaagaaagugcauggguuauuuguuuauuuaaucuaagguuugugcuaaugaaguaugaguuuuacucagugucugagcuauuaggagcaguauggucauagcugcaguaucuguaauagagaaaaacgggggcuagcuuaaaugucuguuacuaggaaagugguuaaaaacuuggcuacguuuauccccugaguaccagagugagauaucucauauaggcaggcaugaaaagggaugaagaugcagagcuguuacugugcauacagugugauccuguugguguuucaguguguauguauuuuuguuucuuucuuuccuuuuuuuuuuuuuggagauagggucucacucuguugcccaggcuggagugcggaggcccuccaugcaggcucacugcagccuugaccucccugggcuuaggugauccucccaucucagccuccuaaguagcugggacuauagauucaugccaccacucccuguuaauuuuuguauuuuuuguagagaugggguuuugccauguugcccuggcuggucuuaaacuccuagucuuaaaugaucugcccagcuuggccucccagaauccugggauuacaggcaugagccaccguaaacauccugaaguuuuuaaaauacuuuuuuauacuuuuguaaaaaugaauaaaugcagcucuuucugguuuugagucuuuaucuucacuugggauaggugcauacuuaauuaggaguaaaguuaaaauuagagacccauuuguuuauuuauuuauuuucuugagauggugucucacucugucacucaggcuggaguguaguggugugauuuuggcucacugcaaccuccgccuccuggacucaagcaguccuuccaccucagccucccaaguagcuaggaccacaggugcaugccaccacaccuaauuuuuguaucuuugguagagacgagguuucaccauguuucccaggcuggugucgaacuccugagcucaagugaccaccaccugccucggccucccaaaaugcugggauuacuggcaugagccauagcgccuggccugaaauuggagacuuuaacccuucuuguuuccucaguguucauuggaccuaguuuucuuuuucuuuuuuauuuuuuucuaacagagacaggucucacuauuguugcccaggcuggagugcaguggcuguacacagacaugaucauaguacccuguggccuugaaguccuggauucaagugauccuuuugccucuugauuaucugggacugcaggcaugcuugugccuggcucagguuuucuuuucuuuuuuuuuuuuaagacggagucucgcucuguugccaggcugcagugcaguggugcgaucucggcucacugcaaccuccgacucccugauucaagcuauucuccugccauagccucccgaguagcugggauuacaggcaugugccaccacacccagcuaauuuuguauuuuuaguagagacgggguuucaccauguuggccaggauggucucaaucuccugaccuugugauccaccugccucggccucccaaagugcugggauuacagacgugagccaccacgcuuggucuuuuuuuuuuuuuuuuuuuuuuuuuuugagacggagucucgcuuuguugcccaggcuggagugcagugguguaaucucggcucacugcaaccuccgccucccagcuucaagcaauucuucugccucagccucccaaguagcugggacuacaggugcgugccacuaccgccggcuaauuuuuguauuuuuaguagagaugggguuucaccauguuggccaggcucaucucgaacuccugaccucgugauccacccgccucagccucccaaagugcugggauuacaggcgugagccaccacgcccagccagguuuucauuuuuuaagcugcuuuuucaagcucuuuaaggaaugauauugcaugaguuguauucuuuuuuagagguauuacaaagaacugagagaaaguauacuuauauuuuaaaauagugcaaaacucuuucugucuuacaauuaucauaggggucuuuuggauccuuuuguaagucuuuacaugaugggaucuuagggaucuuaauuuuccuguguuuugaacguuuugcuauuuguuauuccacauaauuauuucaauacuauucaucaucuacucccaaauaugccagaugagaugaaaaucauaagaaaauggaagaaugauaaagccucugggguggauauacaauagugaaguaauugucaugaugacaccuucuuuuauuguccuauggccuugccuaggcuauugcauugucuuccaagagguuaaaaaaagaagacuagagacaccaucuuuugagucuccuuuuugcuuucauugaacccaggugagaauccagaauuuuucuauuuuucaucuguaaugucaaggagaagagaauugacagaggaagacauuucugaugauuaacaaaucagaagaugaacacaaaaagacagauagauggcagcacuccagacuguaaugaugauggugagauugucuaagcaaaaucgcagacugugagucuucagaugcuagcauagaugaauuuccccaaacucaagaaucagcuagugauuauuuaucugauguauggaaaggaaaugugguauauucucaucuagucauucaacagaaaggacuucaucaugcaacauuuuucgacaagaaccucucccauccuguuugcauuuaaaaaaaaaaaaguacgugugacaacauucuuuuaucuuuuauguuuggccgccaacauuuauuucuuaccacuuauugucaacaaaauaacuggacaaaugcacaaggagguguguguccaaaggugauuggaagaaaauagauauaaaaaugacaaaaauaacuggauugauccuucuguugguguuuauaauccaaaaaugaaagcauuuugcacuuaauggagcaaggaaauggcugcuuucucuucaacagaauuaugagucuguuucaaaaguaguguguuugacagugccaguacacgaagaaucugaaguccuguuaaguuagaaccuguuggagauggacuuggaaucugacaucgcuacaggugggcugugccccagcugcaggugcaucaggugaugagcaguuaguugcauauagaggaccuugcuuuuuuucagguauauaugccuuccaaauuagaaacauugggauaagaagcuggguuugcuguguuuaaguucuuauuaaaaugucuaauaaaauggcuuuugucauccuuuuauuugguaaauuauuuguaaaaugacuuuagauauagaaaaacagaagagucuguuggagccagauaauaaauggugauggcuaauuuuccuagcauacugugaggguuaagugugguucagagcauuucuuucuuuucuguuguuuuguuuuguuuugaaauagggucuuccucugucgcccuagcuggagugcaguggcacgauuguggcuuacuacagccuugaccucuuggccucaagugaucuucccaucucagucucccucguagcugggacuacagguguaugccaccacaccuggcuaguuuuuguauuuuuuguagagaugcggguuuugccauguugcccaggcugguuuugaacuccugggcucaagugauccgcccaccguggccucucaaagugcagagauuauagggaugagcuaucacaccuggccucuuucuuaauguugccuagauuuuauugcugaacuauacacuauggaaucaguguuaacaguaauuccuacauugugaagauaagacuaagugcccacuaaaccuuccucauuuuacugggaaugguuuuuguagauuaguuuugaaccauuugcugccucccuacuuggaacauuuugucagucuggauaauaggaaauuuuuaaugagccaggcacgguggcucacuccuauaauuccaguacuuugggaggcugaggugggaggaucacuugagccuaggaguuugagaccauccuggacaagauggagagaccucaucucuaccaaaaauauuugaaaaaacgaaaugguggcauguaccuguagucucagcuaaugaggaggcugaggcaggagaauugcuugagccugggagaucaaggccgcagugagcucugauuaugccauugcacugcagcugagggcacagagcugaggcccugucucaaaagaaaaaaauuguguaaaagagcaaaauaauuucauuuucaaauauguuuuuuugcauuuuuauuuuacuggcugcuuuguuccuaaugauacuccucuggaagcaauggcuuagagcagugaaucgcaacuccagucaccuggggacuuauuuaaaaaauaaacaaauacuauaaauaaaacugcuauccaggccaugcccucaaaaauuugaguucaguugucuggagcgggcuccagaaucugaacuugugaagcucccaagugauuguagugcugcugugguugagaaccacuggcuuaggguguagaacggagcaguagacccauuguuuucuaucagucuuacguggaaccuugauacauguauauaaaauagaaaaggagcauuucguuaguauaaauuguuauuuaaaaaaauuuuuuuuuggcugggcacgguggcucacgccuguaauuccagcacuuugggaggccgagguggguggaucaccugaggucaggaguucgagaucagccuggccagcaugacgaaaccccaucucuacuaaaaauacaaaaaauuagccaggcaugguggcuugugccuguagucccagcuccuugggaggcugaggcaggagaaucacuggaacccaggaggcggagguugcagugagccaagauugcaccacugcacuccagucugggcaacagagcgagacuucaucucaaaaacaaaauaaaaaauaaauauuuguuguuguuguuguucuuguugagaugaggucuuauuauguugcccaggcuggucucaaacuccaggccucaagugacccucccgccuugaccucccaaagugcuggaauuacaguuauuaguauaaacuuauaaguuuggauuuauaauaaugguaaaggcaauuucugagaaugagguauaugaguuuucaaaaacaccaaauuauauucauuuaaaaacacggcugggaaagauacagucccacuuuaggauagugauuaacugcccugggaaugauagugagauggccuucauugccucuuuuuuugagacagagucucacccggcuacuuucuguauuuuuaguagagaugggguuucgucauguuggccaggcuggucucgaacuccugaccucaagugauccgccugccuuggccuuccagagugcugggauuacaggcaugagccaccucgccuggcccguugccuuguguuuugagauggagucuugcucugccacccaggcuggagugcaguggcacgaucauagcucacugcagccuuaaacuccugggcaaucaaucaagugaucuuuuugcuucagccaccccaguagcugggacuauaggcacacuccacugcaccuggguaaucuuaaaauuuuuuuguagagauuaaggucucacuuuguugccuagacugaucuugaacuccugacuucaaacaaaccauccaucucagccuccagaaguguugggacuacaggcgugagccaccaugcguggcucauuguuuuucuuaaaacagaaaaaaacaguccgacgucaguaguacuuaacuauugacauuggauaaauccaggaaauugccuguuauguuauuaucuguacuuuucuguauguuugaaauagguuguaaauaaaaauaaaaguuaaaccuaauugggcugauacaaugaacaaaacauugaaaauuggggcauguacguggcauucaaagucuuacgacagucugagcaccuaguuuauuuccaaguuguguucuggcugcucauaaagagcauucucauuggcacaguucuuagcauguggaccuuuuuuuuuuuuuuuuuaaacagaucaucuauuaaaaaaaacucuggaugcucuucagggaaacagcugucaagcuuuauucuguugugcacaaaaaugaguuaaucugggguuagcacaaguuacuguguugaugauuucugguaucuuaauauuuggugugaaacauuuuuguugcugcuuuuuaaaaaauucaggcaaaauauacaucuaaaauuauuaaacauuuuuaagugcaccaguggcauuaaaauacauucuugguuuugcacaacugucacuacuaauuuucagaaccuuuccaucauuccaaauagaaauucuggacucauugaagaguuacuccccacucccuugcucguggcccuugguaaccucuacuuuacuuucuguuucuaugcauuugccuagccuaggcacuucauaaaaauggauuuuuuuuuuaauguguggcuuauguuacuuacuguaauguuuucaagguucgucucuguuauagcauguuucagaauuucauuucuuuuuuaagggugaauguuuuaugguaugaauaguaaauauuuguuuuuccagucaucuguugauggacauuuggguuguuuuuaccuucuggcuauugugaaugcugcugugaacccugguguauaaaaauguguucaaguugcuacuuucaggucuuuuggguguauaucuagaaguggaauuccuggaucauauaauaauuauauguuuaauuuuuugaggaacuaccaagcuguuuuccauagcaacuguaccauuuuacauuuucuauuaaauuaauuaacuuacuuuuuuuuuuuuugagacggagucucacuggacuggaaugcaguggcgugaucucggcucacugcaaccuccgccuccuggguucaagcgauucuccugccucagccucccgaguagcugggacuacaggugcgcgucaccacgcucagcuaauuuuuguauuuuuaguagagaugguguuucaccauguuggccaggcuggucucgaacuccugaccucaggugauccgccugccucggccucccaaagugcugggauuacaggugugagccaccgcacgcacugcccauuuucuauuuuauuuuuaauaaaauccaaaucugguacaaccauuuuacauuuucauaagugacuggaagcuucucauuucuccauauccaaaaacuuguuauuuccauuucuuuugauagcagccauccuuaugggugugagugguaucuuacuguggauuuuuuuuuuuuugaaacagaguuucgcucuuguugcccaagcuggagugcaguggcauaaucucagcucacugcaaucucugccuccuggguucaagugauucuccugccucagccucccaaguagcugggauuacagacgucugcuaccacacccggcuaguuuuuuguauuuuuaguggagaugguauuucaccauguuggccaggcuggucucgaaccucugaccucaggugacccaccugcuucggccucccaaagugcugggauuacgggcaugagccacugugcccagccgacuauuuguauuucuuuagagaaaugccuguguaagugcuuugcccauuuucuaauuggguuguuuuauuguugaguuguaguucuuuauauauucuggauauuaaucccuuaugagauaaaugauuugcaaaucccauucuguggguuuucuucacucucuugauaguguccuuugaugcaugaauguuuuaaauuuugaugaagucuaauauuaauguuucuuuuguugucugcgguuuucaugucauauguaagaaaucaccagauggugucauaacacuuuuccccuauguuuucaucuaggaacuuuacuguuuuagcucuuauguuuaaguauuugauccauuuugaguuuuuaguggugugggguaaggguccugccuuauuauuuugcauguggauaucuaguuuuccuagcaccauuuguugaacaagcuuacaguauuuuuuuuuuaaguuuaauaucuauuuaacuauuagauugguaauuacuuuugcaccaaccuguaaauuucaagccaaaccucuguagaacuccagccuuuaagguaccuugcuugcaaauugccaguuuuaaggauucacucauaaaaaaguagacccuuuuucugcuuaggauuuaaacaaaaauacaagugugggcuggguaugguggcucacaccuauaaaucccaacacuuugggagguugaggugggaggguugcuugagcccaguucaagaccagccuggacaacauagugagaccccaucucuacaaaacauuaaaaaaaauagcugggaguggugccuaugccaguagucccagcuacucaggagggugagaugggaauauugcuugaggucaggaguuugaagcugcagugagcuauguuuguaccacuguccuucagacugggcaacagugugagacacugucuccaaaaaacaaaaaaaaguauguguagguuaauaaaccaccacaagugcuaugaaaguaguuuugacucaggugagauacacugaaaccagauuggaaagaaaagauuauggaaggauagaaggaauuacaaagagcaucuggaauaaauuuauuuguccaggauuauacccuugguuauauauauauuuuuuuaaccuagaguuuguuuuauuuuaauuauagcuuuuuuuggugggugugacacggucucacacugucacugaggcuagaaugcaguggcgugaucauagccaccucagccucaacacccuaggcucaggugauccucuccccucagccucccaaguagcugggaccacagaugugcgacaccgcaccugcuaauauuuguauuuuuuuuauaaagaugggguuuugccauguugcccacgcuggucucaaacugggcauaagcaauccacccaccuuguccuuaaaaaguuuugggaucacaggcgcuagccaccaugcccagccaauuacagcuuuuaauauucaguggccagacacgguggcucaugucuguaaucccagcacuucaggaggccaaggugggcggaucaccugaagucaggaguucgagaauagccuggccaagauggugaaaccccaucugugcuaaagauacaaaaaaaaaaaaaaaaaaauuagccgggugugguggugggugccuguaaucccaccuacuugggaggcugaggcaggagaaucgcuugaacccaggaggcagacguugcagugauccaaggucaugccauuggacuccagccugggcgacacgagcaaaacuccaucucaaaaaaaaaaaaguugaguguagguggaauauaccugauaaacauaaggaaaugcacaacagauaaaaucuuggauaguccuauaccuugccuauuuagcaguuucagccauggguuccuuuucagauaguucuaaucucagaagcaggacuuuauaaauucuuugacaaaauaagcaauaaugugaagaaaaacagcucuuuuuguuuugggggacuuugcuagauaagcuuugagcuuaucuaguuccucuuauuaucacuacagcacaguauaaaauccauguuaucagcacgcagaaguaagauccuugcuccucuuuaaucucaucccugauuggacgacucuuaagugaaccuuguuccaaagauggaaucucugccuuuguugaggagacuuuauuaguuugcgccuuguauuuuuuugccaacagccguugaguaugagauacauggcaguuuuguaauguguuucaucgcauccuuauuuauuucuuuauuuuuaauuauagagauagagagucuuuguugcccaugcuggaguucaguggcuguuuacaggcaugaucacagcucacuguagccuugaacuauugggcucaacugauccucaacugucaccuugcugaguacuggggcaauagucguguacugccaugcgcauggcugcauucucuuaaagugguuucccgccgggcgugguggcucacgccuuaaucccagcacuuugggagccgagguggguggaucaugaggucaggaguucgagaccagccugaccaacauggugaaaccccguaucuacuaaaaauacaaaaauuagcugggugugguggcgcaugccugcaaucccagcuacucaggaggcugaggcaggagaaucgcuugaaccugggagguggagguagcagugagccaaaaucgcgccacugcacuccauccugggcaacagagcgagacuccaucucaaaaaaaaaaagugguuuccagggaauuuauguucaaauaagccugcauacucauguggacagacuuaaucugaauuugccacgucccacauauaucugucuguauuuugacuuuuccaaaauguggcuucccacuacuugagaaggacuuuuggaagucacuguuccgagcagcagugacaucuugcugaaccacagucaggcugacacauauccaaaggucuauuaugugcggauuguuuuuggugaacuuaugagguacaauuugacucaaacuugacaggacauguaucuuuuuaaccucuuaaauucagugacacuugguaugugugugguuaaauucauaaagccaaagcucagugcuuuuaagguuuaccauugcagcuaggauguugauggguguuuuuuugugggggacagcgucucgcugugucacccaggcuggagugcaguggcgcaugaucauggcuuacugcagccucgaucuccugggcucaagcaaugcuccugccucagcccuccaaguaguuggaacuacaggcauguaccaccaccacauccaccuaaguuuuguuuuuuuguuuuuguuuuuguuuuuguuuuagagacaagguugcucaggcuggucucaaacugccauguugcucaggcuggucucagacuccugggcucaagcuauccuccugccuuagccuucaaagugcugggauuacaagcaugaaccaacucaccuggccauugacuauuuuaauaagagcuaacuacuaaacaauuauucuuacaggugaauggaagagaauccgaagaagaaaaucucaauaaaucugaaauaagucaaguguuugagauugcacuuaaacggaacuugccugugaauuucgagguaagcuaauuuuacauguaggacuuuguauucuaaaauccuguuagcauucaucauaagaguuauuuuuuccccuaaauaucauuggaauaaucuucacauaaugugaaccuccaaauuuaagauucauacuuuauauuuagugaagcaguguuuauucucuucuucugggaguccguaacuaaggggcauucauggauguguagagaguucaugauggcuucaguugguguguggaccuccugaagcagucugaagaugguuguguuaguguucauauguguauucuucuggauagggaaggguggaggggcuaguucaucacuuagaucagucucaaaagcauuuguggucccuaaaggucucuucagaguaauuuugaaaaggacucaguuuuugucauugucuagcgucugcccucaauuccuguuuaauaacuucauuuguuguugagaccuuguguucuaaaaacaauaaucaaugaauugucugaucaaagugggaaauaagguacauuuuaauauauguugccuuaaaagacauauaguucauccaaauggacgagggagguaagggagaauuuuuuuuguuacuuauuuuuauuaagcgccagcuuaaugcugcagaaaauuucacaucacccuugauaacccacuuucuuuucucccacccaaauucuugaucaagaguuuuucaaguaaagacaugcucuucucucuucuauauaaaacguuacgaauaaaggcaaaagauuguguacaucuugcuggaaaaugcugcccagggcucuggagauggcggcugcccgggcucccuucgcuguccagguccugaaagacucuuguucaugaacugucucuucacaaagcaaguccaccacgugcuggguuuaucauucuuagggucgaaaacuuccucacaaagucucaguccagucucuugccuuagcuguuguaaauaggcucucaucacuucaucuuccuguuuguuugcagguuugguauaaauugcgugaaguggaaaaccaggcucuccaggaaugggaaaacuaaugauucccaguguauacauuucuuucucaccuugacuuuuggaauugcacuuuuggaguuuuuucagacauucagaaauguagagaguuaaauauaucaagguccuaucagcuucauucuuaauuucauaguuuuugaagaagacauuggccuugaaguaauaguuggcuucauccacaauaucuguaucuuuugucucucugggggcagguccuuugaauugacuucugauagguaacagugcuauguuuccgaugaguuuggugucaggauccaugagagaagaguaaugagccggcaucuuggcggcgcccggguuucaacccagagcuuuuuuuuuuuuuuucccugagaugaguuucacucuugucgcccaggcuguagugcaaugguguguucucggcucacugcaaccuccaccucccagauucaagcgauucuccugccucagccuccugaguagcugggauuacaggcauacgccaccaugccgagcuaauuuuguauuuuuaguagaaacgggguuucuccauauuggucaggcuggucucgaacuccuaaccucaggugauccacccaucucggccucccaaagugcugggauuacaggcgugagccaccuugcccggcccaguaagggagaauuuuuaauguuuaccuuagaaauaaggucugacccacagcagauucuuugcagauucuuuugauuuacgugcuugauuauggcuuauuucuuaaaaagccuaucugaagcuuauauuccuguaaaauaucuuugaaguauucuuuacaguuacaggugauguauaccuucuccuccuaugugcuagcacccuaaacuuaacccagcuucagugcuccauccuuuggccgagugaugaugauuucucaccucacccugcugaugccucucugccugccaugggccagaggugggauuguaguugccagggcucccuacuguggcccaccuggguacgagggcuuguuuguuccucuccauuccucugacacucauuccugccccuccacccucaguggguaagagcagguuuacacuguucucuuggaguccagagcaccgacauggaucuagggcuggaaucuucucaccuggcccuacauucccucccuggccuuucucccuccaucaguggaggcugggaugcacuuggggagggaaugagacaggggacauucagaauggcuguuugggcucacaguugagugggaaaaagaugggagcugcaucccaaggagucaugaggucucccccggcaccuguuucaggaaaggggagaaguguugcuuuucuccccugcugacagauuagucugucaugagaguggauuuuugcagguugugggggagggguaccaagaccguggggagugggagaugccuggcuggcuucccgggucaccucaugugcagaguugacggcuugggccagagccuuggauuccugagaagcuuaccaccugcucacucuugcugcuacccagagucacugagauuucuggaaacuuagagauugcuauuuuauguuuuuguucugugggauuuggggucagauugcuuccuuuccuccuucacuuuuguuaagguuucagaucuggcucucaacucuguguucaggaaucuugacaguagucacauaaaagaauuguaggagugcccucucguggugaucuuuuaaaguaauuuaucacagcuugcauguaguugguggcgugagugcuuauauucauuaacucaaauaucaggaauuuuuuacuagcuugcauuauuauguugagcaaggucuuuccuuucuuuugccgcuggaagguugccuggcauguauuagauguuuaggaaauaguuacugaauaaaugaacagaauaauuuuugauuaaguuuuugguaauuaaaucugucacauaggaagcuucguuagguguuuuaauaggggaagacaggaacaguuuuuuggaaaaauauauacagcuugacuuuuguuuuguuuuguuuuguuuuggagauggaguuuugcucuuguugcgcaggcuggaguacaauggcacgaucucagcuuauggcaaccuccaccuccuggcuucaagcaauucuccugccucagcccccugaguagcugggauuacaggugcacaccaccaugccucacuaauuuuuguauuuuuaguagagacaggguuucaccacguuagccagucuggucuugaacuccugaccucaggugauccacucaccuugaucuccuaaagugaugggauuauaggcaugagccaccgugcccagccaguuugacuucugauaaaacauacaguuuuaguuagaaaaugugauggugcugauggauacggucaucgggagacaauugugacaugcucacaccacaugcaauccaggugauccuccagauuuagauuggggggaucuugaugugggcagacaaugcaagccguuggagagggccagggugggcugugcauuugaagugagccaucaggguggcugaccugucccuccaaagucuaaccugaggacagggaaagcacuguugugggaagaaguguuucagaaucucugcccuugggugugggcggcaccuaugggaguucuuuaaaaucaguccacgggugccuaagcaggccagguccuucccacaccucugcuccuggccacugugcugaauuccuaccccccauucuccgcuaccuccuuccccuacaccaaaaaaaaaaagagugcauccauuuuggaggcucacuuuucuuaccuagacauuuuuucaauuuuuuacuucaaaaauuucaaaucuaucuaaaaguuacaagaauaggacaaugaauauaacuuucacuuagauuaaccagugguuaacauuuuaccauauuugcuugcuccuuccuuccuuuuguuuuuuuuuuuuuugugacggagccuaacucuguugcccaggcuagagaacaguggcaugaucucggcucacugcaaccucugccuccuggauucaagcaauucuccugccucagccuccugaguagcugggauuacaggugcacgccaccacacucggcuaauuuuuguauuuuuaguagagaugggauuucaccauguuggccaggcuggucuugaacuccugaccucaagcgaucugccugccuuggccucccaaagugcugggauuacaggugugagccacugcacccagccugcuuuuucuuuuuccauaaauauacauauuauuuucuguuuuuuacuuugcuggauuauuugacagaaagugguagauaucauacccuuuaacuccuaauauuucagcauguaucucuuaagagcaaggacauucucuuaaauaaccacaaucuauuaaguagaggaaauuuagcauugcuauaguacuguuaccuaauacacauccuacauucacauuucaccaguugucucaaugauguccuuuauagaaauguuucuuccgcucuagugucugaugcagacucacaccuuacauuuagcugaccuuucucuuuagucucugcaguaucuuuaguaucugcaguacauucucagccuuucucuguguuucaugacauugacauguuuaaaggucaguuauuuuuguacaguggcccucaauuuggguauuucugauggauuacuuaugauuaggucugguuauguguuuuuuggcaggaucaccaugggagugauauugauccuucucagagcaucauuucaugucacuuuguaauuaacuccuaaccucugaggagauguuugaaggcugggccuucacaggucuccccggugguuccagcaaucuuuuuuuuuuuuuugagacggagucucgcucuguugcccaggcuggggugcagugaugugaucucagcucacugcaaccucuggcucccggguucaaaugauucuccugccucagccucccaaguagcuaggauuaggcaugcaccuuggccucccagagugcugggauuacaggcgugagccaccacacccaccccucagggaucuugaugauucuugcuggcauugauuaucacugugguagaugucaaaauuaugauuuuuggcauuuccaagcuggcauucuacaguaaagaaaaaguuuccuuccuccccucuuauaguaauuauaucgguauagaugcauugcugcuuuuuuuuaaacccaaaguauuacuccauuguuaucgucacccauuuugauguccaaauuguccuuuaaauuggcccuugugcccuuuaacaugcccccaucaguuauuuuuuggaugaagggguggucaggcuucuugagguauaauuuacagugaaagucacccuguguaagugcacaguucgauguguuuugauaaguguauaugguucuguaaccagcaccauagucaaaacagaacaucucccacccaguaaaguucccugugucccuuugcagucagucucuccccucuguccucaggcucuggcaagcauugaucucauucugucccuauaguguugccuuuuuaagaauauuacauaaauggaaaauagaguauauugccuuuugucugacuucuuuaacuuagcuuggagucauuauucaugcuguuguguguuucaguaguuuguuccuuuuuaucaccaagaguguuacauaguguguacacacuacaguguaucuauuuaccaguugaagauuuguauuguugugaguuuuuggugauuauuaauaaaucuacuguaaacauuuauauacaucuguggagacauguuuucauuuuucuugaauaaauacuugaguggauuugcugaguugcaugauaaauaaauaacuuuauaagaaguuggcugggcucaugggcucaugccuguaaucccaacacuucaggaaaccaaggugggcggaucacuugaggucaggaguuagagaccagccuggccaacauggugaaaccucgucucuacuaaaaauacaaaaaauuagccaggcaugugccuguaaucccagcuacucauuagacugaggcaugagaaucgcuugaaccugggagucagagguugcagugagccgagaucaugcuacugcacuccaaccugggcgacagggcgagacugucucaaaaaaaaaaaaaaaaaaaaaaaaguugccaaacuguuuucuaaaccagauguaucauugugcauuucaccugcaauauaugagagaggcuuaguugcucuacauccucuccaacacuuggguauugucagcuuuuaaaauuuuaguuauuccagccuggccaacauagcguaaccccuucucuacuaaaaauacaaaaauuaggugggcaugguugugugcaccuguagucccagguacucagggggcugagggaggagaaacgcuugaacccaggaggcagagguugcagugagccaagaucgcgccacugcguuccacccugggugacagagugagacuccgucucaaaaaaaaaaaaaaaaaaaaaaaaauuuuuuuuuaaagucauucuagcagguagucaguaguaucuuguugugguuuuaauuuauauaucuccaugaagacuagcaauacugagcuucuuuucguguuuuuauuuuacuauuuucuuugaugaaauauagguuuauaucuugccaguuuuuuugagugucuuuuuauuauugaguuuuggagguucuauauauauucugaauucaaguuuuuucucagauaaguauuuugcagauauuuucucuuaagucuguggcuugucguuugauuuuaagugacuuucaaaaagcagaaguauugaauuuuggugagguguaguuuguuaaauuuuuuauaguuaauaauuuuuguguaugcugagauacauuuggcuaaccuaaagucauuuuccuuagaaauuuuaguuuuagcucuuacauuuagguuuauaauucauuucgaguuaguuuucauauauacugugacauaagggauguuuuugucuuuuuuuuuuuuuuuuuuuuggauuuggaugucuaauugugccugcacuguuuguugaagagacaguccuuuauuuuuugagacagaguuuugcucuugucgcccaggcugggauuacaggcuugagccaccaugccuggcugagacaguccuuuauuaaauaaccuuugcaccuccccucuucacauuuugagaacuuccaugcuuucugauacaacaaaauguuuuagccucacuuugaacuuccccugcucuagcuuuagccccaguggaaacauaaauuucuaauagaaauggucuuggccauuccuccaagaagauccgguuccuucuaauugggagugguguguagagacaggacagggugcuagcaugcuuguuccugcuggagagccauggcucucgguuaggagauagagcuaggaaauauguauauuuugaaauaacaaguuuauuuuauuugauuuuagagaaaagaacucacuugguacccgggcuguagugcaguggcaugaucucaccucacugcaaccucgaccuccugagcucaagugauccugcugucucagccucccaaguagcuggggcuacaggcacacgccaccacacacugggcuaauuuuuguauuuuuuuuuuuuccucugagacagaguuucgcucuuguugcccaggcuggagugcaauggcgugaucucagcuuaccgcaaccucugccuccuggguucaagcgauucuccugccucagccucccgaguagcugggauuaugggcaugcgcuaccacgcccagguaauuuuguauuuuuaguagagaugggguuucuccauguuggucaggcuggucucaaacuccuggccucaggugauccgccugccucggccucccaaagugcugggauuacaggcgugagccaccgagcccagccaauuuuuguauuuuuuuuguagagacgggguuuugccauguugcccaggcuggucucaaacuccuggacugaagccauccacccgccuuggccuucucaaagugcugggauuacaagagugagccaaugugccuggccccuuuuuuaguuuuuuuuguuuuuuagacaaagucuugcucugucauccgggcuggaaugcaauggcgcgaucucagcucacugcaaccuccgccucugggguucaagcauuucuccuguguuagccucuuaaguaacugggauuacagucaugugucaccacacucagcuaauuuuuguauuuuuaguagagacaggguuucacccuguuggccaagcuggucucaaacuccugaccucaggugauccacccgccucggccuaccacaguguugguauuacaggcgugagccacugcaccuggcccccuuuuuuacuuuuuaaaugucuuuugaugagcaguuuauuuuuuauuuuauucauuuauuuauuuuugagaugguguuucgcucuuguuguccaggcuggagugcaguggugccaucucagcucacugcaaccuccgucuccuggguucaagcaauucuccugucucagccuccuaaguagcugggauuacaggugcccgccaccacgcccagcuaauuuuuuauauuuuuaguagagacgggguuucacuauguuggccaggcugaucucgaacuccugaccucgugaucugcccaccucggccucccaaagugcugggauuacaggcgugagccaccgcgcccggccagugguuuuuaauuuugaggaauuucuuuuuucuuuaugguggauaucuuuuguguucaacucuuugccagccuuacagucuugaggcuuucuccuguuauaaagucuuuguaauuuuaguuuagaucacauuuaagugauccuaggucuaauuuuuguugugguaugaguuagagaucaugguuugauuuuuuuuucuuccccccaccccgcuccaugcagauaccuaguuaguugcucugguacuauuuuuuuaagagauuuuuaauuuguuuugguguguuugccaaaaaucgagugaccuuauaugugcaggucuuuuucgugcuguucuguugaucuauuuauccuuacacaaaaccauauccuaguuguugugacuuuauaggaaguuuuaaaaucugguaguguaagucuucuauuuuucuuuuugagugucuuggcuaauaucgguuagauuuuuaaguuuuuuuguuuuuuuuuuguuuuuuuuuuuuugcuuuuugagacgagguuuugcucuguugcccaggcuggggugcaguugugugaucauagcucccuguagccuugaucuccugggcuuaagugauccuccuguuuuagccucccacauagcuaggacuacauacaggggcacacuaccacaccuggcuaauuuuguuuuuauuuuuguagagucaaggucuugcuguauuggccaggcuggucuugaacuucugagcucaagugauccucccacccuggccucccagagcguugggauuacaggcaugagccacccugcccagccugauuuucuaucuguguuauuguaaucacuuucuugauaauguccaugauacacaaaaguuuuaaaguuugauuaagugugacuuuuuuuuuucccucuuguugauugugcuuuuaguuucauaucuuaaaaaccaauugccaaacccaaagucaugaagacucgccuguuuuugcuucugagaguugugcauguuagcgccucuguguaggucuuugguccauuuggagauuguaaucacuuuaauaugcagcuaacuuucuguucauguuuaauuuuagauucuuuccccaucuuuguugacuuaguuuuauuucuuuaauauguaaaacaguaaaugcuuccagaagucaaaacuaucauucccgucucaucccgucugucuacccuaaucccucacaccuguuguagguaacuaauuucauugcuugcuuuuugagacggagucccacucugucacccaggcuggaguggcgcaaucucagcucacugcaagcuccgccucccagguucacgccauucuccugcuucagccucccgaguagcugggacuacaggcgccugccaccacgcccggcuaauuuuuuuuguauuuuuaguagagacgggguuucaccauguuagccaggauggucucgaucuccugaccucgugauccaccugccucggccucccaaagugcugggauuacaggcgugagccaccgcgccuggcccauugcuugcuuuuuuuuuuuuuuuuuuuuccuuugagacagggucuuacucuaucgcuuaggcuggagugcaguuuugugaucuuggaucacugcaaccuccgucucucagguucaagggguuuuugugccucagccucccaaguagcugggauuacaggugugcaccaccaccccuagcuaauuuuuguauuuuuaguagagauggggguuucaccauguuggccaggcuggucuugaacuccugaccucaagugauccacccgcuuuggucucccaaauugcugggauuacaggugugagccaccauguccagcccauugauuuuuuuuauccuucguuuuuuuuuuuuuuuuuuuuuuuuuugcaaaaaugagcuuauaaaugugugucuguuuauauauguguagauauuuguauaaaauccuauuuuucuuaaacuaaagcuaccauaccauauacucuuuuguggguuuuuuuuuuuuuuuuuuuuacuuaaugugugcggggaaucccucuuuaucagugcuuaagagauuugucucguucucuuuuguggccacauagcaaccaguauuuaguaggccuaguccuggcuggaggcucagagcagauacuaaacuugagcauuuguacugcauuuauuucuggacuuugcugggcuagcuuccuuuuugccaguugcaguggaccacacuaaacucaggacagccugugagccaggggcaugggaguaaaaaggucucccuauuucaugccugacuguuugggacucaccagacucaagagcauaaaccaguuugagaaguaagaagaaaggcgagaaagcauuugaaaugauccccgcuuccuuucauuuaguaggucuuguccuugguuccccuucccugugucugugugaagugugccagccagugugccuuggagcuuuuaauaagugucuguccgcuuucacucagucuuucccucugaaacagguggcccgggagaguggcccaccccacaugaagaacuuugugaccaagguuucgguuggggaguuugugggggaaggugaagggaaaagcaagaagauuucaaagaaaaaugccgccauagcuguucuugaggagcugaagaaguuaccgccccugccugcaguugaacgaguaaagccuagaaucaaaaagaaaacaaaacccauagucaaggugagaacuuuucugaacacagaagguguuuucauuacuuauagaugggugggggguuuagaaggcuggucgcuguccccaaggugaaaggggaugagaccaacgugccacaccccaggccugccagaccccuuagaggugcugcaagagccaccuguuagguaagauaaggacauugugucaguucaguagagguacccgcagacgggcacacacaucugugcaggagggcgcucaucacagcccuggcgaucacagugggguauugggcaggaacgccaugccggucuguggggcgcguggugaaauaacagugccugugucucagugaccauguugcuguucugaagguggaggagauuugugccaggcaggaggcccauagugggaggguaggagugagacauuuugcugugugccuuuucuuuuggauuuuugagccacacuaauggaucuaucaaagcauuauauugaccccuuccccaaccccagaaaggggacauaauuccauggggaacuuugugauuuucaguauauguaguuucaugcuguaucaagauccaaauuuuucuuacauaaaagcauacuauguauaccuuuuguuucccuuuuuugcuuaauauagccuggaagucacuucugaucagcagagugaggguuccuuggcacaaaagguggccucaaggaaguaacugggauucugagguucuucuugccauguggcaucagcuugagcuuuuuuaaaaaagugguuccuggauuuugaguucuuuucaagaaaauugggaacccaucauagcucagacuuuuggggaguuguaggaauaguguuuuauguuuuuucugcccauuuacugucauauguugaaauauguuaaaaaacagccgucgcagucauagugacgcuucguuauagugaaauguugauguugguuugcuaagaccuuaaaaucaccuagaacaaucauaaaaaaaauaaagcaucuuuucauuguuaaaauguuaaauuaaaaaaaaucgaauucugagccauuaggucaacccaaaaucucuuaucuccucucauauccugaucucugaguugaccaaguucaugcggugaauaacauuacagaguuucugccuuguuuguuccucagccacagacaagcccagaauauggccaggggaucaauccgauuagccgacuggcccagauccagcaggcaaaaaaggagaaggagccagaguacacgcuccucacagagcgaggccucccgcgccgcagggaguuugugaugcagguggguccgcauggaugaugggcgccccuuccucugaccacguccagccuugggggcugauggcgguucaaggucuggacaccuuccugaggaggcuggauccugugggccauguucugccagcgacugugauccuuauuuauuuauuuauuuauuuauuuauuuauuuauuuuugagauggagucucacucugucgcccaggcuggagugcaguggugcugucucagcucacuacaaccuccgacucccugauugaagcgauucuccugccucagccucccgaguagcugggauuacaggcacgugccaccaugcccagcuaauuuuuuguauuuuuagcagagacggaguuucgccauguuggccaggaugguuuugaucuccugaccuugugauccucccaccucagccucccaaagugcugggauuacaggcgugagccaccucgcccagccaacugugauccuuauuaagaccuuguggcuugcaauaauuugauagcuuaaacauaccacagaaaucuguaaaggcuacauaucaaagauuaaguuguuuaucuuaaugcuuaaaaaaaugaauguaaugucugcacaccagcacuacugcugggugcacuggugggaauguggguguguugcacugaaauuuggaagaaagaguccugggguggugggugcugggagaaguuuuucuucauuacaucuccuugaagguuuaugacauugcucuuuaccaaagguaaauuuuguaaguaguaucaagagaucuguuccucuuccuccuaauucuuauggagucuggaaucuaggguuaccucuuccuuagauugggugacacuucagauuaguauggaacauuucuuuguacuuagcugauuaaguucaaagcuaaguggucauuucacauaggcagcuuaacuuaauugugauuugaauuuaagugcuuucugauguaagacagaauccuuaucucuuguauagcaauuuauaacuuagaaaguugaccucguauauuuuaccuaugcagucagaagguaggaaaagaaugauccuuucauuccacaaaaggaaguugcaguuugcugagaggaucaguaguuugcccaagaugaaauggcugguagauggccagguuggaauuuagucccaggccagggaaugguuucuuugacucucugagucuugugaccugggcuuuugguuuuagcagccaggugccuguuauuacaaucaacuuggaaggggguuguaaguagugaugugcuggaacauguuuaacaaccagcucuucuucggggagggugguuugguggaaugagcugaauauguauguuauagauauauacauggguguuauauacauguguguuauaaauuuuacugacacaaaggauguguguuauaaauuauacugacauauauguguguuuuauaaauuuuacugacagaaaggauguguaguacaauuuauaaauaauauacacuuuauuguaaauuucauacauauuucagugugacaguuaccaacgauaguguuauaaaaucagacagcacauaaugguuuauuacuauccaguucagcaaagguguugcucaugucacugacaaauacauacuguagauuugagauuuugguuguagcaugaauacugguugagauacauuuuuuuugggguagaggggaauggagucaacuugcucuguuguccaggcugcagggcaguggugugaucucggcucacugcaaccucugccucccagguucaagugauucuccugccucagccucccgaguagcugggauucacgggugcccaccaucacgcccagcuacuuuuuguauuuuuaguagagaugggguuucaccauguuggccagacuggucucgaacuccugaccucaggugauccacccaccucagccucccaaagugcugggauuacaggcgugagccaccacgcccggcugguugauguuuuuuauuuauguuaauagguaagaugaaaguaaaacaggcugggcuugauggcuuacgccuguaaucccagcaugacggaucacuugaggucagggguucgagaccagccugaccaacauggugaacccucauuucugcuaaaaauagaaaaguuagccaggcaugguggcacacgccuguaaucccagcuacucggguggcugaggcaggagaaucgcuugaaccugggaaguggagguugcagugagcugagaucaugccauugcacuccauccugggugaagaagugagacccugucuaucccaaaaaagaaaaaagaaaaagugaaacaaugaagacauguaacaucacucauuuguaaaugauaugaguggcuucucugcaaaauuagauaauuuucaaagacgggaagauauuucaguuuuuugugcuaguuacaauguaauggcugcagacuucucaugcuuuuaagauuaaccugcuuuauuaaccuuuucaucauuguagguuuagaguuagacaauaaacagcuuaugaucuuugauacguagcauuuguauauuucugugguauaaauagucccaccauggcugauuucaagcucucaaagugauacuuccaauggcaaugcugggaauagauguacaguaguucaccaucacagacuguuuccauuguacaaaugcaauagcugggcagacccucagaacacagaugauuauaaaaugcagucaaaaauuaccucuguuaaaauaauuaucagcuuauauaauuaaauguuuaauacuggcuguguuuaacagccagcuucccaaacuccugacuauuuaauaauuagcucucagagacaaggaggccagguucggggcacugcuguuaucuugcuucugaccauaguugguuauuuugcugacacaccaauuccugccugguuguuauucugaagguuuaagcacuggucuguguuuugacuucuuugugcaggugaagguuggaaaccacacugcagaaggaacgggcaccaacaagaagguggccaagcgcaaugcagccgagaacaugcuggagauccuugguuucaaagucccgcaggcgcagcccaccaaacccgcacucaagucagaggagaaggugagugcugugggcucucugauugcaagauggucucucgccucacccuagggaacuggggcaccuccaggggcaggcuucaaggcaaggcuuuaucugccugacaguucaaggaguccugcugaggagugucucauccauuuggaccauaaugugcucagaggggccucgcauguccacuggccccaggaggcucuggguuagaucguugauugugucaguaucuuuguggucuggggacgcuuuguggagggcagcuugcuccucucuauuuguaggaugaggaugaaggguaauuaggacugaaauuacuaagugugauuugcacucuagaaaugaagccugugugaaagauuuauaacuguuaggcuuucguuaauuguggaauaggcuuugauuuuucuggcaaaauaagacagugugacaguagagacaggccaaauccaaaguuuagguuugggauuucuuuuuuccuaugugaguuaaacaucagaugaaaauaauccccuguugaaaaauucacggccaggugugguggcucaaacuuguaauuugggaggcugaggccuugaauccaggaguucaagaccagucugagcaacaugaugaaacccugucucuacaaaaaauuaaaauaucagccagguaugguggcuuguaccuguagcccgagcuacaaggcugagaugggaggauugagccuuggaaggucaaggcugcagugagcugugaucaugccacugcacucagccugggcgacagacccugucucaacaacaacaaaaaaggaacguaaaaagaaaaauucgugucugccagaagugguaagcaggaccucagcaaaagccauggcugaccuucuucuuucccaucacugaaugguccuggugagauaaacuugaaaucaggccugauucauucaugucugccagucauauugacagaaacagcaucagucauggccaguuaauaacugacugggaccccagauaccaccaguauagaucuuagacuuggcuuuaggguuuuucauuucagaaucuuguaggacauucagaguguccuuuguuacuucuuagaaaggugauguuguguuagacaaaauucuuagguaauaacauuuuccccguaaggguguuaauuuuggaaugucaccuuauuuuuuaauuggauaucagcuccaggaaauauucuugauuuauuuguuuagcuucagucugaaagcuucuuuccccaccuuggugggcucuaccgucuagcaucucugcucuuucugguuaaaugcuucccgucuuccugugggugcagagugcagcucagcauucacagguuagugcacuuuguuagaugcucuuugugggcaggggugugggcaggagggugcauuaggagaaggaggcaggcucugcccaggugucugucagggugccaguggucagguggggcaggguuuuucugccgauugccacaguuauugcugacuggacuuuguguagauuuagacagcaggagcuaauuuuucagugaucugauuuaugcucauggccuuuuuuuuuucuucuucuuuuuuaagacacccauaaagaaaccaggggauggaagaaaaguaaccuuuuuugaaccuggcucuggggaugaaaaugggacuaguaagugugaucuuaauaucgucuuccucugaacgugauucugggauuugcauggguccugaauaacagcaggagcccagccagugaggucccgcaugcaaagugucuuuaucauucccugauucccugcgcugccaugcgugccaaggggagggccagcgugggguuugauggugucauugcguuuuuccaggcuguggauguggauucguguuuaccguguaugucccucccagguaauaaagaggaugaguucaggaugccuuaucuaagucaucagcagcugccugcuggaauucuucccauggugcccgaggucgcccaggcuguaggaguuagucaaggacaucacaccaaagauuuuaccagggcagcuccgaauccugccaaggccacgguaacugccaugauagcccgagaguuguuguaugggggcaccucgcccacagccgagaccauuuuaaagaauaacaucucuucaggccacguaccccauggaccucucacgagacccucugagcaacuggacuaucuuuccagaguccagggauuccagguaacugucuggccugagcugugauggcugugccucaggacagucaucuuuuggcuucucucagaaaaugaacuuugaacuuuguacuuuuuucuuaaaucaaguucuguccagggaugggcuggggagcagugauggaaggguaggagguauagaaguauuguaagcauaugugguaagagaaauaucuuuauccuuugguaguaagauuucaacaugcaagccaacccuaaaagcuucuaaccacuagcagugguuguaaauuuggauuucaaagaacagacucaucgugcugacacuuucugucugguaggaaaggauauggcuucucccagucuugggcuucugagcagacaccuagguuccuggaagguucugggcugacagggcagguguuaguauggccacaguggggcugaguuggaaaaaagagcuggugaucuugcuuguggggccuggagcugcagcccuccagcccacucauacuugcuguucccuaccuagccucagcucucuuuucccccuuagguugaauacaaagacuuccccaaaaacaacaagaacgaauuuguaucucuuaucaauugcuccucucagccaccucugaucagccaugguaucggcaaggauguggaguccugccaugauaugguacgucacaccuugggugagggauugggguguuguguguuuauguggagccugccuugguucagcuuguuacuagccugaggaagaugggagaaagauugucccauagaccuugagagcaaugaaucguuugauaguguucauauuuuugaagacuuuuugucauagcugauuggaucgauuucucacucuugaucagaacucaucagcuuuagcccaccuuucccuuccuuuucccugcuggccuggaggggcaacugggauccugcagcucacccagagacugcacucacuucaucucucaccagaacaaggaauugcagguccacguucuggcagcuguaaaaaccacuugcuuuggucuucuguucagaugaaauuauuguuauaagaaaacugagaaaaggaauugaucagaucaacaaaucuaaguaaacugugauguauucacuugaugggaugucaugcaugcaugaaauuaaugucucuggguggggugugguggcucacacuaaucccagcacugcgggaggcugaggcaggcggaucaccugagcucaggaguucaagaccagccuggccaacguggugaaaccccaucucuacuaaaaauacaaaaaaaaauuagccaggugugguggugggugccuguaaucccagcuacuugggaggccaaggcaggagaaucgcuugaacccgggagguggagguugcagugagccaagauugcacuacugcacuccagccugggcagcugggugagacugcguuucaaaacaaaacagugucuccgaagauaauguaauaagaagaaaaauacaugauaggccggguguggaggcucacaccuguaauuccagcacuuugggaggccaagguggaaggaucgcuugagccuaggaguuugagaccagccugggcaacuuagugagacccugucucuauagaaagaaaaauacaugauagauuuuuguuagaaagcaggauauaacauuuauacagucugguuaccacaugguuaaaaauacuagaaggaaaaauauaacauuuucagagguuaugauucagugagguaacugaauauuuuuuaauuuguauuuuaaauuaaaaauucaaaguuuuauuuaguaguaccagaguugaagaaguugccaccuguuugcugggcagcaggaacucucuugccugccugaccaguguauuaugcuguggucccaagcgguggcuguggcuuuacccuucuuuccauccccacuaggcugcgcugaacaucuuaaaguugcugucugaguuggaccaacaaaguacagagaugccaagaacaggaaacggaccaaugucugugugagugcacugaugaaggggaaggcgcugaugauggggaggcugccccucguuuguguugaguuuacacuaucugcugacucagcggggaaauauuugccugaguuacuuucuggcccuuuugccugaaaguuuuccagauucucugggcagaaagcucuacuuuuaaaagacauuuugaggcugggaacagcggcucacaccuguaaucccagcacuuuggguggccaaggcagguggaucaugaggugucagguguuuaagaccagccuggccaagauggugaaacccugucucuacuaaaaauacaaaaauuagccaggugugguggcaggcaccuguaaucccagcuacuugggaggccgaggcagagaacugcuuaaaaccugggaggcggagguugcagugagccgacauagcgccacugcacuccagccugggcgacagagcaagacuccgucccaaaaaaaaacaaaaaaaccuuuuugaguuggucauaccuucacauggucagaacucugcauuauuuuacaagguacaaucuuccccucggacagcccccaucccaucccuccuauucuccccaccgccucccccauagaucacauuuuuacuaguuucuccuguaucuuuccuguauguuucuuuauacaaauauagacauauauuucuucccucauuuucuuccuuuccccccacagagauaaguacacacacucuccuugcguauuuuacuuacuggcauacccugggaaaacuuuuguuaucauaaacuggggcuuuuaguauuguacuuccugauguuugccaauuucuuuucauuuuuaacaguacuuuaauucucuuacauuucaaaacuagugucauuuucauuuuucuuccuuaaaggugugggaggugcugaaccuuuucuggccaugaaccauuauaaaaucccaacauauauacugaaaauacugaaacugcuuugaaaauuuggaauuucugauaccuccagugggccgagagacacgguggguaaaggaugugggcagcagcagggaagacaacagaaacacaaggaggcggcuguggccgggcuggacugugcugggguuuguugugauggccacucggugaccuggcggucccuacgcaauagcagcugccuguggggaagaagggcugcccagccagcugguucucccgggacaccagcagauccacacccugggcaccuccguguuuggucuuuuuuuuccccugugugaaagaagaaacggcacgaccccuucucaagcuggcucacucagacacauugggacaaacccuggacagccaugccagagagaggccuuugaccggccccagagcuaaaagcaccagagaaaaucaaaugcuuccuacucagcgugacccaacuuuucuagugugccacggccccaccaccuccugcaguacccacaccaucaccacugcuuucucuuccaacagugaucuguauucuuaguuucauuauuuucuuuugauugauaugacacuauauaaaauuuucauuugagaauuucucaauuguaucuaguuaaauagcacaguuuggaaacuugucugagacugacuuuaucaauaaucuaaccgacaaagaucauauccauguguaugugguuagacauuuuuauuucauugacuaacccaggacaguuucagugaugcaaauugugugcccucugguucagcugaaacaguccuggacuuucaaaaaccuugaauaagucucccacaguuguauaaauuggacaauuuaggaauuuuaaacuuuagaugaucauuugguuccauuuuuauuucauuuuuauuuuuguuaaugcaaacaggacuuaaaugaacuuugaucucuguuuuaaagauuauuaaaaaacauuguguaucuauacauauggcucuugaggacuuagcuuucacuacacuacaggauaugaucuccauguaguccauauaaaccugcagagugauuuuccagagugcucgauacuguuaauuacaucuccauuagggcugaaaagaaugaccuacguuucuguauacagcuguguugcuuuugauguuguguuacuguacacagaagugugugcacugaggcucugcgugugguccguauggaaagccugguagcccugcgaguuaaguacugcuuccauucauuguuuacgcuggaauuuuucuccccauggaauguaaguaaaacuuaaguguuugucaucaauaaaugguaauacuaaauuuuuuuguuaauuuauucucaaaugccacuacugcuagguugguccccucccaacuugccccuauccuuuuuuuauuuuuaagaaaaaaacuuuguaaugcuugugauuccaucugggcaaaagucugaagaucugaaauaacuuuauaucaaaccauugaucaauaaacagcuacuaaugaa

SEQ ID NO: 191279 - RNA, 24783 nt, Homo sapiens
uugguuucucuuuucccaaaaauacuuccauuuaauauagucauaugaaagcuaaucagcaagaagggagauugacagacaugcuuaggaaaauagcuacguaccauaccaccacaccaaaguguuguuuuuuguuuuuguuuuuuuuuuaaacaaauggagaaaagacagaccagccaggaugacuucccacagggaagggauuuaagggcugcccccaugaauuucuucaggccacgacagcuacuuccuccucuuguaucuguaagaaaaucagaguuaagaccagaaugaggauggagaagcuucuuuuccaugaaagguuuuuaucucuaaucccaaaaccuaugccccuccaaaacagccaguaucaccuggauuuagauuuaaaguuuccuccucgucucugguggggcaagcccaacuguuuccuuucuucaaaggaagggcugugagagaagaugacaugcugaaaugagcaaacuguugaacaaauggguguugucucacccccacccuccccagcuccuacaugaagcaguagcaucucugggaugcaucauuuucaggcccuaaguucuaagccuuuauguguuuccaccugauaacguguuucuggaagucagggcccaauuuuaaaacaagguuggaagaggcccuucuuagguauauaccacuacuugggaagcuuagucugccccugccccaaccuugggcuggggaaaauggugugggacaacauauuccuaagagcaagccaggauucucugggguucugcaggauggaacuugagaugaaagaguuaucacuccccugaaggaaagcuccauuucugaacccaacaauguacuauuucaccuccaaggcaggaacagugcuaacugaacaccccucuccuguucucaccuugggauccucagguggcucugagaggggugggggguggagaacagacagguacccuugaauuuacauaguauaaagcuauaggugugcaaaaacuggaaauggggaaggaggcagaagacucauagcuuccauuagaauaccaagggcucgccgggcacgguggcucaagccuguaaucccagcacuuugggaggcugaggcggguggaucaggaggucaagagaucgagaccauccuggcaaacauggugaaaccccaucucuacuaaaaauacaaaaauuaguugggcaugguggcgugcgccuauagucccagcuucuugggagacugaggcaggagaauugcuugaacccaggagguggagcuugcagugagcuaagaugcaccacugcacuccacccugggcgacagagcgagacuccgucucaaaaaaaaaaaaaaaaaaaaaaagaauaccaagggcuccaugaugacuuaaaauccuacccagcucgauacuguuucagggccuucuugcuuguguuggugaguucuucaucaaauacagauuucuuccccugcuuuugcuucuuggcugugcacagagagaauggguuacauaugguugucuuuggcccaagcuccuaaauccccuuaaguucaagguaaugauuccaaguucaguggauacucuggcauccaaagacuauuuucauucuguccucaccagcuccuccaaguagcagcuggugaggccuuaggcuccggagucagaaaagcuggcguucaaauccuaguucucaacaaccacaaggucacugcgccccuuagaccguggagggauagcuguacacauugguacauacuaauuacucaaauaaugugggcuacugucaucaucccucagauuuucucccugacccaaagcacagguuucagggaaaaccuuguacaagcuccuuugggcuccccauucaccuaccaggaccucucacuggcuccuccucgggcauugcucgggcccgcuuggcucugcgauuccucuucgcuagccguucagcaaacaucugcgccuugaggauuucaaacugagaccuuuccucugccuagggggaguggggaggugugaguguggaacacaccaggccacucugacccaccccaccgagugggcccaaacuccaaaagggaggccacucacugucaucucccccuuuuuuuuggcauccuucauaaacuucuuccuuuucuucuuuccucuuaaggccaagucaaauuccugcagagcuuuggcaacugggaugagaagaaagcauaagauuucagggaugauuuuaucuuuuuuuaagcuuacgauaagaagugcacguuuucaauugguaaguuagcagauuaaaaugaaaagcggcaagcacuucuuggccgagugcaguagcucgugccuguagucucagcacuuugggaggcugagguggguggaucaccugaggucaggaguuugggaucagcauggccaacauggugaaaccccgacuacuaaaaauacaaaaauuagcugggcaugguggugcaccuguaaucccagcuacuugggaggcugaggugagagaauugcuugaacuuaggaaggggaggcugcagugagcugagaucgcgccacugcacuccagccugggcgacagagcgagacccugccucaaaaaaaaaaaagaaaagaaaagccgcaagcacuucuuccacugauuaccuccaucucacuaaauaacaugcuuuuuugacuauuucucaauccacuuaagauacucauuacaaaccuccugcuaugaaggaugaagauuuaggucacuuuacuacuuuacccaccaauacaguuauaacucuauuuuuaucagaaauuuaaguuauauacacccuuauuuugucccaucaaauauagacagcauuucuaaaacugcugguauacccucuaggagggaaauuuugcaaccucuaacaaaacuagaaauacaaauauccucugacccacuauuccacuuuuaggaauuaauccugcaagccaaauauacacuugcuuaauuguaaaagggcauaugugcaagguuauucccuacaucacuuguuuguaaugacaaaugauuauuuuuuggguuuuuuguuguuggugguggugguuugagucggggucucauucugccgcccaggcugcaguucaguggcagaaucuuagcucacugcaaccuugaccuccccaggcucaggugauccuccuaccucagccucucaaguaguuggacuauaggcaugcaccaccaugucuggcuaauuuuuugauuuuuaguagagaugggguuuugccaugcugcccaggcuggaugacaaaugauuguaaacaaccucaaugucccucaacaaucuacucauaugauggaagaacaugaagccauuaaaaaaaacaaaaagggggccgagugcaguggcucacaccuguaaucccagcacuuugggaggccaaggcaggcggaucacgaggucaggagaucgagaccauccuggcuaacacggugaaaucccaucucuacuaaaaauacaaaaaauuacccaggugcgguggcaggcaccuguagucccagcuacucaggaggcugaggcaggagaauggggugaacccaggaggcagagcuugcagugagccgagauugcgccacugcacuccagccucagugacagagcaagacuccgucugaaaacaaaaaacaaaaagggcagcauaugugggccuauauaaaacauaucucuaagcuucaaaauuaagugaaaaggcgaggcauagaacaaugugaacuuauaaguguuuugggucuuuuuuaaagggagauggagaggaaaucuguauuaaauaucuccuaacuuuuuuaaaauuauuuuuauugugguuauauauacacauauaaaacaaaggcugccauuuuacccaaucuuaaguauacaauucaguggcauuacuuacauucacaacauuguacaaccaucaccacuaucuguuuccaaaacuccuaucaggaggcuacucacugacaucauugaaaacagaagcucugcaaccacuaauaauuuccuauaaccccccuuccccuagcccuaaguaaucuauaaucuauuucugucucugugaauuugccuagcuagauaucucagguaagugaaaucagacaguauuugucccuuugugucuggauuauuucauucagcuuaagauuuucaagguucauccuuauggcauguaucagaacuucauggcugaauaauauuccauuguguguauauaaacacacaccccaaauuuuguuuauccauucacuuguugaugaacauaguuuguuuccaccuuuuugcuauuaugaacaguaauucaaagagcacuggcaucuaaguaucuguuugagucccuguuuacauccuuuacaacagugguccccaaccccaggcugcauaccgguuccaguccauggcguauuaggaaccaggcugcacagcaggacgugagcauugggcaaccaagcauugccaccugugcuuggccuccugucagaucagcagcagcauuagauucucauaagagcacuaacccuauugugaagugcgcaugcgagggaucuagggugugcacuccuuaugagaaucuaaugcaacccccacaccccaaauguggaaacauugucuuccacgauacugguccuuggugccgaaagguuggggaccgcugcuuuacaguauagaacuaggaaauggaacugcugaguccugugggguaauucuguauuuagauuucugcggaaccucccugacuuacuuuucuccuucuuccucucuucuuuggucuggaaccagcuccucucgggcucuuggaccacugccuccuuccccuucuccaggagccgcuuugcuguauugaucuguagagauaacaaaaggaugccugccgugaaacccguaucuacuaacacaggaagccacgggcugcaaaugccuggggcucugaugggagaaacauuucagaagggcagcaccagcagggaugcagcagcuugcuuacugagcagccuugugaacaagaucccgccucgcagccucaccugggcuucugacugcugcaucucuuuuuccuccgccucuagcugcagaacugcauacacaucuuucuccauuuucucaaucuugucccggaauuugaggaugacaucucaaugggagaaaauaaaaaggauuuacaaauaaggguaggccaggcaugguggcucacaccuguaacccggcacucugggagauugaggugggaggauugcuugagcccaggaauuugaggccagccugggcaacguggccagacucugucucuacaaaaaaaaaaaaaaaaaaaaaaaaagccaggcacaguggcucaugccuguaaucccacgcuuugggaggccaaggcagguggaucaccugaggucaggaguuugagaccagcuuggccaaugcugugaaaccccgucucuauuaaaaauacaaaaaucagcugggugugggggcacacgccuguaaucccagcuacuacucagaaggcugaggcaggagaacugcuugaacccacgaggcggaggcugcaguaagccaagaugacaccacuacacuccagccugggcaaaagagcgagacuccaucuaaaaaaaaaaaaaaaauuagccaucaugguggcacacaccuguagucccaccuacucaggaggcugaggagaagaacugcuugaacccaggaguucgaggcaacaguaagcuaugaucgcaccccuguaccccagccugggcaacaaagcaagaccuuaucuuaaacaaaauaaggcaguggcucaagccuguaaucccagcacuuugggaggccaaggcggguggaucacgaggucaagagaucgagaccauccuggacaacauggugaaaccccaccuguacuaaaaauauaaaaauuagcugggcgugguggcaugcaccuguagucccagcuacuugggaggcugaggcaggaggaucacuugaacccgggacgcagagguugcaaugggccgagaucgcaccacugcacuccagccuggcaacagagcaagacuccaucucaaaaauaaauuaaauaaaauaaaauaagggugacuacuaauacuguguaacugaugaaaauaauuuagcugugcauuuacugacauaggaaauggugucuguaaugugugccuucucugcuucauaucccccagacucagaguggccccugccuaccgcucugaucuucugugugucccugcucaccacgccugagccuccugaccuuucucuuguucucacacacuaagcucguuccuaccucacagccuccacccuuguucucucagcucagcacuuugcccucagaccucucauggcugccucauuccgaucacccaggacucagcuccaaugccagcugugcagaggccuuuccuuaacagcuuaaugaggcagucuccuccugcuguucucaaucacaucuacuguuagcuuauuuauugucucuuucucccagaaccacagcucugcuuuguucccugcuguauccccagcaccuagaacagaaucaauagcacuaggcccacagcaggacucaauaacuagucgcugauuaaaugaagacaaugaaaaugaaaaaaauaaaagggacauuuaagaaaggaaaaaugguuugaaaagacauacaccuaaaugcuaccaguggugagcucuuugacacagaauuacauuuuuuuuuauuuacuaauuuccaacaauaaauacguacuuuucauuucauuuuuuagagacagggucuugcacuuuugcccaggcugcagugcaguggcacaaucauagcucacugcagccucaaccuccuggauuuaagagaucuccugccucagccuucugaauagcugggacuacaggcacacaccaccaugcccagcuaauuuuuuuuuuuuagagacaggcagcucacuauauugcucagguuggucuugaacuccuggccucuagcaauccuccugccuuggccucccaaagugcuggguuauaggcaagagcuaccaugcucaggcuaaauauguauuauuuuuauaacuuuaaaaauuuuuaaggcugggcaugguggcucauuacuguuaaucccggcacuuugggaggcagaagguggguggauugcuugagccuaggaauucaagaacaaaacaaaacaaaaaaagacuuuaaagaggaugugcuuuauaagacccccacagaucagaggaacaaaaucaaugaaaggacccaaaaagaaugaguacugaucucucucuuccccaccaccaacaguaagggaaagaggaguuuagugagaauuuugccccaagcaaccuucucuucucaauuuccaccuaaauggggcacuguguuuacaauucugucauaauucccuucuacacacaggaggcaagcucagagaggugaggugaaaccugcacauggucacucggcaaggaagcagcagggcuggaauucaaaucuggcucugaacugcaaaguaccugcucucagccauuacacucuguccuugccccgcccaccgagccauucugcacugccacaggggugccugcucaccuuggggaaguauccuggccuucacaggggccuuggcagcuuuuacaaucuccuucagcaucuuccgcucaucuucucccaccagagagacugagcgcccagcccugccagcacgugcuguucgccccacccgguggacauaauguuugaugguauuaggcauugugaaguugauuaccuagaaggucaaaaaugaacgucaggccuggcaagggaaggggggugcgaagaggcaaaaagacuuccaccaaaaguccaaggaagauagugucugcucaccguuuugacccccucaaugucaaguccacgggcugccacaucaguggccacgaggaugucaaucuguucauccuuaaaacgccuagaaacagucacaaacagcuguucauccagacacccuccccuaauaaugcuccacaagagccugagccagcagaggacagaacagggcauuaaaauggggauagaggcugggcacgguggcucacgccuguaaucccagcacuuugggaggccgaggugggcagaucacgaggucaggagaucgagaccauccucgcuaacacggugaaaccccgucucuacuaaaaauacaaaaaauuagccaggcaugguggcgggcgccuguagucccagcuacuugggaggcugaggcaggagaauggcgugaaccugggaggcggagcuugcaguaagccaagauugcgccacugcacuccagccugggcgacagagcgagacuccgucucaaaaaaaaaaaaaaauagggauagauucuaaaugugagcacaugggauauuuacacccacccuucaacaacccaucauacagagcaaacguaguucuguaucugcuaacagcauaggcaauugucucaguuuaaaucagccuaucuuuaacaaacaccuuucagcacccacugaugaacaggguuagguggagaguucuaaaggguuccuccuugccaaccaccuugaugccauucucugaggacuaaacaagaaaucacauggaaagcacgcagcacagugccuggcaaaguagaugcucaaguaauggcugcuaacuuugacucuaaaucuuguucaaucagacccaggaauguucaccacucucagaaagcuuccaagaagagaccauguguugccuuuccaagccagcuuccucugucacgccacacaacagcucccaugcuagggacaagcauccaaggacaugagggucaucucugacuaugaaguuagaguucuaaacacaucuaagacaugaccucacagugguuagguuaaaauguucaaggccaagaucaugcuauguguccccugcuaauguucuaauagaaugcucaggguccucuucuuccuucuauccucucugccccagaaggauggugggagccucaguccccaccccaaauguuaccggagggccuccagccgcugcgucugugacaaguugccauggagcucacccaccugcagccccaugagccccaggaggaugugcaugcggugggccugcuucuugguuugcgugaacagcaucacauggucagugaagguccucgucaacaaagcuggcaggaagagaggacugagcuggcagcuguuucuaggcucuuauucaacauguacccccuccucauccacaaaguauggucacugugccuggcacuggauagacaggcacugucccuguccuguggaacucaaauuccaggguggauacagagaagccaauuccuggggggugaaaaaugcugugagagagagugcagggacgagggggaagcagcuaagggcuggccucucugaagaggugacauuagguugaaugacaaggcagaugauccaugggaagauccaggggaagauucuagacagaggaaauggcaaacaugaaggcccggaggcaggaaccagcuuauagugagaagugcaagcaggcggcuggauguaguggcucaugcccguaaucccagcacuuugggagaccaaggaggacagaucacuugaagccaggaguucaagaccagccuggcaaacacggugaaaccccaucucuacuaaaaauacaaaaauuagccagaagugguggcaagugccuguaaucccagcuacucgggaggcugaggcaggagaaucguuugaacccaggaggcaaaggcugcauugagccaagaucgugccaguguacuccagccugggcgacagagcaagacucugccucaaagaaaaaaaaaaaaaagugcaagcaggcgaauguggcuggagccaugagcaagccuccaaggcugggaucccgggcaggcaagggccaggcccgaagaguccuaaaaaacuaagauguuuggauuuuagucuaagaccaauggaagccaccgcaggguguucaaauaaggacauaauaaguacgaaugucuucugcaagcaaucauuguaaaugcucugcaaugcagagagucacaaaaggccgaguggaagcagggagcucgagcaagaggcugcgcaacgauccaggcgacagagaacaguggucuggacugacggguacaacagcagcugaugccaagugguugggaguugaacaggacacaaagaggauuggugaggcgauaaagcaaagggaggaaggacccguggagaagagaggcagcggaucaucauuagugcagugcagccucugcgcuggggaagacuggacggcagaggcgcaggggaaaccaagcacuucagcauggauacuacgagcucaaggaagcugaccagcccacccugcccaggcuugcccugugcugccaccugccacgauggcuucccggucuccuucacgauuaggccggauccggaugaacuccugccgcaggaagggagccacaucuguguugcuguucacaaauauccggacaggauucuucaaggagacagaagccagaucuuucaccugccaagcacaaagccagguuuccucagcucucugcaaggugguagggaaggaggaagcagugcucaccccaggcaaacccccucaagcccagccaggguccucugcauggcccccucugggcacaccugccacccgccacagagaagucccucggcccaccucgucugucaugguggccgagaagagcauggucuggcgguggugggaacacauucggaugaucuccuucaucugcuccucaaaguacucauccagcauccugggagcagagaaagacauggcagaaauggagagagugcucuucggucacagugagggacacgggauugcauaccggcugcuguuuguugucauugguuacauuuaggacucaucuauuuuauuauuuuaucuuuucaccaagaauuaucauuuugccacauuugcuuugucuuuuuguggcaagucagucacagauguuauaacaccuuaccccaaauauuucagcacacaacuccuaagcacuaggaccuucucuuacagaaacacaacuucaucaacacacccaagacuuucaagugcgugaauaucuaaagcacaggccacguucaaauuccuucagcugccuccagguuccaagugucuuuuuuuuuuuuuuuuugagauggaguuucacucuuguugcccaggcuggagugcaauggcacaaucucggccucccggguucaagcgauucucccgccucagccuccugaauagcugggauuacaggcaugcaccaccacacccacuuaauuuuuuuuuuuuuuuuuuuuuuuuuuugagacggagucucgcucugucgcccaggauggagugcaguggcgcgaucuccgcucacugcaagcuccgccucccagguucacgccauucuccugccucagccuccggaguagcugggaccacaggcgcccgccaccacacccggcuaauauuuuuguauuuuuaguagagacaggguuucacuguguuagccaggauggucucaaucuccugaccucaugauccgccugccuuggccucccaaagugcugggauuacaggcgugagccaccgcacccggcuaauuuuguauuuuuaguagagaugggguuucuccauguuggucaggcuggucuugaacucccuaccucaggugauccgccugccucggccucccaaagugcugggguuauaggcaugagccacuacgccaggccaaguuuuauuuuauaguuaccuuuuguuuuagugcaagaaccaaaguuccugccuugcaacuggcugccacgucucuagucuuccugcaucuagaaaagcccccucagccugggcagcauagcaaaaccucaucuccacaaaaaauacaaaaaugagcuggggccgggcaagguggcucaugccuauaaucccaaaacuuugggaagccgaggcagaagggugucuuaagcccaggaguucaagaccagccuugacaacauagcgagaccccgucucuauuuauuuaauauaaaauaagccaggcaugguagcaugugccuguaguaguagcuacgucgggggacugagaugggaggaucaccugagucuaggaaguagaggcugcaaugagcugguguucacaccauggcacuccagccugggugacaaagcaagacccugacucaaaaaaaaaaaaaaaaggaacgaaaaggccccucauccuucucacagucuggauucguauaauuauuucucaguaacuggauucagagaaauccucauggggacagcgcugcugggcacagcugugcccugcauucacgcuccaucaugagauacugacggccgguuuguuccagaacuguggaugugagguuggucacuuggcuauagugucugccagaucacgccacuguaaaggauccucuuucucuuuauacauaauaguaaucugugagauuccuuggauuccauguuuucagcaagcccaaccccuuacagcauuucucuccccagugcaggcuacagucuagguccagguaucacacagagcugucuccugaucuaaaucucaaauacuuccuccgccuuuuuuggucuuuugagguacauacuugaauaguuucccucccccuuuaaaaccuaaaccagaucacauccccuuggcuuaaaaugaucucuuuuucauccuuuaggccucaggaaugggucuucuguucugggggagucagccaauugguuauucaacaaguauuuacugagcgccugcuauauacuagacaugcccuuguucaugggaguauagcaguagccccuucaugaauacuguauccuagggagagagggggacuuggcacuccaugaacccucagugacaaugcaggcaggacgggaggagcaagucagggcaggaccgucacagggcagccagcaaaggccccacuaacaagauaacaacuggaacagaaaccugaaggggcaggagauggcuccaggcugaggaaauggcaaaugcagaagccacaaagugggggcguguggccaggcugugucgacaggcgggcuguggaaugugaaaacaggaggacacgcuaagaauucagaacagcuggaaggauggagcugccauuccccaagcuggugaagagucagggauuaagggccugcaaccuuagcaugcccuggggcugucugcgagcuccuuccccugccccaccuccagccucaguccagaguucaggaagaguuccuucuguucagucccagagcaaagaggugagcagauggcacagagaggaacagagagcuggggggcgggguggggggagagggaguccccacugcagucacagaggcccugugggagccacgcuggcacuuccucuuccucccuccucagcuccucaacacuauggugugcguauguccuuaucucccauuuacaaaugagaaaagauuuguuuugagaaucuaaauauuuccaaaucucccuuaggaaguggcaggaccaacauuugaccagccuuaucacuuaaccaccauaauagagaaagagaaaaaagaggaaaacaugggcuaaggcugggcagaggccccagcacaaguggcugaucugguaucgcacaccaacagccauggcccagagccacaaagaauaacgcaguguggcagguccacauccagguucugggccuuggaaccccacagugcccugggccccaggcugugaggagcaccugucagccucguccaggaugagcaccucgaugcugcucagguggaaggaagggcaguuguggaggugaucgaugagccggccugggguggcgaugaggaugucaggcgcugcccgaagagcugcuuccugagacuucacauccaagccgccugcaaagagaagagagccccaccaggcggccaggucagcugcucauggguguugacugagcaccagccacucaccaggccucaggccagaugcagagaaaaccacugagagaguaagacugacaaaggcccaagcacauggguuucccagaaacgcacugggaaagacagaucaugucauuaaaauugugcuaagugcaaaaaucaacaaugaugaugacacaaaagcacuucagaagagaaugcaugggcugggcgagguggcucaugccuguaaucaaucccagcacuuugggaggccaaggcagguggaucaccucaggucaggaauucgagaccagccuacccaacauggcgaaaccccaucucuauuaaaaauacauaaauuagcugugcaugguggugcacaccuauaauuccagcuacuuggaaagcagugggagaaucacuugaacccaggagguggagguugcagugagccaagaucaugccauugcauucccaccugggcaacagagugagacuuccucucaaaaaaaaaaaaaaaagagaaugccugaaacauucaaggacuaagagaagcagcugaggaaagugaugaggugucuguuacagggagacaaagaucacuucugacuuccaauagcacaaggagggcaaaaugcaggcuagauaacacuaucauauaacuucauuggaaaaacgcugcccaaaguaauauuugauucauuauucucacagagcagaaauuauaccccaaauuuguucaguaccacgaaaaaaauguucauaguuuucagguuucauuugugaagguugguuaagucucaaucaaaucccacccaccuaaagcacuaugaaaacaugucggcugggugcgguggcucaugccuguaauuccagcacuuugggaggccaaggcaggcggaucacgaggucaggagaucgagacuauccuggcuaacacggugaaaaccugucucuacuaaaaauacaaaaaauuagccaggcgugguggcgguagucccagcuacuggggaggcugaggcaggagaauggcgugaacccgggaggcggagcuugcagugagccaagauugcgccacugcacuccagccugggcgacagagcgagacuccuccgucucaaaaaaaaaaaaaaaaaaaaaagucuuccaguuuuuaaguggauucaaucaacacaaaggccucuccuggcaccugucaccaacaccaacagauggcggggcacauccauccuccaccccaccacagucucucaggggcuggcagcccuuggccagaaacucacccacagccaggcagguggugauguugcagaacugggccagcugucuggugacagagugcaccuggaugcccagcucucgggugggcacuagcaccagcacgcgggugacuggagccuggcgggguuuauaaaucagacgcuccaaaacaggcagggcaaaggcggcaguuuuaccuggagggagggacagcaaggaagcaaugagaagaaguuuagcucccuccaggguuagguuuucaccagagcacagaaaaacuacgucugguuggggaaaauaaaggaacuuauuuuucauagaauauuuuuucugcuuucaaaucacauggucaggcucacauauguaaucccagcacuuugggacgccgaggcaggcggaucaccugaggucaggaguucaagaccagccuggccaacauagugaagccccaauucuacuaaaaauacaaaaaacuuagcugggcaugguggcgggagccuguaaucccagcacuuugugaggccaaggcaggcgaaucaccugaggucaggaguucgagaccagccuggccaauauggugaaauccugucucuacuaaauauauaaaaauuagccaggcuugguggugggcaccuguaaucccagcuacucaggaggcugaggaaggagauucacuugaaggcagagguugcagugagcugagaacgcaccacugcacucuagccugggugacaacagcaaaacucugucucaaaaaaaaaaagaaaaaauacagccaggcacaguggcucaugccuguaaucccagcacuuugggaggcugaggcagguggaucaugaggucagggguucaagaccagccuggccaagauaguaaaacccugucucuacuaaaaauacaaaaauuagccgggcaugguggcguguaucuguaaucccagcuacucaggaggcugaggcaggagaaucgcuugaacccgggaggcggagguugcagugagccaagauugcgccacugcacuccagccugggcaacagagcgagacucugucucaaaaaaaaaaaaaaaaaaaauuuccuccucugauauggcagggccaggaggccauggucacagagaucagggauaccccaagaggauuaaaugaaaaugaccuucaucagacccuuugaaacuuguggcccacuacuagaccggacauccucucaugcacuguuuaucuuacaaaauuaauccuucaguaugccaggcacgguggcucacaccuguaaaucccagcacucuugagaggcugaggcagguguaucacuugaggucaggaauucgagaccagccuggccaacauggugaaacccucucucuacuaaaaauacaaaaaucagccgggugugguggcgggcaccuguaaacccagcuacuggggaggcugaggcaggagaaucaccugaacacaggaggcagagguugcagugagccgagauugcgccaccgcacuccagccugggugacagagugagacuccaucucaaaacaaaaaauuaauccuucaguaaacugaguaagcucugcagucuaggaaacacuguuguaucagugccaauuuccugguuuugauuuuguccuacaguuaugugggaugucaccauugaugaaggauucgagagacccuaugcacuauuuuugcaacuugccacugaucuacaaauacuucaaaauaaagugguuaaaaauuuaaaaguccuuuacucucggccgggcgcgguggcucacgccuguaaucccagcacuuugggaggccaaggcgggcggaucacgaggucaggagaucaagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaguccuuuacucucucaauugcaccaguauaucuuuuuuguguuacaaaaauuuuauggccaggcacaguggcucaugccuguaaucccagaacuuugggaggccaagaugggaaaaucgaucgcuugaaccugaaccuaggaauucaagaccagccuggacaacaaagugagaccccuaucucuacaaaauaaaaaauaaaaaugaaauaguucaaaaaaccaagaauauuuauuuagcaaaccagccuuugguaagucaaccuagagcccagcccuggccguaacacccuucugcccacccugggucccuauccuuuucaccugucccaguggcugcacaggcacagauguccuuccccaauagacccacagguaugcacgccuucuggaucggggugggcugcuugaagcccauggcuguaauggccugaggaaaaaagaacugggucagacaggguugagcgggggaagucucagcacaacacaaacagggcagguuuccagacaaguggggaccacaccaauccccaccaaucauucguuccacaaacauucacugaacgccuacuaugugugagguggugcucuagacacugaggacacagcaguaaauaaaagaaauaaaaacccugcccucaggaaucuuacagucugguagaaacagaccaaaaaacaaacacaugucauauggagagaugcugcggaaaacaaugcagcggccagacgggcagcagggggagugcuauucacgguagggcugccagggaaggucucacugagcaagggauacugaguugaacccugaaggaagcuagagagcaccccaaaagauuucuggaagaguuuuccaggcagagggaacagaaagugcaagggcccugaggaagaggaggccuaaccuauuugagggccagcaaggaggccaguguggccagagcagaacgagugccaggaggugucgucagagagggccagaaggggcagagccuuguaggucaauauaaggacucaggcuucuaagaagagugagacugggaaguacugaaggacucagagaagaagaggagggacacgauggaacucauugcuuaagagaguucucggccgggcgcgguggcucacgccuguagucccagcacuuugggaggcugaggcgggcggaucacgaggucaggagaucgagaccauccuggcuaacacggugaaaccccaucucuacuaaaaauacaaaaaauuagcagggcguggcagcgugugccuguagucccagcugcuggggaggcugaggcaggagaauggcgugaacccgggagguggagguugcagugagccgagauugugccacugcacuccagccugggcgacagagugagacuccgucucaaaaaaaaaaaaaaaaaaaagggaguucucuggcaacuguauggacaagaguugagggaggcaaagagagaagcagaaaguccaguuagggguggcugcaauaaucccaugguugccaaaauaagccacuacuggccaggcacaguggcucaaaucccagcacucugggagguugaggcaagaggauugcuugaugccaggaauuugagaccaucuuggacaacauagcaagaccaugcuucuacaaagaaaauuuuugacaagaagcugcuaccuucagaagagggcgggaaagguucauguccuggaacgagagguuuucaucguacugagaugcaucuucaaaaaauccuccugcuuccuacaccagaaaaccaaaagagagaagagaauucaacaaaaagagccaagaaacccaaacgaccuuaaacuccuuucgguuugccaacaagcugcauacugucuugcagccccaagcucaccuguccuuucuucuucuucuucuuccgauccuuuacuuugaguguaucuauggagaaaaacuuagcugaugaccacggcucagacuuacaaagcacuugcauccugcuggacacuguccuaagugccaaugccacacuucagccucugaggggugaccaucgucaaccuuguuucacagaugaggacacuuuguggcagcauggugaaguaacuugccuaaggucagagagaaagcuaacccagugacucugguccagagaccaggcucucgaccacuacacuguauuaugaugcuuuagcacacauuucugcaagaaauacuuauugagggcggaagcaguggcucccgccuaaaaucccagcacuuuaggaggccgaggcagguggaucaccugaggucaggaguucgggaccagccuguccaacauggugaaaccccaucucuacuaaaaauacaaaaauuagccagguguguuggcgugugccuguagucccagcuacuugggaggcugagacaggagaguugcuugcacccgggaggcagagguugcagugagcugaaauuguaccacuugcacuccagccugagugacagaguaagacuccaucucaaaaaaaaaaaaagaaagaaagaaauacuuauugagcacccacuauguggcuggacccaucugaguaugucaccccaaaugaguuuguaucacaguggcaucuggcagccgcauggggcuagaugggaaaagaguaaacuaccuaugaaguacaacaacccaaacaaaaucccaagagaaaagaaaaccuaaaagaaaggauucagcgggcacaguggcucacgccuguaaugccagcacuuuuagaggucaaggcgggaggacugcucgagccuagaaauuugagacuagccugagcaacaaagcaagaccccgucccuacaaaaaaaaaaaauuagccaggcgcaggggcaugcaccuguaggcccagcuacuuaggaagcuaaagcaggaggaucacuuaagccagugaguucaagccuuccagugagguaugauugcacuacugcacuccagccuguggauggagugagaccacaucucuuuuguuuuguuuuuugagacagggucucauucuguggcccaggguuaaguucagugggacaaucucagcucacugcaaccucugccucccaguuucaagugauucucguaccucagccaccugaguggcugggauuacaggugcaugccacuacaccaagcuuauuuuuguauuuucaguagagaugggguuuuaccauguugcccaggcuggucucaaacuccuggcuucaagcgauacacccaccucagccucccaaaguacugggauuacaggcaugagccacugcacccagccaacaucucuuaaaaaaaaaaaaaaaagaaagaaaggaguucaauguaguaggcagaacagcuuaaagauaaacugugcagaagaguggaggaaacccuacaaaguaaaggaggaugccuucugaucuccuguccccauuacugacaccuccgccguaacgucuaccugcuuuggugaggauguucucaucagcugaugaguagucagucuccgaggcuucaucuucugagccuuccucaucauucucuugaaggucuuccugcuccuuugguucagagccuuccuuugcuucuuucuccuuuuccaacuucccagacuuggcuucuuuauccugggaaaaaaauuaaagugagggugaugagaaacuucuagaaauccagaaccuaaguagagcgauaggaagcucuccggccugaaugaacggcuguggggauucucaguacagauucacagcaaacacacagaagagugcgccugccccagccaugccccgcucuauaagggcuuccagagagaugcuggggucguggugagaguaaagagugggcccuaacaacgaaaaauagccacuuuucuucucaccucuguuuuccuuuucuuucgaacuuucucaaucuucucaucuaauguaguggcugcccucugcagauaaaaauaaagaggugaaaaagaaauuuucauugaaacaucgaauaagagaacaaacucuucauaauuaacuugaaaaagaaaaaauuuuggccuucucugaaaauacauauacauauuauauauauaaaaauuuuaggccgggcgcgguggcucacgccuguaaucccagcacuuugggaggccgagguggguagaucaccugaggucaggaguucgagaccagccucaacauggagaaacccugucucuacuaaaaaaauacaaaauuagccgggugugguggugcaugccuguaaucccagcuacucgggaggcugaggcaagagaauugcuugaaccugggaggcggagguggcagugagccgagaucacgccauugcacuccagccugggcaacaagagcaaaacuccgucucaaaaaaaaaaauuuuuuuaauccucuccagacgaucuugaaaaugcagugcugguaaggcugagcacaguggcucaugccuguaaucccagcuacucaagaggcugaggcaggagaaucgcuugaacccaggaggcagagguugcagugagucaagaugguaccauugcacuccggccugggugauagagugagacuccaucucaaaaacaacaaaaaaaaacuacaaaaaauuagcugggcgugguggugggcaccuguaaucccagcaacucgggaggcuaaagcacaagaaucgcuuaaacccaggaggcagagguugcagugagcugagauggcgccauuacacuccagccuaagcaauggagagagacucugucucaaaaaaaaaaagaaaaggcaaugcugguuuacuucaaucagaguaaggaccagcaaagccuggauuaaacuguucuggacaggcaauauuucucuuugaagacaugaaauggaaaauaacuuagaugcaucuucuaguuuaaccagauucacagaaaggcaugggaucuuggcaaacaaacagaugacaaugacaucugugguagcuuuggcugugcugugugggaaccagggacacugcacagugacaccaccggagaccaccuggcaagugcucauacuuuguuugguauuaaagaggagucuccccagcaagcagacucagaaaaaaaaaaaaaaaaaagacagugagucauuugugaucccugugcccaucucaucaaaaguauaccagauauuuucuuuuguuuuuuuuuaaccaguuauuuucaaaggaguuguaguaucugcugaauguaaacagauggucagucaggucagggcuaggcccugaaacucacaguccaaucuuaauagcccaaagucuggagcuguccaucacugucagucucaccuucuucuugaguuggcucaugacaucagccagggcccagcugccaucguacguccccuccuucucagugaaaacgaaaucaggguugaaaucagcacugcgguucuuccccaaagcuuuuugucgucugcccagcacaaugggccccugggaagaguaagagacagagugacuuuggggcugagauaaagaaugauagaaagcaagaaggggccaggcacaguggcucacaccuguaaucccagcacuuuaggaggcgaaggcacgcagacaaggucaggaguucaagaccagccugaccaacaugaugaaacgcagucucuacuaaaaauacaaaaaagacgggugugguggcucacgccuguaaucccagcacuuugggaggccgagguggguggaucacaaggucaggaguucaagaccagccuggccaauauggugaaacccugucucuacuaaaaauacaaaaauuagccgggcgugguggcgcaugccuguagucccagcuacuagggaggcugaggcaggaggauugccugaacccgggagggggaggcugcggugagccgagaucgcgccacugcacuccacccugggcgaccgagcaagacucugucuuaaaaaaaaaugaagugaaugagacuggaguguuggucaugaagaggagagcugugagagaugaaagucaagguggaaaggacaagaucgugaggaccuugaaagccacgugaaagcaggcuggagaguuuuuuuuguuuuguuuuguuuuguuuuuagcaauuugaaucauuucuugaaaaacaaacacaaacaauuccccccgcaucaugggugugacaaacacaccccgcaucaugggugugaccgggcacuguacaggggccuggcuccucggggacuggcccaugaccucccacgcagcgggcugagccaaggccuguccgagagggggccgcagccagcaggccuggguggccgcccgcgcccacaggggacaucggggaaauggcgacaguguacgggacccagacgcugccugaggagucuuugcaagguggacaggcccgggggucucuaccagcaggcuggagaguuuuaagcaagggaggucucuaacgugacuguaucgcagagaucccucugcugcuaagcgaagaauacacuggaagugcucaagauaaagagaugaagaugaaguauguuuggacugcaggugugcuggugugcaagcaugagacagcaguagccggagcuaggguggguacagugugaauggagagaggcgggagaagcuuaagagagauucaugagcuagcuugcagagcacuggcggcggugaggaagaaaaaacugucaagaauaacucuaagguuucuggcuugagaagggaacaggaugagagugaacacaaguucaucuuuggaggaguugaauuuguagaggccaugggacaucuggauaaaccuaucaggcggacagaugagagugcagaggggacaacaucugggcugaauguuugaagggcaagcauccuuuucagaacaccaauaccucuuuaauugccauacugcuuaaugucugcaagcccccacaccaccauacgcuucaggagaguggcacucaccuuguucauugcuacgcccccaacgcuuaacacuaagucuagcaggcguuaaguauucaauaaacacuggcucgaugaacauacgaaaggacagcuaaccauggcuccuugagcaggaaccauggcugacuucaccucuuacaagguguaagaaaccugccgucucuuacacagggcgugguuaaauaucaguucagugaauagauacugaguucagcaaggagacagggaacgacauggccaaagaagcaggcggacguagagauaaccuaguggcggggaaacugaggaagaucuuggggucccggugagauccuuuucgggaaacuuccggggcuggcaggggaugaugaggauucggggacagggaccugaggaaucgcgaggaagggaagcagucaaggaaacccaaagaccagaaccgugcucauaccuccucuuccucguccccggagucagacucgggcuccaccggcaccucgucauccucgccuaugguuccgauuaagccgagguccgcaagcauguugucgcagaagccacuuccggaagcgagcacagccugcgguccggcccuuaacuuuucgcagccuccucgucgucuuugcgcaaguaccaugcgucacuuccguuccagagccccugccgcccuccccguucgaccucuuaagagugcgcau

SEQ ID NO: 191280 - RNA, 79523 nt, Homo sapiens
ccgaaagccccgggagagacuaagaagcaauccucccacgcgcuuucucccacccucgggccacugagacggagggacagagggccgcccucgcgcggccgaggccccgccucccgcucgcccgcccgcgccuccagcggaagccggaagcaaaagcggguccugcuagccccgcggcuccgaacucggugguccuggaagcuccgcaggaugggggagaagauggcggaagaggagugagugggcuuuuucccgggcggcggaggcggcggggcugggccccggcgggugacagcgagcgccucaggccgcccuccggccccggaaggcggagcuucuuuugcugguuggccaggacugaccaagccggugccuacgaggagggcgggaugggcgggccugggcccaggugggccuugcuuuccccuggagaucggucccucgagcugggaaucuacugcccagcgcaggcccggagagcugucuugcggaaaauacaaaccauauuuacuuucccaguuuucgguaaucucaugguuacugagcccucuuccgccuccuccaggaagucguccggguucuccacacccaccuccuacguagccagucgccuccuguauaacgaucaguuuucaugucuuucuccuucacuaaguuucauuuagucauuaacuguuagccaucuacucaauuccaggcccugggcaggugguaggaaaggaggccgaccaggagccgcucucugggagcuuccauucuagugggaaaagaagaccauaauuagucaaggugguuucagaucgugauuaauuaacguuauuugugccuaguguuccauuauuggaacgcuaagcaugugggaguuauuuauauccuacugcucaaggucaucgccaaggucugauuuuucucacgucugcaguucuaaaaauugcaaccucuggcaugaauggguuaaguguucugaaggaagcaaaauagaguuaagguuggggaguccacucaggaaaaagugacauucagcagaaacuugaaugaccagaaugagggauaggagaaauaacaucagguucaaaaggccuggcucaagaaagaguuuagugcuuuugagugacaggcagcauggcugguguguagagaggaaggggguuagcuggacaaggggagauggggaaggacgggcuguguccuccagguacuuuugggcaaguccaaaagucaucuccauaccugcagggcagagucuguugcagauuguagaugcccuaucacuguuuguggaaugaguaugugaagaugaauaaggaaccccuucauugauacuggaguccuucaccugauaacuuuucaaauauauuucuuggccaugugggggucauuucauguaaucaguuauuuauugagcagcugcuccaucccagacacuaaacagccucagcagcacaaaauaaaagaggcaauauagcccagcgauuucaaguuuggguuuucagcuugauucugccacuaacugagauguuggugaaguuuugcaaccucccugagccuuaguuaugcaugaguaaaaaacggaaaguaaucauacccaaucagacauguuauaccuauuaaaugagagguaguguguuaccuaguuccuggaauaaagcagugcucagaaaauaauaacuuuuguagucacaguaacaguuauuauagcaauauuguacuaguucacaaucccagcacagugugaaagagcugugggaacauacgcaguggaguggguaaauucgggugugguaagaugggguaauaggaggugacauuugagccguuugaaaucugagagggauuuuguaaaguaggguagggcaugcccagaucaacaacugggcaaauugagguggcuucuucaacuugcagaaauaaugccaggaaaauaauguaaauuggagaaacaaaggugcuaaguaaacaguguuggaccuuggaaagugaugagacuccaguuugccucccuuuaaaucccccaguauuugccaaagagcaggcagcauuucauuucuauacuagcucugauucccuaccguucuuguccucuaaguggcuguauucaaaagcaccagaggccacugguacccuugugcugugcaggcagggauuuucuuaguaaguuucucucgaaggccugccuguuaaagacuucugaaucccauaaaguucuuggacagcuucucuuucuggugugaggugugugaauugauguuuugggacccuuuuccauuaucuaauuaugcuuucuauguccuccaggagguuccccaauacaacucaugaggguuucaaugucacccuccacaccacccugguugucacgacgaaacuggugcucccgaccccuggcaagcccauccuccccgugcagacaggggagcaggcccagcaagaggagcaguccagcggcaugaccauuuucuucagccuccuuguccuaggugaauauggacacugucauccccaucaucugccaucccgugucugugugcucggucuguguguuuaacccugucacuccucuugacugucaagucuuccucccauuugguuuucauaucaaacacugagggaacaugaucaguuuauaacaucauuaacaggaaacucucuucuuuauaaaaucauggugcuuagcaaguucugaagagcuguugauguaauaucuuggccuuugaaagaaggauuaaaaaaauuuuggccuagaaagaaucuugaggccuggcgcgguggcucaagccugacaucucagcacuuugggagacuuggguggaucacuugagguuaggaguucaagaccagccuggccaacauggugaaacucugucuucacuaaaaauacaaaaauuagcuaggcguagugguguaugccuguaaucacagcuacucaggaggcugaggcacgagaaucacuugaaccugagaggcagagguugcagugagccgagaucacgccgcugcacuccagccuggaugacagaguaagacugucuggaaaaaaaaaaaagaaucuugaacaucuaguuuaauggauuucaaguucuacucaaaggaguaugcaccugugcaggggaugaaggagcagggggugggguggcaggaggugggaggagucagaugggagaauaucugacccccugcuccuggcuucaaucagagcagcauuuuguguucauauuuauuugacuuccaugugaauuuuauuuaaugguuuugcugcugauugaaagagcagaaacccuugccccagcacccuguuuuccuuaaccucugucauucucauuaaccauggucaugacuuuugccauaucuauguaccaccuguauuguuaauuuaguuauguacuauuuuugauuaaaugcauucacucucugaaaaccucauuuugggccgaguuugguggcucaugcugguaauaccaacacuuugggaggccaaggcagauggaucacuugaggucaggaguuccagaccagccuggccaacauggugaaacccugucucuacugaaauuacaaaaauuagcugggcguggugguaugugccuguaauccccgcuacucaggaggcugaggcaggagaauugcuugaaccugggaggcggaggcugcggugagccaagaucgugccacuguacuguagccugggcgacagagugagacacugucuuaaaaaaaaaaaacaaaaaaaaccaaaaaacuaauuuuguucaaccuucucuuuuagugugugaggaaauuucagcauagagaagucaggugguugucauaccaggcugauauaagacuagagacugauaaccagguuaccagauaccagucgagagguuuagauaaaagacaaaaacuuaaaugccucccagugugccuccaucucaaaaaacaaacaaacaaacagacaaaaaagaaauccaguugaaacuacacaaccacuuuugauuagcuaaggaauaaauagcuuugaguuugacccaaguucaaauucuuuuuuuuuucuugagauggagucuugcucugucgcccaggcuggagugcaguggcauuaucucggcucacugcaagcucugccucccggguucacgccguucuccugccucagccucccaaguagcugggacuacaggugccugccaccaugcccagcuaauuuuuuguauuuuuaguagaguuggcauuucauucuguuggccaggauggucucaaucuccugaccucgugauccaccugccucggccucccaaagugcugggauuacaggcgugagccaccacgcccagccaaguccaaauucuuguuuggccgggcgccguggcucacaccuauaaucccagcacuuucgcguggaucaucuaaggucaggaguucgagaccagccuggccaacacgaugacuccaucucuacuaaaaauacaaaaaauuuuagccagacgugguggcgggcaccuguaaucucagcuacucgggaggcugaagcaggagaaucacuugaacccgggaggcagagguugcaguaagccgagaucgcgccacugcacuccagccugagugacaagagggaaacuccauaccccacccccccaaaaaaacaaaaacaaauucuuguuugaaagugaaacaagcauuucauuugcugcuuuucuuuaaugauaccaaagucauacuccuaaugagauuaggucuuuucagaaaguuaaaaggugcaacuguuuuuuuuuuuuuuuuuauuucucugauguguauuaggacuguuuauuaaggaaaaguauaacuucucuuacauuuauauucugucucuggugaguggacaaagaauuuuaauaauacacuugaggccagcgauuugagaccagccugggcaacauagugagacucugucuccacaaaaaauaaaagauuuuaauaauacggucuuuuuauuugaaauccuaggacucauccuugucugucauaguuuuagaaacuuauaaaccgauacugaaaaaguacacagaccagaaguauacaaugucucauauagauuuaauacacccugguaauuuuuuacccuguaaauguaguugaauucuauuucuaggggauuacuucaacaaugaaggacucucuuuuguuuuauuuucuuuuucuuuugugauaguagucgaagacaaagaagaaaagcauuucuuuucuugauuaagaaaucuuuaguagcugaagucuuccuucaggauuaaggaguauuauuaaucuauuuacacugcugucaauuugauauguuagacaauauaaaaggcgggccuggaaaaaaaaaacuuuuguaaucacuuuuuuuuuaagggaaauugaaaaguauaauaugacuuuuaaaguaacuuccagggcguggagcauuuaagauuagcugaacaaaagaccacaaaacagguuucuauaauguacuuuuuaaaccaggcaaaauccugcccaguguuaauacaucuuuggggccagaaaggcugaacuugcuguauauuucucuuggauugcccucuccaaacagauuauaaaccuagacucuagagucacaccaauguuagauggcuuucauuuucaccuaaucagauucuugauaguuuaugaguuagugucucugcuuauguggagguuagcauguauuaccaaaacagaaugaugcuuucuuuuuaaguaaauuuaaggcauuguuugccuguugcauguuauuuuauuucugauuagauauccaaacauugaauuuuuuuuuuuuuuuuuuuuuuucccccugagauggaaucuuguucuguugcccaggcuggagugcaguggcaugaucucaccucacugcaacuucugccucccggguucaagugauucuccugccucagccucccaaguagcugggguuacaggugccugccaccacacccagcuaauuuuuguauuuuuaguagagaugggguuucgccauguuggccaggcuagucuugaacucuugaccucagaugauccaccugccucagccucccaaagugcugggauuauaggcaugagccaccacacccaguucaaacaauguaaaucugaugguguuuuaaaaauugcuguuauuagguaacuugcuaauucaugaauaaaugaacucaagugaauuaagggaaauuagcccauaguuuauucuagaccucagaacuccugaccuggaauucauuugccacuuuuuguuacucuuuuaguuaauucaaaugaaaugguaacuuuuguguccuguaagcacaugacaggauuacaguguguuccucuuuguugagaagggaugacaaaacucuguaguuacuuuugauuuuuagaagcuugaaaucaguugacuugcauuuaaccguuguugaucuuugacuccacaagaaaaaauggggaaucauuguuauuuacuuacacuagauuaacaauuaacauuauuugacacauacauuuuaugggccuugaaacuuaauggaguuauuaugauugauauguguuuuauauauuuuccauagucauuacuccaggcaugaaaaauugaaagcacacccuccauaccacacagaaguguuugcccuuucuugcucgguuuuuuuccaaguguacuugaaaacgugcuuguuuuugcauauacagauguauauucguaaguacaugcagaaacacaaauaauacauguuuggaguugcaaauuuguuuugacauaaauggggucccauaacuugccuuuucaucucacagaaugucuuggagaucauuguauugguguuuuuucugucuaccucauucuuuuuuuuuuguaguaaauacauaacauacauuuacaauuuuaaccacuuuaaaauguacaguucagcagcaucuaguacauucacaauguugugcagcuaucacuacuaucuaguuucagaacauuuucaucaccccaaaagaaaaccauuaaaagcagucauuccccaucccucccuuuucuaguccuuggcaaccacuauucugcuuucugucucuaggaauuugccuauuuagaauauuucauauaaaugaaaccauauaauacguggccuuuugugucugguuucuauuacuuagcauaauguucucaagauucauguuauagcauauguuagaauugcauuccuuuuuauggcugaguaauauuccacuguauggauaugccacaugauguuuauucauucaucagugaacauuuggauuguuucuaccuuuuggcuguugugaauacugcugcugugaacauuuguguauaggcuuuuguguggauaaauguuuuuauuucuuuuggauauauaccugcaaguggaauugccgagucaaacgguuacuguauguuuaacuuucucagaaacugacaaauguuuuccacaggggcugcaccauuuuacaaggguuccgguuucuccauguucuugcgaacacuuguuuucugguuuuaaaaaaaugauagacugggcgugguggcucauaccugcaaucucagcacuuugggaggcugaggcgggaagaucacuugaggccaggaguucgagaccagccuggcaauauggcgaaacccugucucuccuaaaaauacaaaaaaauuagcugggugugggcgugguggcauacaccuauaaucccagcuauucgggaggcugaggcacuagaaucauuugaaccugggagguggagguuucagugagcugagauugcaccacugcacuccagccugggugacagagugagacucugucucggggaaaaaaaaaauuauagcuauccuaguggauaugaaauuguauuuuuguuuuguuuuguuuuuuuugagauggaaucuugcucugucucccaggcuagagugcaguggcaugaucuuggcucacugcaaccucuaccuccuggguucaagugauucuccugucucagccucccauauagcugggauucaggugcgcaccaccacacccugcuaauuuuuguauuuuuaguagagacggcguuucaccauguuggccaggcuggucuugaacuccgaccucaggugaucugcuugccucagccucccaaagugcugggauuccaggugugagccaccgcaccaggcccucacuguauuuuuuaaaaaaucuuacauguccuuccagugaaucauuguauuuugauuuuaguuucccuugugacuauugauguugaacaucuuuugucuauucauguccuaugcccguuuaaaagcugugguguuugucucuuggcuguugaguuuaagaguucuuuauauauuguggauaguacaccuuuaucagauauaugauuugcaaauauuuucuccccuucuauggauugucuuuucugacuuuauucuuuuuaauggcugaaggcuguuaccuggcauugaugagccuuauauuaacucuuucuguuaauaguuuccccuuuugcucuuaaagccgcaaagaguuguuugaucuauuuaugagaauaacuuaaauuuuuaaaaaucuagcuugguacaaaggaagagcagaaacugguucaacucucuuggucuauuuucuguccacuuaugugcuuauuugccguuuuuuguuuugucuagacauugggcauguucauuagucacauguuauguuuaugcacuggaacuuuuuucuugccauuaguauuuaauguaggauuucuaacuagguuaaauauuuauauaaaaauaacaccacagauugauaguuuaaagcacagaaugaaaagaggacaaaaugucuacauuuacaacacucuggccaccugguguuuuuuggugggauuaaagaaaccuaauuugucagugcagccucugagggugaccaguuaacaggcauguggauuguuuaaacauuuccuugaaaaaaauaacaaaauuaauguuaguccuguuaauacugugguugaugagcugguauaccaucuaggugcccaguaaaagaaagacaugcacgcuaacauuuggauuaggaaauuacauucaggaauaauuuuugugaaguacccauuuuuuuugccgggggguuggugggggcagaaauaucccuuucaaaucguuuuauuuuacaucuucuuauuuucuuucauaacaacaccucugugaggaaaguuagacauuauucuguuuuggagauugaggaaugaaggcauccagccaagugggagguggugggguaugcugugguuaagagcacagauuuggaaucugacucaauacugcagcaccuaccaguggugugacaggggcugugaugucuagaagccucaguuuucugauuuguaaucagagaagauagugguaaugacagcuaauuccgagggaaguuggaggauuaaaugagagaguauuugggguguucagccuaguucauggcucaugggaaguccucagccgaugggaauggcaggacacagcugcacccagcuggggagcaggaguguuccauauucagaucucugauguucuugucaccaaaccauuuacuuuuuccuguuuguaaaacccuuacuucccucuauguuaagagccagucacaugauggcaaaauaauuugugucaaugcaaucuguugcaguuacauuuauguaaaagugauugauuucauugacuuccucuucaccauauaguguuccaguugauaaucacuuccaaaaaguugaagaccauuucucagaaucagaaaaauuugaauaauuuuaaauaauuuuauaagguuuaacagcuuauauaaaaaaauagguuucuggcugaucaccguggcucacgccuguaaucccagcacuuugggaggccaaggugaguggauugcuugagcccaagaguuggagaccagccugugcaauguggcgaaaccccaucucuacuaaaaauacaaaaaaauuaguuggguguggugucaugugucucuagucccagcuacuugggaggcugagaugggagaaucaccugagccugggaaguugagacugcagugacccuagaucauaccacugcacucuagccuggaugacacagugagacccugucucaaaaaaguuagauuucuguuccucuuccaauaacuacugggaaacaaacuaguucaggcagacaaagaaguauagagaaaauauaauaaacauuguaaauguaccuccaguuuaagaaaugagacacgaaaaacaccgcugaaguucacuguguuauuccaauuguccauuucugugaggacccccccagaaauaaccacugacuugaacuugguguuuaucauucagaauugaguguuuuuuuuaaaacauuguauuauuuuuuuuuccacagcuaucugcaucauauuggugcauuuacugauccgauacagauuacauuucuugccagagaguguugcuguuguuucuuuagguaaguguguauuggugauuccauaauaaaagcaguaacaauaacuaccauuuuuugagugccucuuuagugccaggaaccacaagagaugcaucacaucccugaucucauuugauccucacugcaaccugcccuaagggugcuaugaucccauuuuacagaugaggacacuggggcucaagaaggguagugaccuccuaaaggucauguagaagcccaaaggccauacagcucuguacagcucaaaggcccuuucuuagccuuuugcuucugguagaacuacccuuggggaacauugaccucuacugcuaggcuaggcugacauccaacucaacuaagguaaguaaugacacuucauagaaucacucaauuuuauagacagaagggacucugacuuuacaguuuaggaggaagaaauggcucacuuaaugccagagucaggucuaaagucuucagagagcauugugcucuaccccacuuacauuucuguuuuguuuccugugccaauuaacuguugagaucuaguugcagugaaugaacccguguaauaacaggugugaaugcacacacaaguucauugaagugguuagugaaggaagaaguggggaauuuccguaaguguaaguucaaggcuaaaauguggguggagacauguaaggcacaguaaauaaagucuuacuaaggucagccaaagcuuuuuaucaguuuauuauauugcagucacuuuuacuaguuucuacuugccuacugaugguauuuaauuuuuccugaucacugcugauguuuagaaauuaacuuucauugccugguagaucuuuaguggaguaguaauucuuucacaagauaguuauuguuuagauuagcuuuggaaaugauuguuuagacucuguucacuagccucccccuccucccaucaccccagcaguccuacuaccuugguucagacucuccuguauuuucccuggacuucaguacuaagugccagauccuggcuugugaggcuucacauugucaucuaucucauuuaugccuuaugaccuccaggugaugccguauuuuaaggaaugggcaccacuggauaguguugaccucgaguacagguuucaaaaccaguuuuacucaaaaaguucuuguucuguuuuuagcauguuuuuuagcaauauaucuugguagauucuaacaaccuuagcuaguaagauagucauagagcucuaagaauaggagccuugcucauuaacauuccuuucugcuauuaggcauauugaaaagaaccuaugugacuaauacccauaauucugggacauucgguaaaggcucuaagaacuacuccaaggaauuuacaguuguguggucaguuuuauagcuucuuacauaaauuuguuaucaaaauuauaguugguguguauuuagauauuauacacaugaaaauuaaaaugauaauucuuauaauuucauuuggaauuucaagcuccucauguuucuugaaugucuggguaacugcagcuugcugaacaccagugcuucuauuaggacuuagagcagacauuguugguggcuuaccaaagagucauuucccccuucuuccuugaaaauagaaccccaaauuugaucagguaucuugccacagugugcucaaggaagaugggccccuccaagucaagauuggucuuugccaucauguuaauuucacucuucucugccaaugauuaguucagagggguaggggcggcaaggcagugugaaacccaguucuggccagugacaccaaggggaagcgugaugagguaguggguccuggaaaauguuuuccucucagauaguaaugagacauuuccccuucauuucuuugaugcugcugaaugagagugugaugccuaguggacugguagccaucuugcaacuacuguggcucaaagacaaaagccagaaugcuaaggauugccgaggggacagaugggaaucccagauuauugauagcauuguugcuuuguugaguugauagcccugaaacuuccuaucuuagugcuaccuuuuauaugagauaauaaacaucuauuagcuguuguugacuuggaauaaagaaaaaaaaccaaaaccaacaucuauuguuuaagccauuuuuagucuagguucuuuuacuugcaacuaaaagcaucuuaacuaacauagaacucuuuccauucaagggacaaaacccaauucaaaagaaaauaaauuggccaggcgcgguggcuuaugccuguaauucuagcacuuugggaggcugagguggguggaucgccucaggccaggaguucaagaccagccuggccaacauggugaaaccccugucucuacuaaaaauagaaaaauuagcugggcaugguggcaggugcuuguaaucccagcuacucuggaggcugaagcaauagaaccacuugaguccaggaggcggaaguugcauugagcuccagucaacgccagggcacuccagccugggugacagagcaagacucugucucaaaacaaacaaacaaaaaaaauugguggggguaggggcgcucaccucuugacucauguaacuggcaaaacuacagguaguauuagcuugagacuuagcugaaucaggucuccuggacccaguucuucuccaugccucagcagugaaucccuuuuccccggcuucgcugucaggcaggcucucucccugugguacucugauccguucucagacaggcucuuggugugguaagcccuuaaagcaguaacugcagugggagagagaaccuccucuucuuucuggcaccaaaaguugcaggaugaacucugaccaccuggcgaccucaacugggagugggguggaaugguguugggagucagccagagcucuccaucuacaagguucauuucuucacugauguugcagaaauaauuguagccugaauagcuaggucuugggagaagugauggaaaggcagucuugcuuucaaugcuuacuugcuaacucaggugacuggaaacccaagagcacuuccagggagagugcugagguccagaaaguacuuuuuaaaaauuauguuagaggacauuugguuagaauuuguaaaugcugacauagcuaucaaaguaauucuguauuucauaaagcuaaagaaauggaaggaaaacguuuuucuccagcuggagcaaaguguaacaaaauauugagauaucuaccauuucaagaauuuccaacuuugugccaaaaaagaaucuagaagaaguugccagagaaaguaugguuuucguucuuucagggauaaauuuuccucuccugccagaaguugcuuuguagcuugcagucauuucgagacauuacuggucuuuugcuuuauaguuagguguucagcauuccuaagaaauucucaguauagaaaaggaccaucugcacuccaaaagcacauguccccuccuucuaccuuacuguauuuuuaaaugagugucugucuggccacuuuucauucuuuauaaaaauauaguaucaaccugaaguucuaaagaguuccuuggccccuguucgaagcuuucaggauacuuuccauacuuuauggaauucuguaguuugggccuuuuaaaaacuaauuucuuuugcacaguuaaacaacuacuauauauagaaaaaagaaaaaucuuguuuauugacaauuauuuuuaucuuguuucauucucuuccaguccauguguagacauguccguauguauuagaugccuuuguauaguuuaauuugaguuuauaucauuuuuucuguucuuuccauguauuaguugaguucacauauuuauuuauuuaucuuuuuuuuuucagacagagucuccuucuuucacccaggcuggagugcaaucacgaucuuggcgcacugcaaccuccgcccccuggguucaagcgauucuccugccucagccuccugaguagcugggauuacaggcacauaccaccaugccuggcuaauuuuuguauuuuuaguggagacaggguuucaccaugucggccaggcuggucucgaacuccugaccgcaagugaucugccugccucggcuucccaaagugcugggauuacaggcaugaaccacugugcccggcccauauuuauuuuuuuacuggcuguguaaugcugauucauguauauauuuuaggcuaaaauuuguaaggaaugaaaaugaggcugggugcaguggcucaugccuguaaucccagcacuuugggaggccgaggcgggcagaucaccugaggucaagaguucgagaacaaccuggccaacauggcgaaaccccaucucuacuaaaaauaacaaaaauuagucaggcaugguggugcacgccuauagucccagcuauucaggaggauggggcaggagaaucacuugaacuugggaggcagagguugcagugagcugagaucgugccacugcauuccagccugggcaacagauagagacugcaucucgaaaaaaaaaaaaaaagaaaaagaaaaugaaauacuuguaagcguauggccagcauccucuguugaauaauaccaaagacaggaguuucccccaaccccaaaaaucaugcuuuauuuuagagugagaaaaggccagauuaggguuauaaguggagggcugaaaguuugacuuucaguugccaaaguuuagccuuaauacugcugaugauuagaaaaacugugaucuaacuuacaaacuagauuugauugaaucauuggguaaauagaauauacaaaagugcuccccugucauaacuuuuuaaaccauauuugugcuauuuaauucuauuccuucuuguuuucuacuaaaagauuuuaauuuuuuuguuuuuuaaggauaguacuuuuggccaguuacagcucuuuuagaauuugucgagcaggcuuuccaguuuuuguuggaaagcccccguacccccaccaaaaaaaaauuuuuuuuuuuuuuuuuuuuuuuugagauagaguuucacuuuugccgcccaggcuggagugcaauggcacgaucucggcucacugcaaccuccgucucccggguucaagugauucuccugccucagccucccgaguagcugggauuauaggugccugccaccacgcccagcuaauuuuuuguauuuuuaguagaaacaggguuucaccauguuagccaggcuggucuugaacuccugacaucagguaauccgccugccucggccucccaaaaugcugggauuacaggcgugagcuaaugcaccccgccuaauuuuauauauauauuuuuuaguagagacgggguuucuucauguuggucaggcuggucuugaacucccgaccucaggugauccaccaccuuggucucccaaaguguuggaauuacagccgugagccacugugccuggccaaaaaauuguuuuuaauuaaaaaaaaaaaaaagggccuggcacaguggcucaugccuguaaucccagcacuuugggaggccgagguggccggaucaccuugaggucaggaguuugaaaccagccuggccaacauggcaaaaccucaucucuauuaaaaauacaaaaauuacccaagcaugguggcauauaucuguaaucccagcuacucaggaggcugaggcaggagaaucacuuuacuccgguagacggagguugcagugagccaagauugugccacugcacuccagccugggugacagagugagacucugucucaaauaaauaguaauaauaauaauaauaauaauguauuaauauauuuuacacauuagcacagugcauggcacacaguauagauguguguguguguguauguaugcauuuauuucuuuuuaacacagugcaaauacauagguguguguguauguguguauauauagauuuuuuuuuuuuuuugagagagagagaacuugugcugggauucuacacuuuguaaccugauuauuaauacauuugaggauguuuucgguggcccaugcgucggggaugguuggauaguaagaugggggcugugaguucgcugcucagcaacuugaugugggggaaacucggcugguauccuccuucaccaggaaagaucguuaauccaccgaaggacuugaagaaaccucauggggcugggcgcgguggcucacgccugugaucacagcacuuugggaggccaaggugggcggaucacgaggucaggagauugagaccauccuggcuaacauggugaaaucccgucuauacuaaaaauacaaaaaaaaaaaauuagccaggcgugguggcgggcgucuaguccuagcuccucaggaggcugaggcaggagaauagcaugaacccgggagguggagcuugcagugagccgagaucgcaccacugcacuccaaccugggcaacagagugagacuccaucucaaaaaaaaaaaagaaccucauggaaagaaaugcuucuuugugaaauuuuuuuggaacauaagaucaugccuggauuaaagugaaacagcugaagccauaucaugcucauaaagaggaaaugauaaagauucacaaggguaaacuauuccagcaagcgguggaugccgccaaagaguuucucaggagagcccaaagggaaagaucagacgucaucccacaauucugcugaugacaagaaucggcuuaauuccagugaggagagaagcaggccaaacucaggugaugagaagugcaaacagccugucugaaggaaaagugaagaagaucaugggagauggaaagaagggggugucuucgggcucuucagagacaggcuccaaauccccucugaaaagaauccaagagcaaaguccccagaagcggggucagcccccaaagaaugagaagaaugucaccaucguggaguccgguaccuugaaguggaugauggccggaccaguggcugcauuuaaauggcagccgaccagaagcgagccuguuaaagaugcagauccucauuuccaucauuuccugcuaagccaaacaagccaucucugucuguuaccaggcaaucacaaagaaguugaaaauaugugaagaggaaacugguuccaccuccauccgggcagcugacagcacggccgugaauggcagcaucacagacaaaaagaugggauuugggggccuuggucucaugagaaguggaaucgucucuaacuugcuaaaaaugggucacacagugacugucuggaaccgcacugccaagaaacgugauuuguucaucuaggagggggcccgccugggaagaaccccugcugaaguccucucaaccugugacaucacuuucgcccguguguuggaucccaaggcggccaaggaccuggugcugggccccagugguaugcugcaagggaucugcccuggaaagugcuacguggacaugucaacgguggacgcugacauagucacuuagcuggccugggugauugcguccaggucggggggucgcuuuccagaagcucccaucucagggaaucagcagcuuucuaaucacagaauguuggugaucuuagcagcuggagacaggggccuauaggaggacugcagcagcugcuuccaggcgauagggaagaccuccuccuuccuaggugaaguuggcaacgcagccaagaugaugcugauuguaaacauaguccaagggagcuucauagccaugaucacugaggugcugacccuggccuaggugacagaucaggcccagcagacacucuuggacauccucaaucagggacaguuggccagcaucuuccuagaccagaagugccaaaauacccugcaaggaaacuuuaagccugauuucuacugaaauacaugcagaaggaucucugcuuagccauugcgcugggcaaugcggucaacucucugacucccauggcagcugcagccaaccagguguacaaaagagccaaggcacuggaccaguccaacaauauguccgcuguguccugagccugcauacacuaagccgucggaccccccacccccagcccucuaaucucuccgcuaacucccucuuccucacauggggucaggggccugggacuuugcucuggaccagcccaccugucuccauuuccuuuuacacagacuuugagacuugccaucagcacagcacacagcagcacccuuccuuugaggcugguauggaggggaugagugucagcaggauuggcucaugggaaagcucuugagcugggcacuggccuccacacgaggagguggcugugugugcacgcacacacacgaggagguggcuguguacacacacaaacacacacacacucucucucucucucucucucucucucucugucucucucucucucaccccaggauagaaacugcccagaaacagcugccuggcuuuuuuucuucuuccaagcuugucuuaucucaaaccccuuccagucaaggaacuagaaucagcaaugagaguuggaagccuucccacagcuuccccaagagcgaagaggcuauagucauguccacgucccccgcugaauucucugcagggagaggacuugggcccagaugagccagaccagacuccagacagagggucccguggggcccccaaacucaggugaugagcugagaaagagaaagauguucaugucuaaguguccagugugcaccuagcacuccuuagacgccuuugugaacugaaaagagacuggcagaguccugcgaaaaugaggcccuggcuuuccagggaguauggugagcaucuggccuucgcugccuggaagugacaccccagacaccacugccacagugggcgcuugccccgcccugggcuguucuaguauuuggauuugcauuccaguccuugggaggggguccucagggucauuagugaggagccaagaggagugggguugggggacacuccuuccuguuucuguuaggccacagacucuucaccugccucugaagagcugcucugaccuuggucuccuccccgcagucccacauucuccagccugcccugccaagccccuugcaugcccacugcucucuguccucccuucuccccaccuuccucucauggagacaguauuucuuucugucugucugucccuucuuuggcccagacccagccugaccaacgauaagcauuucuuaggcucagcucuugauauggaaaugagugucuucacuccagccagcaucauggucuucggugcuuccaggccuggggucugucgggggugaaaagaacuggccugaccuaccugaacugacugacccucuggggugggucugggacauccucgaggcccuagcauuucuccuuggauaggggaccagagggcgcuugggauguugcauaagaacaggaagucacccaagggaugucaauuucuuaucccucuacauggguuggauuuuccaaaaucauaauuugcagaagaccagcacuuaugguggaauguauauuauaaggcagccacacuggggcaggguccuuccccucuccccacucacggcuuuggcccuuucacagauuagaaccugaguuagaggauugcagaagacgaggugggagggcagggaagaugccugucagguuuuuagcacaguuuauuucacugggauuuugaaacauuucuguuugaacacaaagccuguucuagucuuggcaggacacauucuggggguggggguggaggaagaugugguaauguaaccgguuagucaguguugucuuaauauuguugacaauucuguaaaguuccuuuuuauaaauauuuguuaagcuguuucaccuuuguuuugaaauccuuuccuuuuuuuuuuuggagacagagucucacucuaucacccaggcuggagugcaauggcauggucucagcucacugcaaccuuccccucccggguccaagcgauucucccaccucagccucccaaguagcugggacuacaggcacgugccaccacacuccgcuaauuuuuguauuuuuagcggagacgggguuucacuauguuggccaggcuggucucgaacuccugaccucgugauccgcccaccuuggccucugaaagugcugggauuacaggugugagccgccaugccuagcguguccuucccuuuuaagcagaaaaugugacacuugugaaaaagcuuguaagacagcacuucccuuuuuuucccuuuaaaccuuuaaauggcaaaucuagguaauuaaaguugugaauuuuuauuuuugcuuuguuuuuaaugaacacuugucuuucagaauaggauugugugauaaugucuaaauggcaaaaacaaaacgugauuuugcacaauuaacaaaacuacugcaagaaaaauaaaacauuucuugguaacaaaaaaaauuaauacauuugaaacauuuuucauguaaccuuacugaccaggaauacuuauauuuuacagucauaaugguagcccugcagugcacucugggagugagcgagcgagcauuggcaguucauuguaguaguguaggcagccugcaguagugcagucuccugugucuuuagcaugaugagaugguaggaugcacccgagccaacgggccagcauccuuacuggcccuaagcucucagaaaagcuucuuaaacucucugagcuucccuacaguguucuuuugaggauuagaaguaauugaaagugacaaauccugaaagaagcagcucaacaaauaaucauuaauugcuccugauccucugaaugaauugagggguguccuuaauuagguguaugcacaaagaucaacuaggagcaaaggaaaauguuagaacuuguguuucuauuuauuuuuaaccucacucuuuuacaauuucuauuuuuuugugaauauuuuuaaauauaagcugggcgcaguggcucacgccuguaaucccagcacuuugggaggcugagacaggcggaucaccugagguugggaguucaagaccagcuuggccaacauggugaaacucugucucugcuaaaaauacaaaaauuagccgggcgugguggugcacgcuuguaauauuagcuugucucucucucucucucucucucucucucucucucucucucucucucuauauauauauauauauauauauauauauacacacacacacuauguauauacacacacuguauauacgcacuauaugcacuauauauacacacaguauauguauauacacacacuauauauacaguguguauauauauauauacuguguauauauauauauacuguauauauauauauacuguguauauauauauauacuguguauauauauauacuguguauauauauauacuguauauauauacuguauauauauauauauacuguauauauauauacuguguauauauauauauacuguauauauacacacacacacuauauauaugccauauauaauaucugguggccaguugugugaaauacauucauuuucucuguuggguagauugauuugaccuaacuaugagccucaaucucaagagguaaagugguaguuugccaauuuaaugcugcacaaaggauuauuuaaguaauaauaacaauaauaucacauuguauuuuacagcgcuuccuaguacaucauaaauaauaaaaagacgcaggcuugggcaauagaauaauuacugauuuucaaauguaacugcuucaugugugauuauaaacgagguaaucauggcauuaagguuugguauacauuuagaagggaaaaagaaaguugagguuuuaguaaagcagaaaaacacuaagcuuuaaaaaugaagccugaaaccauggaaagagguuuaacuucccuaguaaucaggaugauugcugaaugcaaauugaaucaaauacaaauugaaacauuaaaguacaauuucuugcccacuauguuggcagaaauguuaacaucugaugauuauccagcgcgacugaggaugugggacgcuuucuuguggaaguguaagucgguacaaccacuuuggaggauaauuuggcaauauuuucagaguuaaaaaugcuuaugcuuuguaaaccugccauuuguagucucuggaucugcccuagggagauagucuggguuuguuuuuuuuuuugugaaugucuuccacagggagauacucuuaacacagaguggcauguacaagcauguucaaugcagcaccacuguuaauagcaaacagcuggaggcaaccaucaguggggcaaugguucaaaagguugugauuuuaaaaaaaagguacaauauaauucacauaucauaaauuucaccaucuuaaagugcacaauucagaguuuuuuaguauauucacagaguuguacuaccaucaccucuaccuaauuccagaacauuuucauuaccccaaaaagaaacucauacccauuagcagucacuccccauuuccacauuucucccuucucccauccccuggaaaccaccaaucuacuuucugucugugaauuugccuguccuggacauuucguauaaagaaauagaaucauacaaucggugguacuuuuuauuuggcaacagcuuuauugagauguacuuuguaugccacacaauucacuuuuuuuuuuuuuuuuuuuuuuuugagauggagucuugcucuaucacccaggcuggagugcagugcuacaaucucagcuuacugcaaccuccgccuccuggguucaagcgauuuuccugccucagccuccccaguagcuguaauuacaggugcccgccaucacgcccaacugcuuuuuuuguauuuuuaguagagacgggguuucacuauguugaccaggcuggucuugaacuccugaccucagccucccaaagugcugggauuacaggcaugagccaccaugcccagccaauucacccauuuuaaauguacaacaauuuuuaguauguucagagucgugcagccaucaccacagucaauuuuaggacauuuuuaucaccucaaaaagaaaccacaugcccuuuagcucuccucccugucccugggcaaccauuacugucccuguagauuugucuauuguggacauuucauauaaauggaaugguaaaauauauggucuuuugugucuggcuucuuucacuugguguauuuucaagauucuuccauguucuggcagguaccaguacuucauuccuuuucauugcugaauaauauuacauuguauggauauaccacauuuuguuuacucacucauuaguugauagacauuuggguucuucccacuuuuuuuuugaaauggagucuaacuuugucacccaggccggagugcaguggcgcaaucucggccuacugcaaccgccgccucccagguuccagcgauucuccugccucucccaaguagcugggacugcaggugcauaccaccaugcgcagauaauuuuuguauuuuuaguagagacgggguuucaccauguuguucaggcuggucuugaacugaccucaagcaguccacccaccugcgccucccaaagugcugggauuacaggugugagccaccacaccuggccucuuuccacccugugacuguuugaaauacugcuguuaggaauaucuguguacagguuuuuacaugaacauguuuucaguuucuuugaguagaauugcugggucauaagguaacuuuugaggaauugccaaacuguuuuccauggugguugccccauuuuacauucccaucagcaaugagugcguguuccaauuucucuauauccuugccaacacuuauuucucaucuuuaaaauuauaacugugaaaggaagacaaaucuugggacccuaaaaucacuaagcuaaagggaaaggucaaucugggagcugcuuaggacaaaccugccucccauucuauuucuaaaaagauagcuacuaagauaaaaaaguuaacauaccucccucucaauuuguacacaagaaaauuccuuguggacaaaggacagaacucaaagucaccccucucuuuguugagauaaaugcauaucugauugcuuccuuuggaaaggcuaaucagaaacucaaaagaaugaaacuguuugucucuuauuuaucugugaccuggaagcccccucccugcuucuaguugucccaccuuuccagaccaaaccaauguacaucuuacauuguugauagaugucucaugucucccuaaaauguauaaaacgaagcugugccccgaccaccuugggcacaugucgucaggaccuccugaggcugugucaaggguggucauccuuaauguuggcaaaauaaacuuccuaacuugacugagacuugucucagauacucugguuuacauaaccauccuaguagguauggagugguaucucauuguaguuuuuauuugcauuucccuaaugauuuaugauguugaacaucuuuucauguguuucucagccauuuguauaucuucuuuuccaaaauaucuauucaauuuuuuuuauuauuuuuauuuucauuuuauuuuauauaauauuuugaguuggagucucacucuguccaccaggcuggagugcaguggcaugaucucagcucacugcaaccucugccuccuggguucaagugauucuccugccucagccuccugaauagcuaggauuagaggcgcccgccaugcccggcuaauuuuuguauuuuuuuaguagagacuguauuucacuguguuggccaggcuggucucgaacuccugaccucaggucaucugcccgcuucagccuccuaacgugcugggauuacaggcaugagccaccacgccuggucgguucuguguggcauuuuuauacuauccugcccagcuguuaaaaggaaugaagcaaaucuauacauaauaaucccugacuagaucucuaagacuuaauguugaacaaaauagcaaguaguaggaugauacauuauacuaccauaaauuuuauauaaauaaauacacucaggugugccaugcauacacuuacacacacacacacaaacacucacacccugguacuguugaguuaaauauauguaagaggauagagaagggccugauauaauauuucccaaacuuuccaagauaguugguuaccuugggcuaggaagagagagaacgaagauggggguggaagugggguaugaucuaaaggggcuuuugucuuauuuaugacauuuuacauaguauccgcauacuauuuggccaauaaaacauguaaaagcuccuuaaaauguaauuacaaccugaaaaaauaagaacaugggagcuguuggggaacuguagcaggagauggguucaaauccaugcuccaugcccucuggcaagggaauguguauucauugacuccuuuuauagcucagcuuuauuuugucuuggguccuuccucuuuuucaaaauaguuuuauuauuuuuuaauacuauauaacaauucaaauagcauggagguuuauaaagugaaaaugaacuuaucuccccucuucaccugaaacuacccacccugagguaguuuuagugcacguccuuuuccugcucagcuucuguguucugguauugucuccugcccacccaguaagcugugcuuccaucuucucguugauggcgaaagcuccuuccuccaugggaaagugaagucuucguuuugaagcauccauggaauggccugcaggcuugcuuugugucaccuccuacccgagauugugauugugucaccuccuaccgagacugugaacuccuacccuacaaugaguaggucuggaguucuacuugggcgucuuuauuuuauaaaaaguucccauggugauucuggugaaccaacagaggguuaagagucguuuaucuagggaguaacagagcaaucauaaauugugcccaugcugcuucuuugagaauuauuuuugguggccacuuuauaagagugaugagccugucagcuuuauggaaacaugccugaacuuagauggucuguuuucuuccaggaauuucacagaacuuuuacuuuagguuauuuucagcauuuguguuuuucuagcuaaauauucaacauggaacugcuauuugagucugagaaagugaucauggauucuuuuuugaaaaugauggaaauaaacaguacacggcaaacuuagcuuguaaacucugcauuucacauugaaaauggguggauaugguaaaaaugauaggcgguaaaucuucaccaggcagaguguccuugggucuugcuuuaaaauacuuuuccucccccacagccugacuuuuguauuucauuuuaguguguuugccugagaugugagugagaaauucaugugauagaugucucacgucucccuaaaauguacaaaacgaagcugugccccaaccaccuugggcacaugucgucaggaccuccugaggcugugucaugucuuaaauuugaguaaucuuucucauaucuuaaauuuauguuaaaguuuacauuuucucuuguagguauucucaugggagcaguuauaaaaauuauagaguuuaaaaaacuggcgaauuggaagguagguuugcccuuugguuguucuuaauuuuaguaacauugaucauuaugcuggcuuuuuuguaauuacuuggcuaucaguggaguuauuuauauuauuauguuauauaucccauuacuuuuuaauuuuuuuauuagauacagguugaugccuuuacaucugaguuuuugcaaaagcauaagucucaugcuguuucaagugaacaugggcgccaaugucauuuuuuuuuguuauuauacuugcauuuuuguaauccuagacuaaccuacuuuuuuaggcaggaaaauucucuaauuagcauuaaacauuaaauacuguuuauugcucccaauuccauuuugacaacugaggauaauaaaacauacuuguccaguacugugagacacaguacuuuauauauuguagcucauguuauucucaugacagucaugugagguggauugucuggguauuguaauaucaucaccucguuuuuacagaugaaaaaagugacacucagggagauugggauguauucagugucacagagcuagaaagaaaguggccgaguggagucuuguguccaaacccucuggccugaauaugcaguguuuucuccaccauaccaccccguccucaguuugcugauauauauacccuuguguuaaagagguuauuagaauaugaacaucauccuggggugcaaguacucauugaaacuggaauuucaacauaaacuugagcauccauguugaguagggcgagauuaacaaguaugcuacaaaauugauuuuguggagggaaauaagauucauuucaaaauauaaagaauuauauggcuaaaauugaucacauuuaagcccuuccuacuuugaugaagcuccuaggugcuaggauuaauugaccugugaaacuguagaguguaaaauuagcaagacaaaccuuauagacuaacguaaaacacaauuugaagcuguuauaaauaguaguaaugaaauauuuuauauauuaaauaaauuuugaaaauguauauugagcucuggagagugauaagacacacuucugcuggggaggccccacuggagcgcauugcaugugggaucucugccuuccugcuacuugguuacauuuaaccacccaagagugggucaugacugaagagccuuuuucuacuccuaggcuggauauagccugauguguagauuuugcccacuaacccauuuuguuugaucugauuuaaaaaucauuugaucaaggcugggcguuggcggcucaugccuguaaucccagcauuuugagaggccaagguggguggaucaccugagcucaggagcucgagaccagccugggcaacauggugaaacuccgucucuaaaaaaauacaaaaaaaaaaaaagaucaaaauuugaauugacuuuaaaacaauuaaaaauuguuagauuuugggcgggugcgguggcucaugccuguaaucccagaauuuugagaggcugagucacguggaucaucugaggucaggaguuugagaccagccuggccaacauggugaaaccucaucucuucuaaaaauacgaaaaaguagcuggacgugguggcacgcaccuguagucccagcuacuugggaggcugaggcaggaggaucgcuugagcccaggaggaucgcuugaggcugcagugaguuauaauugcaccacugcaguccagccugggcaacagagcaagacccugucucuaaaaaaaaaaaaaaaaaaguuggggcaggcuuccuggaggagacugcauuuguggagagucagagugagaaguaggauuccugccuggaaaccagaugugcagggagcagugggaagucagaaaaacaagaggagcuggugguuucuuucccugaaguucugauuccaaacugaccugcugggucugcccagguagcaaccuguauuaucaugugcuuaauauuuuucuaucaacuugcuuuuuaauuauauguauauauauauaaauuauuuauuuauuucuuauuuucuuuuuuugagacagagucucucuugguuguccgggcuagagugcaguggcacgaucucggcucacugcaaccucugccucccggguucaagugauucuccugucucagccuccugaguagcugggcaggagaacaggcaugugccaccaugcccagcuaauuuuuguauuuuuaguagagacagggucucaccauguuagccaggcuggucucgaacuccugaccucaaguaauccacccaccuuguccucccaaagugcugggaguacaggugugagccacugcgccuggguguggcuaauuuuuaaaaaaauuuuuuguagagacacgaugucacuaugcuacccaggcuguucucgagcuccugggcucaagugauccucccaccuuggccuuccaaaguguuaggauuacaggauugagccacguggccuauauauuuauuuuauuuuauuuuauuuuuuuuuuuuugcuggggagugguggggagcagagucucacuauguuauccaggcuggagugcaauggcguggucucagcucacugcaaccuccgccucccagguucaagcaguucuccugccucaaccuccugaguagcuagaauuacaggugccugccaccacgcccggcuaauuuuuguauuuuuaguagagaugggguuucaccaaauuggccaggcuggucucgagcuccugaccucaugauccauccaccuuggccucccaaagugcugggauuacaggcaugagccaccacgccuggccauguuuauuuucaaggcaacauuacaguacuauuucaauucagaaacuaauauuguuuuguaaacaugauaaaaaugaaguaguacagaugccugcugaagcaucagaggucaagucugcucucugucaagggagaucagcacguuggagagagcccuuagaagcgguauugccauccuaaggugucuuggauuuauuugggccugaagaaauaaucaaaaggggcugacucucucaauccaugaggucagugguauuugacacacacugcucaagugccaccuaaaaucaccucagaacauuuugggggagccauugccaaaaggaacuguaacacuauuucccugaaaggcaguguguucauaagggcugcaguaacaaauuaucacaaacuaaguggccuaaaacaacagagauuuguuuucucacaauucuggaggccagaagugagaagucaagguaucaacaggaccagguucccucccaaagacucuagaaaagaauucuucauugcaucuuccagcuucugguggccccgguuuuccuuggcuuguggccgcaucacuccugucuuugucucugugcucacauggcauucuucuccacgugucuaugugccuuguucugucucuuacaagucgauguuugcugccuuuggccuucccuuauccaguguaaggucaucuagauccuuaccuucauuagaucuucagagacccuauuuccaaauaaggucacacucugagguuccugguggccaugaauugugauugggguugggggacacuauauaaccccacuauagguagauucuccuuuuuccugggguggggggggcuaguuuuuauaccuccaaaaggcuguauauagugguccugcugcacagauccugagaauagguugccccguaaaacacagagcucggcucauuuuuuuucacacagucccagucugaaucaugagcuugagcuuguuguacaugcugcuauuuuaagacuuaauaaggcauuucagaagucaucauuugcuucuauuuugagcguuuuuugacuuucuuuuagucuuuaugguaacagcuguacauuuguaagaauacauuuaggcauucuuuggaauaggcauuuugacaaaaaaucagacugucaaaauugugacaugggaaaauauucauaugaaaaagggccugauuuugcauuuuuaaauagacuguguauuacacauaaccauuuugggcuugaggaccaauauauauuuccccaaaauucuaccaacaacuagagagauauauuaauaauauagaaaaugaaauuguuauuguuucaccccuccaaagauggcuauauucuagaaacaccuuucguaguggcacuuaauaaucaaaucuggaagcauggugcuaugguuugggcauuugucuccccaaaccucaugcugaaauuugauuccaguguuggaaguguuugggucauggggguggacccucauggauagacugaugcccuugcugggggagggaggugaaugaguuguugcucuguucguucccuauacagcugguuguuaaaaacagccuggucccauccccgcccccccuuucuuccucucuugccauggaucucugcacacucuggcuccccuucucuucccccaugaguggaagcagccuaagguucuuaucagauacccagucuugaacuuuuccggacagcagaaucaugagccaaauaaauguuuuuccuuuguaaauuacccagccucagguauucuuuuauagcaagacacaugguaaggggcugucuuuguaucaaagucucaagucgaaagagcauccaguguggacuguuuuaucacaucagacuuuggaaaauggcagaguugucugugauaagcagaaagaaggcagagcuauuuuaaccauauauaggauuuacuguuccucugaguggauuguuuuagggcuugccauuaccuuuuuccuggaggauuccaauuuguggaguuguuuuugaaagucugcaaccagaauugaaauuuucuguauucagauuaauuuucuuucuguacuaaggaauaaaaaacauacuacuguguugugcuguuucuuuucacugaucaccuuuaaaauccuugucuuggccacgcaugguggcucaugccuguaaucccagcauuuggggaagcugaggugggaggauugcuugaggcuaggaguuugagaccagccugggcaacauagcgggacccuguaucuuaaaaaaaaaaaaaaaaaaaaaaaaaaaaaaauuagcccggcaugguagcacgcacauguagucccagcuacucaggaggcugaagugagaggaucacuugagcccaggagguugaggcuacagggagcugugauugcaccacugcacuucagccuggacaacagagcaagaaagacucugucucaaaauaauaauaauaauaauaaugauaaaaauaauaaaauacaguuucauuuuuuuuuuuggugggggaaucucucauucugcuugauuuuauuaucagguaguuauuuaaacauuauauguuuccacuaggccaggcccugagagaauaauuauuuuggcucuuuauugauuaauuuauuucuuaauuacacaaauuccaugcccuuaagauacucauuuucuauuuacaggaagaagaaauguuucguccaaacauguuuuuccuccuccugcuucccccuauuaucuuugagucuggauauucauuacacaaggugagacucaggcacacauuggugcuuuggucuggacaguuucucauguuuguaaggcaaguuccuuaaaagcuuggguauaauuuagcagcagcagcagcagcagcucugcuccuuccugguugugcucaguggaagcuggacugcagugccugacuucuggagaggagcagacaugaugaauuggcugcuuuaaugguuucaggcaguauggcucacugagccaguguuugccauaaaugggugcuuugcccaggaagauggcugaagugauguuaaguggcucacagaugaugcauugacucgucuuccuggacacagacugauagauguaaagaggauagacuguguccugggacgacggggacaugugccccaggacuuuuguuucuuucagcucccccacuggggccuuucuaaccuucucaggcccauccauccuuccaugucucccucucggugcccuccccuggccucagaccccagcuugauauuccccuucaucccucaaccucuaucgcuccucgcccacucccugguccagcuucuccuucccaggcuggagccccauccuucccugccuagucccacaguugccugcccauucuuuccucccugccuuggugagcaguggcacuggccccuacccacuucucugcuuuggcuuggccuugacggccauugccuugcaacucccagugugagauguuuuuuuuuuuguuuuguuuuuuuugagauggagucucacucugucacccaggcuggaguccuguggcaugaucucggcucacugcaaccuccaccuuguggguucaagugauucuucugccucagccuccugaguagcugggauuacaggcacacgccaccuugcccggcuaauuuuugucguuuuaguagagacggacgggguuuuaccauguuggccaggcuggucucgaacuccugaccucaagugauccacccaccuuggcuucccaaagugcugggguuacaggcaugagccaccacacucguccccuagugugagucuuucugccugagcaggagcuucucacuuuuaagccugcuugugugcgugcaugguuuuuuccuugucugugaguuuucuuuaaacauaaauguauuuaaguuuuaaaauaaagugauucaacuuaaaauacuaguauuaauaauacagcagcuauuuugugaaugugauuuuuaaaaaaacugugaagauuggaaaguuuaggccaguccuuggagagaggaaagccagagacacaacacagaucuaaucaugcgcugcccccuacagguuucuuuuugguaaaguagaaaccaaaaaccccaaaacccuaccucccagggugcuuugagagucacacuagaugaaagaacguaggcaaagcaccacccaccacacuaaauaaaugaagugcugcugcuuguuauuaaugauaaaaaugucauuuauuauuaauaacaauauuaccaccaguaguaauaauaauuuauuaagcuuaauauggucgggcccaguggcucaugccuauaaucccagcacuuugagaggccgagguggguggaucacuugaggccaggaguucaagaccagucuggccaacauggugaaaccccaucucuacuaaacauacaaaaauuagcuggucgugguggugcgugccuguaaucccagcuacucuggaggcugaagcaugagaaucaugagaauagcuugaacucgggagguggagcuugcagugagcugagaucacgccacugcacuccagccugagugauagagggagacuuugucucaaaaauaaauaaauaaaaauaaacuuaauuuguuguugacaugguauaaaauaaauaaauacauaauuuuaaaaaaugaguuagauuugucuagaaauguuugguaaaaacauagaaauuaagucuuuaauuuuccuguacuaaaacaaaagcauauuaagauguucagcccagauuuuuuuuuaaguuauuauuuuauugugcaucuauccaaagaaaaagugaaaaggaaauuuaauguaaaaaauauucacaagucuuacaaacuguuagugacaucagauaauuuuuaacaaggaaacauaaguugaaggucaccaugucuuuccuuucacuuuguaaacaaaucuuaacuguaagcagauaugaaaauauuucaaaacaugcugaggaaauugacuugauuuugacuuaaaaacaugacauuuugaauauuagagcauguaaaguuuuucuuuucuuuuuuuuuuuuuuuuuuagaggggagagaaacuuguucaaaauuugaggaaaguaauaguuuuuuagagaaacauuuuguugaagaugacuuuccagcaggaaaugugacaauuuauaugaaagggacugauaggauuaugaaaugcuacuucugaaacuucuauccacuuucuacccucgcccaaagaugauaggaaguaaaguuugaauauuuuauuuuaauauuaugauaucugcuaauguaaauuuggauuuagaauacagauuacaguaagauuaucaucaguugauaugcauuagcuaggcagcaacugguucuuugaauugcaaauauuacacaaaucacaggauguuaauuaugucagagagaaacagauaaauuugcuuuauguagcagagggaaguucuuguauuaugguaacuuuaacuuggguaaauguucaggauccagauuaauauuaaccaaauauauaaauuauaucaacauuagaucucugcaaacaggucaaaacugauuaaucuguuuuuuuuuuuuuuuuuuugagauggaguuuugcucuuguugcccaggcuggagugcaauggcacgaacucggcucacugcgaacucggcucacugcaaccucggcccccuggguucaagcgauucuccugccucagccucccgaguagcugggauuacaggcgucuauaaccacaccagcuaauuuuguauuuuuagcagagaugggguuucuccauguuggucagguuggucucgaacuccugaccuuagaugauccacccgccuuggccucccaaagugcugggauuacagguuugagccaccgagcccagucuaaucuguuuuuaaauaacaaaagaaaacagcgauuugcaaagagcaacucauagauugaaagcccuuuguuuugaaaaaccaaaucauuguguuuuaaaauucuuugugcaguaaagauugauaugccaaacaaaggaauugaaugucagaugauaggcagccaagucaaaauugcagcuucuaggaggugggcuuaguggggcagucaguguucagcugaggacacucuuucacaagugggcuuuaaaauagcaggucuugauguccaugguuuggugauuucugagcuaaaaacaagauucuuguucacaaccacaaucgggggugaucaaagacucuugguagcuccuaaguggaguucauaggguuauaauaaauagcuuaauuuccuuaauuuuauggaaauuugaaagaugcuaccaugcugcuugaacuugaauauuuuaucuuaaacgcugugaaguauagauagaaacauuuuaucugacauaguuaaugaugauacuaauagagugaaguaaaauuguuuaaaagaccuggccaggaaaaaggaauaucugauaguguaucuugguauccuaauaguguggacuuuggaugugaaacacaguuaauuccuucagugccugucuguugggcaucuuccaucugacgggcauuaugucagggaccguguugugcgaaagcagguggggucauugcccagaaugagccugcagccucaugggaaaguaagacaucaguacauaaauaagugcaaaauugcagucuugucaaccgcuacaagagagggugacugugcacugagagcacagacuaggaucugggaagaguugaaauguccugagaucuugggaugaugaaagcuuaacaagcaaagagggagcacaaccugcucgaagccaccagugggacuggaacccagagaacaaaggcgagcauggugccagaugagcccagaggccuccccaggagucgaaucauucagggugggggcuagcugcauuuuaaguggaaauagggguccaggugaaggcagcacaaucagauuugucuuuugggaagaucauucuggaaagacgggagaguggagggaaaggggcccugggggguugaggagacuugugcgaagcuaugcaguguuucagaugaaagauggugugagugacgggacacugcaguaagugcgggggugcaggaagacucccgggcucccagcuugccacacagguugggcaguggugccuuuuacagagaaucaagucugcacggagggccaggugugcaggccgugccuucacugacaggaauggcuuuucuaaucauuucccugauuucugcucuuucaaacaggguaacuucuuucaaaauauugguuccaucacccuguuugcuguuuuugggacggcaaucuccgcuuuuguaguagguggaggaauuuauuuucugggucagguaagaaaaucaucuuugaaacacuuugaaagucuuacauucuuagagcuagugcagggaggugggaaggugaaauggggccacuuuguggggccuggguuucacccuuaagguaaauuccuucuggaaggaaauccuagcuucauaugaggcacaguagaggcgugcuaaauuguuucaaaguguccuccaagaccuuugguaucuggaauugaguaaaacuuuuccauaaucccccccaaaguauuugaguuuauuugcaaaccaauacugucuuaaauuagaauaccuaaaaaugaagccaaauauaugccaucaagaacuucaaacuguguugucaaguagacugaauugggguugaaugcuguuuuuugauaaaaauuuguauuuaaaaaaucaaagaugugcuuuucugcuggcauuggagaaauaauaaaaucaaaggugaugcugaaucucuucacucaauucuaagcugucuaccuguagaauuauauacucuggauuuuccacaauugcuaaaccacuucccaguggcaccaguuggguggucucuacuuuagacuucaaauuaauuuagaccaaacaucccuaggaagguaguaucuguaguuuuguauuaugcauguccaugcaugucacauucuuuuccuuuauugucaguugcagaaaguuugccugucucaguucugaaaauuaaguugagggucagguaucugagugacgggcagauuucuuuaacacaucagcugcuuucuucucucaauagccaaagcccauuccauuggauuuucaccuauauugcagcuuugauggcaccagaauaaaucugucugucaugcagcuuucuucauugcucagcuucuaguauuaaguaagaauaaacuuaaggaaacuacaguuaauugggcuugaagaauguagcauucuuuuccauacucucguugcaugccgauggaaugcauguuucaacuaaggcuuaggagcuuuuauuuuucaagugguuugggaacugaagauuaauguccuuauuaguuuuaauaaagcacuaauggacauuuaaaucuuggcuguucuccaggguuuuuuuuuugugugugucuguguguuuguguguuuuauuuuacaggcugauguaaucucuaaacucaacaugacagacagguaaauccuucauacuguaacacccaugcgacugcuuuucagacaggggaaauguuucuccacauugcuuccugggugugguacuguucuauucucucucuguguauuuauuuuugguaaggauuucugccauagaaucuuacucugaguuaauuuguaucucugaaaugaaucaaaaguauccuaaagacuuuugaagaucccuaguggggcauugcugauuggaaugauuuaguuuaagcuugggagggaguaacucugcucagcuaacugcccugccugugugcacgcguacacuguaccauugucuucuuauuuacaagacuuuucagucgccguaacaaaaagucuucuugacagauuagagauggagagggggagugacggagaaacuuuccucugggauucccacgaagccuguggugggggaagcagggccaagaccucuauugugguuauuguagaaagccccuccaucugaagccacucccgugagcacuucccaugagccccauccaggauuucccagaauugcauagugagaagcaaccucacuagguugaggcaguugucucucagaagguaccagaucuagugcugaaaaagugcccaugcugagcauagucuggguuccccccucugagagcagacagccuugcucagugugucugcauuuggucuugugacauggcuggggagcugggcagcagggucacauguucguccccagauccuugccauggggccagucagagcuuucaggauuuagcagcaguuuagcaacuugggacuagaaucugggaacccuuuucaugggaacugugucucugauaacaaauccaauucuauuucuaccuccacucaccacccaccccagcccaggacaauuuuggagcuuuuguuguaagacaguuuugauacauaaacaaguaguccuauuccaugagagcuggaaauaaagcagaacugauguccuguguuugguagguauuuugcaaauaaaaagaaaugcccaguaaaggaagguaucacaguauucaaaccuuccacuuguuuugggggcaacugguuagagauacagacaaugcuggauaacuuccugugaaguugaauugaaucagugguugggauguucagguggaggacaggaaaggaauugcccuguagacacacugacuuagagccggguaguguuuuccucuccgugugcagaaguuuccuuugcuguuagaaagugacgaucccucagauggggacugcucuggggucgcaaacccacacagccgcagggccuggcagagcacuuaacagagggaagcuggccagcugugagucuagacauggggcagcggccagugggagaacacacccuguaugaagggacagccacuucucagcgccaacucaugauuaccauguggaaaucugggcccagaauugguggcuauuuuaaauacuuuuuuuucaaaaagaugcuggguuucuagauuuuuauagggaauuuuccaguuuuucaauguugacaacuugcucaauuuuucacaaauaccaugcagaccaaacaugagaggggaccacagacuuuuugcaaccucugcacuguagaaaacauaaaaauaacuucguugcacacguuuuguuuuguucuagugauaucuuguuggagagagauuucacucuuagagauccugaauuauuucgcugccuuaguucauuucuuuuucauuuuguuaauguugcuaucuuuuggggcuaugggauaaagaaaauacauuuuuaaguugaacuucuggcguuuaaaaggcgaggucuuaaagaugugaaguggaacagcugacagccaggugaaauaaccgucuuuccauacagaccucucaaugauucagcaguuuguauuucagacuucucaucuucacugucagaaauacucugccucaauuuagauucccaagcaaacuguguaacaugauuuauacaaagcauuucccccagccuuuuguuuguuuuguuuuuuucaguuaauuuagaaaguuuauuuugccaagguugagcaugcgcacccgugacagccucaggagguccugacgacauguacccaagaugaucagagcacaguuugguuuuauacauuuuagggacacaugagacaucagucaacuuauguaagauggacguugccccaaccuuuuauuaugaaaaauuuuaaacauacagaaaaggugaagcauugugaagugaauacccauaaacaaauuuuuaaaauauaaaagguguauccugcagggguaggagaggcacaggacagggaacuugggagccuguggugggccugcgcuucacugaggcuggaguauaguggcaugaucacagcucgcuguagccucaaacuccugagcucaagcuguccuccugccucagccuccugaguagcucggacuacagguaugcggcaccacuuccggcuaauuuuuguguguguagagauaggguucucucuauauugcccaggcugguccugaacuccugagcucaagccauccucccaccucagccuccuaaaguguugggauuacaggcgugagccacugugcccggcccaggauacacuuuuuagacaucauccuccuuccuucacggccucuggugauggggcugugguugaugagagugaaaauaaaagagcgaccagaagcucugucuggguuguggugcaagggccuggggaccagccaccaauaaaauaggaucucccagaugggcaguuguuuaguggaguuaccuucccuuucuuccuucccuuucuucuucccaccugccugccugcuugccuucugcaagugucucugggccaugcccaguacagacccugggaauucacccaugacgaaaauucagcauccacucccuuggagcucacaggccugugaugaccucugugaggacaggcgaagucugggaacugaauccucagccugggauccggaggcacucuggguuaaugcgcaugagucacauucacaggcagcuaccauggaaaccagaggccagaugauugacuucugaagagaacuguaccuggcaaggcagccaggcauuuccucagucagcucuccucucccugacccugcagccaaaagaucacccauugaaggcugcucagccgagcauccuuuucccccuagacccaggcuuggugagggugggaagcucagggcagucgucucuggcugaugacugacacaggcuggccauugggucuccauguuuuggcugguguuguggaagggggcagacccaccauucugcugcccuggaaagaaaguugcaacaggcauggcacagaggcuugugggaaaaucaccaaagggcagggagagugaauuguccaggcucauguggcacaugaggccccuugagggagcugguccugccucccucgccagccucuuauggcuccugccacucaccccacccccaccaccacaugcaccuuccuucuguuccucaggcagcaggcuugcucccaccgcaggagucgcuugcugucaccucagccugcagcucuuggccuggccagcugcuucuuaacauguagguucuugcuuacaugugucaucccuucacagaggccucuccagaccgccccaucuaaguggcucccacacccacacccccaccccaccuucccacgucaccucaauugauuuccugggucacaugugguauugucugaauuugccuucaucucuggguauugcuguaucuacuguuggggguaggaguaccgacucugggcagauagccuggcucugcuacuuguuagcugagugaccuuggacaaguuacuucaucaucccguugucccucgguuuucuccucugucauuggggcaguaguagcagucucauacagucacugucuggauuguugagucaccguaugugaagugcuuagaacagugccggccaugguagccuccauuccugaaacauguuagacaaucagcacauaucugcugggggugauaagaucuucacggggacugucagugaggucacuggcccaguugggagauggccucaguguuucucucggcugucuacgccacucacccccaaagcacacugggguugcugcugcuuuuugacacuuucuuagaucuugcaaaucugagugcaggcuggggucggucacggacagcauuccaaggggcugguggcgaggggcagagcagaggucagaugcaggagcucaugggccauuuggcucuagcugcucugacccguggaacugggcgguguaugauaaauauaucuaagcaaaagucucccuuccaucauuggucaaagucaagucuccgugcugacacuagaaaaccaggccauuccuaacaacucaguuuagagugggccuuucauacuccacccacaaaacagcagauaaguggggaaaaaauacgcuaccuucuguaauuaauucagcucuagcguguaguauugcuuucuguuaaauauggccuuugacuuuaaugcuuuaauauguggaccaagugacacacauuacagaaucuccccuucccucugucucuuacaguuuugcguuuggcucccuaauaucugcugucgauccaguggccacuauugccauuuucaaugcacuucauguggaccccgugcucaacaugcuggucuuuggagaaaguauucucaacgaugcagucuccauuguucugaccaaguaaguacgggggcagagaacagacuuuuuucaugugacagaacuaaagguccuuguaacaaaggggcagauauuuccacacagcauguguacaguugcuuguccucugggugaucaguucacccacucucuuucucuguauuucuguccugacaagccuugaugugcugcaagaauauggucagguuccaggggugguuaaaagaggagaguccaccuuuuuuuuugagacagggucucgcucugucacccaagcuggagugcaguggcuccaucacagcucacugcagcuucaaccuccuggguucaacugaucucccaccucagccucccgaguagcugggacuuacaggcacgugccaucacgcccagcuaauuuuuuaagaaguuuuuguagagaugggguucgccauguugcccaggcuugucuugaaccccugggcucaagcaguuugcccaccucagccucccaaagugcugggauuacagguguaagccauugcuccuggcuuugcccaccuuuuucgaccugccuuuuaguagugguuucugagcccagcuugucaacaucacugagggugcuuauuaagugugacauuccuaggccccacccucagagcuucugauucauuuggucuggggugagucccaagaccauggguuuuuaauaaguuccccagauaugaugaagcggccuguucaggggucaguguuugggcaauauuauuggcaacaaaagcaauagacagaggccccacuagcugaugcaugucaccuuccuuuucacagcuuuaaaauaagguaggaaugcugauaggugcccugccuuaagaugcuauuguguaaacucuacuuuggacacuacaauuuguuuucaaauauuuguugguauuacuacccuaauugaugggaucugagaaguuaaagaugaauaauaaaaugucaagaagucauugggggccaggcgcaguggcucaguccuguaaucccagcacuuuggaaggccaaggcggguggaucaccugaggucaggaguucaagaccagccuggccaacauggugaaacccugucucuacugaaaauacaaaaauuagcugggcuugguggcgggugccuguaaucccagcuacuccggaggcugaggcaggagaaucacuugaaccugggaggcggagguugcagugagccgagaucacaccacuggauuccagccuggugacagagcgagacuccgucucaaaaaaaaaaaaaaaaaauuuuagcugggugucauaucacgugccuguauuccuagcuacuagggaugcagugagcugugauggagccauugcacuccaaccugggcaacagagcaagacccugucucaaaaacaaaacaaaacaaaaucacugggaaaaguaaaugcauuucagauaaucucaaauauauuuuucugaugcagggauauuuccuugaacucugcauuuuaugguggucauuaacaggcaggcaacaaacccaaagauuuuugccaaaacacagauguuugagaccagucuggacaacauagcaagaccccauucucccaccuucccgcaaaaaacuccaaagcacguggagaaaagagccccggauaauguaucaaaaaugagcuaagagaaucuuagaggccaguguguguucuguuagauaauagaauuuccauuuaccugaauacugacuuacugccuuugcuaaagcauaaccacucugugguagcuggcauuuucuuagaaguuuuuuuauagacuauauucagaauucuuauguuggaauaaaaugccucagccuaggacuagauuugaggacugaauaguuaaauaagguacuacagggcugggcgcgguggcucacgccuguaaucccaucacuuugggaggcugaggcggauggaucacuugaggccaggaguucaagaccagccuggccaacauggugaaaccccauaucuacuaaaaauacaaagauuagccaggugugguggcgcacgccuguaaucccagcuacucgagaggcugaggcaggagaaucgcuugaaccugggagacagagguugaagugagccaaacucacaucacugcauuccagcccgggcgucagagugagacucuguuuuaaaaaaaacaaacaaacaaaaggguacuaugagaaaagcauccagcauuggguaaugugacauccuuuccuuuucuuucccugccccuaguuguuguuuucaccacauuugcccaguuuuugcccuguuuuugcccuuccuuugcaggaggagcuuaccaaauacugccugauggcaagaggugcucaacaggccuuaaaaaacaaccaaacuuauaaguauuuuuguuauucuaaauguaguacauauauucuuaccaaauuuaggaaauacacaagcaaaaaagagagaaguaucacacacauugcuacuaccuagagauaauuaugguugauaauuugguguaaauauauauacauuuuauuucaauaggcuuauaccccaaauauuguacucuauuuuccauugaacacaauugauaaaacagucuucuggaaaauaauuuuacugguuacgguguauuccuuuuucuggguuuacuaugaucuacuuaaccaguuuccuacuauuggcuuuuucauguuucucuuggcagaaauuucuauagcuuuauuaggauauuauccaacaucaugccacaagaccuuuaaaaaauccaauggcaguauuuuuucuuauuuaagaucuacucugaaagcugccuagcauucugguuuuuacuuuuaucucguauccuggcuacacauauugaacauuugugacaaggaauuuugccuaacuuggaggugacaucaugaguuauuuuuaugcauugggagcuaaacucaauugcuuugucucuugauuuuuuuaaagaaaaauaauuuuucagagguaggaucuuuucugagcuuuuccaguugucucuauuauaaaagccaaagauaggagacuuuuucuauuuaagaugggaaaugauggagucaucguugguagccagagguucuuacuggaaaagugcuuuggaaacccaagauggggccaggcaugguggcucaugccuguaaucccagcacuuuggaaggccaaggcagguggaucaccugaggucaggaguuugagaccagccuugccaacguggugaaacccuguaucuacuaaaaauacaaaaauuagcccggcauggugguaggucccuguaaucccaucuacuugggaggcugaggcaggaggauugcuugaaccugggaggcggagguuguagugagccgagaucgcaccacugcacuccagccagagcgacagagcaagacugucucaaaaaaaaaaaaaagaaagaaaagaaaccaagaucgucugugguaacaguucccacaguuggaucuguggagcaugcauguauaguuuccagucuccucguccaccagcagcagugcuacugcugaggccacgguuggaucuguggagcaugcauauauaguuuccagccucuuccucuaccagcagcacugccacugcugagacccaagcuggcuugagaaucagccucacaaacucuccagccacggcuggucaucugccaucagcauuuggugagggaccucugugugccagacacugcugagagccagguggauuugacagucgguccaugaugggcaaaagaugcccguagagaagugaacauggugccuuaagcaugagggggcucaaugaccagaccaugaaggauaugaggaaggcuucucagaaggaacgucuugugagccaggccugggaggcuuauuuucagacagaagauacagaaaaggggcaugucagacuuacccccgccucccccuccaccuuuuuuuuuuuuuuuaguacagaagaaaaauaugcuccugggagcuguugucaccuuuccuugguuaucagaaucauaccugguuuugaagagguauacuucauaaacgaucaucuccaaagugagcugacacauuuaucuuugcaacugaauauguaaaugaguuacccccuuuuugauguuguuaccuucaugaaugccagaaagcaaaugucuucuguuucuucgguaacuugaauucauuuucagcuuugauuuguugcuaugauaguguguucuuaaagucacugcuguagaggaaaccuuuuguuuucuccagcuacagcuuaagcucaugaaauggacccugaagcaauacucccuuuuauucuuuaagguaugagaaacaugaccuuaagaaacaaaauguagaaaauuaccaggccagaaagaguccaaauucuacuuucauuaccuggaguucagaaaccauugccccagcccuggaucugcuguuaacccuuugugugaccuuacccagugacucacucucuuugggccucaggcuacucuguauaaaaagcagugaaaccagccuggguaccugcugugguagugaugugggcugaggcugggcacuguaugugugugaccugcagauccauuuuugggaacuaugggugaucauggccuucaaaagcacuuuuccaauaugagcccuuguuggcugccacauuccucaaggugggauguuaaccugugaucugcuagaaagaagggggauuggggagauuguuuguucagaugagucugcaaagcuuucacgugaagaaaguuagauuucuuuuuugcaagacuucucagaccuuuauuauguuauuuugggcugugaauuuccucgaaaggcuuucugaguuuauuugaccaagcuaccuuuucaucuuauucugcuuuaaaaugauaccaauccuggggccuggcauggugguucaugucuguaaucccagcacuuugggaggccaaggcagguggaucacuugaggguaagaguuccauaccagccuggcuaacauggugaaaccccgucucuacuaaaaauacaaaaaaaaauuagcugggcacgguggugcgcaucuguagucccagcuacuugggaggcugacgcaggagaauugcuugaacccuggagacagagguugcagugagcugagaucgcaccacugcacuccagccugagcaacagagcgagacuccaucucaaaaauaauaauaauaauaaaaugauaucgauucaugacauggugauugaugaagcugaauauuacuguugacuauucuuuguuucauuuacugagucaacaaaaagguauugacugucuuuugugugggaggcucugcuuuaagccccggacauaaggcagcgaacaagauggacacaggcuucauccucauggaaugaggcacgacaguuucccaugcugugaaggagaagucaagcaccaugacaaccuuuaaaugggcaggccugcgugaagggaucagggcaggugugccugagggaguggcacugacccuggguucugagggaugaauaagggaguuagcuggggcaaggaaaagugaauggugaccaccugggaggugccagugacaguguggcccagauguuuagauuuggggagaggagguaaggucagagagguauggcaggcaggagccaagucaaacuaagacugggcuuccugauaacgucgggaaacugugaguucugaacaggcugguaaccugaucaggugugccuuugaaaaggaucaguuagggccuguauuucuagcacuuugggauguugaggcaggcgaaucacuugagcccaggaguucgagaccagccugggcaauauggugaaaucccaucucuacagaaaauacaaaaacuaacuggguguggugauguaugcuuguggucucagcuacucuggggcugaggugggaggaucacaugagccugggaagcagagguugcagugagcugagaucaugccacugcacuucugccugggugacagagugagacccugucucaaaaacaaaaagagggggaucaucuaggccacugaguggacaacgggguuggucuguaggaaggcaaggaugucuagaaggagaucagugagacuuaucccugggaguaaagggcaguaggggagggaagaagggaauggauuugagagacacgaggaggauauuuaaugagaauaacucgauguucaugguguaaugguuuuaucuuuaaggacaaaaccaacaauugaauuuaauaacaucugacauuuuacuuuguucuguuacaguaaaaggaaaguucuuucuuucauuucuuccuccuuaaugucuccuaaauccucccucucagccugaaaccucggacauuucuucuuuggguagcuccauucuaaucugacuugccauagccucaauuucagguuuuaucacaggauuucuguacugaaauccuuccuaucgacuccccaggccuucaagcugaaauaccagcaccuuuccugggcucuuuccugucccucugccacucuucucaccuugccuccugccacugucccacccccaccccaccgcugcguuuuagcugcacuaaucuugguacuugaaaguuccuacaauggguugcauaugcaugggcucucuuccuuugcacaugcuguucccucacugggugccuucccccauuucuucaccugggcaagucgucuuuaucccaaaucuaaacccagcccccggccuuuuuuauuuuuuauuuuuuugagacagagucuugcucuguugcccaggcuggaguguaguugugcgaucuuggcccacugcaaccucugccuccuggguucaagcgauucuccugccucagccucccgaguagcugggauuacaggcgugcaccaccacacccagauaguuuucguauuuuuaguagagacgggguuucaccauguuggccaggcuggucugaacuccugcccucaagugaucugcucaccucggccucccaaagugcugggauuacaggugugagccaccacgcccggcaucagcccacauuuucucaagcaccuuccuugagcccggccagucugaguuaguuaccuacccacccugcuuuucuacagcccucuaccccucccgcggauugucauuaguguucaucuuguuuuucucccucauuagccugaggggaggagcuccuuaagggcagcagcuuugcucucaucucugaaccccagaaaauaacaguaccugggacaaaguaggugaacaauaaacguuuggcugacugaaugaaugaugguaugaaugaaugaaugaaugagcgaauaagcaagaaauguuuuaaguuaauuucuaagaacuuuguguauauaacauuuuaauuuauuucuguuuucuuucauuuccuagcacagcugaagguuuaacaagaaaaaauaugucagaugucaguggguggcaaacauuuuuacaagcccuugacuacuuccucaaaauguucuuuggcucugcagcgcucggcacucucacuggcuuaauuucugcauuaauauccuuuuaaugugaugaacaugcaggguuaaaauuauuccugauaacuucugucucuagccaguuucuccuguuuuuuaagggggccaauuuuagaugaagauuuugcuuaaaggaggauuuuuuugcuuaguuuuuguuugagaaacacucuaacucaaggauuuuuuaaucuaacgugaaauuuaggaugucacuuuucaaaguuuaaaaaacauguacacuguuggauaucagaugugauuuuggggaccucucaguucccagaguaugauaaccacacuccgaugauuuucguuuucugccaucuuacuuuucacauuuggaaaacuggaaauuaauuuucuuugaaaaugucaaauagaccaggugcaguggcucaugccuguaaucccagcacuuugagaggcuaaggccagaggauugcuuucgcccaggaguucaagaccagccuuagcaauggaauauagugagaccucaucucuaaaaaauacauaaauaaaaauaaaaugccaaauagagaaaauuuuuaucccacugaaaguguuuauccagaaggauugcaaaaggggcuuucaaaguguguuccauugaguuauuugcacugauuuuguuguuugacaaccaauaagcuuuuccagcuggagauggaaagaggcuuguuaaggccaaugucaccuuuauugcuguagaaauuucauuauguuuaaaauaguaacaggcaguagaccacuucggugcgcaccuaagccuacgucucagggagauggccaccuggcccgccuccacgagcaguuugugucacagauggccggaagagacucuuuugccugguuacaggcauguuuuucugccauccuguugaauuuucccaucaacuccuuuguccagaagucuaagggcucuauugaguuggcugacagcuucucauauuguaccaauaaacagaauggaaaagaaaauuuuuuccaguucaguauuuuccucuauauuuaucuuuuucuuuaaaaaaaaaaaguaucuaucaaaaugaaguggagcaaauggguacugugagcuccaguauaggcauugugaaugauguuucaauauauagaaggcucucuccuuucacaggggcaugaguuuggaaaucuccaggaauaggaaauacugugcuucaacagggccucgaaccucaguuugaacagcgauucucacuaguugucuuugacucaaaacugauggggaaagcaagauggguagcauuagugaucucauccgauguuguuggaggagugggggugaugccggcccugggaggaaccuggccaagugagcuguccuuggugugucugcagccccagcuuugcgccauggcccggcacauccccagcccucuaagucagcguuuuuaaaugaguugacuuagguugauuuucaucuuccaccaccauuuaucuccggaauuuacauuucuuaguguuuugucagauucccuuucuuauagcaacagucucccuacaaaggaaaaaauccauaaugacaaauuuccauuuguaaccuugggacauucuaaaaucuauaucuguuguuuacuucauauauuuggaaagcagcaguuuugugacuucuccacaucucccaucaacucucccucgauucuccuuccuugacaguugucauuuacgugcugaagcauauugacuugaggaaaacgccuuccuuggaguuuggcaugaugaucauuuuugcuuaucugccuuaugggcuugcagaaggaaucucacucucagguaagugacagagagccugaaagugcuguggugauggcaucuuguccugccuggggaaagaggcuuugucaguugggucacuuuuagucacaagagacagucacaacucagaagagcuuaaguaauaaaggaaaucuauugguucccuagaaacacaucuggauuuaggccugccuggauccaggggcucaaacagucacauuggugucacggucacauuuucucuuaacccgccuucucucauuuagcccaucaguccugugaggcucccucagaggaggguagccuuguaggagggagguacugugaaggucccuguuuuacugaugagaaaacugagguugagugagauuaaguaaauuacucaaggucacagcugggauugguggaacaacgauucaaacuaguugucuuggagucaagaacuagugcuuagaacccucuaauacaacucccuccaaaacagaucaucaugaaaccauguacucagugcuacauagagggacaagcaaaguguggugguggcguaauguugggcguuuauuggacacacuuuaccaguauucaguuuuuuuaugcugauaccagcccugugaaguagguacuaagagguugucauuagcccaaagcugcacugcacaagcaguggugguagugagauugacaguggaggcccagagccuuuucccugcaccccauuggaggagggcacacagcucucagcagcagagacgacucugaugcggcccuagaagaugaugcucaccagcuggaggagggguggccagucacagcguaaugaucuuggagccgucaccugguaaucacucagcagcccaaucaggcuuggcuuaguugggcuuucugccuacaaguggcagucaagcuugcguccacagcuuguuacguuguaaggauguugaccugaaaauggagcgugacucaccccuguuccugugugagggggcagccaguugggaagggcucugcccuggaagucugaucccauccuuugagugaaggcccuucagaggccuuguucuggaaaggaggcacuauugcagggauguuuugaucugugccacaagauggcagagauuuucuuuuuuauuaacuucguugagguauaauuuacacacaauacauggacccguucuaaguauauaguuccaugaauuuuugcaaauguggacagucauaacuacccccacagucgagguguggcauauucuuaucgcccaguguggcuccccugugcccuucugcagucaguccaccugccuguccugagcccuggcacccacugauccugcacugucauuguaguuuaaaugaaaucaugugguacguagucuuuugugucuccucucuuucaguuacguuuuugagagacauccguguuuuugcguguggcaguaguuuaucguucuuauugcaccacaguuugucuguucaucauuugaagggcauuugggguuuuccagauuugggcuaagaacagugugcauguguuuucauuuaucuuggguaaauaccuaggauuaaggcugcuaggucauaugguaaguacauuuuuacuuuuuuagaaacugccuaguguuuuucgaagugacuguaucauuuuacauuccucagaauguaugagagagugccaguugcuucauauugccaccacacuuauuuuaauuuaaaaaaguuuagcuguccugauagguguguagcaacugcauuuagaugugcuuuggugugguuauuuuuauauucgccuuggguucauugaguuuuuuggguuuauaguuuauaugaguuuauagcuuucaucaaauuugguaagcuuuugcccauuucuuuaucaauauuuuuuuguuccgccuuccucuuccccuugagacuucaguuuacuccaguuaugagagguagcaugcuauuggcccacaauaugcuuugccuuuuuuucuuuuuuucccuaugugcuuaauuuugguuauuuccuguugccguaucuucaaagucacugaucuucugccauguggaaucuccugcuaauccuacccagcguauuucucauuuacauauuuuauaauucaucuacagcagaucccuuuagguuauuuucauuucuuccauuucucucuucaucauguucauguuuucuucuauauucuggagcauaugaaacauagaaauuucugauagcuguuuuaauguccuuguuugcuaauuccgucaucucugucaacuguaggucuguuuuguuguugauuuuucuugugcuuauaggucacauuuucuugcucuuugcuuguuauuaaguuuugauuggaugucagucauugugaaguuuuauguuguugagcacaagauuuuauuguauuccuuuacggaguucuggacuuuucuuuuaaaaacaauuuuuuuuguguguguguguuauuucuggacuuuucuucuggcacguaucuaagucucuugacaucaguuuaauccuucuugaggcuuacauuuaaacuuuuuuagggcuggugcagaguagcagggcccuaacuaaggugucucagguaccgugagcucacuccacucuggcuggugggaacgcaaacuauucccacccaugucagcuucuggaauuguucagccuacuucuuuuuaaugguucuuuccccagcuucuuguuucauccgacauauuuacugaucaguaucagucaaagacucaaggggacuuuacaguagauguccaagagcucucuuucugugcagcuuccccgacucaacaggacagcccucuuaaagccucagccucaggcagucagcucagcagggggccuagggaaagaguggccaccuuugucucccuuccggcaggaaucacaguccuacccuaucuuuugucccaugucagaaaauaguuuuguuucauaucuuguaucagguuuucuaguuauguagagcaggacaguguucuguguagcaguaauuucuucagacgcaaagcugaaggcccaguggucucuagugacucaguugacagaacuuuucuacccagucgcuauccggagucacacuugggugcugcaugagcagcacaaggaggaagcagaguggacucaccauuuucaggguuuuguuuuucaucgcagaccaguucaccaggguaauuccauccuggugucugccaugagguucccuuucuuuacugaauguuggcacuuacaaaaacguuaccugugagucauucggcucuagccuagcuauuuuuacaucuguuuuucuaaauuguuccucuacccccuugagaagaucauugaguaccuguuggcaaagauguguuucaugcaucuguuuggaaucugugauuaaaauaagggaguguuuuucuuaccuucuuuucagacuggcaguguuuccuguugagagggguuucauuuccuuagggaccuugcuccacacacagcagugcaagccaggaacaccagaucugccucugggugagggaaccugcucuguccgcacuuugccuuuuggguauuugucacgcaggguuuucagagaggggcaggauggcccugugugguguguggacgccccacauugcacugugaaagcacagauggaaagggugguuucugcugucuucaccuuccuuugugugcuccccuuuuccugacuaucacaaaggacugaucucaagugguucccaagaccauggagcaggacauucucuuccuaggaagugggaauuauuuaccuaaauccacauguagggaacacaguugcuaaggacuggggcuggauaacagacagacuuggauuugaaucccagcuccaccucuuauuggcuguguaaccucagauuacagacuuaaccaccccaugcucuacuuccucauuauaaaauagacaaaagggccagccugacgccuuugcugaggaguggggagcgaugcaagugagaguccugauggggcaucugugccacugcugggguggccagaaguccugguuugcccucugucucaauaugaugaauuaauaauauccccguuuauucuaaaaaauguccugguauccacagcaaaucaaacagucucccuaauuauaacucagcaagcguuagcuauucucagaauauuuguucugacuguauccauguuaacuauuuuuauuguucagucaagccaguuuugagggccacuuuggccucugacacuaaagauucaaagaugaauagaccccacuuaggcagagcaguuagcgaacacugggcuugcaggggaugggagagagugacacucugucaaggugagucacagaggaggggacuuugggcuugaaggaugaguuugcaagauuaaucaugagauaacacuuucuuucuuucuuucuuucuuuuugaggcagaguuucgcucuguagcccagucuggagugcaguggugccaucucggcucacugcgaccucugccucccagguucaagcaauucucugccucagccuuccgaguagcugggauuacaggugcccaccaccacgcccgacuaauuuuuuuuuuguauuuuuaguagagacaggguuucaccaucuuggccaggcugaucuugaacuccugaccucgugaucuguccgccucggccucccaaagugcugggauuacaggcgugagccaccgcgcccggccaacauaacacuuucuuaagauguuggcaugggccaggcgcaguggcucacaccuauaaucccagcacuuugggaggccaaggcagguggaucacgaggucaagagaucaaaaccauucuggcuaauauggugaaaccccaucucuacuaaaaauacaaaauauuaucugggcaugguggcacgugcugguagucccagcuacucggcaggcugaggcaggagaauugcuugaaccagggaagcagagguugcagugagccgagauccugccacugcacucuagccuggcgacagagcaagacuccaucucaaaaaaaaaaauaaaauaaaaauaaaaagauacuggcaugaaguuggccaaagauagaauguauggugcagugcucuucugcacagauaucuaaggaauuccauugcagcacugcuugggagagaaaaacuggaaggaacuauauguucaucaguaauggaaaagaucaaauuccaguccauuugcacuauggaauccugugcagcuacuuaaaaaaugaacuugaccugucuguacugccauggaaagaauuugacauauuguuaaauuuuuuaaaaguaaguugaaaaaucaaacucucgcccauucaagaaauacuuauuaaauguccacccuaugcugagaacuauccuugcuguuggggcuacauuuauaaacaacacaagaucaguuuccuuuucuugcagaagaaagccagaauuuaagcaaacccauacaacaauuccagguggcaagaaaugacaagaagagaaauuaaagccaugugacagagaguggcaugugguagagaauggaugggaucucaggcagucagggaggucuccccuggagguggcacuggagcccagaccuguguggcgagaggagccagcccagggacgcucuagggaaggaggguuuuggcagcaggaacugcaggagccaggggucugaagauagaugugcgggaguguggcaugcuccaggaagagaaggaagaccaguguggccaggacgcugccucacagguucugcaggccugagaaggagcuggguuucuaguauaugcaccacgacaagagaguuggaagcccuugaaaaaaaaucacucugcugguaauaggcaccauauaugugauaggauccuguuuauuacuuuaguuuuauuuuauuuuaauuuuauuuuuugagacaggaucaugcucuguuacccaggcuggagugcaguggcacaaucacgucucacugcagccuugaccuccccagguuuaggugauccuuccaccucagccuccugaguagcugggacuauaggcacgugcuaccacacccaacuaguuuuguauuuuuuguagagccagucucacucuguuguucaggcuggucucaaacuccugggcucaagcaauccacccacuuuggccucccaaaguccugggauuacaagugugagccaccaugccaagccuauuacuuuaaagauaaacuuuauaaucacaugguaaaagaacuggcagucugcauauugaaguguuaauaguaguuaagaguaguuacgucugagcgggcaguaugaauagauugucuuuuacucuguaccucagugagucugaauguuuuauggcaaaauauguuuauuauugaguaauuaacacagcguacucauuacgguuucacucagcccucaagaaguauguuauauuuuacauacaguaaggcacgguacaguguaaauuguaccaugauaccuuuucacugccuuuuggacuugaaucccauacugucuuccuuuauuacaucuagaacaguggauguaaccauaaacagaaguggauuuccucucucccuuucuuuucugccauucuuccuucaggaggcugaacgcuuuugcugcauuugcuuucuuaaacgauuuugccuaauucuuaaaggaaauucuuccuuaagcguauuuuuucaaauaccaugccuuuuaccucacuuaaaaaaguuauccugguuugcaccaacccccgcuuuuguguuucuguagccugcuccacuggccgcagaugagggugaugugggugguggagaguccccuuugcuucuggagggcauaugaggcagauacuugagccaucccucuggcuuuugugccugcugcugacccucuuuccuuucgccuagaacucaaggugcccugaccccacacuagcccaggguaaagcccucugggauuguccagauggcccagugccaacagugggucaggugcacagguggcagcugugguccagucucagcccccagacagggcuuacuuauccauauagaaaaauccaaaauguuugaauuuguugccauccuuaaagauggagauuuccuguaaggaaaaccagaaggaagacugguccauguuagauccucagucccacagggcuacugucagccuuuguagacaggcugagccgagacugcgccucuaaucccagcugcuugggagguugagacaggagaaucgcuugaaccugggaggcggagguugcauugagcugagauggcaccauugcacuccagccugggugacaagagugaaacuccaucucaaaggaaaacaacaacaaaaacacucuugagcuucaaagagcccuaaaggagcagguaaagaagucuccuacccucucauuuuccuucgcccaccaugucaggugugucuuacaggaagcauggcuggaaucucccuguaggggaaacugaagagcaaaggcauuugcuguuuccuaagaggguuaggagaucaaauguccagcuccugcugucacucagccagcccauaccugcuggggcaauacaaaaaaguagguuuccuauauuuuguaggguauuguguuacaguaagcuuagcaguugacaagucuguaauacagugcugugauuuucacccuuuuuuuuuuuuuuacaguuuuuuguuuguuuguuuguuuguuuuugagacagagucuugcucugucacccaggcuggagugcagugccgcaaucucggcucacugcauccuccaccccuccagguuuaagcaguucucugccucagccuccagaguagcugggauuacaggcgugugccaccaugcccagcuaauuuuuuguauuuuuaguagagacgggguuucaccaucuugaccaggcuggucuugaauuccugaccucgugauucacccgccucggccucccaaagugcugggauuacaggcaugagccaccgcgcccggccgauuuucacccuuuuauacguggaaaguuugccagauagucacuguuuccacaaaauggcagaagugaauuaaaacuuugcuuuuaaaguuugacuuggaauuaguauaucuuggcagcuuauuugaugauuuuuuaagacaaucucagcuuccuuacaugaaauagagaccccuuuccugcucccuaugcagggagaugcugagaagagaccugugaguuccucaggagugacugagggcagcggacgaaugucgaggcucaaauccuguguaagcacagaagguuguacacacccucgugcagggcucugaagaaaagaugcauuaccuuuuuaaauaacaguaguucaugauuaugggaaaauucaaaguuaaggaaaaguauuuuaaaaguccaucaaaauccacacauuuagcugggugcaguggcucacacuuauaaucccagcacuuugggaggccgaggcagguuggauugcuugagcucagggguuugagaccagccugggcaacauagugaaaccccaucucuacaaaaauacaaaaauuagcugggcguggugguaugugccuguggucccagcuacuugggaggcugaggugggaggauugcuugagcccaggagauggagguugcagugagcugauaccacgccauugcacuccagccugggcgacaacgcgaaacccugucuccaaaaaaaaaaaaaaaaaaagaggccgggcauguuggcuuacgccuguaaucccagcacauuggcacaauccugaagucaggaguucgagaccagccugacuaacauggagaaaccucgucucuaccaaaaauacaaaaaugagcugggcaugguggugaacacuuguaaucccagcuacuugggaggccgaagcaggagaauugcuugaacccaggagggggagguugcagugagucgauuucacgcuauugcacuccagccugggcaaaaagacugaaacuccgucucaaaaaaaaaaaaaaaaaaaaaaaagaauccacacauucuccauacacagauucuuaggcuccuuucugccccccagagugguuugcuugccacccuuauauagucaucccucagcaucuguggaggaucagcuguaggacuccccacguauagaaaauucauaggugcucaaguuccuuauacaaacggugcaguuggccaggugcaguggcucacaccuguaaucccagcacuuugggaggccgaggugggcagaucacccgaggucaggaguuugagaccagccuggccaacauggugaaaccucuucucuacuaaaaauacaaaaaauuagccaggcauggugaugcgugccuguaguagucccagcuacucaggaggccgaggcaggaggaucacauaaaccugggaggcagagguugcagugagccaagaucgcacgcacuauugcacuccagccugggugacaagagcaaaacucugucccccccccaaaaaaaaggguggggggguagugcagugggcccucaauagccacagguuccacaucugccaacccuaucccuggaugucagugaugguccacaccuuuuuaucuuuggugcugugaaggggacuuuacauggcuuauuuucacucacccuccuaacaguucugugaguggcuacuauuagucccacuguacagaagcggaaacugaggcucugaugggggauguaauguggcucaaggucacccagcuaguaaugaggcugccagagcgaagggacccauaguauuuuuucugaagccucugggaggcuucaggaauucauuuauuuuccuuuuucuuaaacccucuaaugcucuaggccccagggccuugcaggcauugugagaucugaguuggggaucacacggcagugcuuucuguucuguucucucccucucuaggcaucauggccauccuuuucucaggcaucgugaugucccacuacacgcaccauaaccucuccccagucacccagauccucaugcagcagacccuccgcaccguggccuucuuauguggugaguucugcuucuguguggccgugagcaggcccacccagagcugaucuugcuuccuuauccuguuugagaagucaguugagacuuucccuggcagcagggcagcagcuccucagagccagaucccucacucccuuaucuuuuguuuguuccucuggcuuugaaauuucauaaaguaaaccaaacaccuaauaaaugaacaucuggcgccuacaauuuaaagaccaaaaauagugagaaccaauuaugaacauuugauacaugcauuuuuaauguauuaaugugacauuuccaaaaauguauuccuuggaaauaaaauauuaaugaugguuuggugaaaauggcuccauagucaagcaaggcauggggcucacaccuguaaucccagcugcuugggagacugagaggaucacuugagcccaggaguucaaggcugcagugggcuaugaucuuaaaaaaaaaaaaaaaaagaaagaaagaaaaacaaagcuuuuguagucaaacaagaguuuaggaaauccugguuaaauaaaguuuaacauuuaugaauugccagacuuuucagcaaauaauggauugucaaauccuuaacgggggauauaguuauagaauuuuccaaacuuguccacagaauccuuuauucacaagagcagccugagggacaucacucggggacaguucgcaguagaggugucauuuguugggcugggauaaaccacgauggcuuugucuuuaagcaguuuguucaaguucuuguucccccacgcuccgacauacccauguaucuccccaccaacuuuauacuuggaagugguuggagucggggaacagcucucaccaugucccuuuaagcuggcccccaagugacuuugcccuagcugucaucaaaaucaccccuggcauuuugagggacuugucucuuuuuuuuuuugagauggagucuugcugugucgcccaggcuggggugcaguggcgugaucucagcucacugcaagcuccgccucccggguucaugccauucuccuaccucagccuccggaguagcugggacuauaggugcccgccaccaugccugacuaauuuuguuuuuuguauuuuuaguagagacaggguuucaccguguuagccaggauggucucgaucuccugaccuugugauccaccugccucggccucccaaagugcugggauuacaggcaugagccaccgcacccggccacuugucucauuuuuaauugcuacuuccacacuguuagcgugcuaggaggcaaaggcaacccaggcagaaacuucagcagauaaggaggcucaggugaggaguagucacaugacuugcccauggucucauggccaagaaguggguaugcaggccaggucucuuuauuccugggccagaggguauuauuuguacagcaccucucucagaaagccaggcuacagauucugacccugagccucccaguuaaagacacauaaagcaaaucguccauccaaaaagauucuauuuuguacccagcaguuuggcaaauguuaaguuugauaauacccacuucuggccuuggcguguggaaaacaggccuacuggaaucuuuucuggagagucauuugccacgucugucugaauuuaaaaggcacgugcucuuuggcccaacaguccaacccuguggaauuuagcccauacugggguguuuguugaaccucucagaaauaaaaacagucuaaauauccauccauagaggauugggcauuagaaaaauugucgaauuuugacaauuugucaaaugugacagaaaaacugucaaauuucucugcaaauaaacauuaucccgccaagggaagaugauaaacacaauucugccuguuuacugaacaccuucauuagcaagggucccaacuguggcaaaguggcagaaauucagagcaaauggauaccgugauguauccagauccuggaguugaugcugccagggaaaagcauccacuagaucugaaugucuucuaaaugugcucauuuggaaagaucacacaaauauuagauaagaaaaaaauuucagagagagaaggggggguaaauucuccagcuuguggacuuguuuuaaacuuggguaccauucaaaggaaaaacauuguuagaauguaaaacagccuugcuguuugugaucaacuauuuuaaaauacaguuuuaggccaggcgcgguggcuuaugcuuguaaucccagcacuuugaggggggccaaggugugcggaucacaaggucaggaguuugagaccagccuggccaacacagugaaacccugucucuacugaaaaaaaaaaaaaaaaaaauagcugggcgugguggcgagcgccuguaaucccagcugcuugggaggcugaggcaggagaauugcuugaacccaggaggcggagguugcagugagccgagaucgugccacuacauuccagcuugggagacagagugagacucugucucuaaaaaaauauauauacaguuuuaaucucuuuagucauuaugcuguucugagggccaucacaguuuaagcagagagccuaguguuagaaauuuauaaggugcuuuuucuuaauauauacaaguuugugugacagagaguaaauauugggcucuuuuuggcucgcagaguggagccaggaguuagcaaugagucucacucugcaaauccugcugggugugagcuguguucuaaaccuuguggcaguguuaaauauauuaagcuaaucauguggaaguuaaccagaggccccuucacauuugucauguggcgucugcagucauuugcucugaauuuuugccacuuugccgcaguuggggcccuugcuaaugacaguguucagcagauugacagauucuuguguuuaucaucuucccugggugggaucguguuuauuugcagaaguauuugacaguugacucauuacauuaagagauuucugaauaccagggacauguagcuuauguaauagaaaagaaugagagaauuuaagcacaaguuugaccaagauauuggcugcaggauuuucaagaaaauaaggaaaguguuguauuggauucugacugugaauguuugcuugcuuaauaguuuaguaccauauuggaaugaaaucauugggguugaauaauccauucuuugguuuguuucagaaacauguguguuugcauuucuuggccuguccauuuuuaguuuuccucacaaguuugaaauuuccuuugucaucuggugcauaguaaguauuuuccuuuuuuuuuuuaaauuuaauuacuuauuuguagaucaauaaacacauguuccggauucauuuauguaacuguuaacuguucaaagucaacagcuacauagacacucuuuuguuuaaaguuucuuuuguuaaaaaaaaaaaaucacaaacauacaguaagggggcagggguagaauuaagugaauaaauauccccagaaaggacuuuugcuuguuuuuuaagauuuuuaauggccuugaauauuauggucuuuaaauaaaaguacagguuuguaaguuuuugugugaggagguaaaagcagauuucaaaauugaauauguaauugaucauaaccauguaaaaauauuaugcacagaaaaaagaaaauauguaaagaaaauauagccacauguucacaguggucauagaguugggauuucuuucucuuuucugcuuuuucuggauaauuuauuauguacuucuuacugcaguuuucuucaaauuugucuauuuauauuugucuauuugucuguuuauaagauauuguuccugcaaccuggguacuuccaucucucagucagcaagagcucauugcucuuggucacuguuauuuguccuccaaacucagguuucagggcaagagagaagcagcaaaaguccuuuacagaaaguauaauagccuaggcugggcgcgguggcucacaccuguaaucucagcacuuugggaggccgaggcuggcggaucaugaggucaggaguuugagaccagccuggcaaacauggugaaaccccaucucuacuaaaaauacaaaauuagccgggcguggugauaugcgccuguaauuccagcuacucaggaggcugaggcaggagaaucgcuugaacccgggaggcggagguugcagugcagugagcugagaucaugccauuugcaccccagccugggcaaaaagagcgaaaguccaucucaaaaaaaaaaaguauaauagccuuuaguguggccacuggggaaaagggacacauuugaucaaaccugaaacaaguguaggcauggaagauuggauuucagugggugaaacagggaggugacuauuucagccacagguugggaggaaaaugaaaggaugcccuggggugacaacucaguuuucucuaagcaguuaggcccaggcuggcccugcagcuaguggagauggccuauucagguggguuacaguuccugcccuguaaacucaauuuaguggucaagagcaugggcuuuggggucugaaccagauuugagacuuggauccauuacuuccugccuugucaacuuggaccaauuacuucaucucucuauaccucaguuuccuugucuauaaacuggagacaacaauaccuacuuuguaagaccuuugcaaggauuuaaauuuagcaggauaaugcauguaaaaugauuagcauguugucuggcauagaaauguuugaugauuggaaacauuuacucuuggccaggcaugguggcucacgccuauaaucccagcacuuugggaggcugaggcggguggaucacuugaggucagcaguuugagaccagccuggccaacuuggcgaaaccccgucucuacuaaaaauacaaaaauuagccgggcaugguagcacacgccuguaaucccagcuacuagggaggcugaggcaggacaauugcuugaacccgggaggcagagguugcagugagccaagaucacgccacagcacuccaucucaaaaaaaaaaaaaacucucaaauucaugcuuguuaaaggaauaaacuuaaagccuaaagaauguacuguacaugucuauaucauccuuuucaaguaguuauggugagaaccaagaugaagaaaaugaaaguaaaguaauaaauguccuaagaauccacuuagauaagauuuaaacuuuaggcugggugcaguggcucacaccuguaauccuagcacuuugggaggcaaaggcaggaggauugcuugagaccaggaguuugagaccagccugggcaacauagcaagaccucaucuuuaacuaaaaaauuuuaaaaaguagccaggcaugguggugcauaccuguaguucuagcuacuugggagguuaaggugggaggaucacuggagcccaggagguugagguugcauugagccacaaucacaccacugcacuccagcaugcgagacagagugagacuuugucucaaaaaaaaaaaaaaaagauguaaacuuuacauaaagcuguacuuugccaagacuaacaugccuuuggagauggagaggaaccaaaagccacagcaagcagcuggcaggcuaagccggggcauguggccuccugauagucccuaccucugcguuccucuugcucagagagcaguguuuccaugcaugggagguccuucauagcugcccuccuuucccugagggagaggcagaaacaccuugucugucccccuaguccugguaugaucaaugcagcccugucccaaggaggggcaccuugggagucagguugcccuuaaacuaaucugugaauacuucuguacagccucuuggcauucaguuuuguucugcugucauuacuaaagcccuuccugauaccucguccguccucucuuuucuggcuacuaagaaagguaacguacaaagcuuuauccuuuccuagaugcauagaaucccgcagcuguggcagcacgcccaugcugggucucugacgagcaugguguugcucgugucuuuuguggcugaggggaauacugcauuuguacuggauguguuacacagucugcauuagcuucauccaagaagcuucagcuugaagagccagauguuuucaccuaagacuuaguuuguugcuaucaacaggugcuuguacuauuuggcagagcgguaaacauuuucccucuuuccuaccuccugaauuucuuccgggaucauaaaaucacaccgaagaugauguucaucaugugguuuagugguaagucaaaucuuggauaaaugggguggggaaguaccuguuaaaagcacgccccauacagggagagcugugguucucugcuagcgcccuuggcaaaaccacaaguaaucaauacucccguuuaauggcacccacugcaaucaagauggugccccucaccauggugcuaugaagugggugaggcuugguuggaagagggcaaacaacaugcccagggucacgugaccacuggaggcagagccgggauuucugccacucucuucugaacaccauagugcaguccgggaugcagcugggcgugcuucagcgccucccugggggucuucuaggcugaaguaauaauggucucaagguagaaaaggugaaaguugaaacuguuucauaccuuauguuaguuuuggauauuuuuccuuuuagucacaaaguucuaguaguuuaauuugaauguuucaguugcuauuuaaucacuuuuuaaaggacggaaaugauuucauacaucuuugcuucuaaagaacuggauccauaggcauccuuaaauuuauuuuugagcaauacauacuguucuuuaugcuuucuugcuuaaauauuauaaucaaaguauuuuccguguggguuggguuauagcaacacacuauaauguucucuauccaaaggcauaucugcaaguuugucucagauuucucuucuuucaaaaggccauguuuaaaaauguauauguuucauauauauguacguauguguauauauacauauacauuuauauguggugagaaaaacucauuuuuuuccuaaucucuuuugccagugaggcaaacuacuuuguaaaugguugcagaagugugucagagguuuuugaagugaugugggcuauuugggaaggggggcaugaggauaagagagcguuauggggaagguuggaguguauuugaaauggcgggggcugucggcuccuguucucucccaggcuccccgggcucuugcucuguggguuuccauccaggcuuuccuggauccucaacgaggggcacugaacaagccucugcuaccggccccucccaucaucauuuaagcaaucagagcuucuccuccuucccacaaaacaccagcaacuucagccagaguuccuccucaugucccccgcagcuguguccgcaccucuuuugccauggccagacccuugcgagugagccgugcucgcucauuuucuccacuucuucaccgccuguccacggggcuggaauuggccuuggcaggucaccagugaccucccgcagccagaccuggaggggaggcguccgcccccguccuagccuaccuccuucccacugccccuaccuucuggcgaggaccacuucacucucuuccccggccucugggccaugcuccuccuuucucuccuuugacgucuccuugggcucgucccccuucgcugaccccucaaauaguggcuucuucaggacuuggccccagccccacuucuguucacguguucugcacuucacugagugcgcucacccguccacuggccuucacuuccaccuagucccaaagcuguucccgcgaacccagaccucccucugggauccguacuccuguuuccagcugccuguuuggaugccguggggaugcugucaucccuaugccuuugcaucccccuugcccaagaaauccuacuuugaauugcccgguggccuggcuagccgguacuaagcacuugcuggguacacacccuguuaaagcacauuacaugucccgugucacugaauccucuggcccgugacagguuuagagaggcugagagucccuuguccucaccaugucucuguauuaugugcccuuugcucuugcccugccgucuccccaucugggucuggccugcagcagccuggcugcccuaccccauggugaugugagccuccccgcuuuccugucuggggaagguccuggugcugucugcaccaugcccccccccaccccccaccccccuccccccaccaucucuuccagguagcauuucacaccccuuauuugcugugccuccucccagcugcucuaggagcuccccaaggguggggcuaggacugccuguccccuccguauggcaccaaggaagccaggaaacuucuaacagaggaaugugcuguuuuccagcucaguccaugccccucaguugugcccuaguagcgucacagaggaccagccagccugucauuaccaccuaagcagcccacagccccaucagugccaccaggggccuccacagggacagcaucucgagauaggagggguacuggacacauugcaucuugugcuguuguggguauuaguugaguggcccugggcgggccaugcugcucuuggccuccaucccucaucuguguguuguggacaagaguagcgcugcucggugaggauuccugugaagauccagugaugcucugcacacugagcaccugcccaggccuggcgcacacacagggagggcucagcccacagcagcuguccugcaguuuccaagacacgagcaucaggcuugcuaaguccucccgcacccgcaucuggggcucuguagcuggggcaggccaucucauuugaucugccaauguuggaauggaggugagucuguggucccaucucugccaccugcucuuuacaccccaaagccucacagggugagcacacacucuucagcagggccauuagaauagucagcuggucguggugcugggccggcuggauuuccagggaagccagcccaugaagcugcugccucuucacuguguccucucacacuguuugcugucacccaggccugcggggagccauccccuaugcccugagccuacaccuggaccuggagcccauggagaagcggcagcucaucggcaccaccaccaucgucaucgugcucuucaccauccugcugcugggcggcagcaccaugccccucauucgccucauggacaucgaggacgccaaggcacaccgcaggaacaagaaggacgucaaccucagcaagacugagaagaugguuaguaccaugcgccuguggggguggggcagggggcuggccugcuacgcagcuggugguccccacugucaggaaauggggagaugagccuugcuuucuugcuuugaggaugcccagcaccuccacacacacgacacacacacacacacacacacacacacacacacacacacacgacacacacacacacacgacacacacacacacgacacacacacacacgacacacacacacacacacacacacacacacacacacacacacacacaccccccggucauccccccugagaaggaggugacggaacuugaguucugaagcauggcucuuggggugggggugucugguggccuugugaccugccgcagccaugggggcuguggacgaccccaucugcucccucucugaagcuccauggggcaccacaggagucuggaccugugccacaaccacagcagugccucugcccugccagcagcugagacaccugucagggcccagguuugaggguuucaaaauccugucauuccccaguaugguuuuacuaaaaaccaccuguugggggccugaggaggggaggaugucuugcgguggcugugagggccgugagagggguacucccccaaggacagacaugguguggggcuggagguacccaggccccagcuguagggagagcugagguucugcagccugcccaccucuucuuccuacaagccaccgccccugccaccaggcugccuucccgcccugucuucacccucaggaccccugugcaaagcuaggcccucugaccgaagcagaggcugcuguaggcuccagcccagagcauccccugcugaucaccaugcauuucuggacaugcaucucuuucuaguucccguauucuaggccucaguaacuuuaaucagucaucagaggcccaggaguccucacguggccauccacggcuaacacuggagucagggcuggcaagaccauggccuccaaucuccaugcucagcugggccccucacccagugcagugcugcugggaggaaacuuccagauggcugugaggccuggcucugcagaacuuccaccacacuaagaggcccuuugcccccacccccuaucuaccaacuuuuuuguuuuucacaaaagcucuagcuuaggccuuucuggguaucagaaucgguggggggcuugcuacacacaggcugcugggucucacaccagcaucucauagguaugguaugggguccgaaagaauuuguguuucuucuuauuuauuuuugagacagggucucacucuauugcacaggcugaagugcaguggcgugaucguggcccacugcagcccagaccucuugggcucaagcgauccucccaccucagccucuggaguaguugggacuccagacaggcgugaccccacccaguuaauuuuuucuuauuuuuaguagagauggggucucaccaugugguccaggcuaagaauuugcguuucuaacaaguugccagguggugcugcugcagcugauccugugaacacgcuuggcgaagcacagcacuagcagaaacaggacagcuccucugaggaugaaccgcugaguuucuggaauguuuucuguggcagucagugugcuugcguuuuccuuggaugaucucagauuguccccauagccugccagaaacuggcgcuuucauuauacccacuuugcagaugagaaugccgaggcaccaagagaaucagacagcugugggcacagacucccgagccuguccucuuuacuaccacgcugaucagcaguccucaaaaugggcuccccagacuagcagcaucacuggaaaccuguuagaucugcagauucccaagcccauucagaccuacugaauuagcaccucugcagguggcugcggugggcucaguauuuugugguuucacaggccccccagguagauucuaauacagaccaguguuugacaaccacugcuucacagcaucuaaaugcccuccccuccccggccauccucugcccucccugcaccugccccgucccccuccccaccaccugcagugaagcugcagagcacacuucacuguggccccacugagacuccuccagcagagcaggcgcugcacucagagccugucugcuuugcuccuaccuaugacccgagucccgccucuuuaccuccgucucuccccuccacaugggguccuuuucuucgucccuccccaauuccuacaggauguguuccucuccccucuccucucuugacuugauuggcaaaagccuguccacgguggaguccuagcuaauagagccacaggcaaagagacaaaaagccucccugugcgauuugcugcuaaugaaaagcccagaacagcaguucugguccugguugcaugauagaaucacccaaaagcuugaaaagcuuaaagaccaagccccagccuggcccaguccuucuguuuuagcuguccuaggugggguccugggcauccauugugcccugauggacguuccugccucccugcaggcucccaggaggccgucugcugcccgucacccugcauugauggucaaguggaguuaggguuggggacacuggcggccuggguggugugggggcuuccaggaggugccccccgauggugccagcugguggccgucgggccgccuuuccucccugcucagggcaacacuguggagucggagcaccugucggagcucacggaggaggaguacgaggcccacuacaucaggcggcaggaccuuaagggcuucguguggcuggacgccaaguaccugaaccccuucuucacucggaggcugacgcaggaggugggauaccggccaggccacacuuucugggggucccuugccugccuccuucaggaccugcgguggcccagggugggguggaggaagaguggggaggcaggaaagcucacgugggcccgccaggccgccgccucccgaucuggaggcuggacgugcuuguggaacucggcaucugcuguuuuuccuucgcugccacauuuagugcgagguuaauaauagauuuguuaacacaguuugguuuuccuggaugauagacucgggguauugaucagcuacugaaucggagcugaggaauuucagacauaccagggccucaagcuguggcccaagucugcccccagcucagggcucugguucugucccucggggcacugcuggccucucuuuaguuggaggccuuggguagggguggggcucuuccugcugcugcccgcuuuguuuccgagcaggcccauuuuccacucuccggcaggccugagagcugccggugugugcgcucuuccaggagccaggcagcuccagugacugugaccacgaccgcuuccuucuccagcauccugugcaguggaugcagcugugucccugacagcugaggagauggaggccuaagggggugcaguaaccccgcaaggucacagccaauaugggcauaacugggagcagagcuaacugugucugacuccagagaccacauguucagccucaagccaugcucccuccuccuuucugaaugacaccucccgugaccuccacccccacaaagaacaaucccagcucaguuuguucaacugaaacugaaguugccuguggccaucacccugccucccaccuccucccuagacaccccacacaaaacacccaguagcauccccucccuuccauggcccugccccugacgcccugacggcuugguugugucucucgacccaggaccugcaccacgggcgcauccagaugaaaacucucaccaacaagugguacgaggagguacgccagggccccuccggcuccgaggacgacgagcaggagcugcucugacgccaggugccaaggcuucaggcaggcaggcccaggaugggcguuugcugcgcacagacacucagcaggggccucgcagagaugcgugcauccagcagccccuucaagacauaagagggcggggcgagguacuggcugcagagucgccuuaguccagaaccugacaggccucuggagccaggcgacuucuugggaaacugucaucucccgacuccucccugagccagccuccgcucaguguggcuccucagcccacagaggggagggagcauggggccaggugccagucaucugugaagcuagggcgccuacccccccacccggaggaccccugcggcccccugccuagaggagcaccaucuacaguugugccauuccccagccacugccuucaugcugcccccgccggacuggcagagccaggggucagccaccugccuuugagucaucaagaugccucugcagccacaauucugaccuaaguggcagggcccagaaauccugaaaaccucccgcugccuuuugugauacuuccugugcucccucagagagaaacggagugaccuuuuguccuuuaccugauuggcacuucgcagucuaucucccuggguagcagacggcugcugcccuucucugggcauguucugaauguuuacacugguaccuucugguaucuucuuuagagcccccugcaagcugcaacucuaggcuuuuaucuugcggggucagagcgcccucuagagggaaaagcuagaggcacaggguuucugccggcccacaacugcugucuugauuugcauuuuacagcaaagugcugagagccucuagucgccuccugccaucugaucucccuccccaccauucccguacucaguuguucuuuugucuaaucggaggccacugugcugaggcccugcagugucugcucacugcugccaucuucgcugcuagucaggguuccauccucuuuccccucucccaguucccuaccacguuggaucccauucgucacccaugcuaggguccccaaagcacuggggcaggggccagagcagcagcacccagugcucccuccucuacucugaccuggggccccagcauccuggagcacacgcuccacgcacacacaccccagcccugucccaggggccuggcccccucagccaucucagggugaggagcugccagucauguccagauggaaugacucccauccucuccucaucuccccuuugacgagccucaaacugcucagcucaucaaagagccauugccaacuuccguaugugguucugggucccagggagccuuggaaccuggcacccuggggugguuuaauucaucauuaagaagcauuccugcuucucaagggacacaguggccugcaugggccagcauggacccugggcugaucaugugcauuccugcuucucuggggacacagugggcccacaugggccagcauggacccugggcuagagcaagcacaucuccaucucuuccaccucaggcaguguggcuccagaugucaggagggacugaccucaggaccuuccagguuccucugugccaggaaugagaggccaggcccgauccuaccaccucgccuugacccugaagucagagcaggccagccaagcaggaagcacacuguuuacuuuuugcaugaaaaguaaauguguacuugauagagcuaaaauaugaucuuuuuuaauuucucaaccccauaauuugagccauugccuugcuuaauuuugguuuccaccauuuccuuuuaguggagaagagaggaagucagaggguagggaccuuugccugccccugggcgagugcgggcagggaucugagaccagauuguucucgcaccccugccagaacucacucuccccugaaguuuagggucccaucucccagauguaaguuguuuugcaaacucaguuugccaggauuucuuucuuuccuaaucuuaaauucacagauaaagcaaugaaaagagucagaucccauuuccgucugcccccucgucaccaggugugauagccccagccaggucacaccuggccucacacuuugagcugagacuugaaaacgaugcuguggcggaagagcauguggggcuugguggaggggccccaggauuuguugggggcaaaggggguggcgggaccguucccaggagguaccagcaccugccucgaucuccucugagccucuucugcccccugucggccaggugaggucagcagccugggagagugcccccaagagaugagggcaccccguguuccuuggcaaucuuggcucaccuugguaacaaaaggccauagaagucuguuuuucugggucaguuuuuuuugccugagaauaacaaauugcugcugucuaccuuuagcacacccaauaauucuauuuggggcagugaaugcauagaagauauaaaaauacgcagcuuaacuauaucuuccugcguguguauuuauuuucuucugggucuaggccaugguacaggagaacuguggcguguaggaggaauacuucaggaugagugaaggcuggagccagggagcgcuggaggaaaccagcccuuuagccagcagccccuccaccacaggcacugcuguguggaacgaguucuuggaaugaaucccaugcuuucugcagccuguaguuguuaugaccccucggaacaaccaccccguggcuuguguggggucucgcagggaaaagggcuggcuucuagguccccgagauaagugugcagggggaugggccagggccaggcuaaggguggcucaguuccaucaucuggaggucagacacacuguccagaggcagaacugaagcccucucggccccuacccuaagccagccaccccucuucacagugggugagcugggcugggcuggcuggcaugaggccaagggguaggccugagcgccagagucgcccagguuagcccacaggauuccuuugugugccauggaaugcugaaagaugggugacuggggacccuucuuaaaaccuuuggcaaaggugccaucggcagggcuuggccucaugaagucucagguccguguucccgcagggcgcacaugcuuggagaguccucagcaggguagccgaggccaggccacuucugcugaggauggggcaggcugggguguggguguggccugggguggcucagggcuggaacugcugccugauuccuguguggggagaagcucaguggccguuugcugccacugacaaggauuucacaugcagaagagaaaaggccccccuccaccccccgcauucccugccgagugagagccaguguuugcugcccuugcugggggcggguaggaaacccugagcuuccugaugcggagucaugaagcagaguccucgggaaggcaucuccacagccccggguccucugucuaacgcccuccauuucacgcccuccaucucacagucaagauaaaggccucgagaauaaagagccagcccccuuccauuuagucuccugccguuucccaaacaguuguccaacaguuagacauugaggggcuucacuguuaccaggcauguaacagaaggaggaagacuaacacacacccccugccccaucccaucccccucucccgagcuauuuucuugcuguggccucuggugcccuugaguuggucuccccggcugcucugcgggggcuucacuggcuucggagugagcgcgaagugcuggugagcagugggccugugauuggaugggaagaugugcauccguggucaaaagucagcugccagcccugcggaaccagagccucaggcugggauggggaggccucccugcuuccaccugcauggugggcauggccuggcuuacaccaaaggcuuugacgguuucuccaaguaaggaucugcaaaucuugaaucguccucaaaaugacgaagcuugaauuguccucaagauggaugugaaucuuacauuccuuuucaucauuuccuuuguaaaaaugacgagugcuggguuuuuguuuuaagaagcauuaugaaggccagacuuacucauuuuucucccccaagugagcugcaagaggccccuguuaggccccuguuuccugagcagugaugugcugcucuucuugguggggcuuugggcugggaggggaaggcgggucagagaugggggaccuguggcugccaugcaggagccccugcgucaucucguuggacucuuuaagggagucaggaauagauguaugaacagucgugucacuggaugccuauuuagaaauaaaguguaugcugcug

SEQ ID NO: 191281 - RNA, 22907 nt, Homo sapiens
acaaggcagccucgcucgagcgcaggccaaucggcuuucuagcuagaggguuuaacuccuauuuaaaaagaagaaccuuugaauucuaacggcugagcucuuggaagacuuggguccuugggucgcaggugggagccgacggguggguagaccgugggggauaucucaguggcggacgaggacggcggggacaaggggcggcuggucggaguggcggagcgucaaguccccugucgguuccuccgucccugaguguccuuggcgcugccuugugcccgcccagcgccuuugcauccgcuccugggcaccgaggcgcccuguaggauacugcuuguuacuuauuacagcuagagguacaagggguuuguugagugguguugacaugcgcgggaggggugggugggcuucagauuggauuuuguccuccgagaucaccuggguaagaaaagcacagaaggucucugcuguguuggaguucacguucuaguggguggggagacagacgguaagcguacggagaacuugcagcugggguggguguuacagaggaaaagcaggagugcgguuuaacgggggccgcuuuagauagaauagccuaagaaggcccuuguccuggcuggaugagugggugaauugaugaaugagaaccuccuugcagaggccuucccgguccguacuucucagaccguagaccuuggagcaguuguaccgggauaacuugcagugcuuguuaaacauauagcuccaccgagagcccgguaaaucagaaucucugagggguaggacccaggugucuaguuauuaacaaacucuccagaugauucuuagguuucauugagaacuagggaugcagaccggugcauacaaaucgucuggggacguuaaaaugcagaaucuguuuuuuuagaccugggguuaggccucagagucuccauuucuaagaaccauccggcugagguagacguagccacuguccuuaacucucguaaugucucuuccucuuccguaaccuuccuugucccuugaauuaaacguuuuucagcaaccuacucaguucguccuucccuucaucucugcagacaugcacaggucugagggaggaaggaauaaaccguauaaaccuccugcgcuauuagccuaacagcuuuucuauucaaaauaguaggacuucugguuugaacugaauggauccugugaaagucaucugguucuucaaucugguugcagauuagagucaccugaagggcagucuccuuggcguugucuccagaauucuggauuagaaucuuauuccauucugcuuguuauucaauuucccuagaaagaaagguagaauaaauuggagcaaaugccuguagcuucugucagaagaauguugaauaaauguuguuaggccuaugugaucucauuagacugcuacuuagaauuguaagggaaguaaagcauuagagcaugugugaaauuaaauauuugauuaacacaagugugcauuuccuuguugcuguuuaucaacuuuuacuuacccacuguuuuuuuauaagggcugcagccuguagucugggccuggcuucaucauggaauuauuugcuuaauuguaaaaugguaaucuuaauuuuuuuuuuugagacagggucucacuccauugcccaggccagagugcggggauauuugauaagaaacuucagugaaggccgggcgcgguggcucaugcccguaaucccagcauuuucggaggccgagguggguggaucaccugaggucgggaguuccagaccagcccuaccaacauagagaaacccugucucuacuaaaaauacaaaaucagcugggcgugguggugcaugucuguaaucccagcuacucuggaggcugaggcaggagaauugcuugaacccaggagguggagguugcgggugagccgagauugcgccauugcacuccagccugggcaacaagagcaaacucuaucucaaaaaaaaaaaaaaagaaaccucagugaaaugaaagacugaacuacacaccugggggaaaagcguaauaaagggagcaagaagugcaaaugcuuauggcaggggacuuauuugcagaaagaaagccuuguguggcugguacacgguugacaagaagaggagaugaagucagagagguaguuaggguccauguucugugagacuucaauaggccugucuaugcagguuaggaguuugcauuguuuugauugaguugggagccaugggggucuucugaacugaggaucaacacaucugauuuguuaaugagauugccggccucaguguuaagaauggaccaugacaggguaaggguggaaguggggaggccauugggaggcuguuggaaaaaacucaagggagagagaauaaugguuugaccaggugguaguaguagagguggugagcagugaucuugaaggcagagccuacagaauaugcugguggauuaaaugaaggguuugcgagagagaaccucguaaaggguuauuaugccaaggcuuuuggccugagcaacugacaggauggguuugccaugcacugagaugaggaugucuagagacuagauuuggggaggugagaguggggagagauuaggacuucuguuugggacauguuagaauggagaugccgcucagauaaucaggugcagauguugcauagaaaguagaaaauguagaucaagaguucaggggagaggucugggcugaagaaugaauauuugggaguccucagccuguagaugguacugaaagcaaagagacuggauguacucggcuagggaguaauuggagauggagaagucauucuaggccugagcucagggcacacccaugaacagggaggugagaaguggagaagggaagagguucaguuuuggauauguuaggauugaggugccuggcagacauuuuugggagauccugggcaaauccuuggauauccaagucugacaguccaaggagagacuagggcagaagacgcacuuugagugguccucaugaaggcauuuagagcugaggcacugggugauauggaucccuggugaagguguagauggagaaguggaggguccagggacucguucuugagucaccccagacccuugaucuggcaaaaaugagacugacccagcaaggagggaaagacaggacgacuaggugguagauaaaccuggaagugaagugaagaaaaaaguguaagaugugaucaaccuugucagauucugcugaggaugcaaguacggggaagguggaauugacccuuggguuuggcagcaguaggugucagccaugagccugacaaugugguggagacaaaaaagccagguggggaugggcucaggggaggggagaggagcaguagagguggcaaguguggacgguucuucuggagcuuugcuguuggagaggagggggucauuguuagcaacgauaauagaauaaagaggacuuuuauuuuauuuuauuguuuugagacgaagucucgcucuuuucccauaggcuggagugcaauggugugaucucagcucacugcaaccucugcuuccuggguuuaagugauucuccugccucagccucccgaguagcugggauuacaggugacugccaccacgcucagcuaaguuuuguauuuuuaguagagacgggguuucaccauguuggccaggcuggucucgaacucuugaccucaggugauccgcccaccucggccucccaaaaugcugggauuacagguguaagccaccaugcccggccuaaagaggacuuuuuuaagguagcagguaugccaguaggcugcacagggauggaagugauccauuagaggagagaugauggagcagcaagaccaucaggagugaagacuccgugacagaggaugggacgcagugcccaaggggagguuggccuugcagggaaagcacaugccugucccucccucauuagcuucauuuggacaaaacauguaaaauccgguguguuguggaggccuuuugauuggggaacuguaacgcugccuaucgagcaacagcacuuuaagcagguggcuuuguucaaauuaaagguucuucuuuuucuuuucaggcaucauggaccgaucuaaagaaaacugcauuucaggaccuguuaagguaaauugaauaaucuguaaucucauucacauuuauaaacccacauggagguuggucuugucgggaauucuuuccgccuuuacuuuggauuuaaauuuagaucccuuacugugauccuggauaugaauuagucacuuuucucguguucaguaacauuuugcugcuucuuagaguagcuuuuuuguucugcuuugucuuauaaucggcugcuuaaguuucuauaucccuccacuguaugcaggauaauaguaauaaugcaucuggcaggaguucaaaacuuuuaaaauuggccauaaauauaaaauaauuagaaaaaggcuaccuugaauuacuguauuugauucuaaguuccuaugauaacggccauuuaaaaaauugcucuauauuuaaaauguuucuuuuuauuugucuuugucugaaugccugcugcguuguggacagugugcuaauuucaggaguaacugacuuuguauuuggaagucuuaacacccucucuuuguagagcacucauaccguugagcuggggauggacuuugaggcuuucauuucuagcacuugucccucacuuacaaugagcuguugaagcugaaggaaaucucaucccuccuaccccuuuuaguuugauuagcugaggguguuagaguuaacuuaacaauuuaagguuguaauacaguacuuacaggcguauaaauaauacauuucaaggcugggcgcgguggcucacgccuguaaucccagcacuuugggagaccaaggagaguggaucacaaggucaggaguucaagaccggccuggccaagauggugaaacccuguuucuacuaaaaauacaaaaaauuagccaggcgugguggcaggcgccugucgucccagcugcuugggaggcugaggcagagaauugcuugaaccugggaggcagagguugcagugagccgagaucaugccacugcacuccagucugggugacagagcaagacuccaucucaaaaauaauaauaauaauacauuuuaguaguaacuuugugaagugucuacauuuguuuccucuuugucaguuuuuugcucaauuccauuuugucaauacuuggaaaaugaaacauugguuaaucaauaguacaguaauaagcuuauuguggaaaaucuucgauauaugaaaacuuagacucuucuaaaacuucaugaagauaauaccacuguugaacguuuugacguauuuuuuuuuggucuuuuucuuaaacguauauuaucaaagaaauuucaauggaacugagauuuuggcauaaaguuuuuguaucauagcuuuuugccaaauagcaauguagugucuauuuccaaauuauugagaaauuuuagaaagugucuccuucauuaauggauauuuguuaauaaagcaugauuuuuaggggugaggaauuggaggggauagaagguaucauucagguauucuuagccacauacuaacuauccucuggagguacugauuaaaauaccuuuucaccuuccaucucuuaucagugacauucauuauuuugcuauacuagagaacaaacuuugugaaauucucaauauauucaucuuuugcuuucaugaaugccagaaaguuuauuuucucuuccauucuaggcuacagcuccaguuggagguccaaaacguguucucgugacucagcaauuuccuugucagaauccauuaccuguaaauaguggccaggcucagcgggucuuguguccuucaaauucuucccagcgcauuccuuugcaagcacaaaagcuugucuccagucacaagccgguucagaaucagaagcagaagcaauugcaggcaaccaguguaccucauccugucuccaggccacugaauaacacccaaaagagcaagcagccccugccaucggcaccugguaaacuagcuuuugagacucauuggauaguccuucuuugucgucguugcuaaaaaagccaguguauauacuugcacuuauuguuuggagccuuagcuuuuauaucuguugaggauggggagaaaauauggugucuggguugaaguaacagugucugcccaugggccagaccuaugcuaaaaauacagaccugauucucacccucuuggaagaguugggcacccagggaggacacagcauaaauugguguccuuuugauugcuuguuacugagucuggauguagggugcuugcaguaagugacuugaagggacugagaucuaaagugugggggaaauccagagaagugggugaacugaggcaggcugcggugaggucaccaugggcauugcuggccauguuaaggaauggggccucaucucuagggcauuuggaagcuacugaagcuuuuuugaacucagaagggaacucugccuuuuagaaaguuuacuguggaaggccaggcgcaguggcucacgccuguaaucccagcgcuuugggagaccgaggcagguggaucaccugaggucaggaguuggagaccagucugaccaacauggagaaacccugucucuacuaaaaauacaaaauuagccaggcgugguggugcacgccuguaaucccagcuacucaggaggcugaggcaggagaauggcuugaacccaggagguggagguuguggugagccgagauugugccauugcauucuagccugggcaacaagagcaaaauucuaucucaaaaaaaaaaaaaaaauuuacuguggaaguacugaauaaauuggaguagaacgcuggauuuaggaguaccagacaggaaggagguugaggucagagauggcaauaaccugcucuguguggagcagaguggaugcaauuauuuaccaacuguugagugcucauucccugcaggcucugagauaagugcgugcuucauccacgucaucucuuucaaucuucguaaccacuucaugaagguagccaguuauuaacucaguuuuacagaggaggaagcuaagacucagaagcaguuaacuuauccaaagacaagccaggauggagaggugcacacaaauuugagagcucauuuacgaugcagacucauuagaacugggcaauaaauuguaccugaaagaugaauaaagaggaguuagggauggugauuagauugauauuaauugagugaguguccuggggguugaggggugcacaugugacaggggcaucuggaggaagaguuuggaccagcauccagauaucugagcagagcauugugugcuguucgaguuugcuauguuggagacagaccaguggaaauguuucauauguccuuguggcugaugaaauaguuaccccaguccucugcugcacaacuguucauugugcauuuugcugaauugguggcuuuuauuuuuauauuuccccuuggcagcuaauauaaauggaggguggcuggcuuauguuuugcuacauguuggugauaauucguauguaggguauggacuguuggcuggcccaccuaguaaggggaaaaaggugacgaguuggcagcucgucaugcaugggaagauugguacuucugccacaaaagcucuucuuuggaaacugaggcuucagaagagccugcauagucugccuuuaauuuaucagagaagggccugucuauauauacgucugcucaucuuuagaaauucuauaaaggcuucacaugauggaagucaggguguaguaguccuuuuuuucuauaaggaaaacuuuaaaaaaaaaaaacagauuuaucauucuugacauaccauuaauauuuuggugaccaauucuuugauucaccucuauucacagcuuagcuuauccuauauaguuauucuaaaaacagguuuuuaacuuauuccauauagaaaauaauccugaggaggaacuggcaucaaaacagaaaaaugaagaaucaaaaaaguaagcuuucuuauuuacaaaguucuguacuguucuacuagaauauauuauuucguugcaaauuucguugugggaacucuggggaaaaaaaugaggccuuuauuugcauuuagaggauauaaauguuuccagauuuccaaucuuaaaaaaaauggaauuuuguguaaugagguauuuuacuaggaacucaagugcuuuaaaaaauggcuuucaaauuuagaaaaagcuuguaugaaucuuuuauagaaauguguggaaguuccucucuguccuuagaaauaaccacuacauaugguuuaugcgucuguacuuuuuuauuguacaaaagugcaaguuuuuaaaaaauagaauauguugcagaacuauauacucauauaugacugaggguuuugacaguauuauaguuuuaguucuuuauuguaaagguuggcuguaaugucuuccccagggcuuuucuaaaagccuccucucagucucugaacuaucuggacucuagaauguaccgggaggagcgaggaaugaacccacagacucuuuugcuuuuagcggucuaacagaggcuaagagucuaaauccacugguucucaugccccagcuagccugugggcuccaucccgcuuccauuaguaacaguggcucugucuccaccaccagagugguucuccacccagagagaauuagcaccucugggacuggagggagcagcugggguuaguuugaaacaugcccccagauggucuggaagcauuccucccucucuggucacuuauccuuuuuguggucuucagcguugucauggcccuguuccucugagcauaguacgggcuugggacauuucccauagagugcuucaggucuaaaacccgagacugcuccuugucacugacucucacaccugacggcagcuagggacgucaggguuucaugucguggcagcucuuugauagugguuauugccuugguucuugcugaggaugcauauugagugaaguuggaauacgaaauuauuuguagaaugugucugcuacucauugaaaauuuguuagaaaagcuuuguuuucuucacauucuaaaguguucaaauuccuccuaggaggcagugggcuuuggaagacuuugaaauuggucgcccucuggguaaaggaaaguuugguaauguuuauuuggcaagagaaaagcaaagcaaguuuauucuggcucuuaaaguguuauuuaaagcucagcuggagaaagccggaguggagcaucagcucagaagagaaguagaaauacagucccaccuucggugaguuuucagguucauguucaaaagaauguucaccaaugcugcaccccucccccuccuguaaugucagccucccacugcccaggucccuucacucccucuuacgaggcacugccuucaaaugcauggccccguuccucaccucccccuccccuaugaaaaagauuagauaagcuucuguacugcacuggguuauaagcauucuccugugauucucccaugcucugcauguuaaaauaaaauuguauuccuuuuuuuuuuuuuaaguauaaauuuauuuuuuagagggccugcuuuucauaguaccacaaaaaaugauuaaauuugucaucuuucaaagagcacuuaagugcucugauccuggaaaaaucacuugaggauuuaauguuuuguuaauagaauaguuuauaugggcaagucuuucugguggacagugaaggggaauggcaccccuuauucugagguaugcaggaauugcgagcagcuaccugcagguugacuacggcugguggguuuuuguuuuuccuuuuuuucuuucaguguuuuucaaauuugaaucagaugcuaauacuucaagucuggccacaucaggccuggugugucucugccuggcaacaccuggcuggggcugggaggggcaggcaucucacaugggcugugcuucccauugccugcuucccgcuggccacagucugcaccugcccagucugcucagcacccaucuacugccauuacugaucacugcuuuuaucugucacagugucugggugucaaacuacuguggcaaugccauguccuuuuuuuuuuuccuuuuuuuuuuugagauggagucucgcucuguugcccagacuggagugcaguggcgcaaucucagcucacugcaaccucugccucccagguuaaagcgauucuccugccucagccuccugaguagcuaggauugcaggcaugcaccaacaagccuagcuaauuuuuguauuuuuaguagagacgagguuucaccauguuggccaggcuggucuugaacuccugaccucgcgauccucccgccucggccucccaaagugcugggauuacaggcgugagccacugugcccggccauguccuuuuuuuaauauguagauaauuaauauucagcugaauuuuccuccuaagaauaaaggugccuaaaggaaggaaauagucuuaacuaaaccagagguccauuaauacugugaagugcuuuuaaaaugauauguggguguauguauuuuucuuggaguggguuuauaguuucagauucuaaagugggguuuggagugugguuucaugugaaacaccacugguuuuacaugaagaguuuguuugacauuuuguacauagucuucugugagcuccaaaccaaguguuagaauguuuauccuuuguugcaggcauccuaauauucuuagacuguaugguuauuuccaugaugcuaccagagucuaccuaauucuggaauaugcaccacuuggaacaguuuauagagaacuucagaaacuuucaaaguuugaugagcagagaacugcuacuguaaguguucauuuauuguccaggcuaauuguguuuccuuuauaccuguccuccauagcaauguaccuuucaucauaguagaguggguuuugucuugacguaaggauagcuuaauaucaaauauuugaaguggaaaaaucaaaauagcuuaguuguaccauauguacagauaaagucuagaaccagguagaauguuguaucugcuuuugugccuaguuugcacagcuguuuucuauggaaauguauauaauguauauagauagucacccucauuuucuuuaauagauguuuuauuuuagaauaauuuuuauuuuauuuuauuuuuuuuaaagggacagggucuuguuauguugcccaggcuggacucaagugauucuccaccucagccucccgaguagcugggacuacaggugcacaccauuguaccuggcuaggauaguuuuagauuuacagaaauugugaaggcaguacagagaguucccauauaccccacacugaauuuccuacuaauucuccuacuaacaucuugcauuaauauggcacauuugucacauucaaugaaccaauauugauauauaacuauuaacucaaguccacauuuuauucagauuuucuuaguuuuucucaugauuaaauugggcuuauggguuuuugagagggagaucagagguaaagugcauucuuaucacauaccagggauguaaacucuuaugacuuuuaacuguggaugucagcuugaucuucugacucagagaguguuugucugguuucuccacuguaaaguuacuauuuuuuccccuuuccgugcuguauuucuucaaaggaaguuacuaugaauagcccacacuuaaggaguagagaguggauggaguauugccauaaauuaucuggaauucugugccagagauaaggcuguucucccuuauuuauuuaaucauuuauuuauuuaaagauguagacuccuggguauuuauuuuaucucuugagcuauaaugcaauacuuuauuuugugguucagaucauugcaacuuuggccacugggaacuuuuuuucuuucuuuuuuuuuuuuuuucuuuuugagacggagucucacucugucgcccaggcuggagugcaguggcgcuaucuuggcucacugcaaccucagccucccagguugaagcgauucuucugccucagccucccaaguagcuggaaguacaggcacccaccaccacaccuggcuaauuuuuguauuuuuaguagagacgggguuucaccauauuggccaggcuggucuugaacuccugaccuugugauccacccaccucagccucccaaagugcugggauuacaggcaugagccaccgugcccggccugcucuuuuuguuuuaccagguuccugggaaaaucauugcaguuuugucuugcgugugugugguuuuuuuuugguuuguuuuuacacuuccuuuuuuuuuuuuucuuuuuuugagauggaaucucacucugucgcccaggcuggagugcaguggcauaaucuuggcucacugcagccuucaccuccuggguucaagcgauucuccugccucagccuccugaguagcuaggauuaacaggcaugcaccaccacacccggcucauuuuuguauuuuuaguagagaugggguuuugccauguuggccaggcuggucucuaaccccugaccucagguaaucugcccgccucagccucccaaagugcuaggauuacaggugugagccaccacgccuggccuuguacuuccuuacuuucugauacaagaugcucaggccucaucguguauauuuccugcuccaguccuagaaucgaaccacuucuccaaggagcccuguuuccuuuucuuggagaauguuauuagaaaccaagcucugggcacuugguguacucauugcuacuauggugucacuacuuuuaggcuuucagcugacacagcaagggaauauauguggauaguaaucuguguauagauuuauccaucuaucucuucauuaagcauaccaugaauucauacugaugucuucaacuugaauccauuaccacguuucauucuaacuuccuccuguuuaccuguaaacucccacuccaaaagugugaaaccuggauuucaccgcccaccauccuuuuacuuauucaauuccaauauacauguauaaugguaucagaauuguuaaccagcugccacgugggaaccaacuuuaucaauuagagugcuuaugugcacuuccuuuggccuuugucuuauagauuccacucauuuccaaagcugcuuggaucaacacuuuacccucaugcccuuuaguaaggugguuuccuacauuuguaaugcaaugagauuuuuuugucacaaucugcaugcccaggauggaaucauuuacauuuucauauccugagauugauuuuuguguguuugcuguaaaguucuaugaauuucgacaaauacacaaugccauguauccaccauuaugauauagagaauaguuucgcugcucuuaagaaaaaaaaaauccugugucucaacuacucaucccuuccaacccuuccaucucuggcaaccacugaucuguuuacugucucuauugccuuuuccagaauaucauguaauuggaaucauaacaguauguagcuuuuuuaggugggcuucuuccacuuagcaauaugcauugaagauucaucuguguauuuuuggaggcaugagagcuuguucauuucuguuuaucacaaaaucauauuccauuauuucauuauauggaaguaccucaguuuauucgucuacugaaggguaucuuggcugcuucugguuuuuggcaguuaucauguuuuggcugucaacauuugcaugcagguuuuugcgaaacaagucuucaaauuaguugggcacauauauaggagugcuauugccagcucauacgguaagacuauauuuugcuuugugaggaacugucagucuuccaaagugauuuuuacauuauauuuuacauugcauuacaaauguaggaaaucaccuuacuaaagggcaugaggguaaaguguugauccaagcagcuuuggagaugaguggagucuauaagacaaaggccaaaggaagugcacauaagcacucuaauugauaaaguugguuuccguggggcagcugguuaacaauucugauaccauuauacaacgguaaugugguaucggaaccaaugaauugagguccucuugcuucucauaguugccaacauuugaugucaguguuuuggauuuuuguuuguuuguuuugagacaaggucucacugucgcccagacuggagugcaauggcaugaucacccaccucaaacucccuggcucaagcaauccucccaucucagccucccaaguagcuaggacuacaggcaugugcucucgugccuggcuaauuuuuguauuuuuuuguagagacaagguuuugccuuguugcccaggucgguuucgaaauccuggucucaaguaauucaugccucccaaaauauugggauuacaggagugagccacuauaccuggccucuuguuuugcauuuuaguuauucuaaucggcauguggugguaucucauuguuuugauuucuaguuuccuaaugacauuugauguugaacgucucuuuuuuuuuuugagacggagucucgcucugucaccaggcuagaguguaguggugcgauuuuggcucacugcaaccuccgccucuuggguucaagcgauucuccugccucagacuccugaguagcugggacuacaggcacgugccaccaugcccagcuaauuuuuguacuuuuaguagagaugggguuucgccauguuggccaggauggucuugaucucuugaccuugugauccaccugccucggccucccaaagugcugggauuauaggcgugagccacugcgcccggccuugaacaucuuuuuauguguuuauuugccaucuguguaucgucuuugaggcaccuguugaaaucuuuugcucuuuuuuuuuuugaguuuugaguuuuaagaguucuuuguauauuuuggaugcaggucaucugucacacauguuuugcaaauauuuucucccaauccgugccuuguauuuuuguucucuuaucugugucuuucacaaggcuguuuuuuauuuauuuuuuugagaaaggguuucacucugucagccaggcuggggugcaguggugcgaucucugcucacugcagccucugccuguugagcucaagugauccuccugaguaggugagacuacagguggguaccaccacgcccagcuaauuuuuguauuuuuuguauagacacggucucaucauguugcccagguuguuuuuuuugaggcauucuugcuuugucacccaggcuggagggcagugacgugaucuugguucucagcucacugcaacuucuaccuccuguguucaagcaguucuccugccucagccuccugaguagcugggauuacaggcaugagccaccacgcccagcuaauuuuuguauuuuuaguagagacaggguuucaucauguuggccagucuggucuugaacuccugaccucaggugauuugcccaccucggccucccagaguguugggauugcaggcaugagccacuguacccggccucccaggcuguauuuuuaauaaaaguccaaaugugucaguuuuuucuuucaugauugugcuuuuuugcuucuccuuuuuuaugugauuaaaauuacuuguuuuaagaaguugaagagucuuaguuugggccguuucuuauuggauuggcagcuugauaaagcauguugaauggugguuacuuugauuuuuuucuguuucuugguggagaucuccggguaguguggacauuaguucucuuuuuggcauugauguaaauggcauuuaaauucaaguaauuuuacuuucaguaucugaugaaaucaugcuacuauggacaaauggcucuuuggucuugucucugcaacaaugacaugcuguuuuaaagacuuaaucuuaaauguuugugcuucuccuaaguagaaauagaucucuaauuugcuuuuuuaaauauuagcuaaacaaaucagcuucuuauuuaauuggcaauuaauauuucuuugaguucaucuuuugggccaacuuucucuuacagaucaauaaguaaaucuaugcucauuaaugguagugacucuaccucagguacucacauuuuacccuugguuuuuuuccugguaaucuugcuuaugguggguuguaguuuguuguuucaggucaguuaaucuuuuucuucaguuucugauauugauauccuacuuuaaaagauucaccuuauaccaacacuacaaaauuacacauuauacuacuucucuguuuucucuccuuacacccaaggcuucaaucuagauggaguuuugguguaagcagauagcuguuugaaagaaaaugaaagaucauuucugucuagauuccuuagcaguuagaaugaauacacauguaccuguuuuccuuuucagaugaauucaaauaaaacuaauuguagugacaugucagugaccuauccauaucugcaaucuaacaacaugugagguguggaggaaguggcagugccagagggcuaucaugaaacuaauagcuucuugucuggaagugauuugaggagugaaauccauugcccucucaaacuuuaaugugugcaauuaaagcaucagcaacucaaaguugguggucagaagagcagcuuucuuuguauuugccuucaguuuauuguggucugaauuuugaucuccgguuuugggcugaaagaaugaaaaguguuuauucugacagugacauuugguuuuuacucaucuguuuaguaaaccuuuuugauguaaaauaauguucaauccugucuagaaauugcuguagaaagcaaacucuucucaaacuuuaggcagagcuaaauauauuuuuucaauauucaaacaguuaucuguauguuaaaauaaauucugggccaggcaugguagcucacgcuuguaaucucagcacuuggagaggccaaggugggaggaucacuugaggucaggaauuagcgaccagcguaggcaacauggggagacugucucuacaaaaaaaaaaaaaaaaaaaagaaagauuaaaaauuagcugggcaugguggcacacaccuguagucccagcuacucggaaggaggcugaggugggaggauugcuuacggccaggaguucaaggcugcagugagguaugaucaugccauagcaauccaggcugggugacagagugagacccugucucuuaaaaauaaauaaguaaauacauacauacuggacuuguuugcuaaaucuuagcgauagggacuguaaaacuuuucuuuuucuugcuuuuuuuugagacggaauuuuacucuuguugcccaggcuggagugcaauggcaugaucucggcucacugcaaccucuaccuccuggguucaaccaauucuccugccucagccucccgaguagcugcgauuauaggcaugcaccacuacacuuggcuaauuuuuguauuuuuaguaaagacaggguuucaccauguuggucaggccggucucgaacuccugacuucaggugauccaccugucuuggccucccaaagugcugggauuacagguaugaaccacugcaccuggccaggaaaacuuuucuuacaagaugguaauucggucgggugcaguggcucaugucuguaauccuagcacguugugaggcugagaugggaggaucacuugaggccaggaguuugagaccagccuggucaacauagugagacccccaucucuauuaaaaaaaaaaaagauaguaacuuaaggaaauaaaauuaacaaaaggacugauuucuuauguacuucuaugcugacuuaguguaacccaaaauuuaacaugcuauuuaauaugucagugcaacugcuuuuuaguuucuguuuauuguucaggauaauuuuuucuccugauauucuugaaguaaauuuuuagcuuuaaacaaauucuucugucacagaaugaccuugguuuuaaaaaagggaauugacuauacuugcaaaguucauuuuuuuuuucuaaaaaagaaaaaggcaguauuuacacaucugaauccuuaauuuguaccaguucuucagcacugucuuacuuccuggcugcagggccauuuguugccguaugguguuguaacuuuagguuggugcaaaaguaacuguguuuugcauugacauggcaccagccuaagagcuagcucuaacuggcugaaugucuuuucugacuuucaacaucacaccagcuguauuagcagagaugacuaagcauuggguaauuucacuucaugcuaaccacuauaaauugguucaguugauguguguguguguguguguguguguguguguguguagacuccuauauaauuucuacaauccuugcuuuaaaaccugcaaaauguauuuuuuguuuugucuuuuccuuuuugagacagggucuccuucugucacccaggcugaagugugaucauggcucacugcagcuuugaccuccuggucucaagcaauccuccugccucagccucccaaguagcugggacuacaggcaugcaccaucacgcucagcuaauuuuuaaauuuuuguagagauggagucuugcuauguuucccaggcuggucuugaaccccugggcucaagugauccucccaccucagucccccaaaguguugggauuauaggugugagccacugugccuggccaaaaccugcaaaccauguuaaaucuauguuguguuccuuucggaagagaugucuaauauuaacuuguguuauauaaaaucuaaaacauaggcuuucaauauuguuuuaacaguauauaacagaauuggcaaaugcccugucuuacugucauucgaagagaguuauucauagagacauuaagccagagaacuuacuucuuggaucagcuggagagcuuaaaauugcagauuuuggguggucaguacaugcuccaucuuccagguauguaacuuuagagguggaaguuguuugguuuaccaaagcccugggagcuaaccgugagcuaaauguaaaauauuucaguguagauuuugugcuguaagagggguagguggcuaacccagaaguacuuuggaguaauuuaggcuuaauaauaaacuaggguuugcaagaaaguguuauucuguggagauuuggggcuauuagcaguguucuaggccuaggguugaagaugcuuaauguccuuagaggcuaaugaagggaugaaugagucaacagauaggacacguauaugacagaggugaagugcccacauguugagugggaggaacucuucaccucugcugcuuccuggaugaggagauggggagaugguucagaggacagcacugacaaagaucuagagcucagagugcaggccauaucagggaacuugaaacacuaaauuaguuugguggugcuuugagggcaguggugagagauucucuucagucugccucugucaauaguagggauaguccuuucuuauccccugucacagcugaagcagagaugucagucucaaaacaauucaaaucuuagcuuuccaagugaacuacaauaucuuuacuguuuuaaauuugaguuuaaauaagcuuugaaacuucacaugaaguggggcauuuuaaaacauauaucuaccgaugaaguuuugucaacuuuggaggaggacucaaauuauagccaaaugacuuaaaaaucaagcuaguuaaaaaaaaaguauagccuaaaauagaauaugagggagaaaaccuuugcuuuuguuacagagcacuucuaauuguuccagcaaugcacugaaucugcuauugcagucuuuuuuuuuuuuuuuuuuuuuaaacugguugucauuagugggagcuguuaucuggugagacaaaccagaauaaagacuuacaggcuucauggaaucgcagaguuaaacuguaucuuaaccgguugaauugugauagaaaagauggcuucuugcuuuuugaaaagauuacuuacauaaccgauagucacuucacuccaaaucccagauguuaaucaucaucauuuccugguuauugccucaguuugagaacccccgauucaguccgucggugcugauggagggguuagaugaccagagugguagcuucuuaauccuacgucacaauucaguggugagugacuguuugugugcucagugggugccaggccuggcugaacacagcaccagggcugugaccacguaagccuccauggugaagagcagcugauaacaaagcaacacgaacccacacagacuguucuggcuugcugucugcuguucccagcuuuuuuccaaccuucguuaaaaaaaccuaaaccgauaaaaaugcggaauugguaguugauggcauaccugucuauacagugccuacguucagcaguuuuucccauuuagucagaagggcugcaucugcuuuuuuagugaacacuugaaaauacguugcaaacaucaugaugcuucaaccuuaagcacuauaauagaaugcauuuccuaaauaaggauauucuccuauauaacuagaaccaugaucacuccuaagaaaauuaacagcauugucaguaucuaauauuuaguccacauucagauuucuccuauuguccaugacaucuuauagcugguuuguaaaaucagaacucaaccaaagcccaugcuuuguauuggacugucuaugugguuggauugucucugugguuggacugucucugugguuggacugucucugugguuggauugucucuguggucuaaagccagaccagucucccacuuuaaagaggacuuuucugauuguguugccacuuaacuuggaccuuuauuccccguauuugcugaaaacuggaauguaggucucagguccugaagagauucagguuaagaaaauuuuuuuuuuuuuuugagacagagucucgcucugucacccaggcuggagugcaguggugcgaucuuggcucacuacaagcucgccucccggguucacgccauucuucugccucagccuccugaguagcuaggacuacaggcgcacaccaccacacccggcuaauuuuuuguauuuuuaguagauacggcguuucaccauguuagccaggauggucucgaucuccugaccucgugauccgccucccucggccucccaaagugcuggcauuacaggcaugagccacugcacccagccagguuaaauauuuuuggcaagaguacuucauaggccacccucaaaauuucagcaucacucguaccaaguaucuaucacaaggcagcaugugucuacaucuccaccccagugcuguuacagugggacaguuucuaguguauugucauugcgaccaggcuuuuaagauucuuagcauaucuguaauauccacaugcagauguagaauccaaaucguauuuacagagaacuuugcauggcagcuuuuauaugguagugauacauucaguuucuuacauucuagauuauucagggagguucuggaguuggacagauuugggguuaagccugauggcuagcugugugaccuuacacaccucgcuucaucuguuuccuaugggaauuuauaauaguagcuacuuccuagggcacaggaucuggcccaggggaagaccucaguguuaguggacucuuuaaugauuguuagcagcuguugugaucauaaaacgagaagcacaucaaccugagccucccuccguuuucaggaggaccacucucuguggcacccuggacuaccugcccccugaaaugauugaaggucggaugcaugaugagaagguggaucucuggagccuuggaguucuuugcuaugaauuuuuaguugggaagccuccuuuugaggcaaacacauaccaagagaccuacaaaagaauaucacggguaagacgcaacugaaaaggacccagcacaucugcuggaauucuuuccuuaucagccugaacugcaggccaagauccgaacaucuauacuauuugaucucucuaaccuguguuuugugauauuuuaucauuuguuguacuccagguugaauucacauucccugacuuuguaacagagggagccagggaccucauuucaagacuguugaagcauaaucccagccagaggccaaugcucagagaaguacuugaacaccccuggaucacagcaaauucaucaaaaccaucaaauugccaaaacaaagaaucagcuagcaaacagucuuaggaaucgugcagggggagaaauccuugagccagggcugccauauaaccugacaggaacaugcuacugaaguuuauuuuaccauugacugcugcccucaaucuagaacgcuacacaagaaauauuuguuuuacucagcaggugugccuuaaccucccuauucagaaagcuccacaucaauaaacaugacacucugaagugaaaguagccacgagaauugugcuacuuauacugguucauaaucuggaggcaagguucgacugcagccgccccgucagccugugcuaggcauggugucuucacaggaggcaaauccagagccuggcuguggggaaagugaccacucugcccugaccccgaucaguuaaggagcugugcaauaaccuuccuaguaccugagugaguguguaacuuauuggguuggcgaagccugguaaagcuguuggaaugaguaugugauucuuuuuaaguaugaaaauaaagauauauguacagacuuguauuuuuucucugguggcauuccuuuaggaaugcugugugucuguccggcaccccgguaggccugauuggguuucuaguccuccuuaaccacuuaucucccauaugagagugugaaaaauaggaacacgugcucuaccuccauuuagggauuugcuugggauacagaagaggccaugugucucagagcuguuaagggcuuauuuuuuuaaaacauuggagucauagcauguguguaaacuuuaaauaugcaaauaaauaaguaucuaugucu

SEQ ID NO: 191282 - RNA, 50296 nt, Homo sapiens
agcgugcugcgucacggcggugcgccggaaguggcugcggauuucgccggaaaucccggaagugacagcuuuggggguuugcugcuggcucugacucccguccugcgauggguugcgacgggggaacaauccccaagaggcaugaacuggugaaggggccgaagaagguugagaaggucagugaugugggccggcucuuggcgaccggggguggugggaauuugacgaccccagaaaacgagaggaaguaagaagggggagccagcggaguuccagaccuggcugcggucuuuuauuccauucagaggacucaaaauuaacaacaguauuaagaguggacauucaaugggugcugacuauugccauucacuggacaguaaucuuaacaggggguaucucauguaauuaucacaauagcccuauagcuacauacuguuguccucauuuucagacauggaaguugaggcucaaaaggagaaauuugcaaagcuaguaaauggcagagccaggauuugaacccuaccugcgacuaguagcaauaauacaaauaccuaguguauacugaguuuuguauacacuaacuucauuugcucagagaagccuucccaaacuguucccuuaccacauccuuuuauaaacugucuuagccugcacacggcuguacgugguugauuuguaucaagucuuccccgcuagacgguaaguuccugauagcagaggcuguacccuuuuuuucucugcaacuagcaugguuccuggcacacuaaauauuucgaauaaacaaaugagugaauaaucccugaucucacaaguaaucgaggaaauuauaauaauuucuuugcuacugacggggacauugaguccagggauauuaaggugacuaagaucacacagcugguagguagugaagccaggauucccauccacuuauuugggauuucaaaguuagcacaaguaauuacuuuuuaaugauaaaauauuuguaaagcaccuaguagagacuucuuuacaaaaauauuuguaaagcacacguggagacuucauguauucugauucaggagcuggagagcuuguuuaaaagguaaaccccuuaagucacuauuguauuugaagcauuccaguggcuucccaucacauuaagaauaaaaucucgucagacccuugagcagaccuugccuauguuucugaccucaucuucugccccucuccaccucuuucauacuguucuagcuaaacaggccucuuguucuucaaccuggagugugaguucaucaaucugaaauacucuucacugagauugucacaugaugaguuucuuuacuucauucaguuuuuuacucaaaugucaucuguccacuguaacugaaaugugccucacuuccaauauucucucuucucuucuuaacagugccuaccacuguguuguuuauugucucuuucccacguagacaggaaccuugugugucuuaccucuguaaccccuaccaugugucagccacauaauagacaccuaauaaguaugugugaauaugggaaugaaugaauacccaagaggaugaaguguacccucugaucauacguacauguaaacaggcgaaugcuggauaauuagcauucaugagugguuuuuuggcuuucaccaaaaaaguguuuagcucaguuuuguuuucuugugcccagggcugaaaaggaguagcuuaaugaaaggcuugacaagaaacaggugucggaagaggguagaaaagaaggaagagcgauucaaaaaagccagaaugccuaggcaggauggauuuuuauuauaacuauucacacaacaaaugcuuaauaagugguuaccauauauacauuguuguaggccccagggauauagcagugaacaaggcagagucuagcccugguggagcuuacauuucggaucaauauugugaaaucugcccugguuccuaacgcagagcaccuaaauuccuuguaauuuccugggugacgggaucaucuuuuguucuaauaaggcaauuauuggugggcuccuggauggggccuggucaccagaaacaccaagccaagauuagaagccuggaacuuucagccccaccucacccccauccuucagggaggagaagaggaauuggacauggaguuaauaauccaucaugccuacgugguggggucuccauaaagaucccugaaguugaggguuuggagauuuucuggguugccgacaacauccacaugccaggagaguuaccccaacuccaugaggacagcccugcacuugggacccuuccagauuacuucuuuaucuggcuauuuauuuguauccuuuaaaauguauuuguaauaaaucagcaaugguaacuaaacucuuuccccauaucugugagacacuagcaaaucaucaaacugggcggggggaucgugguagccuuugauuuauagacagucagaagugcaggugacaacuugaacuugugauuggcaucuaaagucgggguagggacaguauuaugggacugagcccuuaaccuuugggaucugaggccauauccaaauaggugguaucagaauugaguuuaauuguaagacaccuggcugcuaucagagaauugguugguguggggaaaaucccauacauuuuguccgaaguguucuggaaguauugaguguugugagugaaaguauagaaaaaacacuugucuggccaggcgcgguggcucacgccuguaaucccagcacuuugggaggcugaagcaggcggaucaugaggucaggagaucgagaccauccuggcuaacacagugaaacccugucuccacuaaaaauacaaaaaaguugccgggcaugguggcaggugccuguagucccagcuacucgggaggcugaggcaggagaauggcgugaacccaggaggcagagcuugcagugagccaagauagcgccacugcacuccagccugggcgacagagcaagacuccgucucaaaaaaaaacaaaacaaaacaaaaccacuuguacuugucuuuccaguacagauauguaaaaacuuaaaagaagaaagacccuaggaaagaagagagacccugguaaacacauuuuuuacugcuuuuucgggggaaacaauuuucaaagcccuggauaaggagugauuugucacuuuucucccuguccccaacucucugaggugcuuuuugaauauaaccuaaucucuuggugccucacuuuccucaucuucaaaaguaaaaauacuaacucauagaguuuuucugaggauuaaaaaguuauggaaacugcuuagcacagugccuggcacacaguaagcacuuaagcaguuuuuacuuuaaaaauuaaauucagagggccagguguguuggcuuacgccuguaaacucagcccuuugggagaucgaggcaggagaaucacuugagcucagcaguuggagaacagccugggcaacacagggagaccucuuaacaaaaauaaaauaaaauuagcugggaauuggcgcuugcuuguaguccuagcuacuugggaggcuaagggggaggauugcuugagcccaggagaauugaggcugcagugagcugugauugugccacugcagcccagucugggcaacagagcaagacccugucucaaaaaauaaauuaauaaaauaaauucagcaggauuguuuuugucuucuuuuuuucuuuucucuuccuauuuucuuccaaaugugcuguccuguuaaauuauucagauuuggcauuugaagaaugggaaagaguggugcagucuacacagugaaggaaaaaacaagaacgggaaggagugggacauggaauaugauguaugugaaaaugucauucgagggccagggagggucuuaugucuggauuuucauacuggggauaaaguuugauguaucccuuagugaauaagccccaaaacacuuauuucuguuaaauugaacauuuuauaaagaauuauguagucuuuguucugaacuuuaaaaaaaaaaugcuugucuucucaguucuuaagucuuuaaauucugccgcaacuuagcaggcuuucccauuguuagaaauuaaucuaacacacuuuuuuuuuucucuuuuguauggccucccuaaguuauuauuaagauucagauguuaauauuuguauguggcuugcauaaacaguuuaauaauuuuauauaaucuucuuuuucuuuguacaugucauauuuagaugggcguuuauuugauguaguauuaauuacuugugacuuuuaaaauccugacuucagccaggcacaguugcucaugcuuucaauaccagcaguuuggguggcugagaugggcggaucauuugaguccaggaguuugggggcagcauggcaaaaccacgucucuacaaaaaauacaaaaauuagccagcccugguggugugcacccauagucccagcuacuccagaggcugagguggaagguuugcuucaguccaggagguggagguugcagugagugaagauugcgccacuacacuccagccugggcaacagagugagaccccgucucaaaaacaaacaaacaacaaaccaaaaacccaacuuccuaugucauuaucuuugauuuaaaaaacaaaaaucauuacagugcgguauuacugaauauacuuuuauauguagaauugugaaccaugugucuuucagaguugaaaauuaauugaauuuuuuguuuuuuauuaggucgacaaagaugcugaauuaguggcccaauggaacuauuguacucuaagucaggaaauauuaagacgaccaauaguugccugugaacuuggcagguaugguuuuuacacuuaaucaagaugaguuuguuaagugauuuugagaauuuugauguguaaaugcaguuuuccauucaucaagcguggauuaucccaagcaaauuugugaggcauaggcugucguucccugucucugaacauaguucuguacucuucuagucaguuugguuuauuuaauccaugguuugaaaacugaggggcugggcugagcgcaguggcucacaccuguaaucccaccacuuugggaggcugaggaggaagggucacuuaagucuaggaguucaagaccagucugggcaauguggugaaaccccaccucuacaaaaaaauuaaauuagccaggcaccugguggcuggcaugauccuguagucccagcuguucaggaggcugaggcaggaggauccugugagucugggagguugaagcuguaguaagcuauaauuccaccacugcaccccagccugugcaaaaaaaauagcaaacucaggggccaauagaagcuaaauuauaagcauaaacacaugaaggagccaugugaggaacaggagagaauggcagggaauggagaauacuggaggguccaugugcuguccaaagcgggagcugccacucaguuccagccaguuuuuacagcucaaugguguuggccuagugauuccacaccuucugguuuuaauuuuuuuaaaaaaagaagaaauacguacuuauacguuaaauuucccaauuaaaaaaagccuuguucagguuacauucagccuucugacugccaguuugccaccuuugauuuaaacuaauuucuggcuggacccauuggcucaugccugugaucccagcacuuugggaggcugagguggguggaucaccugaggucaggaguuugagaccagccuggccaauauggugaaacccugucucuacuaaaaauaugaaaauuagccaggcaugguggcaggcgccuguaaucccagcugcucgggaggcugaggcaggagaauugcuugaauccgggaggcggagguugcagugagcugagauugcaccauugcacuccagccggggugacaagagugaaacucucucucaaauaaauaaauaaauaauuuccuucuuuguaugcucuggaaauaguugaaacaggguuaaauuuacuuuuuaauaauucaggguauuucucuuaucaaauguaaacgacuuuuggauuguguucaguuuauucuuccuucuuugguuauuugaaagucgcuuguugacauaauauucuaauacuuacuauugcagacuuuauaacaaagaugccgucauugaauuucucuuggacaaaucugcagaaaaggcucuugggaaggcagcaucucacauuaaaagcauuaagguaacacgagugauucugaagugcugugagggucugaacaguggcugagguuuauuuuauagaauuuauacgccuuaaagacugaacucagaaauuugggauuccauucccacauggccaucuaauacagguaugaucuugagaggucacuuaaaucucaagccacgaguuccaccaugcauacuuccuacauuauaaaucuguuguaauuucaccuguguguugugcuuugaaaauuuugauguucucuauuaauguuaggaggcauuauuuuuguaauuaagauucaccuacuuggauuuuggauuuggaagauacuuuugugaauuagauaauuuuauggaucacuguuaaaucacguggcuaccaucuggugauuagagguucugauuggcaguuaaaguucuuucauaaaaguugaaaaaacaaguuuuuuuaauaagggaaauuucuugagaggacacaacuuuuuaaauauggucaguggggaaaaaaacuuggaaagguaaugaagaauuugagaaccaucaggcuagucaaacccuucaucucacuguaaaugacucacuugaggccccauggcuagcgaaguacuuaaaccagaaccagauccccuaacucccagucuaaggcucuagguuuugccuucuuuuucuuucuuucuuucguauuauuaggcuuuuuguucaaaugcuugggguugauuauaggauauguucauuucaggcaaauucauaauucugaaauguagcuaaugauagugcucuagaaauuauucugauuuuaguggucuuuuaccuuguggaagagaauuuauuccugaaaaaccugugguaguaugaaucaucuuacaucaaaaaugugauaaacgauucuuuaguaguucauaaugcuaugauuggguuuccaugugcacauguaagaugugccucucucaagccuuguugugacaucagcacauuacccaucugaugagaaaaaaaaacaguuauugaaauuaauucauacaguucuauacuuaaaauacuuguaauauucaguuuuaugugguugaauauuuaauggaaaaaaacuccaagaaauuagaacaguaaagaaaaaaagcauacaaauaaaacaaugcuaauacauaagauugucauuaccgucaauugauaguccacaaauacucggagcagagaacucagugagacgugcucauucucgaccaggaagcugaucguaugaauggugauuugccuuucaagacacucaccugcucucuagaguauugaagucaaaauggucucauuaaauaugaagaaaugccucgaaugcaaaaguagaguuacuguaucaaauuccuuauaaaguugggaauucuugaaaaccugaauagcugugucuuggagugugacaguauuuucuggcuaauauucugccuuagcucguuagaccguggccucagauuuuacugucuauucaaugauuuuauauauauauuuuuuuguuuuugcuuuuuucaacgauuaaauaaauguagauagucaguaacaugaagcagccucagagaggauucaucacagggagaaagcauucccuucuggguggaacucaugcagagcuuucuguuaguggaguaauuuuuuauguaagaggguacuuuuccuuaaguuaaaaagauguggauaguagaaauaacugauuuacuugcuagucagugaauugaaaaaaaucuuguuuucuguuuucuuuuuuuuuuuuuugagacggaguuuugcucuuguuguccaggcuggagugcaguggcacgaucucagcucacugcaaccuccuccucccggguucaagcgauucuccugccucagccucccgaguagcugggauuacaggcauguuccaccacacccagcuaauuuuguauuuuuaguagagacgggguuucuccauguuggucaggcuggucuugaacuccugaccucaggugauccgccugccucggccucccaaagugcugggauuacaggcaugagccaccacacccggccuuguuuucuguuuucuauauaugguuuaauauuauauccauguuucuuauggaccagaggaaaguaacugugagggagagguuuugaugggaagggcuggaauaacaauuuguugacuuacgugguuaaggcaaaggaugaucuguuuaucaaaugaauuguuaaaauauuaaugguuuuucccagaaugugacagagcugaagcuuucugauaauccugccugggaaggggauaaaggaaacacuaaaggugacaagcacgaugaccuccagcgggcgcguuucaucugccccguugugggccuggagaugaacggccgacacagguuagugacggaccugggacagaugaugugggaggcuggaggaauacugccgguuuugguggcaguggugccggagcuuagcagucauguggcuugcuuucugguguccuuggguuugguggcgccuuggaggaaauggugcuuggucaugagcacguucauuuccgucagccauugcuacgggacuuccagcgagauccagccuggucugcggccuuccguucuugagguggggaaacaaaaccugaagugaagugggauucugaaaaguucucaugugacgcuuaugaaaccugaguuuaguucuuagaucaucuuuuccugugggacagaaagcaaagagcaaauguuuccuaucaagcaaaucccauuuccuuccuguuacuaauuuuuaauuuuuauuauguuuuauaguuuuauuuuuauccuuuuuuuuuaaguagaaauaaggucucacuuuguugcccaggcuggucuugaauuccuggccucaagcgauccuccugccucagcaucccaaagugcugggauuguaggcguaagccaccacgcccggccacuaauuuuuauuuuuguagagauagggucucccuauguugcccaggcuggauucaaauuccuggccuuuaacgauccucccaaagcgcugggauaacaugugggagccacugcaccugauuacaaaugccaaaaguuaugcaguaacaggcagaguuauagaaccugugguuaaucagucaaccaaaggcucaaaaacaugguaauuugccuugaauuuguagcuaacagauucucuggcuguagcacugggaaucuuaugguugagauguguguagcaaauguaagcaaccuguauauuuuccucuuuaaaaaauacggacgguugaauggguuaguacaugcuuuuucauaggaugucucacuaagcaaaagcguuaagcccuuucccccacuuuugagaaguacagucauaccucggagauauuguggguucuauuccagacuaccacaauaaaacaaauauuacuggaaagcaagucacacaaaauuuugguuucuuaguacauauaaaaguugccuuuagcagcucacaguggcucccaccuauaaucccagcacuuugggaggccgagacaggaggauugcuagaggcuaggaguuagagaccagccuggguaacauagugagacccugucuuuacgaaacaaaauuuuuuuuuaauuagccagccaugguggcauguaccuauagaccucgcuacuugggaggcugaggcaggaggauugcuugagcccaggaauucaaggcugcagugagguaugaucaugccacugcagagccugggugacagagugggacccugucucaaaaaagaaaguuauguuuauacuauagucuagucuuuuaagugugcaauagcauuaugucuaaaaacaaaguaccuaucuuaauuaaaaauuauugcuaaagaaugcuagcaaucaccugaaccuucagcgagucaucaucuuuuugcugguggagccuugauguugccuugaugucgauggcugcuaacugaucaggauggugguugcugaagguucggguggcuguagcaguguauuacaguaagacagcaauagaauuugcugcauugauugacucuuucaugaaagauuucucuguauguagcaugugaugcuguuuaauagcauuuuacccacaguagaccuucuuucaaaauuggaaucaguugucuuaaacccugcaacugcuuuaucaauuaagcuuauguaauauuucaaaucuaucauaacaauauucacagcaucuucaccaugggcagauucugucucaagaaaccacuuucuuugcucauccauaagaagcaacucuucauccauuuggguuuuaucgugagauugcaguaauucagucaucuucaggcuccacuuuucucauucucuugccauucuaccacauuugcguuacuuccuccacuaaagcauugaaccccuccaagucguccaugagggguggaaucagcuucuuccaaacuccuauuaauguugauauucugcccuccucucaugaaucacagauuuuuuuuguuuguuuuuuguuuuuuuguuuuuuugagacggaguccagcucuguugccccgucuggagugcaguggcacaaucucggcucacugcaacccccaccuccuggguucaaguaauucugcugccucagcgucccgaguagcugggauuacaggugcccgccaccgugcccagcuaauguuuauauuuuuaguagagacaggguuuaccauauuggccgggcuggucucaaacuccugaccucagaugaucugccugccucagccucccaaagugcugggauuacaggugugagccaccacagcgggccaaaucacagauguucuuaaugacaucuagaauggugaauucuuuccagaagguuuucaauuuacuuugcccagauccaucagaggaauggcagaggaagccuauggcagcuauagccuuaugaaauguauuuuuaaauaagacuuuaaagucaaaguuccaccuugauccaugggcugcagaaugguuguuguguuagcagccaugaaaacaacuuuaaucuuguacaucuccaucagagcucuugcgugaccuaggugcauuaucaaugagcggugauauuuugaaaggaaucuuuuuuuuuuuuuuuuuugagcaguaagucucaacgcugggcuuaaaauauuccguaagccauguuauagacagaugugcucucauucaggcuugguucuuccauuucgagaguacaggcagaguagacuuaccaucauucuuaagaacccuaggguuuccaaacgguaaaugaacauuggcccaacugaaagucaccaggcacguuagaccuuagugagagucggccuguccugaugcuuugaauccaggcauuacuucuccuuuuuagcaguagaaguccuggauagcaucuucuuucaacacagggcuauuuuaucuacacuaaaaaucuguugucuaguguacccaucuuuauuaaugauuuuagcuagauuuucuggagaacuuaaugcagcuucuccaucagcacuugcugcuucaccuugcacuuuuauguuauggagacgccuucuuucccuaaaccucaugaaccaacuucuuccaguuuccaccucuuccucugcagcuuucuugccucugucagccuucauagaauugaagagaguuagggccuugcucuggguuaggcuuuggcuuaaggaucugucacuguggcuaguuugaucuucuguccaggccacuaaaacuuucuucauaucagcaauacgguuguuucacuuucuuaccauucaucuguuuauagaguggcacuuuuaauuuccuucaagaacuuuuccuuugcauccacagccuggcuaaguguuugauuugagaggcuggauuuuggccuguuuuggcuuugggccugccuuccucccuaagcuuaaucauuucuagcuuuugauuuaaagugagagacaugcaauucuucuuuuacuuggacacuuaaaggccauuguaggguucucaauuggccuaauuucaauauuguugugucacagagaauagggagaacugagaaggagagagaugggggaauggccaguucauggagcagucaaaacacacacauuuauuaauugaguuuaccaucuuauaagaguguuguuccuggcaccccaaaacaauuacaaaaguaacaucaaacgucacugagcacagaucaccguaacagauguaguaaucaugaaaucauuugaaauauuugagaauuaccaaaaugugacacagagacaugacgugagcacaugcugcugggaagaugcugacacaccugccagaugcaggauugccgugaaccuucagucuaaaauaaucacaauaucugcaaagcgcaauaaaacaagguaugccuauauccuuaauagcugguaguccagacugcccucuggaaucuucuguuaaacacacaacauacugaaagguagcauuuuuuauuacuuucauucaggaaagggguggggcaaagcaucucgaguaaguaaaaaugguuucauugaacuuuaaacagcaguauuuaauccugagcauucuggcacauuggcgucuguuuauuuaacagguguacauggacacccucucagugugccaggccguguugcguguggcagacugugcgaggggaacuaacuguccuguucugaaauggaacaacgaggggcuucauggauuuggagagaaguacaguuuaggguccaaggaccuuuugcuuuuaaauauuacacucuucuucaaauaaucugaauuuaaaccgcuuagggcucucuuuuaaaccaccauuggggucaaguaagacauauucuggggaaccagacucauuuaccuaaccaugucccacuucuguauauguguguguauguguguguguuugcauauauauauacacacacauauacacacacguauguauauguuuguauuucaggugaaagucacauaaaauuggccauuuuaaaguguauguuucaguggcauuuaguacauucacaguguuguacggucaccaccucuaucugguuccagaacauuuuuaucaccccaaaaggaaaauccucugcccauuacauagguacuccccauugccagucuguuucugucucaauggauuuaccucuucuggauauuucauaugcauagaaucauacaauauguaaccuuucguguuuggcuucccacuugcuuuuaagaaaacuagcucaccccagaagaggaacuuagcagaaacgagcuccacaauggggucucgaguaggaguccccugcagccuguugcucugauuguggcuuccccuguuguuucuccuuugguuugcuggucagucucuucuccuuuuucucuuacccagugaauugagcuuugcuuauuuugacuuuguccaucuguuauugauaagagccuccacacuugaaauugaugauuggauuaguuuguguauggucaucccuugauaugugugggagauugguuccaagacccccuguggauaccaaaauccauggaugcucaggucucugauauaaaaugguacaguauuugcauauaaccuacacacauccuccuguauacuuuaaaucaacucaggauuacauaugauaccuaauacaauauaaaugcuguguaaauaguuguuauacuguauuguuuaaggaauaaugacaaaaaagucugugcauguucaauauaaaugcauucauuuuuccucccaaauauuuuugauccgguuugguugaauugauagaugcggaacgcauggauauagaggauauagagggccagcuguauuuaguaaaguuuguauaauaaagauuuaaauauauagaaaaauggaaauaaacuguuaguguaauaaaaacauugggccuuuguaaaaagaaaaauagcuuccuaauaauuuguaaguaucuauaaaauaggauuuuaaaaauucuaaacaacauucagugaauuuagugcaguguuaugaacuggauuuugguuaggccaaucugcgucugcuauaaucccugggaaauuagagaaaauuuguccuuuggcauuuuucaaggaaugccuaaagugaaauaugaaagugcuuuaugcugcucuccagccgcgguggaggcauuauucguuguuugauguuuaaugcucccucccccacaccacacacccauauccacgcuucuccacgccucugcauauagacguagaaaucgacacguauucuucccaaacucucauggggucacauuauauguauuuaauaaccucuuuuuuucuuucuguucuguccaccuuggacauauuuucacaaccuugaauacagauuuaccuucuuuuuaauagccguuuggguguuuauaauuuauuugaccauuucccuacugaggaacauguagguggccuccuuccuuuccuuuuuaccuugcuauacuacacaacuuccugagcacacauuuguacauuugcacacuugugggcauguuucuguaagaagaaacucuuaaaagucacacuuuacuugauacugccaaauuaucuuccuaaaguauuguacuguguuguauccaccugacaacaaaugugccuguauccucaguuuccaauuggauacuuucaaucucuuuuuuuuuuuuuuaaagcgacaagcgacagaaucugucccaguuaccuaggcuggagugcaguggcgcuaucauagcucaggccauccucccaccucagccucccuaguagcugggacugcagggacccaccaucacacuuggcuaaguuuuuaaaaagauuuuuuuuuagagauagguucucaguauguugcccaggcuaaucucagacuccuggccucaagugauccucccauuuugaccucccaaagcacuggaauuuacaagugugagccacugugcccagccccaaucuccugaauuacugcccgauagguaaaaaaugauguguccugguuucaaaaggcauuucuuuuagcauuugagguuaagaauccuuuggucuuuauauauuuuuuguacgaacugcauguuaguccucuuuggccauuuuucuauuauaguguugacuauugcuguauaagaccuuuuugaauauucauaaaauaagcucugaaucuuauauuuauugaaaauauuuccucccugaguuccuguucuuuugacuuuugauguuugugguuucaguuuugaucuuuuuuuuauuuuggauauaacugauuuauuucuuuuuuuccugccccuuuucuaugagaacguacugauuuuuuuaauagaguaaaauguaacuauuuuaaucuuugugguucuuggccuuuguaucaaccgaauaaaugugaauugaucaugugauuaauacaguccuucccccacuggguuauuucuccagguucugcuuccuucggugcugcggcuguguguuuucugagcgagccuugaaagagauaaaagcggaaguuugccacacggugaguuccugacauguaccauuuguuccuucucuguagcugaggaaaucagaugguuuaggguccuuucccuccauuuguucuuucugaaaucagcucucauaaguugcuuuucugcuuccauggcucuugguugcuggaagugcagaauccacuggccucuugucaccugaccacugccugccaguccaggucagaccacacgagggcuguuuccugaaugugcugcugccucaguuuccucuagcagaccugcuguccuggagggccugcucccccaugagcccccauuccauaguucuuacuucuuccgugacucccuggugcuaaaccuccuuccacauuccccaagcaccuuguuuucucacuccucccaucguaauguaauugcguauguaugugucugcuuccccaccggacuuaguuuuugaggguaggaaacaaggcuuguucaucucuuuauccgcagggcauauucucuccagagcacguagcgugcccucaguaaaugcucgcauggguggcgaguaacuagacaugagagcuagccucagcucacguggaggaaauacugaugcuuugcuuuaauggcgcugcugcugcugaagccagaaugugugugugucuuggguguacugcuggcccaucgaaagcgugcugcuucauuuaacgucauggaugccggcagcuucugacuguauuuuccuguaucaacccuguuuguauuucauuccccuccccacuguguuguugcucccuguugugaaagccagcagcuuucacugagugaugguuaggggccaucgucucuucuaggcacugaucugugggaaagcauacugaauaagauccaugaaggcccuugcccuccugcaucccacauucugauuggagagagagacccucaaguagaugagcaaggcagaaucgauugugaccgaugcuaggaaggaaacacaugaggccaugugauggagggagagaggcuggcguagugguggucggcagaggcauaucuggagguuugagcugagacccgaagggcacgagggagccagcugugcacagccugaguagcagccucuucggcagcaggaacagcaugugcaaaagcucagaagugacagaggacuuugcgaguucagugaacagaaagugugagaguggagggcuggugaggggaguagaugagauuaaagaguuaggcaggggucaucucaugcaaggccugggggccacacuggggcuuauggauguuauucgaagagcagcaggaagccagaaggcagcuguaagccggaugggaugugcauuaauuuuguucuaaaaauccuagacguggaggaggacuggguggcucccguuaccuaggcccggaggcaggcagaggugaguggggaagaggucagugggggcggugaguuauguccaguuuggggugacuaugaauaaagccuucauagaaugaggagucugucuuauuaagcuuucuuuuaagaaaagaaauucaaauaaaacauuugggaauugguugauauucagccagaaguauuuauuguggcucccguauuaagaugauggcauagauuccaagggaaaauaagauuuggaugacaugguuccugcacucacggagauugcaguccugcaggaaucauguuaugugagacaucacacucuauuuugcuuuuugaggccagguaccaaacagaugguaaagauauuggcacuaaggggccagagaacuuuuuuuugucuacugguaagaaauggcuuuauaaagggaggggcauuuguucugggccucaaaggaagagcaugguuauugguugcacucccggggauggagagauugcuggugguagcggugcugcucuggggaggcgcacagccagguacuggguaucucuguaaggcguugucuggcaggacagugacgcccauuuugcuguccuucagaccuucugcuugcuuucaggagaaagucucccuuuaaucuucguacguuuguaacacucucuuaacugccuaagaaaguagacuuuaagcucagagcuuuggcaggcaggaucuagcaaaacuguuugguauucucugcauuuuuaugguaacuugauauuuauggcaaagaguacuguuucucuauauuuagccuaggaauauaaaguuaacuguuagguugggcacaguggcucaugccuguaaucccagcacuuugggaggccaaggcggguggaucaccugaggucaggaguucaagaccagccuggccaacauaguaaaacccugucucuccuaaaaauacaaaaauuagcugggugugguggcacgcgccuguaauccuggcugcucgggaggcugaggcaggagaauugcuugaaccugggagcuggagguuacagugacccaagauugugccacugcauuccagccugggugacagagugagacuccaucucaaaaaaauaaauaaauaaauaaaaaauaaaguuagcaguuaaaauuaagcagaaacaauggguagauuuaaauaaaaauauuaagauauugacaguacaguuggcaggggaauggcugaaguuugcaaaacacuguuguaaguccugcugggacugugauugguuagugggggaaagaaaggcagcagcagugcucauggggcagaagcagccgggcagccauacugagaugaguggcaggugugaucgaggccugguccugucaggacuguggggugggguacaggagcagggagagaggccgaggugugagucggacuggauuggggaaaccuucgaaugccagaaggaggagcaggaguucuaguucuuaagaguucucagaaucauuuuaaugggucaccagguuugggggaccuacugaucuaaagcaauccaguuuuuucuuacgcccauaauaguacccaucuguuagaugggugcacaguuguccuuugcguugguuggccuaaaacaaucauacuaauaaccaugaugacacguaugcaguaaaaccucacugucugccgagcuucacagagaagcugauucuguugcauggaaauacagcguuacaagggaacucugagauuauaucguuggugcuugggaaguuuuacugaaagcuaguaagcuuucaacagucuguaccuugcacuucaagagaagggaaggaagcaggaggaaagaggaacagagccacgucaggauugcacaagggacaguagagaccaggugacgaacaggagcgagcguaggcuccucccggcuccucguggaggccaccuuggcuguugcgacuuucugcaguuaugacagggcacugguugaaauucaggaauaccucaggaaauugucuuaaagauacaucuguugccaacaaagaaugaacgagauaaugaauuauuuuuacuuuuauacuguacaucagaguugccuuugcagaacuguguugaauacucugugcuaguuuguuggggcugcuguaauuaaguacccaagccggaugacuuaccggaaagucauugucuuauaguucuggagacuaacguccaaaaucaaggugucaucaggguuaguuucuucugagggaaggaucugguccaggccucucauuggcuucuagacggccuucgcccuguucacaucaucuucccucuaucaugucugucuuuguguccacauuuucccuuauuaggacaccagucccgguacuggauuagggcccaacuuaauggccucaucuuaacuaauuacaucugcauugacuguguuucccaauaaggucacauuuugagguacuagggcuuggacuucaacauauggauuuugcaggggggcauaauucaacccauaauacacaauuuagaaaauaaaaucauagagcguggggccagacaugguggcucacgccuguaaucucaacacuuugggaggcugaggugguuggaucacuugaggucaggaguucgagaacagccuggccaacauaaugaaaccccgucucuacuaaaaauacaaaaauuagcugggcuugguggugcaugccuguaguccgaacuacuuaggagacugaggcaggagaauugcuugaaccugggagguggaaguugcagugagccaagaucacgccacugcacuccagccugggcgacagagcuagacucugucucaaaaaaaaaaagugccaauguagaguacuggaguugugauccguagcauuggacuugcuaccucuguggcuucauuuauguaggcuuuguagauaggugaaugggguguguggauguuuuaaaguuagaagucaaaaauauauauacucacacugucuaccugcuuuucauggaggggguggaguagaaagagaaaaaguuaaguuagggaaaaggagugucgucagaaguggucagugcagcugauucugguuuucaggcuuuggccuucuucagaguaucuuagguuucugccaucuuuauagucuuugugaauauuuagccucaaggaaucagauaagacacagcauaggcagccuuaaacuuucacauguucauuuuguucuuucacucuacccaucaacagacugagggucugauaaggagagagugagccuaggcuucuuguucucaugcucacggaagcugcugcuuucccuuggccucccuggccugucgcagcugccugucucagccucccugccucucggccucccugccucucaagccucccugccucucggccuccccaccucucugacucuuggccuuguuuuccauugcuguccccacucuccacugaagcccagucucaggcuuuuacauuccacaugcauuuaguguacuuuuauuauucugcuuuauccugcuguuacugaaaugauuuuuuuuuuuagauggagucuugcucuguugcccaggcuggggugcaguggugcaaucuuggcucacuauaaccucugccucccagguucaagugauucuccugccuuagccacccgaguagcugggacuacaggcgcccaccaccaugccugguuauuuuuuuuuuuuuuuuguauuuuuaguagaggcaggguuucaccauauuggccaggcuggucugaaacuccugaccucgugauccacccgccucagccuuccaaagugcugggauuacaggcaugagccaccacgccuggccauacugaaaugauuuguucaggacaugucuucauuauagcauuaagccuguugggggcagguguuuguuucaauuugugcuucuuugugugacguaaggucauguagcuaccugggacucaguagucacacugcagaguguagcugccugguccaaaucccagccccacuuucccagcuguguggucccaggaacaucccaucaucucccugugccucgauuuucucauccguuaaaagugucagccauucuucugagcacuuccccacccaggagcacccauguccuccuaacggugcuggugggcggaugcuuuuacagggcccccuucacgguaugugacuggguguaccacggguugacauuggaaugaagugaaggcaggcuuauguuuuaaguaacuugaaagauguaaucuuuuuuauuguuccuuuaaugggguuuacauucaguugcuauugaguuauaaaauaccggggacauaaucguggcuaaucugagcuuucugaaugaacagccugucagcauguagccagcuaucgccuuugggggcgccguguuugccuguagaaaugugugggaaggugguggugggcugucauggggcucuuguguucuuuuugaaagucuuaauauuuuccauaugugcuuuccuuggauuagauauccaaggggaagaaagauuuguuuaaacaaagguguuacuuuucugugguuccuugauguuugauuugugggaucugucuuccaaaucccuuuuccuucugucuagcaaugauguuuucccagggcuauuucacacagugacuugacuucauuucuaugcgugggaagcuuccauuuacugaggugcuuacacuuugcguuggaauuauguuucuuuaauuuccucuccucugguuccuguguucccaucuuuaaaucucuuguauguugugcuguuuaauugucacgcacuucaguuucauaugaugcuguaugaacucuuuuagagaaggaggauauauauaaaguucuccacaacagcagcggcagcagcaaagucguggacuuucuaagggaggagacccagaucugugaauagagauaaucauggccauucaugucucagaucugugcuguucagcaugguacaauuagccacaugugccuauuuaaagguaacuuaaggccgggugcgguggcucacgccugugaucccagcacuuugggaggccaaggcaggcggaucaccugaggucgggaguucgagaucagccugaccaacauggagacaccgcgucucuaguaaaaauacaaaaaaauuagccaggcgugguggugcaugccuguaauuccagcuagucggcaggcuaaggcaggagaauggcuugaaccugggaggcagagauugcggugagccgagaucgugccauugcacuccagccugggcaacaagaguaaaacuccgucucaaauaaauaaauaaauaaagguaacuuaauuuuuaaaaauuaaauaaaaauaaagauucacuuuuguagucgcuccagccauguuuccaaugcccaggagccccuguggcuguggugagcaguuagacagcucagcuguggaauguccaccaucacagaaggugcuaggagacgacaugucaagaccgcagacacuuggggcacccuuuuuaacaagcuguguuuucuacuccagaugagcucuguuuuacccagagaaauacacucuucauuauuuuucuaggaccgccagaauaggguuacauugcuugcagccaaugaggacuguuucagauaagcauauuuucauuuucacugggagucuguucuuucuuaguaucucauacacaguaguaucugggucuucaaaacaggcugugucguucuuauuccagcuugagccuggauccagguguuuggagaauuuggguuuucagcagcuuuuuacugaagcauuuggccuucuaagugcauugcuauaugucaccagugguagcuugaguuuuuuugucuugugauuucuuucccaaagcuauaaaaguggccuguaaucaauaguaaagucuugucaauagcauguuucugaauucauuuuaggaauaguuuguaucaaggaaucauuuucccacuucuuugguucaauguucucuuguuucaagucaaggaaacagaaugauaccaguaagaaagcaaacacucccuagcgguucagucucauauugaaaugacucugcuguugaaaaugccaguguggcucuauaggaacuucugccugccucagcacuugaagucugugccgccgcucuaagcagguaaccacaagcgggucugucgaggguucgaauuuguuggcaaacagagaaggcgacugaaugagccacggcaggucuccugguccguauacgcagaugucuucgacguagcggccugcagaaagaaacacaaaaaccuagcugccuuuguuuccucacccauuuuauucacacacagaaaguggcgcaugcuccguccggugucaguggugagccucagcuucaccagaguucacaucaaacagcauuuccaugauugccuugacaggggcuuuuauguugaauuuugaacuuacgguggaaaggcgcacuuucauucuuuuagugauuucugaaaucuuuguuaguuacugcuuuaggugaauaccaugggauuuaacucaccacgcgcacacgagagauaagcuagcgcucauuugccugcuaaaaucucaguuccgauagauucugaguuccaugaacuucuaagucuuuucauugguuguaaguaguucauaagaaugguauggauuuuaaauaagucauugcuucuauauuuuuuggggaccccagacaugcaccaccaugcccagcuaauuuuuguauuuuuuauagaaacgggauuucgccauguuggucaggcuggucucaaacuccagggcucaagugaucuucccaccucggccucccaaagugcugggauuacaggugugagccacugugccuggcacugcuuuuuauuuguuuuucagagugaacauuugauacaaacauugaggugggaauuacaggccaggcacgguggcucacaccuguaaucccagcacuuugggaggccgaggcgggagaaugacuugagcccagaagucugagaccagccugggcaauagagugagaucucgucuguaauuuaaaaaaaaauuuuuuuuaaagugggaauuagaguuggaauccaguggugacuggauuccuuggagacucagugacacuuuuuaugugcuuuugacaaccguguuuggcucuuucugcucuugcuuuuaauucucacaguaacacucugaaguggauuccaucaucauucccauuuugcaagggaggaaacagauuagcgaagugaggccucagcguaugugugagagggaaggaggucuguuuauuucagaaacguugcucuuucucugcccagcuccuuccugcucucuuuccucacaccagcccaguaauccuacuuuuaaaaaaacguaucuuggcugggcgcagugggugacaccuguaaucccagcacuuugggaggccgaggcggguggaucacgagggcaggagaucaagaccauccuggccaacauggugacaccucgucucuacuaaaaauacaaaaauuagcugggugugguggugcgugccuguaaucccagccacucaggaggcugaggcaggagaaucgcuugaaccagggagucagagguugcagugagccgagauugcaccacugcccuccagccuggugacaaagcaagacuccaucuccaaaaaaaaccuaucuuaaggaaauacuguuuuuaaaaggggcagggggauguaugcacaaaauguccaguguuguuucuaagacuauguaaguggcagcuguuaccaugauuuaacaaauuuuaccugauagacauauuugcuacaaugugcuagaaucucaguagaguuacauuuaacuacuuuaauauuauaaguaugggccagaugcagugguucaugucuguaaucucagcacuuugggaggccaaagugguaggaucacuucagcccaggaguugagggccagccugggcagcauagugagaccccauaucuacaaagauaaaaaauuagcuggguuugguggcuuacaccuguauucccagcuacuugggagacugaagugagaaaaucacuugagcccagaaaguggaggcugcagugagcuaugaucauaccaccugcacuccagccugggugacagagcgagacccugucucaaaaaaaaaaaaaaaagacuacaaauaugaagacuaucagugggagaaacuuaggacauaagugaaaagcaacucagcuacaccuugauuauaaugauacagcugugccauuuagacacagaugaaguugaacuagaagggaauacaaauaaauggaccauuuucagagcuguguuaaugauauuugagugauuaaaaauaaacccuuuguugcugguucuaaugggauagcuguucuucugcaugcagagucggacugggagcuugcccauuguagugguggcaggcgguugcucccagucugagccccagcccugccccuccucccugugccugugggagugacuucacuuaccugagccuuggguuccacaucaguaaagggugaauaaugauuguuucuaccugagaauuguugugaggauugagugcaggcccaaagcucggacccggaagauuuaccaccucccuacacaccagggcuuggccuacuuagggugcugacucugaaugcuggccauggauggccacgcuacugccuaacugugaguaccguuuucauacugaagcuagugauguuaagaacuuucugaaguauuuacuuuuagggaaugaggacuuuguuaggauuuauacuaacuaggguuuuuuucaaacauuguugaaacauucugauuucauugagaauucugaaucauuacuuuauuauugauaguaucaacccuuuaugacuucuuauaccaugugcacaccugaggggcuccuguuuucaggaagaaucugagcccccugcuuuuucugagcauuuacugacuaguccugacaaacccaaguguguaaugacagggagccccugcuuucuaaagaaagggcagagcucuuguuaaccuguuguuuaccugucaccuuucuaccaugugaauggaucccuaauugaaucauaucugcuuuugaaaaaaccccuucacuagaaaauuguuccagcucucuaaccuggucccucugcuucaggaggguggcugugcacauuggcagcaggauuuacuugucuuugaacuagucugguauuugauuuacauuuuuuguuugucuccaaucuguuuauuuuaggccagucuuuuaaacagcugaaaaacuggguaaaccuaguuuauuuuuaauaucuagucuacuguauucaaacccaaggucucuacccaaaaucacuguuaaaaucaguuauuguaucucugugcaguaguuccugccacuggguaggaagcuguguggagacauauggcagggccuagcuguuggugcagaggguauauuuacuuugggaaauuuuaucaaccuguauuuuuugugauuuguguacuuuucuguaugaaucuuauauaaaaaguuuuuuuaaaaaauugacucaaccuauacuaauuggaucaucacuaauuccagauuacuuuaaacaugauccuccgucuugcccacuaggauugaggcagcaguuuuauaguuguuguaaaauuugaagccuuuuuuguuuuguuuuguuuuucuuuuuaccuuuacauccaucaugaacauuuccuuccucacuuuuccgcuuaauggcucgaacauuuccuucccagccagcguuugguguagcaccuggagcaucuaagaggaaaacaaaaccagcauucaguguggaaucugcuucccaguucuuuuaguacaaguucuucugugcuaucauuuccauuuccucuagaugagguagucaaugagaaaaguagaggggaaaguccaaccuuccuugagauguuucacuuguaacaucggaucaaaggcuagugcuuuugggggugggagcauguacuacgcuggcaguagcauccagguggaccaagguuggggauccccaucuuuguacuuggguuucauuuuucagcccuuucuccaccccuuguuacucccuugcuguaugcagaguacucuuugugauucucuugggguucuuuggauuguuuucucuguaacagcccucggagauuauuugaaaaucaaacuugcaguggacaugaaauuauauuaaaaaaaccccaaccaaugucuacuggacucaucguacaccacugucuaggcugauuagcuuaguuguucaggcuugaagccacacucccuauagaagccaguccaccuuuuacaaagagaaaauacugaaguccacuuaaggaugguaucugauuucccucuaccucucagagaacccaucugaaguaucagauuugccacaaaaucauuacuagcuuuaacauuuuccaucuuacagagagcccuuagcacaaugccugacaccaguagguauccaguaguauuuauaaaauaaaugaagaacuuucuaaagauuuauacucagaauuuuccaaagucucaggagaugcaaaaugccaguacuucuuucuagagagggaacaaaagcagccagacugguuugggaacaucuuucagcuaacuucagaccccuaaaaucagagaacuuccuguuucccuaaguggaaggucuugcaaaauguagaacauuuacaaggccaaagaaacauagcugaauugaaaaaauguucaauuuuuucaauaaaucuuauggccgggcgugguggcucacaccuguaaucccagcacuuugggaggccgaggcaggcggaucaccugagaucgggaguuccagaccagccugacgaacauagacaaacacugucucuacuaaaaauacaaaaauuagcugggcaugguggugggcgccuguaaucccagcuacuggggaggcugaggugggagaaucgcgugaacccgggagguggagcuugcagugagccgagaucgcgccacugcacuccagccucggugaccgugugagacuccgucucaaaaucagucagucaaucaaucaaucaaucaaucuaucugcugcuguugcugcugacugcacaggcauccauaucggugggucuuucuuaccuuuuagucgguucagggucacccaguaguguugcucugggcugcggaugucuuuggaccacugaagcaugucuuuugcauggaugucagucaguaugaacucuacaaacuuccuuguaaguacauaguaagcacuuccaaaauaaaugguuaaguuauggggugguuugucuuugaaucuguuauuuggaggugcauagauacuuccuuuaggaacgaauucgagaugacuuugacuugucuuggauuuaaugugcaaugguuggauuacuccaggaguaauauuuuuaucacuccauuugcuucugauguaguguaugauuucucuguugguuuugaugggaaaauccuguccacaaagauugaugacauaguuccauugaaauuuagaaugcacuagaacuuucauacaauuaauaucugccuguagucuuguaaagccagcauaagccaccuucucugucuuggaggaaauaaaaacguuuucaaaacaguuaaccaagguuugcacagcagucuuauacuucauuggggccuuuucaucaacaugaauacaauaaacauuuugagguacauaaauagcucugagaagcugcacaaacauggccagcuccuuaugaauaguuauaauauaugccaaagagaaaucgcccucuucugcagacaggggucugguuaugaaaugcagcccccgagaaauccuggagcaguuuccugguguguguaaaugagcauguauuucagauuuaugagggguuuugcaaaauuuugcaauuuagggggccgccccuuucccuucaaauaaagcggaacacaguucaucuggguaaaagccacauucuacuacuucugguugggcagguucuucuucugauucugcaggaguuggauuccuuaaguaaagaaaaaugaagaugcaaaugacugcccucacgacaaguccagacuuuguggcucgaagcuggcucauaucuugagcuccaggugcauucuuauuaccauaauuuaaguauuuuuuccuuuaagcuuccuaaaagaacaacagauacaauuuaggguguuguaauucucccccccaacuuuauugaaauacacuaaacuacauauacacacccaugaaacugucauugcaaucaagauaacaagcauuucccucacucuucaaaguguucuuaugcuccuuuuuauccucuuucuuuccauccacaucucuggcaauugccgauacgccuucugucacucuaguuugucaguguguaacucuuuaagaaacugccaaacuguuuuccacagugguuguaccagcaauguaugauagccauuuauuauauagccucuggcauacuugcuguggucagauguuuuaauuuuuaccuuuuaaugaguguguaauguuaguucccuguaguuuuacuuugcauuucccuaaugacuaaugauguugagcauauuuucauguuauugcccuuauuagggagaugaaaaaucucaaauacuuacuuuggacauagacaccguccuguucugccuuauucaaaguucauugugugccauuauucugcauauaagacuaaucuuuccaacagaagaagugacaaauuaagaggaauuugaugauuauacacuuaaaccuguugaagugaguuucugggccaggcauaguggcucaugccugugaucucagcacuuugggaggccaaggcagaggaucacuugagcccagguguucaagacuagccugggcaacauaguaagacuguaucucuauaaaaaacuuaaaaauuagccacaugugguggugcccugauuaucccguugcacuccagccugggugacagagugagaccgugucucccaaaaaaaaaaaaaaguuucugaauuauuuuuaggaaagaugucauagauuaaaaacaagguaucuuuaucuaauaacauuauuugauaaucauguaguuguuugucuugagucuacagagguacaugaauagguguagcaauagcaaaaagugaccaaaagguuucaguuaauuaauuauuacacgcaaggaucauucucuggaauuuagggaagaagauugauagguaacaugucaagcuuuauauuguuagaaaguauuuguuuuucuuguuuaugaaucuugacuugguuuccauuaaaaguugcauguuauuccuacuuccuguuuuucagaagaccauguacgugugacugguauuugagcucagguuggacacuggucccuugccuuuccacaucauuuuuacaaaugcuguuuggauaaugccucaaacaggcagcauuuuuaguuauccuuguguucuuaaacucugagccaacaaaaacuguuaacauugacuguggauuuuaaagauguuguauuuauuuucaucguacaguuuauuucuacccaucaugcuuccaaaauaaauagcagccacugccgagguaugucaggccgcaguguguuccacugguucaguaaaugguuucugccccaaacauggaaccuuacagccuaauuuaaagacauucuuauaaauuauguaauacuuaucuuuuuuuuuuuuuuuuuuuugagacggagucuugcucuguaacucaggcuggagugcaauggugcgaucucggcucaccacaaucuccgccucccggguucaagcgauucuccugccucagccucccaggugcaugccaccaugcccggcuaauuuuuguauuuuuuuaguagagacaggguuucaccauaauggccaggcuggucucaaacuccugaccucgugauccacccgccuaggccucccaaagugcugggauuacaggcgugagccaccacgccuggcaauacuuauguuuauaaacaugaaaccaucauaauuuauacauuuuauaugagauuucuaaauuaaauuaaaccugaccauagaaauugaauaggaaagaaaaauguucuugaaaugaaaguaaagcuuuuuacuacuucuccuauaagaauuuugauuaaagauaaaccagauaccauaguuugucauaucuuccccuguauuaugacuuuaguauaggaagaaggguuuggguuuuguuuuuuuuuuucuguuguccuuuuauuuuguuuuuugagacagggucucacucugucacccaggcuggagugaaguggcgcagucucagcucacugcaaccucugccuccccgguugaagcgauucuccugccucagccuccugaguagcugggauuacaggcaugugccaccacgcuagcuaauuucuguauuuuuaguagagaugggauuucaccauguuggccaggcuggucuugaacuccugaccucaugugauccacccuccuuggccucucaaagugcugggaauuuuuaggugugaaccacugcgcccggccuauuuguuuuuuugguuuucuguuguuuuuuuuuuaggaggaguuucgcucuuguugucaaggcuggagugcaauggcgugaucuuggcucacugcaaccuccaccuccuggguucgagcgauucucuggccucagccucccaaguagcugggauuacaggcaugcaccaccacacucagcuaauuuuguauuuuugguagagaugggguuucaccauguuggucagccuggucucgaacuccugaccucaggugauccaccugccucagccucccaaaguguugggauuacaggcgugagccaccucgcccagcuaguuuguuguuuuuaagauaacuugugaaagcguucuguuccuccugucacagaagugaguuagccccucaucacugccaaaugauaccccauguaaauuuggcugugcgccgagcccaggagauuggguauuuucaguaguuuauaauaauuaaaugaagagaggccccaaggguagccauuguccuuugggaaaauacccaggcuaagaguuuuucccuccccuguauagagacagggacauggccaguucaguguuaaccugcuguggccuucuaccuugguuccaucagcaccagcuuucacuguggcccaguuaaaucuucccucuggcuuagauucacugugaaacuucagaauggaugccugcuggacugcccugcugagugggaaccaagguccccagcaguuuaguuugucauuguuucaacauaaacuuuuuuuugagacaaggccucacucuuaucacucaggcuggagugcaguggugugaucauggcucacugcugccucaaccuccugggauuuggugauccucccacuucagccuccccagcagcugggacuacaggcaucuggcugauuuuuuguagagacaagguuuugccacacaagcuuuuuuuuuuaaaaaaaaucuuuuaaaaauugauacauaauaauuauauauguuuauggaucacagaguaauguuucaauacacacaauguaucagcacaagcuuuuuaaggcagucaggcccucuauuguaaauguagccuuuggagaucucacugcuguugcugucacuugaacauaacaucuaguggguaauaugaaaauuccuggaggaauaaacuuuucauggccugacuuuuuuuuuuuccuuuuaagauaauggugaacauuauuuucaguuuugcaaacauuuccuagcaauucuuaguuuuuguuguggcuguuuuauuucuauauugugaagucagcuauuuuaaugaaaaaauaaugaagguuuaguuacuaaacaugagauuuucugucacuaaauuaauuuccaguaaauguaggugcuauuuuguaagugcggggaauaugccucucauaaaaaaguguucuuacugaguuuuugaaccauuuuuuccuccauagaaagauguuuaagauacuucuuguaaaggcuguagaaagaguggcuguuacccuguguauuauguauggaguagguaugcaaguucuuugucuggaacagaccuauuuuuaacauuccaguguccuauuuuccuuguguauuacuagaucacaaacaguuucuaaaauuuggggguuagccugggcgauguagugagaccccuucucuaccaaaaaauaaaaaaauaauuagccaaguauuaggggucccaaaauuagccaaaccuguggucucagcuacucaggaggcugaggugggaggaucauuugagccagggagguugaggcuguagugagccgugaucaugcccacugcacuccagccugggcaacagagugagugagacccuaucuccaaaauaaaauaaauuuggggguuugugugugagagcauuucaaggcuuuuuucgugcacugucuuuccuuaaauugucuuuccuagaccugguauauuuuaauaaucuuuuagcccuccauaucugcagccuuugaaagguagcauuguuaaauauguauauaguguacaguggaacaaaacagcuuccaagccaugaauaauguuaaaaguuaaccauucaguugacugaagccaucuagcauccaagagauacaguagaguaucuuucaguggaaaucauugucaaacuuauggucaaggauggugguuaacuuuuuucccguuuauguagugccagaaucugcacaagaacaggaaugauuuccaguuauaauucucagaguggaauuauuuuacauuuuauguuuuuguccaggguuaaaguacuuccagggaguuguuucaaaacacauugcucuucuaauuagagccagugccuguguucuuuuuuucuuguaauucuucuacagucuuccucucccgacucccaacaagccuucacagccaguagcaaaagucagcaauauggguuugauaucgcauuaccuccagaacaguucguugaaggauauagucuuugagaauuuguuaggaugggauuucauuugugguaaagacuuuuuagggugaguuggcagcaucccauauauacucuuucguugcauuuuuuauauguauauauuuuaaaggaaauuccuaugaguaaauagauaauggaugggaaccuuuaaaggugaacccgaaguauuuugccauauauucuagcauauuaccauuuuaaagcauuaacauuaauuuaaccagcauaagcaguugauuuagcacccaaaguuucugagagcuuuacuuuucaaaaaggguggggguugagggaggcucaauauugcauuuaccuuauuaggaaccucauauuuagcuucaggaaaugggcuuugaaucagggccccaguguuaggcucacagcccuagcacuuacgagucuguugggcaagugacggaagcuccugaguguccauuuucuugacugcggaugugguguaugguagugucugccucacagggacacugggaggaggugugggagugaaggaugugaguuucacacugagccuggcccuaggaggugcccugugcucacuggcacucacccucgggguaaugcggccccaaaacuguaacugcaggugcugucuucacuuguccuaaagucucuguagccacacauugaaaauguggugucucuuucucucugagcucagaaugcuguccaaagcagccucaauguuagcacaauguuuucuugaguuacuugagaugaguuggacaaauuuugaauucaaaagcugucuaacuguccagugaaauggaugccuuucacaaaaugccuauuccuaaaacauguauaaauuauuuuagccauuuugauggaaagaagaaaacuuuauuuuaggauauccacucaaaacaacgacaagaaauaaaacauucuaguuuacaaaaugagagcugaggauuugcacguggccuugaaucugccucucaugugagggguuaacaaaugguagcauuuuauauuuaaaaaucuaguugaugccauacugggaaaauauucuacuuuuauuuucuuuggcuuaaacaaaaagugggggcuauuuuugagagaaaaagacaccugcaacaccgacauuucaaauauuacucauauucuaauauuuuaaaaccacagagcaaagaaaaacauaauuuacuucaaaaaguauaccuguggccaggugugguggcucacaccuguaauccuagcacuuugagaggcugagguggguggaucacuugaggucaggaguuugagaccagucuggcccaacccaacauggugaaacacugucucuaccaacaauaaaaaauuagcugggcauagugaugugugccuguaaucccagcuacucuggagccugaggcaggagaaucgcuugaaaucaggaggcagagguugcagugagcugagauugcacugccacacuccagccugggugacaaagugagacccugacacacacacacacgcacacacacgcacaugcacauauaccugcuuaaccuuugccauugguggguccugcauagcuauugagacgcuuaccaggagaagcccccugguuccuggagggggaguccuggcggugucagggcccagccuggccuuucucucccaucgguuccuccccggcagcggcgccugcuucagucacuugaguagaguugcuuggcagguuuuguugccaucugucccuggagaguuuuauuccuguugguucugaccugcagauugaaaaguugcugcuuuugcuucucugaguauuuccuugggaccagauccuuccugaaaaacaaaaugagacaacagaagacgccugacccagaugaagggcgcacagucacucacauugagaaaacugcaggaugaaaucguggcauucaugggucagcgucuugaaauuauuuuaaauacaggaggcaugauuuaguuaucagacccucucucauuaaggagauaaauaaaagucacuuaaaaauccuguuucuccauaaauagcauucaaaaaaauccagacauuuuacaaggcaggggcugagccuucucugugcucugugucgcccccaagggugagucugcgccauagcauguggugaagguggggucugacugcaccccuucgcuaggcuuuccucuucccuucuuucuccaccucuggguacuuuucuuaacauccuuuccuuuucugguuuuaaagguucucugcuugcugguacucucugcaggcuugccacagacagcucuauuaagaauaucggcaccaagagacauagaucacacaccguagagauuucuuaucuucuaugugccuugacgccuaagcgggauguguggucagaugaauacagauucucuucaccugcucauggggugccucugagacacaugcugcuuuuuugcagaacagauguugcuguugccaaagcacagaguauuagaaaaacacugagcagacagaauguaguccccauaaucuucagggguuguggcauucauguggccuuccaguggggagaccccauacauuuuguuugugugauguucagaguccgugaguuaagguucugauuugaucuagcaagaaucagaaaagguuagguccuuuuaugugugggagagucacauugccagcuugugaggucuugcugugccucucuuccccugcaucuugaaugcuuguuuugaaacauguccuugcugggugcaguggcucauaucuguaaucccagcacuuugagaggcugaggugggaagauugcuugaggcuuggaguuugagaccagccuggaaacauagcaagaccccgucucuacaaaaaauucuuaaaaauuagccggauaugguggugcgcaccuguaguccuagcuacuuaggaggcuaaggugggaggauugcucgaguccaggaauuugagguuacagugagcuaggaucaugccacugcacugcagucugggcaacagagugagaugccaucucauaauaauaauaauaauaauaauaauaauauuugcccugugggugcaccuggacuagacggcagaucugcucacacuggcccauuccugggggucgaggguuggugcuggguuucacuucuugucucacauucuacaucuggaaggaggaagccauucuaagccaaauagcaguggaagaagcaacugaggaaaugcuggggaguguugcccacauuaaacguuacacuuccacauugcugcgggaaaugccaacacaagaagcaaacauacuagacgagcugagccacccauuucuauugguaauaaauggacaaaggguaaaucggcuuuauguauaaaccucuuauacagauugacuaaaacauuuaaaaaaugaaaucccuaauaaauaaaaggacauacgauauaauuuacaaaacaggugucgugaauacagugggguuuuuuuauguuucuuaauccaagccaaaaaggagcuaucucccuugccauucagauuagcauaaguuuuccuucaaaacauacgacgugaugggcaccgucacguauggggauguauauuuucaugcaagcuuuugggagaacugcuuggcuuuaaaaucucaucuccuuuuauacuacuuugaaauauuuccuuaggcucuguucuuauucauucauucagcaguuauucacuguguccaaugugggcagaacccuaggcuccucccgccauggaacaugaagacaaaaugcuuccugcuuggggcuaacaguguaguggaggaaacacacuguuucaaaagucaguacaaacaugcagacauacacucauuuacucuaagccaugggguacugcacaggaaacaaaaacaggauuccgugauaagagaaugaccaugucucggaaguggaauuccuaggucagagaugcaugcagucagcuguucauugcuaauauuauuguaagcacaaagauugggaagccacuguuccauuuguuaaagugauauaaauaucuagauacauuagcauauugcuccuaauuugaccacuguuccccucuuggcacuuccccuacuggccuuuuuaaaaauacuuuaaaaaagcauccagagggcauaugaauauaaauauacaauuacuaguuugcuuuuucguuuaacuuaugauaagcauuuucuacauugccccaaacucuaaccauauaaucuuccuuuuugggaauguauuauaauuuuuuuuuuugagagagagagucucgcucugucgcccaggcuggagugcaguggcacgaucucggcucacugcaagcuccgccucccagcuucacgccauucuccugccucagccucccgaucagcugagacuacaggcgcccaccaccaugcccgacuaauuuuuuguauuuuuaguagagacgggguuucaccauguuagccaggauggucucgaucucuugaccucgugauccgcccgccucggccuuccaaaguacugggauuacaggcgugagccaccgcgccuggccguauuaugauuuuuuuaaccauuucacccauucuuuggacaucugaguuucaagcgauaaaaaggaugaagauacaguuuuaaauggauguauaauuucuaccguacaauagcaguacucaagaaaaaugcauuagcaggaagauaugggugauuuucuguugguauaauacauauuauuuacuaaagagguggggagcaggucccuguggaccagcugugacuuugcggcagccccacuccccaucuccgcaguagccccuacccuuguuuucccucauccuucagggaugaaccacugcacucaggucucucgggucaagcaccuacccagaacgagugauggggccccuagcaguugggaggacucugcccagucuccaggggcaauuccuaccaagguucaagccauugaggcccuugaggguguggguuugguguuaauggaucuuuugaauuuucgagagaaagagcaagauuacucaauuucuaaugugagggguuccugacuucuuauugucaguggccaauucaacuuuaaaaguacaauaagucugggcacaacacaacacaacuguaugcagaauaagguccauguccucugaacagucugaucuagaggaaggagaccgcuuaccccaacacugucggaaggaggggcagcaaggagugauagaaagaagcagcagcagaaacccaggaggagagaaaaagaaaggugggggcagcacccacagggagcagacgcuggguuccuccccaccccugggcccuuuacgucauagccacagcuccaggccccacugggccuuaacuaccaccugguucuguuccugcagauucuuuuucauuccaaggaagagaccaucuuccagagccaagggaaagcucuacucagaccucccauagcgugagacuucccagggaaccuccucuagcagagcaggcugucccuccuccuguaggcccagcucucuacagugauggcuaaaaacaagcuccuuuucuucaaggguuguaccaguuaaaugcuagauugggcacgugcuucagucauucauauaacuucucuauggcaccacccucagggauuugugggucaaaaagguaucuucagucacgaaaauuuaccagacccacccuagaaaaaaagcugaucuuaaccugaaaaucacuguuggagacaagaaccacauuaaauaacccagcuaaggcaggggcugaggagagucagcaaaugcuuguugguaucuucugugcauuugggagauucuggaaaaucuuuggcaacuucaggaaaaaaaaaguacuuuuauggcuuuucuugugcugauaauguuuucuacaaaagagauuccgggcauaguaugucuguuauugcucugggcacaguaggucuguuaaaauuacuguuccaguuguugaaagaauuuuguuauuauuugguugccugccuuuauguuuuucaaaggcagugucuuauggaguaacuaaauauuuuaguuaauaacagaccuuaucuggcauacuuuuaaacaucuaugacuauaacauuuaauagaguuuuucauagauauuagaaagauaaauuuugguugauccacucaauaugugacucuuugaagucauguuaccuacacuaaucaagauaguguggugcuggcaugagaacgggcauauacaucaauggaauaaaauagggaguccggaaauaaacccucacauguauggucauugauuuuugacaaaagggccaagucaauucgaugggggaaagaauaguuuuuucaacaaauagugugggguaacuggauauccacaugcagaagaaugaauuuggacccuuaccuuacauugaauguaaaaauaaacucaaagugaucacagaccuaaaucuguaaguuuuaguuacaaaccacuuaggagaaacgcaggaguaaaucacaaucuuggguuaggcgaugacuuacuaaauaugacaccaaaaacguagcaguaagagagaaaauugcuaaguccaauuucaucaaaauaaaaaacuuuuguaauuauccaguguaagauauuuugucauaacagucuuggacuaagacagaacuuauauccagaauaugcuguauaaagaccucuuagaacgcaacaucaaagagacaaauaauacaauuaagaaauggaccagggauuuaagcagacauuucuccagagaagguauacagauggucaguuagcacgugaaaagaugcuuaacaucucuggucauuugggaaaugcaaauuaaaaccacaaugagacagcacuucacucccauuaggaugguuauaacuaaaaggaaaaaugggcugguugcaguggcucacaccuguaaucccagcacuuugggaggcagguggaucaccugaggucgggaguucaagaccagccuggccaacaugguugaaaugccaucucuacuaaaaauacaaaaauuagcugggcaugauggcgggggccuguaaucccagcuacccaggaggcugaagcaggagaaucgcuugaacccaggagguggagguugcagugagccgagaucaugccacuggacugcagccuggcgacaaagcgagaucccaucucaaaaaaaaaaaaaaaagaaaaacgaugacagguguugggaaggauguggagaaaugagaauccucaggcauugcugguggcaauguaaaauggugcagccucuuuggaaguucaucauuugaggagaggcaguuccuccaaagguuaaacauaaaguuaacuuauggccagucaucccaauccuagguaucuacccaacagaaaugaaaacaacuguccacaaaagacuuccaugugaauuucuuagucugaaaguggaaacaacucugucagcugauucauagaugaaacuuuauuuggcaauaagaagaaauguaguucugauccauacuauaacauggauaaaucuuuaaaacauuaugcuaaaauccagucacaaaaaaaaaaaacauguauauuguaugauuucauuuauagaaauguccagaagaggcaaauuuguaggauggaaaguagauuaaugguugccuaagacugaggaaaggggaauggagugagugccaguggguaugggauuucuguuggaagugauaaaaauaugcuaaaauuagauuauggugaugguugcacaacucuaaauauacuaaaagccauugaacucuauacuucauuauguuauguaaaugagauuucagaaaaccuguuuuuuaaaaaggcgaguuagguagcaaaugcacguggugcugaagcuguuccuuuuagagccggcucuuagcauucuguguccugagcauugugcugugagcuaagagauagaacaugauuucugcuucccccaccccuaaaaaaagguuugggagaucagaagauguaaaacagaaacccagaaugcucuucuaagaguuagcuacagaguaaauaaaaguuugaagagacuuccucaggcaggggaagacagaaguuucauagacaagaugauaauaguaagcucacugcuccauuuuuuauuuuuaaaaacuugccacccaacucauagggggcagagacuaugucuuaacacagggccuaccagcuucaggguaaaaucaaugaaaucuuuaaacugaggcuaggcaugguggcucacgccuguaaucccaacacuuugggagguugaggcggguggauuaccugagcccagaaguucaagaccagccugaacaacauggcaaaacccugucucuacaaaaaauacaaaaauuagccaggcaugguggcgcacaccuauagcccuagcuacucaggaggaugagguaggaggaugaggugggaggauggcuugagccugggagguggaggcugcacugagccaugauggcaccacugcacuccagccugggugacugagugagacccugucucaaagaaaaaaaguuuacaugacuaugaguauguuccauaaaugaauccuuugaauguuauauaugcuaugaauauuucacuuagccuuuggcuuauuguuuuuuguuguuguugugacauugucauguaaaaguuuguaauuuuuacaugguaaaacuuauuuuuuuaaaauaaguuuuuaaaguuuaaauaaaaauuauuuaaaauaaguuuuaaagcuuuagaucacagguccccaacccccauaccggugacaguccguggccucuuaggaaccgggccacacagcaggaggugagccacaggcgagagaacauuagugccagagcuccaucagcggcauuagauucucuuaggagcacaaacccuguugugaacugcgcacgugagggaucuagguugcgugcugcuuaugagacucuaaugccugaugaucugagguggaacaguuucaucccaaaaccuucccccaaccaucuauggaaagauugucuuccaugagacuggccccaggugcaaaaaagguugggaacuacuguuuuagaugacauuuccuacccuaguuauaaaacacauuuuccuauaaauuauucuucuuuccuuuuuuacauuuagguguuuauaacccuaguccagggcuucucaaccucagcacaggggcaucuuggcuggguaacucucugugggggggccauccuguguacuguaugaugcuugcugcaucccuggccucuacccacaagaugccaauagcaccugcaccccagaugugacagcuaaaaaugucuccagacaucgccgaauguccacuagggagcaggaucaaccacugcacuugcguuagaccccaagugguuagagagccacugcacuuggguuagaccccucuuuuuuuuuugagacggagucucgcucugucgcccaggcuggagugcaguggcacgaucucggcucaccauaaccccugccucucggguucaagcgauucucucaccucagccucccgaguagcugggacuacaggcauguaccaccacacccagcaccaccauacacaguuuuuguauuuuuagcagagacgggguuucaccauauuggucaggcuggucucgaacuccugaccucaaauggugauccgcccaccucgaccucccaaagugcugggaucauaggcauaagccaccgcgcccagucuuagaccccucauuuuugcagcugaggaaacugaggcccagagaagugguguggccugagccagguggccuagacagaugguggcagaaaucucaauucaaaaugcaggacugggaaccuccacuccucguucucuuuuuuucccuguuuuuccuguccccagccgugagcaccucugcugugcuaggcacuggguagcugcuggggccacagcagggaagaaaacaacauagacaaagugaugaagacaagacuccaggucaugauuagugccauggagccaacacagaaagagugcugggaucccaccagugacagcauggucacagggagccucugcagagguggcucacucacugacagcucugugagugugggcaugccuuugguguguaugugugcguuucuaccaccacaacacugucaggauggucuagacccugcucgcagucuuguucugccgggguguguugggcgcccccaaggcugccgucaugcuuggggguuuucugaaagacuugagacuuagcauaugguuguauucaacuaacauucacugcagcagcgugguauggaugcacagcuggguguuaagggaaaaggcgcauguagcagagucuggaggaauccacguggggcuuccuuacgcgcacucccucccucaagggguuguacgaagugaauacuuccccccgcaacgaaacugcaacacgugugauguuuuugcccagggaagcaaaugagagacucaguacccagaguuuuggcugagggcuggcuuuauacccucggcccagcauguuccagaauuccacacucccauaagcagguaggugucagcauagaccacguuguucauacaaaagggucuaggcacggugagccaagcuacucuugucaguuaaaaaauggcgggaacccucccaaaauccaaguucccagacaccauccaggcaccagccuugcaagugauagcacucuuaaccugcuacgcugacacuuugcugugugcgggaacuuuccaaaccaaggcuuugaccagaaagccgguaauaggaauuuacucggagccugggggccacugcuuggggcugagagugggggacugaagcguggccuccccauugacuggugauggaaucugcccucucuuguuugcccucuccaguguggggcugccuuccaggaggaugaugucaucaugcucaauggcaccaaggaggauguggacgugcugaagacaaggauggaggagagaaggcugagagcgaagcuggaaaagguaaugggagucuucagguuccgcccagcccccaucucugcuccagagccgacugcaaaucacugaacugagcuggcagcugcuuagggguuugcaugaucaaggcgauuuuuauaaccuagaagggccuggacuguagaagcagauuccagcugaggcccaggcacugccuugcuguggugagcacggcggcucugcucuuccccgccgagcuuucucaucagugaagugggguagugacagcaugcgagggcacggagcugucagcaggcuccagagaccauggccauaaagcacugacacugacacggccucagcaagcccuuggggaagggcagccaccaccguugcugcugcugucacuuacuguugcuguugauuuaaggcaguacauacucaggucucauagcuuguaaaacaaaggaaaaaugaaaagucaccaucaucccagcaaaauguaaggcuccccugcugcccagauuggaaugugcucgggagggcccuggcagucugggcuccagcaggccugggugggccugggugccugugcgucucacccacucccagggcguguggaugcaacuccucagggucacacuuugaauaacaaggagcuaaugaguagccuucccaaaaaugggggccaaaucccucaccuuccugagcccucccacggggagagggagggucuuuuauggagcguggugcuucaugcuucaucguucagaagggagcgugguauccagaaacagggaaagcauugcugaguaacguggcggagugagcaggcuccagacaacgcauccaccaagaguucuuccaugcgcuggugauuccccauccagcaguaaauguuguucauguuuacagaugauagcuauggaauacaggccuuucgugaguggcaaauuucuuauucuuuaaaaaaaaaaaaaguuggguucaggauaagcuagggagaaaacuuuaugugaucagaacuaaggcaaaagaaugcuugaaguacuagaaaauuagcuccaguaggcugaggacauaaaauuaugaaacaaaucgccugcccucgcgugggugugcauuuuaccagugccaguccgaggcgagagugauggaguaccugaagauuuuucagagguuugggguuuuuaaaaaaucauaacaagacaggaccguaucacccuggaauaauguguaauucgugguugugaggcuuuaaaaagccgaggcuugagcacaugguagcaguauuaccauuaugcauggauccagaaugaucagaaagagccaaaggcauuuguauuuucucccuucaucguuuuacuuagguagaaaauaaugucugaaaauggcucuguaguucaaggaacggugcccaaacucugaauucagaugcgaguagaaauacuccguggagcaauauuauaagauguuaauacaacauuccuaacaacuguuuaaagagucacuugguaggcgggcgugguggcgugugccuguaaugccagcuacuggggagacugaggcaggggaaucacuugaacccggaaggcggagguugcagugagccgagaucgcaccucugcacuccagccugacagacucccucuaaaaaaaaaaaaaaagccgcuuggccauugaaaugcuguguucagguugaaaaguaaauacauguguaucuuauauaaaguguguuaauucuaaguugguuuucuaaauuacuaugauuucauuauuguaagagagaaaaaaagagggaaacuaaguuugaggucuuuuuaacuaaggacaguugccaaaagccaucucccuguucuuaauugcuaccauugaucaagcucaguuuuaaaaaacacaaaagggcagccgggugccguggcucacaccuuucaucccagcacuuugggaggccgaggcaagcagaucacuugaggucaggaguucgagaccagccuggccaacauggugaaaccccaucucuacuaaaaauacaaaaauuagcuggaugugguggcgugcgccaguaaucccauguacuccagaggcugaggcggaagaauugguugaacuugggaggcggagguugcagugagccaagaucguaccacugcacuucagccugggcaacagagugagauucugucucagacagagagagagagagagagagagagacacacacacacacacacacacacacacacacacacacacacagugagauucugucucagacagagacacacacacacacacacacacacacacggaaaaaaugcauuucaaaggaaacuacuagaaauguucauauucccuuugaccauuuugcuuucgugaguuuucucugucacagguuuccugccaaguuaauucaaagcccagugggacuaacaugcuccucucugcaaaauauucuccagagcuucugggaauaccucauagcuacugcuaccaggauaccaaaauauuucccaaauacacuugcagcuggaagcaagauauaacauuuccucucuaacuccuucuugccugugcuuuucaaauaaccucagcugugaauggagggcuuagaaguaaacaguugucucuuauuuguuugaaggaccgaguaucaguuuucacagaugugaaugcuugcauugcaugugugaaaugcacagaaggucuuuauguucuguuauaaaucacacugcauguauauguuagaaauucaaggccugagaggucuuucuuuaaugcucagugcugggagauggcugaaguaaucaggcugccuauuuuuagugccaccuuuuggaugcuuaggaaauugacauuuuaaaguaaauuaaaugaacauaguccuacuugucauuucugcgauuaaaucaauuccaacgcagcugugugaccguagaaugguuuguuuuauuauugcugaucaaaauaacuauuaugaguagcagaauucuagugccuggaaaucuaacaagaguaguuuugaguuuagaagaauuagcucaacugucuuuaauauaaacuucaaggccuuacacuugaauaacaaauaccaaagcaguuugacagcuuugaaaaaaaguuaguggaaugugcaagauuuaguugguguuuaugcuggcuggacuucacauacccauauauacucuguguuacucauuuaagugcgcuuuuguauacaguugucaccaucaacauuggcccuuauuacugaaaucugucagccucauuuaaauuuuugcaaaugugauuugggagauguaaauauaaaagugagcagcucugugcagauacauuuuugugugaggcagaagugcaugacuggugucacaugcagagggugaaggcuuuaggaguuacggaacaucaaaagccuucuucagagugacugucugucucaugugacuagcaucggucagucagacagggcacccgggacaaugggcagccacacugacgcugaaguggagugaaucugagcacagccuccaacauucucuaucuuuuuguagaaaacaaagaaacccaaggcagcagagucuguuucaaaaccagaugucagugaagguaagauccuucaagagauccuuauuuuagcaaaaugcgacucuagggcagucugcuaauauguucaugcuuuguuuugcauuguuuuugcuuugccuacuuuguuucuuuuacagaagccccagggccaucaaaaguuaagacagggaagccugaagaagccagccuugauucuagagagaagaaaaccaacuuggcucccaaaagcacagguggguccuguuguagcuacagggagcuguuucgagaaggcuggaaacccagguggccgaguccagguuucacuggaguggguggaugggaagcccaagccuguccuaugucaugucucuagagagugcacugaacucucuuuagggggguaacuaagaaauauugaacacacccucaucaggagccguggcaggagugauggggucugggcacaaaugcugguuguuuagauuccugucgaguaagugcuuggugccaagcaaaagagguugcgcugagaacuggcucagauguugcacagagacugucagauggacuguggcucagggccugcggggaaugcccccaguuucuuuacucuuggggcuuucaugggcuccacguguggcucucagaguccccucucugcugccucuugaccaaggaucaguuucuccuaaaacucacucucuguaacucaaagaaaauaccauuuauuucacaaaaagaaaaauacagauucauuguuaagagugugugaucuugugcucuaaguagcauccaggguggcugacaggcucccaucccggcucuacaugggacagccacucagguuccugugcccauuuccuccccuggaacgcaggcccugccucaucaggacaaucuaagucauucacggggcugggaccagugucugcgacagagcaagacaguaaaugauagauguguugugcugugucugcuuugcuggaguuggcaauuaagaugacguccgccagcacucacacagccagcaagagaacgucugggacagagugacugaugggcuucccuucugaggaugcgaaguuuagaaucaucuuuaucccaacccugacaguuuuggcucuucauuuuucuagcaaugaaugagagcucuucuggaaaagcugggaagccuccguguggagccacaaagagguccaucgcugacagugaagaaucggaggccuacaagucccucuuuaccacucacagcuccgccaagcgcuccaaggaggagucugcccacugggucacccacacguccuacugcuucugaagcccgcacugccaccgcuccugccccagaagguuguuuaguuuccacguaggcaggucgcuuugugccucugagugcgcugcuguguguucucucuauaguucugugucauaaagcuguccuggccagccuucaagcugguguggccacucuugaugugaggcgugucgguuccaggggggacaugggaggggcugcacaguggcccgaggucaugcuugcuuccaccugcaggugcauuugguccuuuccauggccaggaagcccugugggcugcacuuuuuaugcuugcaguaacaagagacuccagaguccucaccggugcagaguuggcacauauuaauuaacuaaaauucuaaugaucuugcuaccagcaauaaaucaaguaggccaagugaaacugggcuuuaaaaaggauggauuucaaauacacugugcccacuagaagcuucgaagggccucgucccucugcuacagcccugggaggagccaggauccuuguuggucuagcuaaauacuguuaggggagugugccccaucucaucauuucgaagauagcagagucauaguugggcacccagugauuggguucaaaaauaaagcuggucugccucuucucuc

SEQ ID NO: 191283 - RNA, 26902 nt, Homo sapiens
ggaagcgaggucagagcuggaaauggccuuaggggucaccuagggccuaauccaucguuucucuugugggggaacugagccucugggaagggucacauugcguuaaugcagugugugucgccucugucccucccccuuacacgucuggcgucucgucagauacaugucagcuccugggagaagcuuucccuggccgcuuugcagaagggcguccccuuuuagccucuuccacgucaaccugcuccauuucuuucguagcaguuaccagucucugaaacuaagucuguuucugucuuagcccgccaaguauuuauuguauacguauauaggugccaccguacaggcaguacuucuccaggcaaguaguauuaaacaccagccgcccugggccaggcauuguacugugggacccaguaugcauuaagggaagaauccaggcaaguggcugcccucuuggagccagcauucugggggggaagagauuuugaguguaaacaagaaauuccaggggaugugauggaagauuagauauguuaaaguuggcaaagaagcgucugaggaggugacuuuaaaaaagaauacgugugacagcuuuauugaaguauaaaauaacauuaauuucaaccauugaaaguguauauugugaguuuggaaauuuuaugcaguugcguaaacauggcaaguucaaauuugggacauuuucaucaccccaagaaguucggaggaggcaacuuuugaacugggauaugaagauucaaacggagguagcuguggggagggagaagcaaaucaucccaagcugaaggaacagcacuagguuugcuccaaggcagggaugagcuuguuguguucagcggagaaaggaagccagcagagcuaggagggcuggggugcagcaaggcgggagagagcgggaagagauuaggugggucccacagaugacugugccuucugaacuuuggaagcuucccagugcucagcauaaggugugguccacacugacuaacacgaacgauucucaccuaccauguucuuuuuccuaaguucaucccuaauggcagaaauguucucucccaacuugaagguugagguagaggaauagagugaaaguaauauuuauuaagaaccuguagugcuuuaggcaguguguguguguggcuucauuuaguucucauaacucugugaaguagauauuagugucucuguuuuacagaugagaaaaucaagguuaagugacccguccaaagccguguaaccagcaccuggacugauugcagaagccuugucaugccuuuguucguucauacagccaacugguguuucaaguaccucugcauuugagggcagaaguguggccggcaaggaccacauccccucacguucacuaaaauguacaugugcuuguagcuguugcucugaccuuuuguucugcacuuauuuuucaugaagcugaggaaacucaaaugccuuccccaaauuccuugcaguuucuccguucuguguugucuuguuagcaaggaugucacucagccauuuggcucccuuuggagaggugacugguauggaggacuuuucagcguaacagguaguaggauugaaaugugguuucaguguacguaacuccucggggaguuggaaggaaaaaagaagggaaaagucguuuauuguacccacuaugaacuagauacugcauuuucuacauaaucugauuugauccccagagcagcccuggagaauguguuaauguucucuauguuugcagagcaggaaaaugaagacuggugagauuagagucccaacuccugaguggcaagaggcccugaccaaacccuggugggccuguuagauuaugauauucaagaaaaaacccagggugggagagguucuugcuggguaaauguccaaaacacgaugcccgaccuuuuuaaaacuuuuacgaagaaauugcugauucgcuucccggacugguuguucuagguaguuucaugcggaugcugaccuaaacuagaauguagaaauuaguaggaaagugaaugcccacuagguggaaaccugaaagcacggggaccugcgaucuuguuuacuguuauauuccugcugcgcagcucagggucucuauguaaaaaaugagugaauuuauuuucuagcuggugccuacaaaauaaucugcaauguauccauacugguuuauuaaugguaacaaaugaaccguacuaauaugagauaauaggggaaacuagauauggaguguaugggaauucuaucuuuacuauuucuggaaaccuaaaacuacucuaaaauagaagguuuauguuuugaaagcacucugcucauugcgcucuugucugaaaagugaagccuggccucaagccacuuugaguauuucucuucugccaguuaauuaucuuaccauugccucucagugauauuaagagaaaacccauccuuaacauuuuucauuacuuuuuagguucaaaaugagccuguuuggaacaaccucagguuuuggaaccagugggaccagcauguuuggcagugcaacuacagacaaucacaaucccaugaagguaccacgaaaagcuuccuggggcuuguaggaagaguuugggcagaguuucucccaucaaggacagaacccgagaugacuugggagccuccuuuaggcugaaagcuuugaaacuuugucuaacucauguuucugaaacacuggagcacagaaaauguguccccguacuuguguccuguucuuccuggccugccaggucuccagaaucacccaaggugcagauuccggugcagauucccagggccuggcccagccaggacuguugacucagaauucccaugguuggagagaggggauggcaggugaaaacugugaucuagcacuguggggccagagugaacuggucauuuagaaaacaagaccaugggcauuucauuagcagcugcuacugcuaguccugguggugcugguacuuucucuagcuuauuuuuuacuccugucuuugaucaaaguaaggaaaggucuaauucaguuaguucuuguacacaaggaaaggccaccgugagguaauuagugagaaagaaaacaauuuggaaugaaguugugagcgugcauacauuuuaacauugacuuuuuucccgcaggauauugaaguaacaucaucuccugaugauagcauugguugucugucuuuuagcccaccaaccuugccggggaacuuucuuauugcaggaucaugggcuaaugauguaagugcuccuuaaauacguguucuagaaaucaucucucuuuguauggccaagguuagcuuuagcuccguuguuucccaaguaaaugaaucaguuggacuuauuuauggccuuuuuugagaaaucaauuuagggggugugaacccuucugaauggcagacauuauucuuacacccguuuuuguuaggaaagcacaaucauauguguugcucgaaauuuucuacuuuaguucagucucuugaaguuuauucccaaaucaaauaucauauucauccagagugaacauuauacccaguggcacacaccaacaaauucccuuucuuggcauccugacaguguuccucaggcauguaugaaacuuuuucaacguuaaauaauagcacagauuugccuagauacuuacucaucauguacaaaaagaaagacaaaaaaauuacaguuuacuaaaagaaagaaaacucugguagaaaaauaagcaaaggguguaaagagggacuucacaaaagaaagaauaaaccugaaccauucauccaugcuuguaaucagauaaaugcaaauuuaagacuuuuuuuuauuaaauuaacaaaauuaaaaguuuaaaagaauaauagugccagcaaggauaagcugaaacccugcauguauggcugguagguauguaaguuggcuuuuccacaggauaauuggcaauaguuaucaaaaauccuucagcuuauacccuuuaucucacugauacccuucugggacuugaguaggaaaucugauaauguacuucaucugcauuaucuaaauuaaccuuuauaacagccaaagcacugugaacuugugaaaauuuugaaaauuuuaauauccaguaguaauggcaauguauaguauguuuguaugauggaauaccauuguaaguuuuuggaaaagcuuuugaacuguagccuacagcacaggggcagcagggguuaggagaacaggagggaggaugguagucaagguugagcaagcuugcuuucuacauguaauuuuuagaaagauuucagauuauuugcugcuuaaaaaaaggauguuucaaguugaacaggcuagugaugcaggugaggaaagcuguagcugcaaaagugaagacacuguauaaucuagugucuuccagaaaauaugcguacauggaaagaagacuaagagcacacagaaccauuagcugugguugucuguggugugauuagggugauuuuuauuuuuuugccauauuuacaaaaucucuaaaauguauuacuuuuuuaacggaggggagauuauauaaaguauucagaaaagagguaaguuucuacuuuggucuugauucucugaaugguaauggguaagugauauucuacuuuaaaagacauaucucauagaugcauugagaaaauuaucugcaauuuuauguguaagcaauagaauuuguuuauuuuaauagcuuaggcgaagaaaacaguugcuuucauagauauuuuaauuccuuuguucuugaaguuagauaauuagguugcuaugagaagucuauguaugguuaagguguaccccauuaguuuuuagguguuaaaugcaagcaauacaucguaauugcuuuguuugcauugaauuuuuuuguuacuacagguucgcugcugggaaguucaagacaguggacagaccauuccaaaagcccagcagaugcacacugggccugugcuugaugucugcuggagugacguacguucccuuccauuucucguguuccauuuuacuuaaaguacagaaugauuuagaauauuuaauaauccaaacacaaauagcauauauguguucauauuguaggaauucuaaguuucugaacauaaauauagucauuuauugauguucuuaauguuggcuuuaguuagccacuuucuuugaaagcuuuucuuguauuaaauuuugugugugugauugaggagaguuuaaugauuaagggauaauuuaugaagaagccagcagggaaggugaaacaccggugccaagcugcagugggcgggccuccuggagcacagcaugagcugcagcuguagaggggcuuccaccuggcgcgggagagccaggggaugaacagcuguagacgggccucggccuggcgaggggagccagggguugaacaccccagccucucuccucccuucuccugccauugcugcugguggcugaacccaacaguagugagaauguuaaggggccuggugacaggcagacacacugcagugcugaagaagcuaagccuugaggccccuuccgaggccuuguaccuguuccuuuagucagguuuauugagucugauuugccugcuguaaaacugaaccuuuuugguauacagcucugugaguguuaagaaaugcauagaguuguguucuagauauagaacagauccaucggccuccaaauucucuuccuuccuuuugucgucaaauccuucccagcucgcagccccuggaaacuacucaucuguuuuuuuugucccuauaguuuugcuuuuacaagaguaucaucuaaauaaauccuauagggugcaaccuuugcgcucagcauguugcauuaacguauggugauuguuuugucagauauauuuccuauguuuggggugggaugcuggaaauuaggacaagcauugagauauagcaucugcaaaaugcuaauguaagugguaggaguuuucucauaaaagauguacgaguuggucuuagcgguauugggguuaugccauucgaauuuguaagaagagagugguuuagaagggucuugguaauuaaauuugugguauagaguucugguaaauauacaguguguagugcuccuaggaaaauaguaguaguuagggcauuuauuaugauaauauucauguauucugcuauaaagaagggggcaaaugagccugcggcauauucgauguugaagccugagacuaacucugacucuccuuuuguuagaucaaaagaggcucaguuaguuucugcuaguguggggauaaaucauauuauggcuaggggccaugaugauaggagcagucagaggaauucuugugaugaguauguguaaguuaaaugagcugcuuaucaguagaacugauagcuggauaauagcuagggugacuucauaugaaaucgugugggccacagcucauagugcgcugauuagugcauauuuugaauuagaugcucauccugaucauagaauagauagacggcuaggcuugauguggcuaguuuaaauaggaggccuacauuaaaauuagaggaucugguauagggagggggguucauaagaggagagcgauagagagggcuaggauuggagcaauaauauaaagggugauaguagauguuaagggccgcgaggguucuuuggugaaaaguuuuauugcaucaaaaaaugguucaagcagucuguaaggaccuacaauguugaguccuuugcauaguuguauauagccuaagauuuuucauucgaugaguguaaggaacgcuaucgcgauaagaguggggauaaugagcaggaggagguuaauuacaggcauguuguuaagaagaggaguugaaccucugauuauaaaguguuaaguuuuaugcaaucgcugggcucugccaucuuaacaaacccuguucuuggguaggaugugugaugauuuaagagacugggauggcaucaucuauggagugagggcacuuuaugaagugggcccuauuucucuuguccuuucguaguaggaggaauguuaaguagguagaaaccgaccuggauuacucuggucugaacugagaucacauaggacuuuaaucauugaacaaacaaacucuuaauagcggcuacaccauuaggauguccugauccaacaucgaggucguaaacucuauugucgauauggacucuaguauaggauugcgcuguuaucccuaggguaacuuacuccguuuaucaaauuauugggucgauguguaauaacucacuuagacuuguguggucuuagguuguuaggagguugaauuaugcuccgaggucaccccaaccaaaauuuuuaaugcagggauaggaggcuagggccuguaggcuuguuggaguuuuuauuugcauugaugaauuaaagcuccauaagguuuucucgucuuauuuguuuauauccgccucuucacggauagaucaauuucacugguugaaaguaagagacagcugaaccuucguguggccauucauucaagucccuauuuagagaacaagugauuaugcuaccuucgcacggucaggauaccacagcuguugaauauaugucacugggcagauagugccucuaauacugguaaugcuagaggugauguuuuugguaaacaggcgggguaagauuugcugaguuccuuuuauuuuuuuguaauguuuccuuagagcaugccuguguuggguuaacagugcaaauaauacgguguuuauuauaucauuuauuaauauugggauguuaacugucaguggguuacucccgucugauguaagcuuaugcaauggagaaugucuucaucuuacuuacauuaacauuacugcuucuauuaaguaauagauuaguccaaugugauguuaggaguucaguagacugguuagaauuuaagauaguuagauauugagcuuaaaugcuuucuuaauuaguggcugcuuuugggccaacuguggugguaauguuuuuuacucucuguaggaagggucuaaagagcugucugucucucuagacuaacaguuaaacuuacagggaguuuaaguaauucuguggguaaguugaaaguugaacuaagccagccagcuaucaccaggcucgguaggcgugucaccgcuacucaugaaucuucccacuguuuugccacauaggugagugugcucuuucagcuauucuuggguagcucgucugguuucgggggacuuggccauaguucuauguaaaguuauuucuaguuaaugcauuaugcagaagguauaagggcuugucuuugcuuuuuaguccucaauacaguucuuucauccuucccuuacaguacugugucuauugccagaaauaucuaccaggguagaaauuucuaucgccuauacuuuuguuuaagguaaaugguuugauuaagauaguuugauaauauuuuuagcgagguuuggggcuagaguugucugaguggucaggucaugaugaaaucuucuggauguaagccggaugcuuuggguuaagcuacacuuugguuuauccaagcgcacuuuccaguaugcuuaccauguuacaauuuaucuccucuauaccuguguagaaaauuaucaguaauagugauuucuagaguaguauucgaggaaggugaugggcugugugugcgugcuucauggccuuauucaaccaagcacucugcucuugguuuacugcuaaauccuccuuaagcccuuagauuucauaaggcugucaugagauuuucuggacauagaaaauguugcccauuucuugccaccucaugggcuacaccuugaccuaacguuuuuauguguauacuugugcuuacucuauaaccuuuuuaggguuugcugcagaugggcauauaggccaggggcaagagguggugagacguaucgggguuuauugauuauagaacaggcuccucuagagggauauaaagcaccaccaaguccuuugaguuuuaaauuguugcuuguaguacucuggcgaaugguuuuguuaauguaacuguuaggguuuagggcuaagcauagagggguaucuaaucccaguucuugucuuagcuacugugucuucaggguauuaaagcuacuuucguaguauguuuuauuucaacuggaguuuuuuacaacuuagauggagcuuagcacucuuuacgccaaguucuauuagcuuggguuaacuguauggccaugguggcgggcacgaaauuaaccaacccuaaauauuaguauagcuuaguuaaacuucuguuuauuacuagauuuaacacugcuguuuccugugggggugugguugagcaaaguguuuugagcugcauuugugcaugcuugauaccugcuccuuuugauccgggugaucuagaggacauuuucacugggguagggguguuugcauguguaaucuuacaaagaacuaauaaaaaggucaggaccaaaccuaucuauaagguuuuguggacccaucuagacauuuucagugucuugcuuugagugguuaagcuacauuaacuguguagaauacuuaaguggaaaauuaaaguaugagaaagaaagaaagaaagaaagaaagaaauagaaauaguugcuuacaguucuggaaauucagggucuuuaaaguuggauuggcagagguuuggcugagaggguuauucauaauuagaguaugguugauuuaggguuaugguguacuggggcagcacuuucagaggguuaugcucaagguaucauaucaguauuagggcagaaguuuaguuaaucuauuauacauaguggaggauuuauuggguaggaggagccuuaagauuuuuuagaaaauuacaucaaucgagggguagcuguugggguguucgugguuaaaauaugucugggcucugacuggguugcauuuuaguuucuuguguuugggguuuggcaaagguauguuuaccuagguugaugguaaagucagauuaggaggggggaguuugcggauuuauucggaaauaguucuugaaauugagcauacgugcaugcgugagcaucuauugauuaauuguuaaguccuucaaccaugaauuaacaccuuaugguuguuaugucaguccggaauauucaguauaaguucagcuacaauggauuuggcaggagucaggcuguugccaugcugagucacagcaucccaaaguuaaaaaauaccaaaugcaugacagugcucccgugacuggcuaauagggugguagugauuaauccaucaagaugucuuauuuaaagggaaccuaugggcaaucuuaauuuuauggccauacguuaaugcagggguccccaacccccaggcuguggaccagaacagguccauggccuguuaggaacuaagcugcacagcaggaggugaauggugggccagugagccuuacugccugagcuccgccuccugucagaucagcggcggcauuagauugucacaggagcucgaacccuguugugaagugcacacgugagggaucuagguugugucuuccuuaugagaaucuaaugccugaugaucugagauggaacagcuuuauccugaaaccauacccucacuucaccccagucuggaaaaauugucuuccaugaaacuggucccuggugccacaaagguuggggaccgcugcuuuaaugugaucuuauuuagcuuauauauaagaaauaauucuguguauaaacauuuugacauaguuuaggggccacaguugcucccauuuuauucaguagcaaggaucagcuucucugaggcauuuuuaucaccuguaaaaugucuuccugacauaccugauuaaguuauugugacacuacauuaauagauauaugaaaaguuugaaaagugaagcauucauuucauaugcaacuuauuuuuaguuuacacacagaaaaguagcagcaugaguagauuugaaacauuucuaauguauuuugucugucuuuacugaucgggcaacgggucagaauuagaaaguuucuuauaaaguacggcaagaaauagaauuaacuaaugcaggaauccuuuugcucaaauguuaucuaauggcuauuggaauuuauaaaacggaaucuaaguuucauagcaucuagugggaggaucagacacaggaaugagaguuguacguucugacggggaggcaggaugaacuggugcugggugggaaaaacaauacagaaagcagcuguaaaguuuggaaaggcuucugugaaugcuuuacagaagacaagaauagagguaaauuuuuguuuguuuguuuguuuuugaguguugcucuguagcccaggagugcaguggugcgaucucagcucacugcaaccuccaccuccuggguucuaagugauucuccugccucagccucccaaguagcugggguuacaggcgcccaccaccacacccagcuaauuuuuguauuuuuaguagagaugggguuucgccauguugccgagacugaucacaaacugcugagcucaaagugauccacccgccuuggccuccccaaguucugggauuauaggcaugagccaccacgccuggccagcagagcugauucuugaaaaguaaaccauuugccuauagcuuuuuaagcauugucucauccaauugaggccuggguucaaauuucagcucugucucuuccaggcuuuugacuuugccaaguuguuuaaucuuucuaaauuuguuuucuuguuuagaaaaugaagguaggcugggugcaguggcacuuugggaggcuugggaugaaggauagcuugaggucaggaguuugagaccagccugggcaacguaaggagacccggucucuacaaaaaauagaaaaauuagccggguuugguggcgcacaccuguagucccagcuacuugggagacugaggcaggaggaucacuugaucccaggagacugaggcugcagugauccaugaugacaccacugcauuccagccuggcaacaacccugucucaaaaaauaaaaaaaauuaucugagugugauggcacaucccuauaguccuagcuacucaggagacugaggugggaagaauccuugaguccaggaacuggagaguacagugagcuaugauugcaccauugcacuccaagcugagcaauagagcaagaccgugucucuaaaaaaauaauaaauaacaauaauaaaguaaauaauaaaaugaagguaauaacacauaauaacauuauuaauucagcaaauaauugucaggcaccuauuguaugcuaaauccuggagauaaaguggaaaucaaaguaggcaaaaccuacacuucugaaacucaugaucucuuaggacaaacaagaagaacaaauacaacuucucgauaguggaaaauugugaugacuagauuaaaccuacacggaaggauuagcacagugcugucacaaagugguuaaggagcuugccugugagaacaaaagugacuggcugagccuaggcccagaccuuccuggugauggagcccaugugcuuagcagccucccucauggagcuuuacaggaagagucggagcuacccgggagagaaagacauguagguaaaggcacaggggcgcuaaagacccaaaguuaccuuggaggcauaaaagccaaacuugguaaaguugaaucuucaguacuuuaaggacaugguucaaacucugcaguugaagcagguagacuuagagcagcugguggagcauucacacauacucuuucucuccccaguguuuugcuggauucuccuuuaugucugcacguguccacugagguuggcaugcucugcuccacaaugcugaugacgugguggggcuggcauuaugagauugagaggccaguguucacuuggacucagggcagcccucuccauacacucauaccuuuccuuugcuguguuuucaaggauuuguagaauuacaaccucauuaaaagcaugaggagcaaguuuuaucucuucuuucaaaugaagucacuucaauggaacaaguuuuugcuagaggagaaugguggucaauuuuugagcucuggaaccaaaaaugaaauauagacuaggccaagguucagcaaacuauggcccaugagucaaaccugacccauugucuauuuuuguaaauaaaguuuuauugaaaugcagccacacucauugacauaauaugucugggugcuuucaagcugcagugacagagaagaccuacuuugaguucucugugugaauauugugaaaccaucacacagugaccacuaauuuuuaaaucuauuugacaaguuagauaggaccaaugacuguuguaaauuggcauagcuuuauugcauguacuuggaaguguuauuagauagggaccgaauaaaaguaauuaagauuauaguuauguguuuuguauauagagagaaagauaaaugugacagaauguuuacaauugaugaaucuaugugaagugcuuauggguauuuuuuguauuuuugcaacuuuucugaaggcuuaaauuuuaucaaaauaagaaaaaaauuuuaaagugguccaugguugcugcugagaggagaccugggaucagggacaagagaaagaguuuguuuucacuaguuugugauuucugauuuuuaaaauccuguuuauauguucucgcuuagaaaaguaagucaaucaugaaauagaugaaaaugaauuuuuuguaugaugcuguaguuugcaguacacugguccccaaacaauuggaaaaauaaagauugccaaaguuugccucaauauguucaacguaguaucuaaauauauauauaguuaaagauuuaauuuuucuuaaaaugcaaaauuuucuccauuuuauuuuaggaugggagcaaaguguuuacggcaucgugugauaaaacugccaaaaugugggaccucagcaguaaccaagcgauacagaucgcacagguaacagaagccucugcagaaaggcuaggcacaacugguacccaggacugugauggcucuuuaagugaaauaauuauuauaauuauaauaagaaaacgugcaguuagacucugucaaaucaauuagacaauauaacagaaaccucuuuagcacaaaaauaacaauuuuauaaccauucucauucuuaacuaguguucacagauugucuugucauggaucuucauauauguauggauggagucauaaggaguuagugacauuaaaaucuaugaaagacaggucauaggugguccuugccauucacagguuggacguugugaccucgugcauggcuggucuucuaccaacugcauuuggucacuuacucauucagcaaguguucugucuaugggccaguaauagagcagcgaguaagaggggcauuuccccacacguguggaacuuuuaccguuacucagggaccacuggcagguacugugugaagaaugccaagggcagaaguaaugaagauaagagaacuuagaaccagaggguccagccugcuaagggggcuucaggaagagcacagugcugaaacauuuucaggaaggcacugcauacucaggucacagugcugugugcuagaaacaucucauugaucucuuaauucccaucaccucagugaguaaaacugugguggaauccccugcuuguuauuucugaauaucucccuaaggaggagcuuacuuucacucgcacauaugucuuaauuaugaguaaaaaaauuaaaguuugcuagaauggaagguagauauauguuuuuguguuaaauugacuguuuugauuauggguguauuagucccuuccugcauugcuauaaagaaauaccugagacuggguaauuuauagagaaaagaaauuuaguuugcucauguucugcagguuguaugaguauggugccggcaucugcucggcuucuggggaaucccaagggagcaggagauggagcaggcacaucacauggcaaaagcaggaaagagagcuaugggagagaggaggugccauacuuuacaacagccagaucucagagaacucacuauugugaggacugugcuaacacaggagggauccgcccccaugacccagacaucucccaccaggccccaccuucaacacuggggauuacaucucaacaugggauuugguggggacaugcaaacucugucagugaggaaggauugguaaaaugcuaaguauguuuugguuuuuguuugguauggccccaguauuuaaauuaguuucuucccuuugaauugccacaacuaaagcuguucagcacauucuuacauuuaccuugaucuguuuuguuuuugucuuguugaaagcaugaugcuccuguuaaaaccauccauuggaucaaagcuccaaacuacagcugugugaugacugggagcugggauaagacuuuaaagguauaaugugcaguugaggcauuguuuggccccaucaggauugucauuuauuuuugcaccauuucgacuucugcucugaauggucacauacuggcuucucuuuuuugcuuuuaguuuugggauacucgaucgucaaauccuaugaugguuuugcaacucccugaaagguguuacugugcugacgugguaagggauuucaacuuaauauguauuuacuuuaaaaaaaaaacaaaauaaguauucucaccuuguggcguccugcaguuagugaguggauaauauaaaaauccugcuagcuuuaguaauagauauaaaggaucgaguugagauugccucagucgucuccaauugggagauuuuugugcugcguuucuuuuagaaguacuaaaugcuggaugucaaguuuuccugccacucguuugaacauaugcagcuagcuacaugccaucucuagugugacaucuaucauguccuuuccauggcaguaggaaaacuugcaguaaguuugugaggugguaccaggucuuuggggacuguuucugagugggauagaaauugaacuuucucggccaggcaugguagcucacgccuauaauccuagcacuuugggaggcaaagguggguggauugcuugaggucaggaguucgagaccacccuggccaacauggugaaaccccaucucuaaaaauacaaaaauuagcugggcaugguggcgcacgucuguaauccuagcuauucgggaggcugacgcaugagaauugcuugaacccagcaaguagagguugaagugagcugagaucacgcuguugcacuucagccuuggugauagagugagauacuaucucaaaaaaaaaaaaaaaaaaggaaagaaaaagaaauggaacuuucuccauuuguuuagucacaucuuaaaguuuuguaccaacaaucccguaauuccacuuuuaggaauuuaucacaagaaaauaaucauagauacagauggucuuuguuuuuuuuguuuguuugguuuuugagauggagucuugcucugucgccaggcuggagugcaguggcaugaucucagcucacugcaaccucugccuuccggguucaagcgauucuccugcuucagccucccguuaacugggacuacaggugugugccaccaggcccagcuaauuuuuauacuuuuaguagagacgggguuucacauguaggccaggauggucucgaucuuuugaccucaugauccaccugccucggccucccaaagugcugggauuacaggcgugagccaccaugcccggcuggucuuuguuuuauguaauauagugaaacauuggaaguggccuaaggggccaccaagacacagauaaauaaacccugugguagguucauuugaggggacguuagaagccacugcuaguacuugaaaaagugugugacguggaccuuaugaaacauguuuugaguaaaggauaugaacuguacagaaauaugcuacauaccaaguauaacgcugagaacaaaggcuggaauagugacagcaacugaaggagugguguaggggauuuuuauuuauucuuaguuccugaguauauuuucuaaauauccacauauuuuauaguuaguuuuaaaacacgagacuuuuuaaaauauaugaauguucuacuuucaaauacuauuucucuagguuuuagugaaauauaaucccaggauuauuaaaauccagacuuaauguuguaaccaaaaauugaucaaauacauuaguauaaaaacagcacacuccuucaccugaagcgcaucucuguuuucuuccauucccuagauauaccccauggcugugguggcaacugcagagaggggccugauugucuaucagcuagagaaucaaccuucugaauucaggaggauagaaucuccacugaaacaucaggugcgucauuagucaaaucaagaaguauguauuuagcaccuguuguaugcaagauugugcucacaucuggaauacaguuguacuuuguaaaaccuguaaguauguucaaagaggggugaauugaaggauauaaacacaaauacuuagugagugaauauuaaguaauacuaagguaucccuggaugaacugaauuuaugucuucuccaaacaugccccuggauggcugagugcuacugaauuguaggggccaagggaaaacuucuccuuugcccucugaagggguucacugaaaaguagcugguaaaagacagauuaauaggagaaauggcauacaaauguauugaugugcacagcgucuuacaacgaucuuaaaggcaauaugguugaugcuuucauaccaucuugaggucacagaaagaagggggcucagggcauggcccaaaacaggcuuucaugguaaauuggguucucguggcaagacagguuaugggaagaagagaagaagaggucuguguagcaaagguggucuuguuaauguggaggaaaccccacagguagcacccucggagagaacugagaccuuuaacggcaucagacugcaguuaaucuucccuaaucaggacaagggaagggccuuggagaaagccuggcugcaucaaugccgauuuucucugcagaugcagaucuccccaccaaagauagcuuuucagcuauuauuuccagcccuucuguauagccaucuugaaauaugucagagaagucuauuuuggggcaaaauauuuugguuuccuugagaauaaaauuacacaucuggauggguugguuccauuguaaauuccuagcuuccaacuucaacucugucugcaucaugccuagaugcuugcuagcuuuuucaccuuagcucaauccuccacuugccacagggcugcugggccugcacucuugucagcuucuccuuccuuuagucuuugucucagccaaucagaucagcucuugcucagagaaaaaagaagcuaaugggaacuuccuccucuuucuccugccagaucuagaaaucugcccgugcuugccuccuccccugccuuuucccccaugagguggaagccguccugcuaaggccaguuuuguggugggacccaugcccuccagccuucucaggaaccguaugcagaguaucaccucuuucccauacacccgucucuccugccgcguaguacuucucccuuagcacugacacuagcucaagucuaguugauccuagaaaacacaccucccuugauccccacauccuccuccaguacugcccgcgucccuauuccuuccgcaguggggcaucuuggaugaaauguccuuuauucccucaccucccacucauuucuaacucagugagaccuuugccccccauuguuccaccagaacuguuuuuggcgugacuaccaguggcauccucauugguaauuccaggggacccuggacacccauccucuuacuggaacagagcuucauucacuguucuuacaagaaacauuuccccuggcugcugucuugccagccucuuacccgcuaccucuguggcucuucuauccuugcuggcucuuggcugaauguggagguuccacagacaucucccuaagccgcugccuccuccacccaagcacaacugaucucccauccacugucgcucagccacgcccuguggacuggagacucguaccucauuccugugcuccugacauggacacccagucggacagcuccuuggugugucucccaggcgucugaagcuacgguaucccacaccaaacccaagacuacauucuguagcucuuuauucacauguuacccuugccucaggauucucccuugcuacugccaccaguaccaucuacuuuauacguauguauggaugucauauacauacuaaauauuucccuucuuuugccuacuagaauguaaacuccaugagagcagagauuuuuguuuguauuuguugcugccucccagcacuuggaggagggccuuaaguguaaaaggugcucugugaauauuugcagagugaacauuugaucugaaccugccccucucggccaccaccagccuguugcuccugaugugcuucacagcccauucaaugggaccuccaucuccuuuguuauagccagaaaucuugaggucaccccugauuggaacuuucccucuccugucucacuaauccucagucuccuccccucuacccugaaauuauuugggaaucuguucauuuuucucccucccuccugccaccacaucuaauucaaaucuuggaaagcacuuagaucagaacucuaugacauuggucuuggcaguaauuucuuggauaugacaccaaaaagcacaggcaacaaaagcaaaaauggccaaguggaacuguguuaaacuaacagcucuugcacagcagagggaaccauggaaaagagugaaaaggcagccuguggaaugggagaaaacaucuggaggcuauuucugacaagggauugauuuccaaaauacguaaggaaccccugcaacucaauagugagaaaacuggugacgugaaaaauggaccaaagacuugaauagacaugucuccaaagaagacauacaaauacccagcagguguauggaaaugugcuuaacauccuaacuaucaaggaaaggcaaacaaaaaccacagugagauaccaucuccuagcugaugggaccacuguuaccagaaagcccaaagauaacaagcgcuggggaggguguggggaacauggaacccuugugcacuguuggggggaugcaaaaugccacaaccguuacagaaaacuggaggccucaaaacaugaaaaacagaaucaccauacgaucuagcaguuccacuuacaggucuugauucaaaagaaucaaaauggguauuuugaagagagaccuguacugcuaguguuccuugcagcacuguucacaauagccaagugaacagauaaagaaaaugaaguguauaccugcaguaggaugcugugcgugcagccugaaagaaggaaauccugccauucgugacaacgugggugaccaugaaggagauuaugcaaaaugaaauaagccagacacagaaagaaacugcaugguuccacuuaaaugugauauccagcauagacucacagaaguaaaggguggaauggcggucaucaggggauugggggagagggaaauggggagcuacuuaaucaaugggaugaaauuucauuaaacaagaugagaauguucuagagauaugccguacuacaugguaccuguagucaacaauaauguagacuuagaaauguguuaagcgguggcucucauguucacucuucuuaccacaguaaaaucagcacuuagaccuuggcccugguucaaggcguccuccggagcugaggcaggggcucuuguaagcggcaccacuggccuugccggaccccagccuaagcccuucccugccuccccauuuccuuuugguugaauccaaaaaaaaccuggucccaucuggcuucacuuccugccacccggugcuagcgcccuggccucuccguuguugagaacugauugccaucggccuuugcacagggccagugcauguggcucuuggugcaagugacaccccuggcauugugcaguuccuggugugccgcacaguagacccugugcugaugaccagccauggccuuuucugucaucuaagaacuuacagauguuugucaguuugcuuuacuuuuuuucuucguacucacaaaaguaauggucuggcaguuuuuaaaaaggcaggggagcaaacaguacaggaaugaaagaggaggccguuuuccuucguacuuaggaaacgugcaucaccagcagcugucacgaugccagaggcugcuucucccuucgucuugccuggccccugccuggguccugccaggcuuccccugaacucacacggaagcucagaugaccagcuuaggcaggguggauggcccuccaagcuuuggccagguugccacgacuggaaggaggaagugguaacuccaaaguuggcuucuccucgggguggucggcuuuucugcccaggaggcuggguaguggaauuucuggguucuucuguagaauagagaccugcccuugggcccucacacucaacacugggcgaagugcagcguguugcuugucuguagcauggccacugcacccaccguccccuucacccuguuacccugugagacgggugcggcagagccugcaucccuccuccagcuggggaggcagaagcgcagaagcuucgggugaccuccugaggggugucugccuagccagggacgucuccauuccccacaggcagggccgcugucugccucgcagcccauggggcucugcuggcgugaacgcggccuugcaggguggcagagggagagcgagcagcgggggcgggggaggagcacagggugugcaguugggucauaaacucacugcuuagauggaguuacuaaggaguuagaaagcaaugcuuacugcuguaucauauuugagugauuuuuucugguucuucuaaaaccuaaacaugggguaaaaaugacuuaccuucacguuagucaugaaaucuuauauuaugcugugauuaugucucuuuuuuauuuuaacuguagcaucgguguguggcuauuuuuaaagacaaacagaacaagccuacugguuuugcccugggaaguaucgaggggagaguugcuauucacuauaucaaccccccgaacccguaagugugacucugucagcuugcagauuucacuggacuuuuuuuaacaaaggaagacuuacaugaaccuuugucuuucagcgccaaagauaacuucaccuuuaaaugucaucgaucuaauggaaccaacacuucagcuccucaggacauuuaugcgguacguuuuuagacacuuuaaccgugguaauacaucuggaaaccagacuuggagguggcugaggaauugugggaucagaaaagacucaucacugaagagcuuguguguucauguccggagauaaguggcuuaugcuguaggcuucagguuucuguggauuuuuguuguuguuuuugagacggagucgcucugucgcccaggcuggagugcaguggcgugauaucaccucacugcaaccuccgccuccuggguucaagcgauucuccugccucagccucccaaguaguugggacuacaggcgcccagcuaauuuuuguauuuuuaguagagacggcguuucaccauauuggccaggcuggucucgaacuccugaccuugugauuugcccgccucggccucccaaagugcugggauuacaggcgugagccaccgcacuuggccuuguuuucuguguuaacgugccgccuaacuagcaguguuguguauuuguuucugaacauaagcuuaggauguuuugccgagagucuucucccucccucaggagcgcugguagacaguucacacccacagcucagacugagaaaucuguuugcucaaaagaaacauuuuccugaggucugcuccuuguuucuugcuguccacaugcucacuuucucuggugugcagcccucacaggaggcaagauuggguucugggcuggcauuugauggaggaagccuggauaguuucucuugcuaucagcgggcagcagcuggaaggaaauguaccugugcgcuuuguuuccuaacucaagcaggaagugugcguggguggaaccuucucugcgccccucugccuggcuucucauugugcaugucaauccuugcagguaaauggaaucgcguuccauccuguucauggcacccuugcaacugugggaucugaugguagauucagcuucugggacaaagaugccagaacaaaacuaaaaacuucggaacaguuagaucagcccaucucagcuugcuguuucaaucacaauggaaacauauuugcauacgcuuccagcuacgacuggucaaaggugagaacucccgggccugcucugggugcuccaaggcagcagagccaggcucuggguucagaaggccuaggccugaguugugacucuucucaggacucacguguguccuugggcaggucaccguccccucccuguaaggggaaauugcaggacuuccucaaaugguuguggggauucaguacagccuuuggccagaacccagcacacaggaagugcucggccagugugagccauuacgggcugcucuguuccugggcacagaagcacaggcaagccgggggcugcacuuuaugaaggggguggcagggcgggucauggagcuuucgccugggugcuguugguugcuugguuggcuggugguuugggcagggggaguuaggagcuggcaggaguggggcugcauuuuugaggccuuugggcaugauggugaaauguguagacucggguacucugcccaaccccaugggaaguguguuggcuuucaaccagccugcguguuucuccacugcucagcucuucuggagagguugucaucauuguauuugugguuuucaucauucuccucccaccccacucugcccuuugcccacaacagccuucuagacuuuucccuacccugcccuggcuuccgauggggaggucaccugcuucacauaggaggggcuuccaguggccugcagugucuuucccgcucaccucaugucugccugcgcugaccccgucuccuuccacccucauggcucuuuucugggccuucucccacugucuucuguccccguccaccagcuccuccccucugucuaagcauggaaggcucgaggaaccauuuccauguauauuaaggcuaucgagagaguggugucagcaccuacccucuugguucccugugcucuggccccuccucaguccacugccagguacuuucuggccucuugcagcuguacucagagucccuguggccacguccuccucauccaguccagaagcuuccuuucugucugugccggucacucacccgucccuuccuguuccauacagcucuccucccugcuucuuggccauguccugguuuauucugcuuugggcugugguuccuguccuccugccagcuccugucuccugccccucuugccuugcuggccccccgcuaucucagccuggggggccaccacagggcucuaaacagcgcuuugcauucccaagacaccugcugccacacaagccagugacuggagacgucccuugguucgggcccugcccgcuccaccuuuaguauuucccagucucaggagcguggcugcaccugagucucccugaggccccgaacuuagacacagaaguccagcugauugccuuccaucccucugaccccuccaggccugcugcugcuucuguguuucccuguuugaggguuugcugugugagccaugaagcuguguucuuuuuuuaaagcaacuuuauugagguacaauugaaauacagucauuguuuaaaguguacaauuugaucaguuucaacaucuguaaauacccaugaaacuaucaccauagucaucuccccgaaagguuuuuguguauauuacuguaaucuucccuuacgcacacacaaaaccauggaucuguuuucuggcauuauggacuagucugaauuuucuagaauuuuauauaaguggagcccuacgcuacauuuuccccucgccccagcuucuuucccucagcauaaggauuuugaaauucacccaugcuguugagugaaucacuuguccguuacuuuucagugcuggguaguauucccggguggggugugccauuuguuuauccauucaccuguguaagccaugcacucaguuuugugacaagaguguacuuuuuugguucugccuggcuggggguggacaggcuguggcgugcguggagcccgaggccucagcucccacaucgggcucuucauugaaucuccucuuugcauacucaucccagcagcugcaucaaaauucugcauuuuaacuuaaaugacgcgggacucuauacguuauacgcguuaaaaaauguaguaaauugaaagcagugagaaagguaauugcuuugagugcuguuuaaaaauugaaguaaaaucucauucauuuaagcaguuaaugucagcuuauuguggggguuacauaaauuagcaucuuuuuaguuuaaaagagaaauuugcuucagggguuuuucauuguucuuaguucaaggacaguuaucuccagugcaaagucaugaucacauaugauugauguuauuagcuugcugcuugaguuacuguucagaaaaacuacacuuuguauauuaugagaauuaguggucacuguugagcaaaacuucuagagcuuucuuggcaugccuguugggaagagaauaaaaaugugucaucagaguacaggugacagagugcacccagcgccaugccccaccucccucuuccaguccuuuggcccaccugcggcuccugccugcugucuuucuuccggaucaucugccuggcccaccccacucaccucucuucuuaaaacuuaaaugugaucacaucacugaccugccuacagccuccuuuucccuggggaauaacguucaaaggccucccucugccauucacagcccuguagucuggccucauccugauuucgggggucuuucgaugcuguauagcccugcauccccuccggugugggcccgggcagacgugcacaccuccgcacacgccucuggcucacucaccaccguucaugccucugcugugcuccgugucuguugcuccuuccauguggggcgggguguccuccuucauccccaugauaccccgcaggucagauguccuccuuucugugaagcauucucaggucagaacuaauucugaccaagggacccaaggcaguuauccuggcguuaaaguccugggguguuaaaagggggcucaguguugaaaaggaacucacagguuccuacucacagacucucucaguaggacauugaugacacacugguaccaaccacauccuuaggccuuucucugaggacugaaguucugcuucgcauuugacuuuaucuuuguuguuuuauuucucugagagauuauauguuuccaguauuguagcacaggacuucaccuagaaaaagcaccuacaaaugcuaacuuucuuuugaauaauaagaucauugguguuuuuugcucucuuuagggacaugaauuuuauaauccccagaaaaaaaauuacauuuuccugcguaaugcagccgaagagcuaaagcccaggaauaagaaguaguggcuggagacucuggcucagccagaguuguuucucuccacucugccucaucucuguacgaauuugggucccagccuuguuggguugucagccauggacauggauuucaaccccuggagaaaacgaugucauuguucagcagcugagagcccaggcguccgcggcgacuugccgucucuccauuccacugccuguugcagaguuuuucuguaacuaaggggguugagguuauuguagacguuagauugcgggcaccgccagggauuuugcagcgcuucaguguacguguuagagaauauuggaaaagcgucugugagccccgugcuguauuuuguaauaaagucuuuugcagauugcuucccga

SEQ ID NO: 191284 - RNA, 19730 nt, Homo sapiens
gacgcuccggaagugacgugcuuucccgagccggugagugcgggagcggggagcggggagcgugggccugggggguggucgcggcccgggcgcaaggaggggccucggcuugggccgcgggguaccggggcgcugggagcgggagaggccccggccuaggagcugagaggccuggagggcugccgggcugcgaaccccggcgggaccgagcgcugcggcccuggaguagcgagcgcucgggcgguggggagcggcgccuugcuccccgguccugccccacucucuccgcagaaccgcguuuuggggucagaagucuugucagccaccccgguggugcucugucacgggaugggugccgugugugaguuccgagucaaguuguuaggaauuugccuugauccagcgcucuaaguauuaaacauuuuaaagugauuauuggcaguauacaguugcacaaaacaacauaaauauauacacauuuggaugauaaaacaacaauaaaguuuuguauuguaaacgcgccucagggagacgcauuuccagauaauucacuguccguggcuggcuucugcccagugagagcggguuacccguucuauucccauuuacguucucguagcuguggauaccgaggaacggcguucacacagaccuguaggugggaauuagagggguuguugggcagugucacuagagaaauaccuuucuuuuguaaaggggaggacccauuauaaaagggggacgggaaaggagaauucaaauuguuuuaaacgcagguucguccucaggcaguucuguuuuagcagagagaacguagcgaaacuugggcagaaaauggauuccuuugaaauuauccuggccuuagucccuugggaagucuguguaggcgaaccucagugagaagauuccugccguaaaaugcaggugucagcagcaugccagggaggccagaggauacuaugugacuuugggcaagugacugaaccucugugagucucagccuccacugcuuuagaugggcauaaaaaauguaaagucaagaaucagguuuccgcugggcgcgguggcucacgccuguaaucccagaacuuugggaggccaaggcgggcagaucacgaggucaggaguuaaagaccagccuggccaacauggugaaaccccaucucuacuaaaaauacaaaaaaguagccgggcgugguggcaggcgccuguaaucccagcuacuggggaggcugaggcaggagaaucgcuugaaccugggagguggagguugcagugagccgagaccgcaccacucugcuccagccuaggcaacagagcgagacucugucucaaaaacauacccaaaaaaaaaaaaucagguuucaugcucacaggaggauuugaggaggguuuauaaagggaccguuugcaaaggcagagugcagguuaaugacaguugguccuuuagccuggaacugguggcaguggaguuucuacuccuggacuccaaaggaucagggaaggcagcagugaucgggacagggagaagagucacuggggagggcuucuuggacuggaggugugagccucagucugagugggcagggagguccaugucccggccuccugcuccugccuccagucucugguagagggccaggucccaguagguuuuccuauggggcaagcucaggcuccugacacacagcacagggcaggguggaaagcuggucuggaaaagcaaauggaagauagcucggcaugcaguauuaccccucgcaggguauuaucguuaggaauacauuuaaaaguggauauauugguugggugugguggcucgcgccuguaaucccagcacuuuggggggccgaggcagguggauuuccugaagucgggaguucaagaccagccuggccaacacggugaaaccccgucucuauuaaaaauacaaaaaugagcugggugugguggugggugcauguaaucccagguacucgggaggcugaggcgaguggaucacuugaacccaugaggcggagguuacagugagccaagaucccaccauugcucuccaaccugggcuacaagagugaaacucugccucaaauaaaaaagaaaaaaaauggccagggcgugguggcugaugcuuguaaucccagcaauuugggaggcugaggugggcggaucacgagaucaggaguucaagaccagccuggccaacauggugaaacccugucucuacuaaaaauacaaaaauuagcugggcgugguggcaugcagcuguaaucccagcuacucgggagguugaggcaggagaaucccuugaacccgggaggcagagguugcagugagcugagaucaugccacugcacuccagccugggcgacagagcgagacugucuccaaaaaaaauaaaaauaaaaaauaaaaaauaaaauauauacacauacauauauauacauguauauguauguacacaaauuagcugagcguggugaugggugccuguaaucccagcuucuuggaacgcugaagcacaagaauugcuugaacccaggaggcgaagguugcagugaggugagaucaugcuauugcacuccagccugggagugagacagagugagacucuugucucaaaaaaaaaccuuucugugaugagggcaguguucuaauaugugcugucccauauguacccacucgugacauguggcugugugcacuuagauguuaccucagggacugaguuuuuacauuucaguuaauuuuagccaaauggccacauuuggccaguggggacugugcuggacaggucaaggacagccuuguuggaaggaaaauaaagacaccaaagagcagcgugaaaacagugggauuuguucauccggcaggggagagagcacagcacucagcgggccuccaaagagaaauugaaagggcaaaaaggaggaagcaaauuaggcaagacuccgaguucaggucucugguuggcuuugcaaccuucucugcgguugaucugcagguuccaugucaccugcaucaggaagccugguuuccagaauauccgggcuggaugguguaacguuccagcaggcugagccguggcuaugcuuguguugaugagcccgaguuguuuuuccccaaccuguuuuuaugcaccaccccugagccuucccaucugauagcucuggguuaagucucuucaccugucugcccaguuuccgcaacuuuaaaaugaggaugaugaaggacuuacuucacagaguuuuaugaggacugaaugaguuaaucccugaaaaauacuuagaacaguauuuugcaaguagugagguagaggucuugaagguuuacugugaaauuauuuucagguacuuuuuguauuuggcacuaccauaaaugggguuuuuucuuaauuuuaauuuacaguuguuugcggcugguauuuaagaauacaacugauuuuuuuauauuagccugauaacaugccaucuugcucaguucccuucccugggacuuuuuuuuuuguuuuuuuuuuuuuuuuuugagauggagucuugcucugucacccaggcuggagugcgguaacgugaucucggcucacggcagcgucugccucccagguucaagcgauucuccugccucagccucccgaguagccgggacuacaggcacgugccaccacgccuggcuaauuuuuauauuuuuaguagagaugggguuucaccauguuggccacgcuggucuugaacuccugaucucaaaugauccgcccaccucggccucccaaagugcugggauuacaggcaugagccaccgugcccagccuucccugggauucucuguggaacucuguccucucuucuguaaacagggacaguuuuacuucuuccuuuuuucccccuuuauuucagugugugaaaggacauuguugcauagcagugguauguguggaggcccuuuuucuccaucuugggagguaaccauucaguauuucuucauuaaaugugauuagcugucggccggcccuacguagugcccuuaucagggcgaagauguucccgucuguucccaguuugcugagauguuuuguuuuccuccucaugaguggguguugagacggugguaccaccuguugauauagugaagugccugggcugaguuuugacugcuugauguggccuuguguucugagauuaccccuacuaggucuugaugugugauccuuucugaacugcuggauucaauuggguaauauuuuguuaagaguuauuugcaucuauauucaugagggguauggucuauaauuuuauuuuuucuuagugucagauuuugguacuagccucauaggaugaguuggauagugaucucacuuccucuauuuucugaaaaagcuuguguaagauuggcacuguuucuuccuggaauguuacauggaauuuaccaggaaaacaagccgagcuagaguuuuccuuuggggaguguucuuuuauaagaaauuuaacuuauugaguagauacagggcuauucuagauuguuuauucuuguguuucuuuaauaaguugccuuuuucaagaaauuuguccauuucauguaaguugaauuuguuacugaauuugcuggcaugaagucguucccagcauucucuugcccucuggcugucuguaagguguguccugauaacccguugaacauuccugacaguggagguuugcgcucucucguuuuccugaucaggcuagaaguguguuaguuagcuugucuuuucagugaaccuguuuuuuucuguuacauguuauuguugucucuuuauuucugcucuguauuauucuccuccuucuacucgacgcuuacuuugcucuuucugguuucuugauuuggagccuuagguuacugauuuuagaucuuucuucuuuaccaagguagccauuagagcuguaaguuuccuucuaaacacuacucuagcugcaucucuuaaauucugguauuucaugguggcgggcgccuguagucccagcuacucgggaggcugaggcaggagaauggcgugaacccgggaggcagaacuuucagugggccgagaucacaccacugcacuccagccugggcgacagugcgagacugucucaaaaaaaaaaaaaaaaaauucugguauuuugcauuuccauuauaauucaguucaaaacauuuuguaauuucucuuuugauuucuucuuuggccuauggauuauuuagaagaagcuuguuugauuugcagguauuugggauuuuccuagauauuuucuagcuauugacuuccaauuuaauuccgagaauagacccugugguugguauucauauacuuccccccagccccaccacagaagcucugucacacaggcuggagugcagugugugaucaugguucacugcagccuccaacuccugggcuuaagugauccucccaccuuagccuccuaaguagcugguauuauaggcaugcaccaccauguccagcuaaucagcuaauuuuuuuuuuuuuuuuuuuuuuuugguagacacaaggucucgcuauuuugcccaggcuguucucaaauuccuggccucaaguuuuucuccugccuuggccucucaaacugcugggauuacaggugugagccacuguaccgggccuuucuguauacuucaaguaaucucuagauuauuuauaguacaauacaauguaaaugcuauguaaauagcuguuauacuuuauuuuuuaaauuaaaaaaauuguuguauuguuacugguuuuuuuguuuguuuuccagauauuuuugacgugagguuuguugaccccacagauacggaggacugacuaugauuucuucucaauguauugagacuuaugacacaucuuauggucuguuugaugacuuccaccuguaccugaaaacaguguauauuguacaguuguuggauguacuguuauguaaaugucaacuagauaaauguuuugauaguauuguucagauuuuaugucuuuacuguuuuuauuuuucuauuuuuagacagggucucaggccaggugugguggcucaugcuuguaaucucagcacuuugggaggccaagacagaaggaucgcuugagaccagccuggguaacugggagacccugucucugcaaaaaaaauuuaaaaauuaggcacaguggcacuuaccuguagccccagcuacucaggaggcugaggcaggaggaucucuuaaguacaggaagucaaggcuguaaugagcugugauuaugucacugugcuccagcuugggugacagagugagacucugucucaaaaaaaaaaaagaaaaaaaagugucucuuucucucauucuauugcucaggcuggagugcgguggcauauucauagcucauagcagcuuugaauucaugggcucaagugauucucccaccucagccuccaaaguagcugggacuauaggggugcgccaccaugcccagcuaauuccuuugguagagacaggagucuugcuauuuugccgaggcuggucucgaacucauggcuucaagagaucuucccgccuuggccuccuacagugcugggauuacagccaggaacugcugugcccagcuagcucuuuuuaauccacuuugucaaccucugccuuuuaauuagaauuuguaaacauuaacuuuuuuuuuuuuuuuuuuugagauggagucucgcucugucuuccaggcuggagugcaaugaugcaaucucggcucacugcaaccuccgccuccccguucaagcaauucuccugccucagccuccugaguagcugggauuacaggcacacgccaccaugcccagcuaauuuuuguauuuuuaguagagacgggguuucaccacguuggucaggcuggucucaaacuccugaccucgugguccgcccgcuucagccucccaaagugcugggauuacaggcaugagccaccgcgcccagccaacauuaacauuuaaugaaauuauuuauaugguuagauuuaggugcacuuuuauuauuuguuuccuauuuguccccucuguuuuuuguuuguuuguucuuuuucuuuggaauuguugggcuaguucugagcauuucauuuaucuguuggcuuuucggaucugugucuuuguguugugucuuagucauugcucuggagguuccagucugcacaccuguuagccuucacugucugcucagaguucauacugugccccucacagaaacguggggaccuugcagucaucugggucccucgaauccccuccugaccuuucuguugccuuucauguggauuacuucugugcgcguuggaagccaacuacgcaguauuuuuuugucuacagucuuacauauuuaagaacuccuaagaggaaaacaauaguauuuuauauuuaccaauucuguugcucucccuucccuccucaagauccaggcuucccucugguaucauuuuccuucaacccgaggaacuuucuugagcauuccuuauacagcagcuguauuagugacaaacuauguucguuuucugccaucuagaaucuuuauugcaccuucguuucugaaagauauuuucccugcguauagaauaccucggugccucuuuucugacaacacuuaaaaauaucccuacauaaugguuaaaagcaggguggauccuggccuagauccuggaccagaagaaggacgcucuugggaaacugcugagccccaagccccaccuggagcucaguuaguagcggugcagcggcggcggccgcacaggcacggcugcgggggcacuggggaggaaguccgcagggaugccuuugcaccuuguccacaaaucuaaaaccaucucaaaaucagcuguccuguaaaauauauuuacaggaaggguaucaaggggagggugucccauggagagguggcccggcacgggaacucagccagucggagaacagagacccgcuaaagaauggggagcucugggagcaggcggggagguggagcugagggcgggucacagcagguagggguugagcagcuccauaaauaucuuaaagugcauggaggcccgguuucuuauaggcggagaauggaguuaccaagaccacaagagaaaauuagaaugaccccagagugcugaauugggaaugaggacguccugugcacagcuggccugcugccucccacgugucagggcuggcucgggagucaggagaggcugaggaaccuuccagcccaaggagcuggacaagguguggcagcugcaggcagccgggauagggacgcagacuuuccuacagggagaggcacugcugagaccggggcccacgugggaggggcugucggucauggccagucucaaugacacccugguucuggaggggacaccauuuucucuaggaaacacacauggacuguucugggugcagggaaguccagucggcgacugacucuuaagugauucaggaggaaguucuuuguacucuucuuccagcuuuucuguaacugugauugccucagaauuaaagcagaauggccaaggaccccacagagauagugacccccccaaaggagguggcaccuuuucagaggagugaggcuggggagagggaggcguccgaggcacugcgagggaggaggcaggcgguguccccucguugugcucccgcucuggccccguguugaguuuucagccguccacuggggccccuucuguacacaucuuuuguagucaggauggggagcaccuuguaaggucccuccugugcgaccugcugaagacuggggagcucugggagcaggcagguauuugugcucauggugaagggagaggggcuguccucuccuggagggcagggucaggacuuccucacugugcccuuggcaccugcaagguagccggcugucaugagcggcuuguugaaugagugacagcuuaaaugaggcuuugagagugacaguagcuggcacuuagagucugcagcugugccaacccugucgcuccggggauauuuccacccacacuacacaucaggcaccaaauguguggguuuuccacaccaacaauucgccaguccucugcagacaccagccaggcauccuguaauucaguucagucugacccugccgcgguuaucagggaccccagcguuaggggcucagucaccccccacuucagaugcuaauugcaaguagugggucccugggguacccacacuucuguccaucuuggcuacacauugggaguuccuacgaccccuucagguuugaugauuugcgguaguggcucacagaacucaggaaggcacuugguuugcauugccaguuuacuauaaaggaugccacagcgggcacaggcaggcagcugggugaggaggggcacgggcgaggcccagaggguccuaagcauaggagccuuuguccccagggaguuguguggcuggccuuacagcacggggaugaguucaccaaacugaaagcuuuccagagccccuaguuccaggauuuccauggaggccucaucauggagacaugaucaguuaugaacucagccuccagccccucugcccuuuuuggaggguggggguggggccgaaagguccaggcuucucaucguggcuuggucuuuaugaugaccagcccccucccaaggccauccaggagcccaccaagaggugccucauuagaacagaagacucuccugucaccugggaaguccaagggauuuaggagcucugugucaggcaccccuaucgccccugucacucaggaaauuaccagcguucugagagcucugugucaggagccaggagcaggggccaaguguguucuucucauucuaucggugccacagccagggccgcgguugugcagccguguggaucagcucagcccguccucacccagccgugugaggaggccgaggccacacagguggauggccuucccuuagaguuacuuuccagagccugggugcuuagccgcuaugccccauguuuaauauucuuguguuccaauguaacaacuuuaaaauuacacaggauaacacucuugauaacauuuuaauaaauggguguuuuucuuuucaagaaauuuugacuugcacuucagauuuccuuuuuaauauuuucguugagcggaaccuugcuauuccauaagaggauguguccaguguuguggaagauuucauguuuuaaauccuuuguacagaaauccugcucccaagucacagauaggcugacgggucagagggcaagacgugacccagggccgagagggugagugaccaggaaaaucggauucaucaguucacuuguuuguuucagaaacgugcacaaagaccugcugcaugaggcccucgucuucaguuucuguuucaugcccagcauuaaaccaaguaucucauuuugccaauuugacuucuguaggggccauggcaccugcaagguguuucucagcaagauugaggaccguguuucagggcguggggcauugggcuuuguccacaugggcuggccugaagcccagccggcuacugccacagcgggcuucucccaggcugcucucggucggccgugcggaccucgccaagcaucaggaacucccggggaagaagcugcucucugagaaaaagcuggugagacuccuggaguuagagcagcuugccugucuccuccucagaaggcacagggugugguuucggguccuccucugggucucaucucuguugauguuaguugaugaucuuagugauggggcacguggagcuucuugaaaaugacagggugaaacgcaggccugcgugcuaaaucccacgcucagcaaaucccagcaggcugggagaggcgcugcgugcuuggaaagccgugauacaggcugcucauuuucccaugagccuguguauuuuacauguauguuacauauauccuuucauauguguggcuauuucuuaauuuaaaacaaaugcggaggcugggcacgguggcucaugccuguuaucccaacacuuugggaggcuaaggcaggcggaucacuugaggucaggaguucgagaccagccuggccaacauggugaaacccugucucuacuaaaaaaaaaaaaaaaaccuuuuuaaauuaauaaauaaauaaaaauaaaacaaguaggggggaauauaccuuccguuuuaugguucuuuaagccuuauaaguuuuucuuguucuauuuaccaaaaccuccuauuuaaagcaugaauugucucuaauaaauucaagaaaaugcacguuuaugacucccuucguuuccugcugaauggaggggcuccagauaagcauuacugggacaaacagcacuuccaguggaaaagccgcuuuggugggaugugugcucaaauagcugaagcguuagcacaggcuugucuccuccccaggagagaaagugagucgagguuuuguccuccacgaagugcucaccaguggggcuuuccucccugucugguggauuuugcuugcguuggcgcaugacagcauuacacauugaaauuuggaaauaacaguucgugguuuucccacaugguggugccaaagaaucuuagaauguuuguguuuuaaauuuuuaaauuuuuuuuuguguuuaaauuuuuguguuuaaaaauuuuaaauguuuuaaaauuuucuuuuaaaagaaaaaaaaacugcauuugaggaguauuggaucggagugcagaggcagcagcccuggguggcugucaggggcagggcacgucugucugugcacgugggcagaagccagguguccuccccagcguguggugagguugcagcacccugggcugcgggagcugacccuccugugguaggagcuguuguguguugaacaguaaccugguugguucucucucuucauccagauugcaccuaccuuagugaccuacagaacagcuuuccuagccgggcacaguggcucacgccuguagucccagcacuuugggaggccgaggcggguggaucacgaggucaggagaucgagaccauccuggccaacacggugaaaccccgucucuacuaaaaauacaaaaaacuagccgggcgcaguggcgggugccuguagucccagcuacuuaggaggcugaggcaggagaauggcaugaaccugggaggcagagcuugcagugagccgagaucccaccguugcacuccagccugggcgacagagcgagacucugccucaaaaaaaaccacaaaaaacaaaacagcuuucccuccagcgaggggcucuguuugccucaccacauuuuuuaaaugagcccuguuuucaucaggccccagaaaauacucuuucuucagagucgaaagccugguaauuguccaggaacgauucuaacuuccuauuucucuaucgcauccugggaaacuagaacuuucuaagaguaaagaucuaugauuucaggaaugguuuuuuugaauggaaagacacauuauauaaggaauauuuccuaaacaagauguggguuuuuuagcuuagaaaugcugauuuuuguuguugguuuuuaaaucagucucacccagaguaagaaaugcugaauuuuugaaguguagguccacacagaauacuuacaucugcauuguggauuuaccucagucuacaaaugcaacugacuuguggagacuguuuuuuaucuucggaauuuagaagugauuagcaauauuagugucauuaaccucuaauuuuaauaggcuguuauagauagaagauguacaucucaaauggaugcauggugucuugaaaggaccuuggaguguugagaugacgugggauauuuguguucucuguagaaaagguacuuuguggacuaucggagagugcuugucuguggaggaaacggaggcgcuggggcaagcugcuuccacagugagccccgcaaggaguuuggaggcccugauggaggggacggaggcaacgguggacacgucauucugagaggcaggugcccuggggcagugcagcgggguugaggaggggccccgagacugcaugugcauuugaacuaaaaaccugauguaugggcaggcacaguggcuuaugccugugaucccagcacuuggagaggcugaggcaggaggaucacuugagcccauaaguucaagaccagccuggacaauauagcaagaccaugucuuuuuuguuuguuuguuuuuuuguuuuuuuuuuuuugccucaagguuuguggaucuacaaaaaauuuuugaaaaaauuagccagacaugguagcgugcaccuguggucccagcuacucaggaggauugcuggaucccagaaguucaaggcugcagugaaucgugaucacaccacugcauauuccagcaugggugacagagcaauacccuaucucuaaaaaaaaaaaaaguaaaauuuuuaaaacccagcuaggcgcaguggcucaugccuguaaucccagaacuuugggagaccgaggcggguggaucgcuugagguccggaguucgagaccagccuggccaacguggugaaauccugucucuuaaaaaauaauaauaauaaccagaugugguggcacacacugauagucccagcuacuuggggcugaagcaggaggauggcuugagcccaggaggucgagguugcagugagcuccgauugugcugcugcacuccagccuggccaacagaggaagacccuaucucaaaaaaacaaaacaaaacaaacaaacaaaaaaaacccugauguauggauaucauuuuuauaaauuauauggauauucagccgggcgugguggcucacaccuguaaucccagcacuuugggagaccgaggcggguggaucgcuuaaggucaggaguucgagaccagccuggccaacauggugaaaccccgucucuacaaaaaauacaaaaaaaauuagcugggcgugguggugggcacuuguaaucccagcuacuagggaggcugaggcaggagaauugcuugaauccaggaggcagagguugcggugagcugagaucgugccauugcacucuagccucggcaacaagagugaaacuccgucucaaaaaaauaaaaacauaaaacauaaaaaaaaaauuauauggauauucauaguuaaguagcacacccaaaaaagcaacuuugaggccaggcgcaguggcucaugccuauaauuccagcacuuugggaggccaaggcgaguggaucaccugaggucaggaguucaagaccagccuggccaauauggagaaaccccaucucuacuaaaaauagaaaaauuagccaggcgugguggcagaugccuguaaucccagcuauuugggaggcugaggcacgagaauugcuugagcccaggacacagauguugcagugagccaagaucaugccacugcacuccugccuggcugacagagcgagacucugucuaaaaaaaaaaagaaaaagcaacuuugaacauguuuuguuuuguuuguuuaauuucaggagcacagagaguuuccugucagggaagcugacaugucggucgcgugaaagcacgaggccugugugguggguucggugggugccgcuggcugcugguuauauucacacucagcauagacgcauagcgagcugggagugaagccuucacaacaaaagcauagaauacagcuacuguaaaaaauaagaaauuuaaaaauuuucagaaaugauagcacuuuuugaaggaaaauaaggauuucauuuuuaaaaaaucacuuugcugguuuuguaacuucugcugcacccucacuccaugcuuccauaccuauuuuuaagguucuuaaacuggacccagacacaucagcaauaggccaugguugucguaacacaaagggacugagauucuuguucuugcuuuaguugaccagcaagucaagucccugucgucgguccugucgcgguaccaggguuucaguggagaagauggagggaguaaaaacugcuucgggcgcaguggcgccguccucuacauccgggugagccgagacugccggaccuggcccuguccccguuguucuggaucauccagcuccugggggccaccgugugacccacggggccccuguggcuugaugcccacagcuaggaaacagcacaauggaaacggaggcuggcagacagcgggaaagcagccccaccccucaaagcaaacccagacgggcauuuguaccagggucucacaccaugugcaugucuagugaaaaagucaugaaacgauucucuuuuaaaaagagggagcccacggcacggacgcuuccuccgucucugaccccaugagccgaccucugacugagggaggccacuggcacccagcgggccugcgucuccuucgcgagcugaauucacucgucucuuagauguuuuuucuggugcuucaguucacacuaacguuuuagaaacacuauuugaaaaagcccuuugugcagucagaaggguguguacgcagccccgugaaagcccuggagcacugggaccuuuuccuugugcuccggagcuguuggcagaggugaguggggcgggcagcugcccggggcacaguccgcucuugucuucuuuccuuagcgcuugcuucaggaauggguuaaggccuccuuuccucacugcugguagagcucagcugaugagugccugcuguuccccagguccccgugggcacgcuggugaaggagggaggcagaguuguggccgaccugucuugcgugggagaugaguacauugccgcgcugggcggggcaggagggaaaggcaaccgcuucuuccuggccaacaacaaccgugccccugugaccuguaccccuggacagccaggacagcagcgaguucuccaccuggagcucaagacgguggcccacgccggaaugguagguguccccacugccaacagcaucugcacacacucagcucuagaaaauccacuuuucucaauggggauuugccaguggccuggaagagaacagcuuugcgacucaccuuuuucccaucaguacacugcugacuuggucgugagcaugagcccuugugacucccccagcccugaaauccucccuccaaucccaguuaguuacagacucugcgcuaacaaaggugcugccgcgggccgugccaccgucuucccucuuucccccaggugggauuccccaacgccgggaaguccucacugcuccgggccauuucaaacgccagacccgccguggcuuccuacccguucaccacccugaagccccacgucgggaucguccacuacgaaggccaccuacaaauagcagguagaacuuccagaauucucccaaagguuagauuuaaaugauguaauucagaaaaguaaugauguaacucuuaaauuuagcuuucuguuuaaaauguagcauuguuggccaggcgugguggcucacaccuguaaccccagcacuuugggaggccgaggcaggcggaucacgaggucaggagaucgacaccauccuggcuaacauggugaaaccccgucucuacuaaaaauacaaaaaaauuagcugggugugguggcgggcaccuguagucccagcuacuugggaggcugaggauggagaauggcaugaacccagaaggcaaagcuugcagugagccgagaucaugccacugcacuccagccugggcgacagagcgaaacuccaucucaaaaaaaaaaaaaaaaaaguagcauuguuuuuccuaauguaaacaacuuuuuuuuuuuuuuuuuuuugagacggagucucacucugucacccuggcuggagugcaguggugcgaucucagcucacugcaaccuccaccucccauauuuaagugauucuccugccucagccucccaaguagcugggauuacaggcgugcgccaccacgcccaguuaauuuuuuuguauuuuuaguagagacgggguuucaccauguuggccaggcuggucucgaacuccugaucucaagugaucugccccccgccccaccuuggucucccaaaguguugggauuacaggcgugagcuacugcaccuggcccuaauuuaaacaauuuucaucagccuguucucuaugaaaaucagguucccaccccauccccuaggaaucugucaguuacaguucagaaaccugcauugaaauuccagccgaggacaguauuucuucccacucuauuuguccccucucaucuguggaagcucagcagcaucacaacacgugacuuaaaagcuuuccuugugccguuugagagaauaaaacuuuuucccagaagacaauacacccauuaaaaauaguaagccugcugguaagguuauuuggauggcacuuuauaucugcagaguacucuacauguaaauuucuaucaguaaucaaaugauuaguagaguacaggcagccauuuuccucuuuuuugaauccuauuagaagcagaaagagaagguaugaaauguacucuacuagauagauccaucgccacgcuggucucccaaacaucuccaagcauugaauuccucaggugucaguuggcccagugaaucacccaggugcuaaaucaaauggcuucaguucaaggcguuccuugaaaggaaaguguuagaacucaggaaauccgccuucgcagugggcuccaggccuucucucccaggcucgagguggaaggcgcucuugggugcugggugugccaaguggucaccucgugugccccugucuucccugcaguggccgacauccccggcaucauacgaggcgcccaccagaacaggggucugggguccgccuuccucaggcacaucgagcgcugccgcuuucucuuguucgugguggaucuuucucagccugagccguggacucaaguugacgauuuaaaauaugaacuggagauguaugaaaagggccugucugcgaggccccacgcaaucgucgcaaacaagauugaccucccugaagcccaagccaaucugucccagcuccgggaucacuugggacaggaggucaucgugcugucggcguugaccggcgagaaccuggagcagcugcuguugcaccugaaggugcuguaugacgccuacgcggaggccgagcugggccagggccgccagccgcucaggugguagccacgccagagcggggucgccucugggccucugucugagcaaaccugggugugaauucggugguuuugaaugcauaaagugccuuguggacacgggggaguuguggugcuucugggucucugggccccgccugcuggccugagaugcccucauguugggaagcauuccgugcccccuaccccgccugcccuccguauuuccugcaccugucagccugcaccgacugaugagccaguugcucauuugugcugauuaacaccccuaauaagggguuggggugcccauaacgggguggcccugccgcugacucaggucuccgccaugcacgcguggacucucggaugagcucagcagaaccgcacagccagagccccaggucagaagugcagaccaggguucucagcacagugcccgucgugcuuccauggcuugcuacggagagagaccucuggauccacacuggggcugcgucuggcccguuguccagcagcccugcgguaccgcaagcccaggcaccagugucucggggggccucacugcugcgcaagggguggggccgaggaugcaaguccaggcagagcggcgcaggcagcugugagcuuuucuccaucagccgucugagaagagcagugaggccagcugcuuccuguccuucagaacacuucucugugcucagugggagccaggaagccucaggcuucacgacugaaugcacccaauauccgaccuggcugcguguuucuggcugggcugccgugugcacagcaaguuaacuagaggggcugugggccauggaacugucagcguuauucucagaaggcggccguggcaugggcaggguauagugaggaguggaaggagacgugugccugguaauauggggcggaauuuccacucagcuccauuugcuggggauuuaaagagaacccuugugcuacgccaggcaguuaccgagccgaagggagaugaugggccuucgccccucagugggauggcagcugagggggcccugcauuugaccgucgagacugcagcagcgccuuuccugucugugguuuaagucuuugcagucaaguacugaugcauccaagccaggcccaugccuggugucucccugacugcagaggagccccagggcaaggacagcucagcugcuggcagccugccuggcccauagacaucccccaaguagucucaggccucugacaugucccugaggggccccuaagaaagaaaguggaggggacacuccagaggcugucgugggaggaucaugugagccugggaggucaaggcugcagugagccgugauugcaccacugcacuccagccugagugacagagcgagacccugucucaaaaaacaaacaaacaaacaaacaaaaacagaacauucugggcacgguggcucaugccuguagucccagcacuuugggaggccgaggcugguggaucacaaggucaggagauugagaccauccuggcuaacacagugaaaccccgucucuacuaaaaauacaaaaaaauuagccaggcgugguggcggucaccuguagucccagcuacucgggaggcugaagcaggagaauggcgugaaccugggaggcggagcuugcagugagccgagaucacaccacugcacuccagccugagcgacagagcaagacuccaucucaa

SEQ ID NO: 191285 - RNA, 15951 nt, Homo sapiens
uucuuuuugaauaguuuaauaguuauuauuuaaauaaggcuuuggcgugcuuuuccacauuuuuagguuuuuuucucuauguguacaccuugcaagauguaucauuaacucaugaaaccaccagcuccucaggcaacgaaaagggagguagaaagaacgccagaaaggugggucuguguguucuggggugcguggggcccgcccccgaggaaggugccaaccgucccuggagagcagaaucaccaggccugggaaagccaugcggguucgagagccugcgccauggccaugcugggcagggcccaaggggugcccaggcgucugcccacugagaacacuguuagugcggagggauccacaggaggggagagcggcgccagggucccggacacaggcaagggucucuagcccgccacccacccacugcccugggggucucugucaggcuucuaggagacacagagacucugaggucgugucucgaggguggcuaccuggggaggcugggcagagucuggagacauuucuggcuguugucugacugggagcugcuggcuagggguggguggaggccagggauaccuuuaagcauccuacagugugcaggacagcucccaccaaggaggacagcccgccagagacacagcaaagugggcugggauuggggaggcugcagccuggugccagccucacauuggcaggcgggcgcugcaggaggcuugcggagaacacggcgaccgagggagguuuggcgggaaccacgcggaacagaucguggugggaaugaggcugcgccuacuaacaauaaccccacccacccugacggccacaccagccugugaggaggacagggccgagcccgcuggcagguggggaaacugaggcccagagagcagcgagccuggucuggacccaggcccaccccacccucccaccagcuguuguggacucuucuuaaggagcuucaggcuccacagugguuuguguuccucucugcucgugugucugacauggagugaccaagucccacacacugaguccccuguguccuggggcugcuggcgccuggguccuuggagaggcugugggguugggagcuagagguccucauggguagagcucagguccacccucugagccuguccaaacaccaggaaggugcacagccccagguugcugaugauggccacaagguugaacaggcaaguccaggagcccguggucuccaucaaguagccgccuagacacacacccacgacaccugcccaagagagggccaggcgggcugagugcucccgggcagcccaggccccacaccccacccugguucccaagguagugccaggggaagggcugggggucuagcgccugauaggagcccccaugguucccagggcugaauucagugucccagcugugggucaggcucagacuuggagggucuuggaggggcagagaucucacaggccauccagaaaauggccugguaacaaguccccuuugucccgcugaaaggaaaaugggagccacaggccggcccaggcgaggcugagcugaagaaggacccccaucauccauggcacucagcggggccaggaggugucccggggacccugggcuaccaggaugggaacauaucugugagucagggcagauggcgacucaugagccaccugccgucagcaaaguccaguggaaccuggaaggcagccccauccuccucuccugggccugcucuggggucugugcccuccucugacacccggacccccucugaagggaggcacaaccccacccugcagcaccucgguggccucaaaccccacagacaggggaacuccugggcacagaggcccgccccucaccugccaaggccccggcuguguuggccacaccugugaagaggccagagcgagagagaauauggauggucagcaaaagcccuccgggaucccccauggcucacccacccggaggcccagggaggggcaaagcugggguaaggcaagguccucaccaaacagaaagccggcgcaggacggggccaaguccuggauguuaacagaaaugccacuguggggaggaaagaggguggugaguggcccuggccaccaccgagcugguggcccaggguugucacaggggaagcggggaagcaaggucucguggagccacgggaggggcugggacacgcucaggccugcucccuggccagagcacugcagcccugcacaccacgccaacccgagccccaaccacccacuggccagagcacugcagcccugcacaccacgccaacccgagccccaaccacccacuggccagagcacugcagcccugcacaccaugccaacccgagccccaaccacccacuggccagagcacugcagcccugcacaccacgccaacccgagccccaaccacccacuggccagagcacugcagcccugcacaccaugccaacccgagccccaaccacccacuggccagagcacugcagcccugcacaccacgccaacccgagccccaaccacccacuggccagagcacugcagcccugcacaccaugccaacccgagccccagcugcccgucuucauggaggacccagugcaggaagcgacuccuuagaguaaagugcuguggggaaagcauguucgcacaaaucacgcgcacgugcugcucacugaagugaauugcugguuccuaaagaacuacugggucuucagugcagucacugcccagcagcuugggaagggggugaagugugaggaagagacugagagaggcggacagagcucccucuucacaugugcgggccucggccgugcgggcagcacggcgcucugguggauggagcagucggcccucaccugugguugaaggucuggaggccgauggaggcugaugcaaagaccacagacucacagaagcuggagguguggcccaggcacagagcaaagacgcuggagaggccaaggcccaugcccugcaggaaagcgccaccgugacggagaggcacccagcccgccugcagcagggcccucuccugacucagcugcccgaaagccccccugggcgcaccgcacaacggucagguuggcugcgaccacaaacuucucucagaccaggcccccuagaggaggucugggaggagucuccgcaagaaucagccccgcuccaagggagaggcccuauucgacgugggcaagcucaggccugggcccagaggggcacaggaugcugaccccagccuuccccccaacagcugucuaaacagccccuucugggccccagugcuggacacauggagaggccuggcauuugccuggucccagauaucaggugacuuggggacacaacccugaguuccugggagacccugaacaaagcagggauauccagagagaacgaccggaaugauucuccuaccugcaugagcuuccgcaccgugauggcucuguaaccuacagggggaggccaaggaaggggcucccguuagcccuuucgugcugacaccccagagggggucccaucccgaauggcugcagaggggcagcaggggaggaagaggcuuggggcucaagacagcuaucccgugcugcaggcaaaaacgugugcacacacgcauguggggugcagccgcgaggccgcaugugcgccuuuggaagguucccaaggcguggguuugggcagaaacacagaacagccacacagcaguuacagaggcggaaacaggcgagcggccccacuuccucugcugcuccagauuuucuagcuuuuccacaacgaguguguauuccuuuugcaauuaggaaaaacacgaacauucuaagaauaggcacacguguggagagagcaugugggcacgcgugugcauccgccuguacgugucugugcagcggacacugcacuaggggaagaaacacgcagcccgcucggggcucaucccagcgugggucuggagcacauggaacaaagacagaagcucuuccaaagguucaaggaugcuuguaaccucugaccccuccaggugccuuccuggagggucaggggcugcauccagcccccaggggugagcuccacagucaccgugagaccagacccuccaccacagucuaaccccacccuuuaaggaggaggccgagccuggaaagaagugccccucugucccagcucuccgugugcugaagcugcagccccaggaugggagcauccugccccucgaaagcgaggugaaccaggguguggcuuccagccccgguccccucccuggggcucacccugauugaugagaugaucagagagaaacccgcugaauagacuggccggaaucgccaccaaccaaggaaccacguugaagauccagcccugcaggggggaguuuggccuuagagggggccagggccggcaucuggccaucuggaagaggauacucaggcuggacagcgcccccgugcccaccacugcccaggaaagcucuccggcagggccagcccugcuccugggaaugugcagcucuugaccaccacccggcagggcagcaagacagccucagagaaggaaccgugcugaccgcaggugaccccucuguccacaucccggcuucugcaccggccuccucaggcucugaagucggguucugugggccagcaggucacgaugagggcugggagggcugcagccgcagcaggaaggcaccgagcgcccgcaucauuuccagccucaaacacagaaaccugccccgagcauggacgggguccucuccagaggaagagccuggcagugccaggacccucagaguccaggaggagccgaggguuccaccaucugcaggccaaggacccacagugccuggugcagcucaagccucgugccuucugggcgcuccuucacccugcgggagcccccgacucaccuuggcgucggggaaggucuccucgaagaaggugggcagccaggagaggaggaugaagaaggagcaggcugcagagagcugggagacgacggcugcccugcggggcccaaugguggaccgugacucuggugccgcacgagcuggccgggccugugggacccaccccgagaggcguccccugggggccagagucccacuucucugagcccuaggcccugcuggcucaagggcugucagguccggccagguucacacccccauggucaccggcccugccgcugcuccaagggguggcacaggucccagcucaccagacagcaggcuuccggaagagccgucuccaggggacucuguugugccuggacaccggccggcuuugggccaggacacccaaggccaggaugagaucugagggagcaacgguuucaaacugauggcuaucagggcgggaggcgccacccguugccaaaggauuggggauuugggggugguuccagaggggucagcaggccucguccaugccucagguugcacaugggcgccagccucccuuggccuccccuaccagacaccuaacaggcagcaucaccuuugagaaccgcguucugaacgacccuccacacggccuccuccagagcccccuggccacccaaagacucggcugcuccugcacccugccuugaccugugcccagcaggucuuccugggugucugccuuagcccuagauggaaccuuccagaucgaauuggguggcggagccgcugacagcucagcacccgagcgcuuuuccucacuggcggauucuuugggaggucaaagccaucgucuccgggcuccugcuccaggcugcucagcggcugccaccaggggaggaggcacugggcagcugugggcgcccgggacuagcccgcccggccugcguuaccuuuuucacucagcagguaccuguacacguaccacacccaaagcaaggugaggccgccggagaaauagaagaugcucugccagccguaccauuccaggagcagggagcccaccgccccggucagcagcguccugcaaagacagggggaguguggccaggccccucagcggcaccccucgggugaggaggggccucucagaaaccccacccuggugcaggcugagccccuggagaagaggguguuuucaucgccuccagaggagcagcucagaagccaccguccuggccuguuuuguuaaggacuucggguacucaggggagacuccgggcacacagggcuggggcgaaccugggaccagccacgcaugugucccagucgggcggcugcuguggaacucacauuguuuuucacaucuugcuucuaggccuuccaauuggccuacaauuugucauguggauccuuuucaacuaaaaacggcaccgaggaggagacggugaugagcauauaccacagugaagcuccgcacgguuuuugugcuucaaacaucauugaggacaaaauucaaaaagacuucuggaugcaaaaauaccaugacggccaaauccaacaacccccaucccguccccaugacuucauugucccaaauagccccucagaggcucccuucugggugcaaccuggcuggcggcccagcccccaucugcugcugaggccccuccacuggcaccagggggaauaguuaacaucauggcaaaaggaggaagagagagagccccaaagcggggccuggcauccagauggggccuccuuccucccgcggagccucugcgggguggacacagcuccugggguagcaagacuuggccuugggcaccagggcgggcugggguagcacucucccugcccagcccagcccacacuugacccugucucugcuccccaccugggugcagaaaaaccgcaagacacucaaugaaaccggguuucggagaagugaggauucauucuuuaguagaaguauauccccuccgguuuaugugaaauucacauuccucugggcagucuguuuuuacuugaugaaucuggucacucuaggccugccugggccugcucccggccccaccuacaggggccgccuccgccccucugaaccucagcaacaguaacacgagggccugagcccagugauugggaagccccggucagcuccugcaccaauccacccugcuacaaccaccgggaaggccucccaccccuggccuggccucgauccaggccgccagcaucgcuagagggucuggagcuccccaaggagcgggcgcagggagggaggacugaggggcacgggguugccgcaucguggaugaggacaagccgcccuccagccagcugauaggcccacccugaggacaagccgcccuccagccagcugauaggcccacccugaggacaagccgcccuccagccagcugauaggcccacccugaggacaagccgcccuccagccagcugauaggcccacccugaggacaagccgcccuccagccagcugauaggcccacccugaggacaagccgcccuccagccagcugauaggcccacccugaggacaagccgcccuccagccagcugauaggcccacccugaggacaagccgcccuccagccagcugauaggcccaccgugaggacaagccgcccuccagccagcugauaggcccacccugaggacaagccgcccuccagccagcugauaggcccacccuggcccagacgcuccugcgcucacagacucuccugucgagggugggggccagcggaugguggggacggcaucuggcaucguuagcacagaugaaagaaaaugagaugauguggccacuccuccaacccauguccccaagucccagccucaucaccugccagccacuccagaaaggcagaaauaugcacaaagcaagcgcggugcccggggcugguaccugcagagcacagccucgggcuacagagcccaaaaggcgccugcgggacccaccucaccaugguggcccugcaagcccauguggcccaucccccacgcagaccaggggccacucggcaaggggcucaccugguggccucuccugggccccgucuuaggccaggacuuacccaaacugggagccggcgcccacgaugcuguaggugaaggcucgcucacucucccgcaccuucugcgacagcaggcuggucagggcagggaaguaaaccccugcaacaaguggagggagggucucucaggguccauccagggaggcuccucccggccuaucugcucagguuugggcugugauuccagaggacguccaccugucccucuagcucaccuccccacccgagggaccagcagggcagggcuuuuggugccacugaggaaacagacuccuuuugggugaggcucgcucagggucgugccacccgcacggcugagggaaacaccccugcuuccaagcuagcccucccaccccgcgaacacgcacaugcacaugugcacacucucaccaccggccuccagcugugcucuagaguccucgcaccaacacacacacaugcgccugcacacgcacguguucaccggcacacuucuuggcagugcugcauugugcucacacugaugcagauacacgcauacgcaugaagaugcacaccugcgugcacagacaccugccgcaugcgugcacagacacauacuucccccaagaaagcugcccuucccuguuuuauaaacugagcuuccucccaggauuucuuuuggaccaaguguucucagccgcuuuagaaguuuggaaaccaccuuaccaccccaugcagcuccuccacauccagagggcucugagccugaccuggagggacucugcgaggggaggcaccgcggagccacggugacaacaggagcuugucccccaaacccacgggccgugucuacagggcgcugaugcuacccugcaggggggcaucgucaaacagacggccacacacaggaagcgccugccuggccagcgccuguaacuuuuaaccgcagagcgcucacucauaggcucacggcucagaggcagggcccguucccucgcucccucgagggaggcugggggccgccuggcggagcuccuggggcucccuccagaaguccgaugccccgcagcaagagccacaggucuugggacaccuggcgucucugcucugcccgaagacagcgugcacaaacacggcaaagccagccgcagguggugcccaccguuaccacgcagccgccauugcugccccccagacccccagaguaggcucaugggcacaggaugacaucugacauugagacgugccagacuuugaagguuucuagaaaacagaaugugccucaggugccaagucaucguagcacaacaagcugggccccgcagaggaagcgcagcuggagcggcagcgagccuacggggucuggcugccugcuggguccccagagcugcccacgaggacagccgccugccccagggccgagggucuucucagcgacacuuagaggcauuggucagcccaguccgaggcagcaccacuguuuuccucacagcuucagccuugggacccuccucccucaccccgaagacccuccaguaaacaaagaugagggcccccaccccccgccaggccuguccuccccuccaggugguugccgauucguucauuccuccccuccuccuccagcuccugcagugggaccugggcagugccuggggaggcggugaugcuggaggggcuggcucugggauggggccucacaguaaacacacaauccuaaguccucaguugcacucgcugcacccucuucugagggugggccaugcacugggcccuuguucucaugugacaccccgugaccaugagaguggccucucuccugggcagacccccuuccucuguuauggagacagucccaggcagcaccuuccaggccauaaccuuggggagugaggguguggagagggaggagaacgaggccugggagugaacuccccaaagucucuggacuuggaggagagggagggcagagguucuaggggagccauggccagcgcucugaaccugaugccggcucaggaagguagggggaguccugaguggggggucuggauggcccaggacacugggggaggaguggcccaggcagggaacugcugaugggugggguggccaggcaggcuggguuggggccagcaggccccugcaggcuggaggccuggcuguuucuccaggggaccccagccaaguaggggccccucaaagcccccuuggcccccccacccaccuuguucuccugacaguuaaggcgcuccaaggcccuaguaucggaggcaucaucagcauacgugugaccaaaaugcacaaaacccagagucccacagcaggucccuugcagcuggaauccaccacugaacuaaggcguuuggugacaaaauucaggggcaggggcaaguucacuacacaggugcccccugugauccuguguaucacugcagagugugcaccuacagaaggcacacacauggccacacguacacccucauacgggcacacucacgcacguacacacgcauaugggcacgcauacgcacauacacauggauacaggaacgcacacacacauacacaugcauacaggcaugcacacgcaugcauaccaccugcacgcacaagugcaugcucacacaugugcaugcacacauacguacgcacacgcacaagcacaaacauacaugcacauugcuugcauacacgugucugcagggacauaugcacuugcacacgcacacacacacaggugcacgcaugcacgcgggcaugcccauacacacacuugcacacgcacacgcacaggugcacgcaugcacgcgggcaugcccauacacacacacuugcacacgcacacacacacaggugcacgcaugcacgcgggcaugccauacacacacuuacacacgcacacacacacaggugcacgcaugcacgcgggcaugcccauacacacacacuuguacaccaccugcaugcacgcaugcaccugcacacacauccgugcacaccccccuugucuccccaccuggugccagagagcgugagggagccgccugagcuccccuuaccuuggagcaagcccaugaggaugcgugagaaggucaugaaggccaggugggcacugcucaggugggcgagcaguggggugacggccgugauggagccccaggcagaggcugacagcaggaugaccuucucacccccaauccuggagggaagacagagggaggugaggauguggcugugcaggaccaaggggcaccacccugacucagggcagcccuugagugggugcucagagcugggccuggccugucugccucuacagggccugcucaugaccccagagcugccucgugaggagaccagguacuccaggggagcggccugccuccucugccugcagggcccuggggccuugccaagccuggccucuccccucccagcucccaucuuccucugggggggucuucugcccagauuuauccaccaagcuccuuccccaggagucgcauccucuguguccacgaagcuccuuccccaggagucgcauccucuguguccaccaagcuccuuccccaggagucgcauccucugcgugcagcagcacagccagcccacucgccccuggaggccccaguggggcggcccccaccagccaggagauggggaagaugggcaguuaccgauccccgagguggccgcccacaaccugugucaggcaguagccccagaagaagcugcugagcacgaugccggccuccuucuuguuccagccgaaguccuggcucauggagacggugcagaugggcaugcuggagcgggcgcaguacagaaggcaugugcccagcagcagcguccccguccaugccuggcacucgggccugugggacaggagauggucaggcccuggggaggccccacggcccugcugcuucgaguucaucacucagagaccucccucagggcugggggacauggacugugaauggggacagcuuugauggagggcaacuuggcaagcauucaaacaccuaaucgcaccuaucugcugaccccugggagaacacaggcagccagaaaugaggcacaguggcuccugggagcaacugaguggccagcacucgggcaggucacagcaacgacucauccccacaaaaggugccugggccgggcccugcuuguuccccucaaagagaacaggggagagggugaccaggagauggguggcagaggagucggacacuggagagucucaccccacccuucccaaaagguccugucugccccugcggggagcuggcugcaccccgggugugugcucccaagaaccugccccagaugagugaguggaugacggugugcuguggacagaggggcagguauacggccuucucggcacucucugcaagucugcgccuagacgcuucccacgggagaaaagaccaccaagucgggcacugaccaugcccgaggucacagagccaggccggccagcucacacucccaauccuggugagggaggccgggcgagaucucagaggcaagaacaggucacuccagcagcccagagcugcguccucugacaccuccugcucugccagaggcuauccuggcuccagccccuccccacggcagggccaaccauuaaccccuggaguuuggagaaaguugugugggaggaagugcugucuguccuggaacuuggcagugagugugguuucgccagcgucauuugcagccagguuccacucuggggacaacuggcuugccccauaucuggcugcucccuggguuaccacagaaggacacaguccucacugccaggcugccuaacccaguacagcccuggccuccacgcccuguccuggcgugguugauacccgcagcccuguuguuuaccuagccccaggcucucuguaaacaguuuucauugacuuaacacacgaggcuugcagaagggacaugggggcccccacccuuaacuuuccacuaaaagccacacaguccaaaggugccuuuaaaaaggagcuuuagagccagguacgguggcuuaugccuguaauccuagcacuuuaggaggccgaggugggcagaucacuugagcccaagaguucaagagcagccugggaaacauggggacauccucagcucuacaaaaaaaaacaaaacaaaacaaaaaaaaacuuuaaaaauuagccagggccgggcaugguggcucacgccuguaaucccagcacuuggggaggcugaggcgggaggaucacaaggucaggaguucgagaccagccucgcccacauggugaaaccccaucucuacuaaaaauguaaaaauuagccaggcguaguggcgggugccuguaaucccagcuacuugggaggcugaggcaggagaaucgcuugaaccugggaggcagagguugcagugaaccgagaucaaacuacugaacuccagccugggcgacagagugagacuccaccuagcgagacuccaucucaaaaaaaaaaagaaaaaaaaacaacaauuagcugagugugguggugugcaccuguggucccagcugggaggcugaaguaggaggaucgcuugagcccaggaggucgagguugcagugagccgagauugcaccacugcacucuagccugggcaacagagagagacucugucuugaaaaagaaagggggggaggugggggaccuguguccagguggcaccugccccgcacugccuggccgcuagcuagaaacagcagaaagcucaguugcacugauccucacccccauugaggccagcacaggacugagaacacagagccacuccagggccuccuuggaaggaggaagucaagaacagcccuuccaggcaagcaaucugcccuacguggcaggcggcagccacagccccuucucugagcugggcagguggugcuggccaggugggcacaggggcacccuccacagcugccggggagacaaggaugucaggcuggagaggauggcccagacagucggcuaccugaggccugacuaggaccccaggcugggaauccuccauccugcugggggcgcgggggacggggggugugccaagaaccggaaagcuuugggcagcuugaacagcuuccucccaccacucugcacucccugagcccagcagccugcuuccugugaacuuucuagagcaaacggccccugugcagaagcagcauccacggcugagcaaacagguggucacauggccccuccauucagaaaagggaacugugcggggccgggccaggcgagcagcaaaccggagagugugggugccgcccuccagcucuguucucgccuggcccagccuuugugauguggcugcaggagggcgggcuaggaaaaggcgugcguguggcagccuugacccacaggccccuccagaauccuuggcgcuacccaauaagggccugcaaaggaaguugaagagcuguggcaagggcuccuuuuuaaacaucgagccugggagggacguagugaaggcugcggcaagggcuccuuuuuaaacaucgagccugggagggacguagugaaggcugcggcaagggcuccuuuuuaaacaucgagccugggagggacguagugaaggcggagccacucaaaccagccgccagugaggaggcccugaaucccuggggagcuggcccugcccggcaggccuggaugaacgugggugggggaagaggaagagagcaaggggcagggcccgcugagggcagcccuccccucuaauuggcgccugacagggcugugaucugggcugccagcuuuucccaugcagccagcgcucccuucaucugggugccaacauccgaugguggcacugccccuuugggccuuccuacaacucuucccagcacuucuaggguccucagcccucauacagcugggaacugguggggccagaaggugccauuaccuugccauggucaggguagguacccuggggacucagugcaggcaggagacugcucuggaacccacagggccugagucuaggcccaggguccagccacuuaaggccucagcccaagacccagagccaagggguucagcagugugggggcugcucucaggagcucccuggcagaggcccuccccagcugaccaauggcccgcggucaccaucucgcccgguuucugaggcgucaccugcccagggagccuccuacaggcagcagugcugguggccaggcgaccugcccaggcccugcuucuccccaccaccaaaugcuccgagagcugaagccagcggggagcucguccucagcacacagcuggcacgugguggcaggaccccccccaaccccguccagcugcaggcuccagcccgugcccccuaccuggccuccugacuguccuggcgccugcuugucagggucaugcauacacagggugguuccaccuggcgagggguaugccuccugacuguccaggacaaugccccuggccuggggaacauagcccugccuggaagagccccaggaacacuggcugggauagggcacuugccagguccgguccuggaaucucauggcagggaggaaggacagggcacucacuuccuuccaccucccacaaggaacacagggggccccacagccagaggagcccgcccagcucagcccuccccaccuagcaucgucccacguggcaguaucucagcucccuccccacggccccaucuccaccgcucccacccccccuccccucacccccgccacaccuggaccacuggguguccccggccaugucccugcgggccucgucuggggguggcugcaucgggcuuggggugcucagacggcgugggcacagcugugucccggggcugccucccagcccaggcugacccacccgggcagcaccgcccaaguccacgugucagucccagcgcgcuuccgucugguucucucaggacuugucgcccccagacggccaccagggcgggcaggcggggcagggcggg

SEQ ID NO: 191286 - RNA, 40930 nt, Homo sapiens
gggagcgcgcgcgccggugcgggugcgugcgugagcgugcucgucuccgcugccgcugccgcugccgcugccggugccgcacccgcgcccucugccgccgccgccgccgccgcccggggucuccaggcugaggagugcgucggccgcugcccagcagcgccgcgaaucggggagcggagccgcggagccggcgggagggcgggcgggcgggcggacgggcaggugagcucgcugcgggucgggcgggcggaucggcccacgucaggcccgggcaggcgggcgggcgggcgcggguggggggcgggggcggcacuccagagccggaaauggcggcgacccccgggccggggcugcgcgggcgcucggggccggagcugcugcgacgccgcggccugggccggggcgggggcgcgggaaggucggcgccggggccugcgggagccgggccgggccgggccgggggucugagcaccguggugggggcuggggcggcgcucuccgcgggucucuucgggcccggacgcccccuccgcucccccagguccccgcggccgcccccaaccccccggggucuccucuccugcggggggacuggagaagcugggccaucgcuggucuuagggaggcagauaauuuagucccugggucguuguguuuauagcucggggaauugaaaauuguucuguaacgcaucguaaauuaaucuuuccgacguuguaaauuccaaaaagcauuugguuuguuagaaaaaaccuguuuucuccgcuuuauaaaaacauuugaagccaugcuuuauauugaacucuuaaggagaguauuaggaacucguccguucagguucuaacuuguugguguuaagugucuggauuaaagacucucuuuuucgugugccgaagccaugauuucucaaauucauucaguugugucauacaggaaaaggaagcaaaaauuucagcuuuauuuuuguuuuccggcuuaggcuugguugggaagauuugauggugguuagacacgucugcccuuauuugccuguuuagaaaaaccuauucuaaugacaaaaacaguuacauugcucccacuauugucaugguuaccugaaggcaaaaguuuacucaaagcuucugagauuuuauguucguuuauuugcuucucuuuuuaaaaaaaugucagcugaguuucaggaaugaguagucugucaaacaagagaugaaauuagaagccuggaucuaagggcuuuggggaaguuucgguugaguuccccuuucacuugugucggugcuguaggacucgggguggcuccagcuggcgucuggcccagcagagagcuguaggggcccgcucugguugcuggcuguguggacucugagggacaccccuggcgaggguguuaaugagccugcagcgucugaguccacccacccucagacuggccccugacucacucugcaccugccauaucagccuccuugcuaguucugaacagagccacaugcucuguccuuggaucuuccuggaaugccugguuccuuaacccccuagccuggcgacugccugccugccuugccacccaguucccuuccucgcuuaauuuucccacagcgcugaauccuccuaguguccugcuuaaugcauuuaucauacuuaauauuuuacugugaguuaguaagguccguggagagaauguuuugugaaaaaaacaguugcuggcacaugaucggggcccaguaaauauuuguucagugaaugaacgugaggagcuuagcagcagcugugcguggugcuggccuugucacccggaaguccuugucggugaggacugagcauguagagguaaggguuccuggaguguuggcccucaggacagagagccaccaucucucaccugcccaaugaggaaagacagccagguaagggguggcuuggaagggugcaugggacccuuguaaaucuuuucgcaacuuugaaucuauaauuauuuugaaguuaaaacguuucuaaaaagucagaucuguugggggcacaguggcucaugccuguaaucucagcacuuuaggaggcugaggcggacggaucacuuggagucaggaguucgagacuagccuggccaacauggugaaaccccaucucuacuaaaaauacaaaauuagcugggugugguggcgugugccuguaaucccagcuacuagggaggcugaggcaggagaaucacuugaacccaggaggcggagguugcagugagccgagaucgcgccacugcacuccagccugggcaaaaagagcaaaacuccaucuuauaaaaaaaauaaaaauaaaaauuagcugguugugguggugggcguccguaaucccagcuacucaggaggcugaggcaggagaaucccuugaaccugggagguggagguugcagugagcaaaggucacgccacacugcacuccagccugggugguagagcaagacucagucucaaauaaauaaaaauaaauaaaaagucagaucugccagugguaauaaugcuuuuagaaauuuugucuuugauuaccaggaaaaacccuacaugcuaguccuuauacuccgucgugacauuugguaauuaaguagagugagguggaaugaucucccuggcucuuaauucaggaggacugccugagagugacuguggcugauccccuuagcaugaggcccuucagcuguggugcugugacagagccacagaggcugcuuggugacuugcagacucuggaguccuuuccacagccuccaccucaugccuacauuaacucagagugagugggcuucagggccuuccugcaucccugaagaugguuguauuaacgugguucagagauugaacagacgcugcacguuucucaggcauuuuuccucaguuccccuugcuuggaggguggauaccacugagccugguuguacagcugccuccgugaccagcaccuuugcccaaggucucccuguuaacaaucgucagagcuggaacuugaacucgagucuucucuagaccagguuucuucuaaguauuuggcaucaccaggaagagcccuguacaaggugcuggugguuuuauccuuagagcccagaugugaggugcucacgugugugccugggguuagcaguugguguuuguugaaugaaugacuaaaaugcaguggggcggggagucaugauaagguagaauuuuaucugagguggaguuugcuucugaaaucaggcaguaaggugaaugugauacccaguuaggaguauguaaugcugcagguaaacuguaacagcaaaugaaagcaguauuucuccaggaaggaaacagaccccuggguccucgggcuggguuggaaaaagccauuuguagagaaauggaacaugguggcuagcccugcacaagacauagagaagagacccuuaacacuccaguuaucuccaagugggcaguuagaaugagugcuucuaggccgggcacgguggcucacaccaguaaucccagcacuuugggaggccgaggcgggcagaucuugagaucgagagaucgagaccauccuggccaacauggugaaacccugucucuacuaaaaauacaaaaauagcugggugugguggcgggcaccuguaauuccagcuacuagggaggcugaggcaggagaauugcuugaacccgggaggcagagguugcagugagcugagauagcaccacugcacuccagccugggcgacagagcgagacucccucucacaacaaacaaacaaacaaacugcagugcuucuaaggugagacucaucgugauguucugauuagaacguucucgugccacaaaguccugagauguguccaagaagcaccgucuucugucagacacaccuccugccccgccauaggccuucccacuguggcagcagaaucugugcuaggccuuccuucgugaaagaggacaagaucagggcucacgugacuggggccgcugugacucugagccucugcguucugucagaugaggguaguggugcuuccccugcguccugcugggagaaaaaaggaggcaguaaaugaaaggugucucaucaccugcuuccuaaauagaagggacaaagaggcugaaaaacaguaauagucuuguuuuaugaaaaugccaccccuaaucuaggagcugggacugccaugccaggaccccucagauaaugacaucccugaagaggauuagcagcuagucuguuaucagucacaggcaguucaacccagaagauuuaaggauuagauuacccaacaaccuugaguguagauuuugucucucaucacccuuugcauuaacuuugggugcauguguguuaaugaggaaguguguucugcuuuauucuugguacaucacagacauuuaauagauacaggucauuagaaauaaaaauuguuuuaacuuguaugaguuuugcaagcauugauauuucaaauugaaauugcagaaauuaggacagcauuucauuuucuuuuguuuuuuugagacggagucucauucucucacccaggcuggagugcgguggcgugaccuuggcucacugcaaccucugccuccuggguucaagugauucuucugccucagccucccgaguagcugggacuacaggcggucgccaccacgccaggcuaauuuuuuguauuuuuaguagagacaggguuucgcgguguuagccaggauggucucgaucuccugaccuugugauccgcccaucuuggccucccaaagugcugggauugcaggugugagccacugcgccugggcuuuuuuuuuuuuuuuuuuuugguugggggacggagucucacucugucacccaggcuugaguacaacgguacgguuuccgcucauggcaaccucugccuccuagguucaagugauucuccugccucagccuccuggguugcugggauuacaggcgccugccaugacacccggcuaauuuuuguauuuuuaguagagaugggguuuugccauguuggccaggcuggucuugaacuccugaccucaggugauccacccacuuuggccucccaaagugcugggauuauaggcgugagccacugagcccagccccaaguuggucuugagcuccuggacucaagugaucguccaaccagcaucucauuuucuaaagaaagaaguacuuagaccagguuugggacaugucucugaaaauucugggcuggugcaguggcucaugccuguaaucccagcacuuugagaggccgaggcaggcggauugcuagaguccagaagugaagaccaggcugggcaacauagcaaaaccccaucuguacuaaaacuagaaacaauuagccggguauggugacaugcagcuguagucccagcuacucggaggcugaggugguaggaucaccugagccugggaggcugaggcugcagcaagccaugauugcuccacugcacuccagccugggcgacagagcaagacacugucucaaaaaaaaaaaaaaaaaaaaaaaggaaguucuguauugaucaauaauuuccuccucaggacagaccugcauaugccacaauuuaacuuuguugcaacaucauucuacauuuugcaugaaugguuucaaaaaacuuauuucuaugacagagaacuuugucauuuauucuugacauauuaaaccugagugacauuuuuaaauuuuuguguuguguugugagugcuuagugaagauuccuugaauauggaugugaaugaaucuuauuuuucauggguuuauaauuguauugucccuuuaaauauucuacauugaacauguaucaccagcagaaauaaucauuuacgaggugaaguguccagagccauguagugucugcauugcuguguccagggauucuuuguuuguuugagacggagucucgcucugucauccaggcuggagugcaguggcacgaucgugucucacugccgcuuccaccucccggguucaagugauucuucugccucagccucuugaguaacuggaauuacaggcgugugccaccacgcccagcuaauuuuuguauuuuuaguagagaugggguuucaccauguuguccaggcuggucucaaacuccugaacucaaguaaucaacccaccuuggccucccaaggugcuggguuuacaggcaugagccacugugcucaaucugcguucugaggcauucugugccuguuaugaaaucaugaugcuggcaggucggaagauggaaucgacuucccagccccaucggcugugcccugcccuccuugcugucucuagagcgcggcugacuucggggagagcucucccugcccugugccucuauuuuuucaccagguaggguggaaauguguucuagugaaacugcagaacgaaaauaucccgucuuacucuugacccuugaagaagcaggagcugaauucaggugccagaggcugcguccgcgcgcuccacaucagucucagaguggaggcgagcccaggccagaggccucuaccccggacgaggcugcaggugccugacgggaggagugacugcagcucagcagagggaguguguggagugugcggcccugccuggcuuuuauuuugcuccuccuguuauugggagggauuagcagcagagcgaauguuuggaucuuugcugagcagucccaucggauuuuucuuuauuaaauaggauuguguuuuauuguaagaagguuucccuaagacaaauaacgaaggaaauucuggguccaggaguacagacuguagcuucugucaucucuugccaaguucguagcccucagauggugucugucuuuccccuuugcuugcggggccuuuuaccacagcacuuugguguucuuuuagcugcugcgauaggacuagcuguuaaaaucugagauuuuacauuuuugccagucgcaauaaauuuuguuaguucuuucuugauguguucuuuaaaauaauaaugcuuuuuuuuuuugggugggggacagagucuugugcugucgcccaggcuggagugcagugacgcgaucucggcucacugcaagcuccgccucccggguucacgccauuccccugccucagccucccgaguagcugggacuacaggcgcccgccaccacgcccggcuaauuuuucguauuuuuaguagagaugggguuucaccguguuagccaggauggucucgaucuccugaccuugugauccgcccagcucggccuccgaaagugcugggauuacaggcgugagccacugcuccuggccucaucuuuuuuuuuuuuuuuuuuuuuuuugagacggaguuucacucuuguuucccaggcugguggagugcaacggugugaucuuggcucaccgcaaccucugccuucuggguucaagugauucuccagccucagccuccugaguagcugggauuacaggcgugugccaccacacccagcuaauuuuguauuuuuaguagagaugggguuucuccauguuggucaggcuggucucgaccucccaaccucaggugauccacucaccucggccucccaaagugcugggauuacaggcgugagccaacgcaccuggccucaucuuguuuuuuuuuuuuuuuuuugagacagagucuugcucugucgcccaggcuggagugcagugacucagucucggcucacugcaagcucugccaccuggguucaugccauucuccugccucagccucccgaguagcugggacuacaggcacccgccgccacgcccagcuaauguuuuuuguauuuuuaguagagacgggauuucaucguguuagccaggauggucucgaucuccugaccucgugaucugcccaccucggccucccaaagugcugggauuagaggcgugagccaccgcgcccugccacauccuguuuuuuuuacaacagggugucacucugucucucacccaaguuagagaggagugacacagucuuagcucacugcauucucccaggcccaagcaauccuccuaucucagccucccaaguagcugggacuuuagguaugugucaccacaguugacuaauguuuuaauuuuuguagagauggggccuccacauguugcccagguuggccuuccugggcucgauccuccugccucagccucccaagguggugcaugccuacagucucaguagauuagaaucacccuaacccucaguaacugagauuguaggcacgcaccaccucacugacucaccucaaacucucuuuuuugagauggagucucugucaccagacuggagagcaguggugcgaucuuggcacacugcaaccuccgccuccuggguucaagcgauucuccugccucagccucuguagcagcugggacuacaggcaugcgccacuacgcccggcugauuuuuguauuuuuuaguagagacgggguuucaccauguuggccaggaugaucucgaucucuugaccucauggucugcgcaccuuggccucccaaagugcugggauuacaggugugagccacugcgcucggcccaucucaaacuuuuaauaaggcucuucguauagaaauuuuuaaaaaauuaaaaacauuuuuggccaggcuuagugguuuaagccuguaaucccagugcuuugggaggccaaggcaagcagauuacaugaggccaggaguuugagacuagccuggccaacauggcgaaaccacgucucuacuaaaaauacaaaaauuugggcaggugcaguggcugacaccuguaaccccaacacuuugggaggcugagguggauagaucucucgaguucaggaauuugagaccagccuggguaacaugaggaaaccccaucucugcagaaaauacaaaaguuagcugggcgugguggugcaugccuguggucccagcuacucgagaggcugaggucaggcugaggugggaggaucccuggagccugggaagcggagguugcagugggggaugaaaaagaauaccccguguccaaauagcaaaacacucugaaaugaggcaaaccgugguuuguugaacagguguucugggacaagguugccgaauaugcauuagccguaauccccaggacagccaugcagggugggucuuaaacaguuuuuuagauucucgaguauaaagguauaauauugaagaauaagcacaaauaaugucaucauacauguuaaagugacaacacaggauuuacaaaauuacccuuuuuuccccaaaauuaccucuuacgaugugguuucuguuggugcuguuuucucuugcaucaucccgccagguuggguaacccuaacugauugucaccagcagaccaacagacagacucacagcauccuucucccuggugugagcacugcuuaauucacauuuaugaaaauacuuuaagacaagggcacuguaacucacauagaaucugaaguggccuugaacagggagcugguccagcugccucuuagugugucugaccuccaggugggcggacugagaugcgugcagguguucaugguauaggcauccuuguaaaccugcucugguuaaggauaaauaggcaaaguugugcuaaugcuguuccuacagcagccuuugcccuggacugacuccagaacagcuggcugacugacagcugccucccaguaaagccuuaaacaggcuuaucuuauauuuuuaaaaggcaaaggacaauaaggcagauuaauaaacuguggggguuuuuuuguuuguuuuuguuuuucuugagacaaagucucgcuguuguaccccaggcuggagugcaacggcgcgaucucggcucacugcaaccucugccucucggguucaagcgauucuccugccucagccuccagaguagcugggauuacaggugcccgccaccacgcccggcuaauuuuuguauuuuuagucuagacggggguuucaccauguuggccaggcuggucucgaacuccugacaucaggugauccgccugccucggccucccaaagugucaggauuauagggugagccaccgugccuggcuuuuuuuuuuuuuuccugucuuuuguguaugugauggggucucgcucuugucgcccaggcuggagugccauggcacgaucucggcucacugcaaccucugcuucccggguucaagugacucuccugccucagccuccugaguagcuggaacugcaggugugcaccaccaugcccggcuaauuuuuguauuuuuacuagagaugggguuucaccauguuggccaggccgaucucgaccuccugaccucaagugauugacccaccucagccuuccaaaguacugggauugcaggugugagccaccacacccggggcuggauuuuuuuguuuuaagagacaaggucucacacucuugcccaggcugguuuacaguggugcagucacugcagccuucaccucugggcucgagugauccucccaccucagguuacaggugugagccaccacacaugaccgcacauggcagauuuuuuuuuuuuuuuuuucacggagucuggcucuugucacccaggcuggagugcaaugaugugaucucagcucucacugcaaccuccgccuccuggguucaagcaauucuccugccucagccucccgaguagcugggauuauaggggcgugccacccugcccagcuaauuuuuuuuuuuuucuggagacaaagucuugcucugucacccagacuggagugcaauggcaccaucuuggcucacugcaaccuccgccuccuggguucaagcgauucuccugccucagccucccgaguagcugggauuacaggcacgugccaccucaccuggcuaauuuuuauauuuuuaguagagacgggguuucaccauguuggccaggcuggucuugaacucacugaccucaggugauccgccucagccucccaaagugcugggauuacaggcgugagccacuaugcccggcccaggauuuuuuuuuuaauuaaggaaaauacuuuuuacaucuaaaauucuacgcgacaauaauuaaugugucuucaagcugagaauuaauuaaaauauagccaauaaaacauguauuaagcuuuguaaacuuugucuauauauguacuuauuuuacuuuuauuuaaaaauauggggccaggcacgguggcucacaccuguaaucccaccacuucgggaggccaagacggguggaucacuuggggucaggaguuugagaccagccuggccaacauggcgaaaccccuuccaucucuacuaaaaauaugaaaauuagccagguguggugcaggcaccuguaauuccagcuacucaggaggcugaggcaggacaauugcuuaaacccagaaggcggagguugcagugagccgacauugcuccacugcacuccagcuugagcaauagaaagacucugucuuaauaaauaaauuaauagccgagcacgcuggcucacgccuguaaucccagcauuuugggaggccgagacgggcagaucaugaggucaggagaucgagaccauccuggcuaacacgaugaaaccccgucucuacuaaaaauacaaaaaaagccgggugugauggugggcgccuguauauagucccagcuacucgggaggcugaggcaggagaauggcgugaaccugggagguggagcuugcagugagccgagaucgcgccacugcacuccagccugggugagugaucgagacucugucucaaaaaaaauuaauuaauuaauuaaaauaugacaguggccugggugccaucgcucgcaccuguaaucccagcacauugggagucuaaggugggaggaucacuugagcucaggaguuugccuagccugggcaacuuagggagauccugccucuacaaaaaauaaaaaauuauccaaguguggugguugcacaccuguagucccaacuacuucggaggguugcaggaguccaggaggucaaggcugccgugaggugugauugagccacugcacuccuaccugggugauauagugagacucugucucuaaaauaaaauaaaauaaaauaaaugacagugguccauauaguaccuuauucagaaaaggcuugauguacaagaaaauaaguuauuugugaucaggacagagaagaauuacugccuuuugugaaauggaugcugagaaucaguuacgauguacggugcuugggaggcugacuuugauuucaguuacagcccugcugauccuuagcacggugacugcaaauagguuacuccaccuuccugagucucagucuucuuagccgaaaagcacagaucaucaucauaauagcuaacauuaacugugugccuggcauagggucugaccgcuuuauucaagccagcucccagacauaccuugcuggacuguuuaaugcccauucgacaaagaggagaucgacauggggagguguugaguaacuugccuggccacugagucccugucaauggcagcucagacaggugaccccagagcuacccucccacccccugaccaggcccgucucacaggccucuuaggaagggcucuguucaguagauggcaggcacgugguaaguguuuccuaagcugcagcugcuguguagauaaaacucaaagcagauaucacaaguuuugucagaucauacugucucaauuuugaggugaaugcauguguuuuacuacuuaacuaccucugaaauuuagggguuuuuuguuuguuuugagacggagucucgcucugucgacaggcuggagugcaguggcgcgaucucggcucauugcauccucugccucccggcuucaagugauucuccugucucagcuuccccaguagcugggccuacgggcaugugcaccaucacgccuggcuaauuuuuguauuuuuaguagagucgggguuucaccagguuggcgaggcuagucucgaacuccugagcucgugauccccccaccuuggccucccgaagugcugggauuacaggcgugagccacugcgccuggcccugaaauuucgcauguuuuacgguuggcuuguuaggguuaaauuggugcaccuuauacuugguugcauacuagacucacuggaaugauuugacuuucgucauaguugcagaggcacucugaaacccuauguaugugcuucaccagggacagccccacgcaugggaggugguggccagccaucaccccagggugaauuucucuaagagcaguccuaggccagggggugagugugggaaagucagggccguuuccaucaguuaacguuucagagcggguucccgcuggaagugcuggaaauacccagaugccaucuguagcauuuuaugaacuguggcggauccacucucugugucuugagcuucugcucuguggucugcucaguggaagcauccugucaguccacuguacagugggguggagccgcagccagggugggugugccguuugauuggucacggaaugaacagggcaaaggucacuaaguagauaugauacugcaaguaggauuguggucauagguauuuuuaugaauuuguguuaugugaaguugaggauuugaauguugugauuauuauauccagauaaaguucuagccuggcacagugcaggcacgugccuguggucccagcugcuugaagugggaggagagcuucagcucaggauuuccaggcuauagggagcuguggucccaccauugcaccccagccugggugacagagugagaccccaucucaaaaagaaaagaaaagaggcuaggcgcaguggcucaggccuguaauucaagcacuuugggaggcugaggcaggcggaucacuugaagucuggaguucgagaccagccuggccaacauggugaaacccccccaucucuauuaaaaauacaaaaaucauacuuacccggcaggggagauaccaugaucgcgaaggugguuuucccagggcaaggcuuagccauugcacuccggaugugcugagcccugcguuuuccccaaaugugggaaacuugacugcguaauuugugguaguggagggacuguguucacacugucccccccgcccaaaaaaauaaaaauacaaaaaucagucgggcgugguggcucacgccugucaucccagcacuuugggaagccgagguggguggaucaccugaggucaggaguuugagaccagccuggccaacauggugaaaauugggaggccgaggcgggcggaucccaaggucaggagaucgauacauccuggcuaacacagugaaaccccgucucuacuaaaaauaaaaaaaaaaaaauuagccgggcgugguggcgggcgccuguagucccagcuacucgggaggcugaggcaggagaauggcgugaaccagggaggcggagcuugcagugagccgagauggcgccacugcacugcagccugggcgacagagcgagauuccgucucaaaaacaacaacaagaacaacaacaaaaaauuagccgggagcagugaugcgugccguagucccagcuacucuggaggcugaggcaggagaaucacuugagccugggaggcagaggcugcagugagccgagauugugccacugcacuccagccugggcgacagagcaagacuccgucucaaagaaagaaaaagaaagaaaaaagucuuccccgugagaguagauuucuacugaaucgauugcugguuuuaugccuuuucuuccgugauaggaaguauguccagacucaucuggcuggggauccucaggagagccugcggggggcagcagaggcccgccugggccagggcgugcaccagaccagaauccugcggauuuaguauugugaggguagaagaccagcaagcagcaugaccucgugguuacugaucuuaugaagaacacuugucuuucauauuugggacuguguuaagguuuucuggaauauuuuugguuguaguaacgauucugcuuuaggagcuuucuucucuaguguugcacagaccugagugauuugaccagcagugcugcgguaacggaagaccacucgugucuucagacucguucuguuccugggggugcuugcuuguucuaggcccccuuuguauggagagguucaaaccuugauugaauagucgcuacccaggugucauaaccuguggccucauuggugucaccuggacuuuuugucugcuguuugcaccaucgaaagugaugugcgcuggccgggcgcgguggcucacgccuguggucccagcacuuugggaggcgggggugggcagaucacaaggucaggagauggagaccauccuggcuaacacggugaaaccccaucucuacuaaaaauacaaaaauuagcugggcaugguugcgagugccuguagucccagcuacucgggaggcugaggcaggagaauggcgugaaccugggaggcagagcuugcagugaguggagaucgcgccacugcacuccagccugggcaacagagcgagacucccucucgaaaaaaaaaagugaugugcgcuugggacugggagggcgaggcccgagguaccugggugcccgaugcccaggagggcaugagugucguguuggauaaccugcucuccaaguaauaggguuuugagaauguuuuuuuuuuuuuuuaauugagacagagucugacucugucgcccaggcuggagugccaugguaugaucucggcucagugcaaccucugccucccagguucaagcgauucuccugccucagccucccaaguagcugggacuacaggugcccgccaccacacccggcuaauuuuuguauuuuuaguagagacggggguucaccauguuggccaggcuggucuaucuccugaccucaugauccgccugccuuggccucccaaaguacugggauuauaggccugagccaccaugcccggccuguucaauucuuuguauucaaauguauaucuggaguuauuuuguucaacuucugaucugcuuuucuuuuugaauuacuguauucuaagcaucaguuuacaagaaaaaaaaucuuuauuagguuuccagacccaagucaauaccaauaaaauuaaugcagcaaacauucacugaaugcucuauuaggaccuggggcaguagaugagucugugaauuaaaagggcuucagcaugugggguuugguuuuguuucucuguagcuaaucauaccuuuggaaugguuuuauaguuucaggaaaccgugguucugggcaggguggcagcuauggguugaggcaguugauccuuccucagguguggccgcuggucuuguugcuucuugacauuaacuuugugacucacgagggcaggcguucguuuucuguggcacucugugugugagcgagcauggggcuuguuacugugugaaaagggccagcugcccugccugucugcuccucccuggcucggccgggcgcugccauggcuccagcucagauucacuuccucucguacuuggaugcuuggugauggucguggaagcaguuuuauuuucucuugcuguucucguguugcguuaagcucagcaucacuguugcuuuuuauucuuagaauuaaggaggaaagcugaaaucuuuuggggauuucuguguuuccagggacuuuaggaauucuuuuuuuuuuuugagacagggucuugcucugucaaucaggcuggagugcgguggcgcgaucucggcucccugcagccuugaccuccugggcucgagugauccucccaucccaaccaccugaguaacugggaccacaggugugcaccaucacgccuggcgaguuuuuguauuuuuuuuuuuaauagagaugggguuucaccauguugcccagaaugaucaaacuucuagguucaagcagucuccccaccucagccuuccaaaguguugggauuacaggcaugaacugccauggcuggcuggaaagucuuuacauuugaaauucauuuuaaguuaggaggaaaggccuagcacacuggcucauaucuguaaucccaucacuuugggaggcugaggugggcggaucacuugaggccgggaguuugaguccaaccuggccaauauagcaaaaccucaucucugcuaacaauacaaaaauuaucugggcauggcggcagaugccugugaucccagcuacucgggaagcugaggcaggagaaucgcuugaacccgggaggcggagguugcagugagcugaaagugcacuacugcacuccagcgugggcgacagagugagaaucggucuccaaaaaaaaaaaaaaaagaguaaaggugagggacaccugugauguggcacacagcgucuuuucucuagcuugcuuuguugacucuuguuuauaauuucuucaaauguauuuacagaguuaauuggguuuuuuuuggaauagauaauaucuauuccaaauaaaaauccagaaauacacauucaaacuguggggcuuuuacccuuuuaacuguguuccaagucccugucccuagcaugcucugauugucaguccuucccuugccugaccuaccugucugaguauccuuuggcagucagguuuuuguuuguuuguuuuugagacggagucucgcucugucgcccaggcugcaggcuggagugcaguggcgugaucucagcucacugcaaccuccaacucccggguucaagcgauucuugugacucagccucacgaguagcugggacuacaggcgccugccaccacguccagcuaauuuuuguauuuuuuaguugagacgggguuucaccauguuggccaggauggucuugaucuccugaccucgugaucuggccaccuuggccucccaaagugcugggaugacagguuuggccaccgugcccggccggcagucaguuuuuacaugguucaucacagauuuuaaauuaagauuccccagcaggauaaaagaaaugccaguuguauuuuauuuuucguauuuguauuuuuagcaauuuuuuuuuuuuguauagaaugagccaagggcaucuagagcaaagagguaguucccugccccgucuccaucucccugucugcacugucucucccagagguguuugcuggugccuucuuugcaguucccugugcugugucaugcccguuugcugacccagccccugcugugucuuccccaucccagugugacugucgcucuugguaguuccuccguguuuccuuuguuuccuuaggugacuugucuuugccccacucccugcaguccgcagcaccuguugucuccuucccucuccucccgcuucuccucagacgucaucuguucuuucuagaguuguuccccuugccccaggguccaggguuccuaacagccuguuuuuuuucuuucuuuuuuuuuuuuuagugagacagagucucgcucuguugcccaggcuggagugcaguggugcggucucagcucacugcagccucugccuccuggguucaagugauucucccgccucagucuucugaguagcugggacuauaggcgugcacuaccauaccuggcugauuuuuguauuuuuauuuuuuauuuauuguugagacagggucucuuuguugcccaagcuggagugcaguggugccaucuuggcucacugcaaccuccaccuccuggguucaagugauucuccugccucagccucccaaguagcuuacaguagggauugcgggcaccuacgaccacgcccagcuaauuuuguauuuuuaguacagauaggguuucaccauguugaccaccuggucucaaacuccugaccucaggggauccgcccaccuuggccucccaaagugcugggauugcaggcgugagccaccgcgccaggcccuaacagccaccuucuuagcaucuguauauucagaccguccauugcaggaugugugaucuuuguggccuggaaugucucucucugagcacuccauccucccaccccucaggcagugucucuugaggccaccugcccagccaccaucuuggggggaccacaggaggcuggggagagagcgaggcaguagugagaagccgggacgcucaccguuggccgaguaccuuagagcagcccugacgccugcuucugucucuuggugaaaguggcgcccagacuucaguccuuacagcccagaacucagaaccguggaggugcugugacccacaggguuuaccuuguaauuguuguuaaaacccuucugggcuucauaauggaaugcuuauguugaaauauuauuuuaaguacuauuaucuaugaugugguuagaaaugccaaagaauuuuuagcuuuuuugagacggagucuugcucuguugcccaggcuggaguguaguggcgcgaucuccgcucacugcaagcucccccuccuggguucacgcgauucucccgccucagucuuccgagucgcugggacuacaggcgccuaccaccauaccuggcuaauuuuuuuugguauuuuuuguagagacgggguuucacgacguuacccaggauggucucgaucuccugaccucgugauccacccgccucggccucccaaagugcugggauuacaggcaugaaccaccgugcccggccuuuuuuuuuuuuuuugguagauggagucucgcucugucgcccaggcuggagugugguggcgugaucuuggcucacugcagccuccaccucccuaguucaaacgauucuucugcuucagccugcugaguagcugggauuacaggcaccugccaccacgcccugcuaauuucuguauuuuuagcagagaugggguuucacuguguugcccaggcuggucucaaacuccugaccucaggugaucugcccuccucggccuaccaaaauguugggauuacaggugugaaccaccacgcccggccagaguguguagcuuuuguaaaaguuuuggaaauggccucagauaauuucagagguuuuuaaauaaagaacgcucaaaauggagcaaaauggagagccccugauaggccuccugcguggagguuugcaguaagccagaggcaccugugggucccagggagagacgggcugcuccauggaugcuccugggaccuggggcacugggugggccucaggcagauaggagcugguccguaucucuugccaagcccaggccaacuccugaugaagcagauuccugugggugacaagugucagaagauagaauaggaccuuagggucaggaaggauuucuugaacaaaaaaggggaaaaacagauugagagauucagaaagcuguaauauauucugugaccucaaaggugacuuggaggagggcuguuguucagcgacgggcguguagugaacacuggggcauuuaaacgguucagaugcugaauuuaauguuauauguuuuuuacuacaauugguaaaaaaaaaaaaaaaagcuugugcucaucaaaagacacaccauaauaaguaaaaaaagaacugugaacuggaagauacuuguaacauuuuuaaccagugaagggucgguguccuggauauguccacugggcaccacagacagaacggccuugaagguaggcuggagacgccuacccuuaucaggccaggcaagcacuggggagccuggccguaccagucauuguugaggcugcaggaauggcagggagcccuaaguuccaguggccacuggugcaguccucagagagcaguuggcacaccgccucaggcugagccugcccauucuugggcacccagaaguuccacucuuagguauacaccagaagaauucuuccucgacuguuugugcugaaggacaagguuuaaguuuuuaaaauuuccagugucacagacugaugauauuuuuguaaacuacaacaaaagugacuagcuaguaaaggaaaucacagaacauaaaauacaaacccaugucauuauuauuaauauuuugaggcagagucucgcuuugucacucagacuggagggcaguggugcgaucucggcucacugcaaccucugccuccuggguucaagcgauuuuccugccucagccucccaaguagcugggauuacaggcgugcaccaccaugccuggcuaauuaugccuggcuaauuuuuguauuuuuaguagagaugggguuuugccguguuggucaggcuggucucaaacuccuggccucaagcaaucugcauuccucagccuccaaaagugcuaggauuccgggcaugagccaucaugccugguuaucgggggaacccgcccccaauauuucaauguagguucuuucuauuuuccauaagugucggccagcugagaaauaaagagaaagaguacaaagagaggaauuuuacagcugggccccccgggugacaucacauaucgguagggccgcgaugcccgccugagccacaaaacaagcaaguuuuauuaaggauuucagaaggggagggggugcaagaacagggaguaggucacaagaucacaugcuucaaagggcaaaaaggagaacaaagaucacaaggcaaagggcaaaaguggaacuccugauaagggucuguguucagcggugcauguauugucuugauaaacaucuuaaacaacagaaaacaggguuccagagcagagaaccagucugaccaaaaauuuaccagggugggguuucccaauccuaguaagccugaggguacugcaggagaccagggcguauuucaguccuuaucucaaccacauaagacaggcacucccagagcagccuucuguagaccuccccccaggaaugcauuccuuucccagaguauuaauucuugcuaggaaaagaauuuagugauaucuucccuacuugcacguccgcuuauaggcucucugcaagaagaaaaauauggcuguauuuugccugaccacacaggcagucagaccuuaugguugucuucccuuguucccugaaaaucacgauuauucuguucuuuuucaagguguacugauuucauauuguucaaacgcacguuuuacaguuuguacaguuaacacaauuauaguggcccugaggugauguacauccucaguuuaugaagauaacaggauuaagagauuaaaguaagacaggcuuaagaaauuaucaaaguauuauuuggaaacugguaaauguccaugaaaucuucacaauuuauguuccuuugccacagcuccagccgguccaucuguucagggucccugacuucccacaacaccuggcuucuauuacuuuuuuaaaauuagcuuuuuucuuuuuuucgagauggagucucacucuguugcccaggcuggaauacauggugugaucuuggcucacugcagccgccgccuccuggguucaagcgauucucuugccucagccucucgaguaacugggacugcaggugcaauacaaaaaaugcagaacuuuuguauuuucuguagagaugggguuucgcuguguuguccaggcuggucucaaacuccugagcucaagugacaugcccaccuuggccucucaaaguucugggauuauaggcaugagccacugcauccagccuuauuauuauuauuuuuuuuugagauggagucuugcucugucgcccaggcuggagugcaguggcgcgaucucggcucacugcaaccucugccucccggauucaagcgauuuuccugccucagccuccugaguagcugggacuacaggcaugcgccaucacaccgagguaauuuuuguauuuuuuggcagagacaggguuucaccauguugaccaggcuggucuugaacuccugaccucaagccaucugcccaccuuggccucccaaaguucugggauuauuuuuuaagcaguuuugauagguguguaccuaguagugcucugugguuuaauuugcauuucccagggagugggggcacugccugucuucucacgccucaguugcuuguugcugugacggucgcccacuccuccugccagugucugugcugcucacgguagcugcaucagcuucacgcuguccgcccuucgccacccaccgcgccugcugcucaggaauguuccaagcaacuuggugguaacagaagcugagaacagcccagauguccuucggugcaagaguggauggaucaguuguggucuauucacagaauagaaugugaccacacuggagaugaaugaauuguagcuacaaucugcaguguagacgaaucuuaggaacguaggcguuucagaagcagaucaagccaggcacgaugcugugugccuauagucccagcuacucagagccugaaggugggagaucacuucagccugggaguuugaggccagccugggcaacauagcaagacccugucucaaaggaaaaaaaaagcagauuacagaaaaguaaauccagugcuaggccguauuuuuaagcucaaaaaauuaaaacuaauuagcguuuagggauaaacaugagguaauuuuuuagaagcaagagaauagcauugaauuuaagguauauauggggaaaaugaaacuuccaaguuauugauaauuuuccaguuuuuaaauuagagacgggaucaugguguuuaugcgucauaauuuauauguuccauauauuuuuuguuguuuuuuugagacggagucucgcucugucacccaugcuggagugcaguggcgcgaucucggcucacggcaagcucuaccucccagguuuacaccauucuccgccucagccucccgaguagcugggacuacaggcgcccaccaccaugccuggcuaauguuuuuguauuuuuguagagacgggguuucacuguguuagccaggauggucucgaucuccugaccuugugacccgcccgccuuggccucccaaagugcugggauuacaggcgugagccaccacgcccggcugauauguuccauauauuucuuucuguauuucacauaauacauaguaaaauauuuaaaacagaacaaaaauagacuuccuuuuaagauguuuucauaucuguucuuacaaaguuggccacaguuuuuccccaacaguaguuugaguucagcagcagcucuuuuauaaaacguuugcugcacacacugagauugcaccuggaaguacagaaauaagaacacacguauuuuauuuuauuuuuuuaccccugaagaucuuuaagucuucugaggagcauggaccugcuagacugcaagcugcugcauucugaggagcagggaccugcuaaacugcaagcugccgcaggcggagauuuuugccuguuugguuuauuuuguuaccacugaguccccagcucugagaacagagcgaggcaugugaucgaugcaucguaacuguugagcaaaugaaugcugagcugugauggcaccgacguguccggggagaggacgcacccggcuguguggacaugugcccagggcccaggacagcgccacggaagaggacacacccggcuguguggacaugugcccagggcccgggacagcgccacggaagaggacgcacccggcugugugcacaugugcccagggcccgggacagcgccacggaagaggacgcacccggcugugugcacaugugcccagggcccgggacagcgccacggaagaggacgcacccggcugugugcacaugugcccagggcccgggacagcgccacggaagaggacgcacccggcuguguggacaugugcccagggcccgggacagcgccacggaagaggacgcacaggacagcgccacggaagaggacgcacccggcugugugcacaugugcccagggcccgggacagcgccacggaagaggacgcacccggcugugugcacaugugcccagggcccgggacagcgccauggaagaggacgcacccggcugugugcacaugugcccagggcccgggacagcgccacggaagaggacgcacccggcugugugcacaugugcccagggcccgggacagcgccacggaagaggaugcacccggcuguguggacaugugcccagggcccgggacagcgccacggaagaggacgcacccggcuguguggacaugugcccagggcccgggacagcgccacggaagaggacgcacccggcuguguggacaugugcccagggcccgggacagcgccacggaagaggacgcacaggacagcgccacggaagaggacgcacccggcuguguggcaggggagguucccaagagcaggcucagggcucuggggucugagugagggcucuccagccagcagggagcagggcaggguguugaagagacggcaggugcgucaggggcugacgugggacccggcacucugugcucugugucugcccgggaacagguaguccugcgucggaccgggaagugugguggguguggugggggaaggggcuggcgucagcagggcucucguccgccaacgucugguggggaugcccgccaugcgggggccucaggcuacagccagggcugugaaggagccgaggucauagaguggcugcccuggcguagggagggaggacacggguccccgccauuucagaagcucagcgucccugcacgugugcggucuugucugccuaggcaugugugcgggcccuggggcugcugccagcagaacggacugggauacgcuggauuuguaaaacgugacccuuuuuguuugcuuuuaauuuuuaauuuuuauuuauuuauuuauuuuugagacugagucugacucugucacccaggcuggagugcaguggugagaucucggcucacugcaaccucccccucgaggguucaagcgauucuccugccucagccuccugaguagcugggauuacaggugugugccaccacacccaguuaauuuuguauuuuuaguagagacagguuuucuccauguuggucaggcuggucucgaacuccuggccacaagaagcaauccaccugccucagccucccaaagccuuguuugcuuuuuuuuauuuuguuuuguuuugagacggaguuucacuauuguuacgcagacuggagugcaacggcacggucucagcucgcugcaaacuccaccucccggguucaagugauucuucuaccucagccuccugaguaggugggauuacaggcaugugccaucacgcccggcuaauuuugcauuuuuaguagagaugggguuucuccauguuggucaggcuggccucaaacuccugaccucaggugauccgcccuccucagccucccaaaguuuugggauuacaagcuugagccaccgugcccggccaccuuguuugcuuuuuaaagauaaugaugucacuaaaagaguucugacugaggccgggccugguggcucacaccuguaaucccagcacuuugggaggccgaggcugguggaucacgagguguggugaucaagaccauccuggcuaacacggugaaaccccgucucuacuaaaacugcaaaaaauuagccgggcgugguggcgggugccuguagucccagcuacucaggaggcugaggcagaagaauggcgugaacccgggaggcggagcuugcagcaagccgagauagugccacugcacuccagccugggagacagagcgagacuccgucucaaaaaaaaaaaaaaagaguucugacugaagguuggaacuuagcccuccagaaaugaagacugcgaauaacgcugauggcagcucgucacuugcagcagguugcagcacgugcugcucguguagcugcggcugcacaccaggccucuccuuuaacuguguuauaaccuuucuguugacaugggauccccuugaaaguuuuuuuuuuggagacagggucucacucugucacccaggcugacguccaguggugcaauuucaguucacugcaaccuccuccucccggguucaagccauccuccugccucagccucccaacuagcugggauuacagaugcacaccgucacacccagcuaauuuuuguauuuguaguagagaugagguuucaccacguuggccaggcuggucucaaacucuugaucucaggugauucaaccaccucagccucccaaagugcuggaauuacaggcgugagccaccacucccggcccccuugaaauuuaaaccaaguuuaggaagaaugaaguugugaggugcuacuucaaacaucagguggcaaacucccggacucauuaccccaaggaaauaggcaguccagguugguggcucacgccuguaaucccagcacuucgagaggccgaggcaggcgggucaccugaggucaggaguucaagacuauccuggccaacauggugaagcccaucuguacuaaaaauacaaaaaaauuagcugggugugguggcgcgcgccuguaaucccagccacuuggcaggcugaggcaggagaaucgcuugaaccugggugguggagggugcauggagccaagauugcaccauugcacuccauccaguuugggugacagagugagacucugucucaaaaaaaaaaaaaaaauagacaucagaaaggguuggcuccugugaucucggcacuuuggugaccaugacccaaggcaggaggaucacuugagccaaggaauucaagaucagccugagcaacauagaccccgucucugcaaaaaauuucuaaaaacuuagcuggcaugguggcucacgccuguagucccaccuauucaggaggcuguguugggaggaucacuugagucugagagguugaggcugccaugaucccuuaucacaccacugcauuccagccugggugacagagcaagacccugucuccaaacaaacaaaaaagcaaaaaaugguguuuuaccuagguauuuaccauuuccaguggucuucauuccuuucuaaaaaucuagguuuuagccggacaugguggcucaugccuguaauccccagcacuuugggaggcugaggcggguggcucaccugaggucaggaguuccagaccagccuagccaacauggcaaaacccaaucucuacuaaaaauacaaaaauuagccaggcguggugguacgugccuguagucccagcuauucaggaggcuacggcaggagaaucgcuugagccuggaagguggagguugcagugagcugagauugcaccacugcacuccagccugggcaacagagugagacucugucucaaaaaagaaaaaaaaaagaauaagucacauuuuggugaggagcaguggcuugcaccuauaauccuggcacuuugggaggcugaggcaggaggaucacuugagaccagccugggcaacaaagccagaccgugucucuauagaaaauuuuaaaguuagcugggcaugguggcacauuccuguagucuuagcugcuugggaugcugagaagggaggcuuucuugaguccaggauuucaaggcugcagugagccaagaucgcaccacugcacuccagccugggcaacagagaaaaaccuuguuucuaaaaaaaaaaauuaggcuggguaggguggcucacaccugugaucccagcacuuugggaggcuguagcaggcggauugcuugagucugggaguuugagaccaacaagauccugacucuauaaaaauuuuaaaaaauagcugggcgugguauugcacaccuguagucccagcuacucaggaggcugagguggggggaucagcugagcccaggaggucaagguugcagugagcugaaaugugaccacugcacuccagcccgggcaauaaagucaggcggggaaaagaaagaaugaguuaacauuuucucagcuuuauguguugagugauuuuggauucuauccugaaaugguaagaaugaaaagaaaaucugccaaguccauccguuccuacacucucacugccuccaagucauucugcgcucuugagccagaacgaccuggccguuuuuaaaaauggaguuuuuugccuuaguaauugacuuguguaagaguucuuuauuccacuugugaauuguuuuuuauacguacauaauguaaauauuuucuccccuucugugccuuucaguaugaaucuaucugaacucgauucugcuguugugugugugucuuuuccucaguaccagauggucuugauuacuguagauauauaguauaugucuugaaaucaauaggguaaauucucuaacuuuuguucuuuuuauuaauguugcuguggcuaaucugucugcuacauuuccuuauacauuuaaaaaaaucaguaucaguuucugcaaaaaaaaauccucuuggauuaggguuaggcuucugucaagucuacagaucaguuuggggagaacugacuucuuuauaucgaggcuucuaauccgugaacaugaggaaucuuuuucuuaucuuuaguaucuuagcaauuugugguuuucaacguacagauuucauaggucuuguuauuucuuuuucuuuuuuugaaacaaggucucacugugucacccaggcuacagugugguggcacgaucauggcucacugcagccucgagcuucugggcucagccauccucuuaucucaaccuccugugucacuaggaccacagacaugagccaccaugccuauuuaacuuaaaaacaaaaacaaaaaaccgggcacgguggcucaugccuguaaucgcagcacuuugggaggccgagggggggauugacugaggccaggaguccgugaccagccuggacaacauggcaaaacccugucucuaaaaauacaaaaauuagcugggugcaguggugcgugccuguagucccgugccugcggcaugggaauggguugagccugggaggcggagguugcagugaguugaugacuuaggauuuuucuucucggucacuuugcaagccggggaccccuggccagugaugccccaccugggcccugcuuggccacacuggcgugccccaacucaccuguguuauagcuuguacuguguucggccauucccgagcucauguaccgcacucaagaucaaggauacacuggacauugaagggugaggagggcggagaagaacuuuauugagcagugaaacagcuuucagcggaccaggggaugcaggggugguuccccuaccugaaggcaggaaaguccgccuguguggcugggucuggggcuuuuuauggacucaggaugcggagugcuugcagagcuugcugauggguuugugaguaugcagaaaagguuaaagugggcaugacaguguagaaaaccaauuauaagaggccgggcacgguggcucacgccuguaaucccagcacuuuaggaggcugaggcagacggaucacaaggucaggaguucaagaccauccuggucaauguggugaaaccccaucucuacuaaaaauacaaaaauuaccugggcgugguucgcgugccuguagucccagugacuugggaggcugaagcagaagaaucgcuugaacccgggaggcagagauugcagugaacugaggucacaccacugcacuccagccugggcaaacagagcgagacuccaccucaaaaauaaaaauuaggaaaggguagguauguguaaaauaggugaaggauggggaucaaucagaggaaaguguggcaaacaggaaggcaaguucuucaucuagucugaggauuuaacuuguagcucagcugucaggcuuuaaacugucuuuggcuuggagguggguuucaccgggaacccgccccaucugccuggcauucagcugccuccugccaguaucaccgagaucgcgucaccgcacuccagccugggcaacaaagcgagacuaucucaaaaccccauauugaugucauuuccuaaauauuugguuaaaaaaaaaaucugggccuggaauuuuaucugguuuuuuuuuuuuuuuuuuuugagacggagucucgcugugucgcccaggcuggagugcaguggugcgaucucugcucacugcaagcuccgccuuccggguuaacgucauucuccugccucagccucccgaguagcugggacuacaggugccugccaccacuuccggcuaauuuuuuuguauuuuuauuagagaugggguuucacuguguuagccaggauggucucaaucuccugaucucgugaucugcccgccuuggccucccaaagugcugggauuacaggcgugagccacggcgccuggccuucuggggauuuuuuauuacaaauauaacuuuauuaacagaugcaggccuauucagauuuucuauuucaugucagucuugguaaauuguaauuuucaagauauuuguccauuucaucuaauuuuucuaauuucuuggcaugaaguuguucguauuuuauccuuuucacgccucuaggaucuguagugaugucuuuccucauguugcucaaagaaccaacucuuuuggcuuuguugaaguuaucuguuuguuuucauggauuucuguuccuuaugauuuccuugcuugcauuuauguuggguuuauccuguuacuuuguagcuuccugaggcggagccuuaggccuugauuaacguguuguacuagucagcauucugcagaggaacguugccauuaucugugucucuuucuaaaggagauuuguuaugaggaauuggcccacgucauuauggagacggaaucucaugcucugccauuugcugaagauugaggaaagcagugggauaauaacaguccaaggacaggaggagacacguggccccgcucaggcuggcaggcgagaaggaaaacccaggccaacuccuccucccaccccuuucuauucgggacccccguggacugggacgacacucaccugcacagggcagcgcaguuggcuucauggagcccccagcucaggugcugcucuuaccaagaaacacccucccaggcacacccugaagucauguuucaucugggugccccacgaugcagcaaaggagacaugaaauuaaccgucauguacacuguauuuauuauucaauucaaaacauuuucuaaguuccccugggauuucuucuuugagcuacauguuagccggagguguguuguugaauaucaagaguaucuuccuccuggguuuccaguuuguagcuaagucagggauagugcugugugugaccucauuccauuacguuuauugaaaccagcuugaagcccuaacauguggcuugucuuaguguacagcauucaguuaaaaacaauguguguucucuagauguuggguguucugugacugucacgucauggugguugauuaguuagaaacaauguagaaacaauguguauuugccaggcgcuguggcucacaccuauaaccccagcacugugggaggcugaggcaggcggaucaccugaggucgggaguucagccugaggucgggaauucaagaccagccuggccaacauggagaaaccccaucucuacuaaaaauaccaaaauuagcugggugugguggcacaugccuguaaucccagcuacuccugugugaggcugaggcaggagcauugcuugaaccggggaggcggagguuguggugagccgagaucgugccauugcacuccagccugggcaacaagagcaaaacuguccccccccccaaaaaagaaagaaagaaacuguguguucucuagauguuggguguucugugaagaucaggucauggugguugauaguguuguucagaacaucgauguuuuuccugauuuuuggucuguucugucgauuucugagaaaguauuaaaauuaaaguugggucuugcauuuuuauccauucugucagucccuuacuuuaauuggaguuuuuuguccacuaacauugaauuuaauuguugauauguuuggauuuagaucuuccaacuaauuuucuauuuguuuccuguguugaguuacuuuuucauuuuucuuguaacuuuuuagcuuauaccucuuugcauuuuuuaugcagagguugcuguaaggauuacaauaugcauguuuauuuuaauuaauuaauuuauuuuguuuauuuauauauuuguuuuuaaggaacagggucccugucuccugggcuccagugcaguggagugaucauagcucacugcagccucaaacuccugggcucaagcgguccucccgccucagccucccaaaaugcugggacuacaggugugagccccugugccggcccacaguacacagcugcaguucuucaggaucucuugggguggccguauucugccgucucacacuucuccaugccauggcgucugucugugcacguggcaaacuccacaaggcaguguuggauucuuuugcuuugaacggucuuauggaauaaaguccaucagcucugcccuugguacuuucaucuauacuuugugauacuuucuuuuuauuuuuucuucuagaauagccuaacauggcagaccagagacagcgcucacugucuaccucuggggagucauuguaccacguccuuggguuggacaagaacgcaaccucagaugacauuaaaaaguccuaucgguaaguggacaaguguggcccccacauccccccaggaagacacacaugccccgugugguuuagucugcauuuuaccaagaaccauugcacauacuuuauccuggccgacucagcguugaacuggucacagcucgguaacaccuuuguauguguaaugugcuccuuauagcuuaaaguuaugguauucauguucucuugccaacaaaaaauagcacuuaguagaaacugacacacuguccacaguuccauagggagucagggucugaaccuguuugaggccucacaggagccgcagagcgcuggcaugguccuguggucuccuuguuuuagcacagugaugacagagaccccucacucuguuguggccuucugauugagcuugaagaacugcacucuuggguacaguuucauugaguaaccuguaagagacaccaucacuaauccagacaauucagauaguccuccucucgugugcuagcaucguguaguucauaaaacacuucuuaaagugccaucauuacgccccgccgugcuuaccguucacuuggcacuugugcaguuagcggcugggacaccagggcuggccuuggugccgcugaacuuagaugugccguggcacucacagcccuuggggcucccuccucugaggcugggucagggugaggagguuuaccugaaacaaccgcggagcuugcuuuugucccuggccccugcagcccuggagagucggacagugagguggccuggguggaccugccuuccacugcacccggcagugcgugcgggugggauggacgcggcggcgggugcggguggaacaaaguccaggguagagccaggacaugguuuugguuugcaggaagcuugccuugaaauaucaccccgacaagaaccccgacaacccggaggccgcggacaaguuuaaggagaucaacaacgcgcacgccauccucacggacgccacaaaaaggaacaucuacgacaaguacggcucgcugggucucuacguggccgagcaguuuggggaagagaacgugaacaccuacuucgugcuguccagcuggugggccaaggugagggcgagcugccugccgugcgggcacccgagucacuccugccgugcgggcacccgagucucuccugccgugcgggcacccgagucacuccugccgugcgggcacccgagucucuccugccgugcgggcacccgagucucuccugccgugcgggcacccgagucacuccugccgugcgggcgcccgagucacuccugccgugcgggcacccgagucucuccugccaugugggcacccgggucacuccacgccugcaggguucccagcauugcagagcccaugcguugaugccagcaacucuacacuccugagaaaaggcuucugggcauauggagccuuucuccucaccugugugaugggcgaagcucugucacuggcuugguguccugccuggaacaagccauagcguacagauugucccagggaagagccgugcggagccgccaggguuucuucuguaaauggcucccaguccuucgugagacaggaggaaauaagccucgauguuacauccgcauuucuucguuuccucguuuuguuccaaaugucauauaugaggccagaggguuggaaucacugcauggcauuugugagaagccuguauuuggcuuugacuggucggccuccucacuagaauccuuauaaaguacuuuuuauuuaguuaauguuagacagagucucgcucuguugcccagacuggagugcuguggugagauccuggcucacuuuaacuuugaauuccuggguucaagugauccucccacuucagcuccagaacugcaggaguugaggcgugaaccacugugcccagccuggaggcugcuuuguuuuuuuuuugagacggagucucgcucuguuucccaggcuggagugcaguggcgcgaucuuggcucacugcaagcuccaccucccggguucacgccauucuccugccucugccucccgaguggcugggacuacaggugcccgccaccacguccagcuaauuuuuuguauuuuuaguagagacaggguuucaccguguuagccaggauggucucgaucuccugaccucgugauccgccagccucggccuccuggagugcugggaugacaggcaugggccaccacgcccgucuuggaggcugcuuuucuuuaagcugcggguuucuuucugucucuccuccucccuucuucaguucuuuccuucugcuuccugucuggaaggcaguauccccaccuggaacgcacccccugccuucugcugagggcauuugggaguccugcgccucccucuccaggggccucggaggccaugcaacaccaccuucuucuccccccaggcccuguuugucuucugcggccuccucacgugcugcuacugcugcugcugucugugcugcugcuucaacugcugcugcgggaaguguaagcccaaggcgccugaaggcgaggagacggaguucuacgugucccccgaggaucuggaggcacagcugcagucugacgagaggggugagugcccgccccagggcccguguguguguguggggcagagccagaaugggcccugaauggugucaaccugucuugucaaacaggagggcacugacacugugccgcgaguguuugugguggcagcugggacuguugaggugugaacguggacccugagguaaagcaggcgcauagagcuguccccgccgugaccugcgguagccguagaucccagggacugcgaggcggggcagggcggcaggcaguuggggcggggcugagggccgagggcuggcggugacccaaggcgacggaggaaagccgugugggguggaggucagcgaguagccucucccgguggagaguuuguccaggugcccgaaagucgcuccacaggaccagcguugggugcgcgccaggcuguggcccucgugcagugcccugugugcuugcuuuucagaggccacagacacgccgaucgucauacagccggcauccgccaccgagaccacccagcucacagccgacucccaccccagcuaccacacugacggguucaacuaaauccaggaggagcuguggucagaggaggagccggcgccuggccacgccaaccuuagaaucaugaacuguagucacagagaugggaaggcagccuccugccugcccuggccuugcuggggccccuccugccuccacgcccacccagcgucgacccuugacccacgaagugcguagcaugcaguauuuaaagcaguguagcuacggucuucuguuuuuuucccuuuuuuaauagcauguaugggguucuguuccaugucuguguuguggacauuccgcggcaugaccgcgugaacugcacgguggagcugccucagggcugucggucagguugguccagugaggggugacugcagccggucaggugggcgaggagaaggggggcugccccuuuccuaccugugcuugaggggccggaggcaggugcugccuggcagagcuguguuaccgucuuggccucggggucugguccacacucugugcucccagccuugaggcugcaguaggacucugaucucaccugccagaagagaggcggggccgcguccuccuggcgucaccggcgucacugucauuccuuggugucugugcugggcaugguuggcuugggggucugugguuuccugggccuuguggcaggguuucucccgugggagaauuugguguggaaagcauaggaggccccuuccgagguugacaccguguccuccgcgguguuucucgccuggucgucucgucguguggacgcugccguucugguucucggagguguguccuucgccguguugggguuauuugucuguguuccugcacuuuucccgggcucugagcuggauugauggggccagucuccccccucccaucuugaggucguucuccacauuccuuccagcacaccuguccuuuccauagcccuuuuuggaccuuuagaaccacagaugauaggaccagcccaaugagccacagucagagaguagauugugcaugugugagcacccagcuacuggggacgggggcucucccacgaccccuccuccuguguuugccagagcucccaucugccccacucgccuuugccccgucaucgaugauucaggcagagccagauucguuaggucccuggaggaaggacugacuggaccagagggacccucuggcucaggaggguugggucccugggaggccggcagccaggccacagaauccacacguggaccauugugggucccugggaggccggcagccaggccacggaauccacacguggaccauugugggucccuugggaggccagcagccagacuacggaauccacauguggaccaugggaagucagucucuugcguguccuagaccuuguggguggcgcccugcauaggggagcagggggaacgggucugaugucccugugcuggcugagggcucagagcugcccgcacuccguagcucaugggaugugcugggccugccuuuggcgccaugcugcagacuccagugggccugguuucugcagaauguccaugguggccgcugcagaguugcagaggucccuguagagauaaagcugaggaggaggcugugugugauggcucuggcucggaccaaccagaugagccuccugaagcccccuucccugccugccugcugacccguggccccagcucacucauugcccucagcagccacccgaggcugugcagaaggguagguucagguugaccaggaagcugccaaaagggacauggauaugaggauacaucuggacgugcuuaggaacagggugcugguugagggcccccagcugaccccuacugcagauccgcauguggaccaugagccggcugccagcacuagguccugggcagcuuuguuugucccacuuuucuuuguuucuucucacuaaaaugaucacgaagaccuuugacaagaggagagauaugcacugugauauuaaauuagaaauaauuuaucaaaaucagaccucuccuaaaagaauaagaaauucauuguuuggcccauccugaaaggugagguggcgagacaguggggugccuccgugccgcuucgugcagcagcaaguucagccugagaugcuggcuguacucagccuuugcaauuuuuguagauguagcuuaggacgugaguuauuuuuccgcagacuggccaagagccagguucuaagcuuggaccuaagguagaaagcugcccaucgggggcccuagcucagccccaccaggcccucuguugggccugcacacagcucuguggcuagaacacuccaaggcccuucgguacccaucagagugggccccuugccagguggcuuuucaguuacagaguccaguggaccauuuuguagaaccaugcagcucccugcggaaggugggguagggugggaaagaggagcaggucuggagguuuguggaacccaguccccugcagaaucuguaaaaccuaauaaaucaugguuguggccauucucacgguggugauugugauuagacgacccccgggaagcccagacacucggggccuggaguuccucccccugccugaccuagaagcagaaccguuuucagcgcucugcccuguuggcuuuaaggcuuugucuuaauuuaaggaaaaagauccucccggguuuuauuucucucuuucuugaguggacuguuucccuauaauuaaaagagguggugaguccuggggcagcuuccgcgccucccuguccacgugcuaacagaucaggacgcccccagcaccccugccugcuuuugcugguggcagugacgggaccccgacuccucacucucgggccgcagacaaugcugugagcaaguguggccaugggcacagaaugucccuuuggacgccgcugcugggggcugccaggggcccucuggggucgugcuuugaggcccguccgguucacgaggggguccgggcagcacugacugcuuccgaccugcaggaggcguaggagcggcccugcgggcccuuucacggcagcugcugcuguauagauuugucuccacucagugacgugggauuuuuuugucuuccuuuuggcuuuauuuuuaaacugcuuuagauauuacugcucaguguuugugaacuuuccuaguucucuauguuguuagugcagccagcacccaguggggaccuacuagaaaaaggaacuggcaugcacacgugcccagcaggaaaagcuucgucuucacgucggcugcugccauccagaagaggcccuggagccucacgccgucgaggcugcucucaggcguucuguuccgggcgaggcuugugcugcaaggaagggcaccagcaugcaggcugccacuggaggguccgggugcugcgggcagaguucagcgcuuguccacccucccuuagcucugacucagugcauccuacuguggggacaucucgugaggggacacgaaaugacugaucucacccuuucccaguauucagagcugugaaccccuguggcgcaggacuggccugugucuguuauuuugguuguaaaucauucuccuguggaauuggcaaaagcuacauuuuuacuguccuuaccagcaacaguuugcgucgucacaugcugugagugugggcugugguguguccguguguguacauauguguauauguauauaucacgcagcaggagugucauucaugcugcuguccccuggugaagugacaaguacaauuaaagguggcucugaaauggccucugguuucuugggagucgggcagggaccugcaggaggcuuucccagcaggugcacagaaggaagcgcugagcccacugugugcagagggugugugcccagggcacugccacggcccccaccagcauuggccucugcucugcaggguggggugcccauccugggggcugugugucaugcucaccugacccaggugugugucccggugugaaaucgaggaggggacuggaagcccuucccugccuugaaacaugaaagcugauuuucugagcagcagauacggucaguggcaaagcugcaucugaagggcggccugggaaggggcccugugcuggccccggguccgccccagaggaguccacacagcaccaccuccagaaggggcugggcccgggguccugcaggcggcaccuuuugguagaguuuguuucccuggaaaauggggaaaauguuucaagccaggugaggggggaaguuaacacugaaauauguauuguuuuuaaaaaucaaaugcacacgcauggaagcugcuuguccaugcacugguuuugucacuggcguccuggaauccgaccguguuggggugcaggcgcugucagacuccggcugauccuggcucgagcacacacaucuaagggccaggcugguuccgcauggugaucuccgucuuguaugucugaauguuggccuaaaauaaagauuacuguuguaaaauaaauguuuucacugcggacccca

SEQ ID NO: 191287 - RNA, 52023 nt, Homo sapiens
uucugacacgagacauaaaaacuuuuaaugaaggaggacacagcucagagcccuuccacaugcggcccaacccugccccacggagaccggccauggcaaccgcucaaucagaagguguucuugaugcggccggccaccagccuaaggauguccccgaucuucuucugccaguuggcgauguccuuggacacggcgcaccacagcuccccaugccgaggcucugcacucucacagcgcuuccucaccuccuccugcugcuccuggggggaccacagggcacgucaggcagggguccucccacgcuacuccccggaccucgccugcuucucgccuggccccugcagaccuggcccuggcagcaccaaccccaacuggcgggccagagggcacaggcccugcaccggaaggcaaggcucuuucagguguguuccucaaaggagccccaccuccugaggagcauggaccccaccagccucagcccacagaugaggaacugagccaggcuccccaugucugugccucacacaagugcucacgucugccuucuccaaacaaggaguuaggguucacgugggcuggcaacacuuuccagggaggaccaggacagccugacugccuccagcacagcucagacaacgcuuggcucuagcggggcgggugggagcagaggggcugcugcccaggcuguccuagaaagccacacucaggcucaggcccaagaaaaaggccaacuccauucccauuccuaaagugagcccaggcuccagccagcaaauaacucguuaaaauacuccagcagacaggccacccuaacggacagggugccucaauuccaggguguggagcugugaggcuauaaccagaaaacggauguggaggcagagacugccuuguggggaggugucgaggauucugugccccacacacccgguccauccucccgaccccgggcagagucacgcuggccguggccaccuccuagagcccccagggcuggcggaacuccccgccacagucccagaaggcacugagcggcggucugucgaggggccucaccucagugccaugcugcagcucaaacuuguagaagaaggcccaggcaucccccagguccgagucaaucuucacagugcgguggaaccacucccuggccuuggugaucuuccgcugacuccaaaacagccuguuccagcagaaggacgugaacccagagugaguggcugcaggacgguauucuggggcaggggaacggcuucagggccaucagcuucaucccugacccgcagcccuggugcuccccucaagaaggccugaggaucagggccucggcugauccagaaauaauuaccccagaucauuaacuugaagcugcccuucacgggucuaaccaaauugguuuuuuuuuguuguuuuuuuuuuuuuuuuuuugagaaggagucucgcucugucgcccaggcuggagugcaguggcgcgaucucgacucacugcaagcucugccucccagguucaagcgauucuccugccucagccuccugaguagcugggauuacaggcaugcgccaccacacccggcuaauuuuuguauuuuuaguagagaugggguuucacuguguuggucaggguggucucaaacuccugaccucaugauccaccugccucagccucccagugcugggauuauaggcaugagccaccgcaccugucccaaacuguuucuuaaaaaauucacacgcagggaaagaucuuccaacuccguaaaauuagggucagauacaaggagaugaaacuaaaccugacacaaaauuaaacugcaacuuugaugagggaaaguuauacaguuucagcuccucacugagacaccugcuggaucauccugccccacccggccuccagcagcaaccccagugaacacugagaagaugggcuccaggcagcacaagggccugggccugcagcccacagcccucaggccacuggauucacaccgccgugccugccagacacaugcacaccugaaaaaccgggcccgaagagguccaugcuaugagaggccagguaagggugugcauggcacccccacccgcugcuggagaagggauggcgggcgcuggcugcugagcaugcuggcaggcccgggacucugcguugcugccacccucuccucagggucaccucccccuggagccagaggcaccguagucaagagacaacacgaggagccuccacuccgggcagcuguucggguucgucucaguugccaaacggaauaauuucacacucugauaaccugauuguuuuuuaagccuugugguauucuuaauugcccgguguuagauaaacugugauuuaaagagcacaaacccagauagcagacacacaaaacacuggcuugggaauagcaaggagugacuuauuuacuuuagcaaagccuuuuauaagguuuuauggcugcacuaucagagugucacccagaagucacucugggaggugaacgcacagggcaggaccaagguagcaccaggcagacacaagccucccuguggggagccucucucaucugucgggggccugcgggcaggggagaggaggugccccuacaggcaagccugugggggcggcacccagaccucuggagaccaagcaccacugccacccagugcuggggagaagggauggagagaaucaaaagccagcacuaggaaggcuguugucucugcaugacccauggcggggcagguggaggggaagccggacacaggagagcuccuggggccagacacgccaccucugccaggugagcccacguccugagcugcagccucaggaacccaggguucuuccaagaacucccuucaccccacauggucacuucccagccuccugacccacacucaggcccagcuccuucccagacugucauccucuuucuagaaggaaacagggacccugggggucggggauggcccugagcucccugcugugccccacaccuggcgggucuuugcccacaugugccuagagucugcaugcucugccccauggcuacccgcugcugccugcaagguuccagagucacguccccagugagucucugacccagcggccagcgcaccagugugaaucacacgcguccccagugagucucugacccggcggccagcacaccagugugaaucacauguguccccagugagucucugacccggcggccagcgcaccagugugaaucacaugcguccccagugagucucugacccggcgaccagagcaccagugugaaucacaugcguccccggugagucucugaccuggcggccagcgcaccagugugaaucacacgcguccccagugagucugugacccggcggccagcgcaccagugugaaucacaugcguccccagugagucucugaccacggcacccucaggugugucugccaggagaggcgccugccccagaccacagcaggagcgacggcagccgaggaucggggaagcccacccugcugccgggcaucuuuacaaugaccaggaagaggcagacagacucuggaaaaagagcccauuaggaccccgagguucagcaauccugugggggccccacucacuuggccacggccaggagcacaugggggucaugcucacacuucuucagggcauccacgcucuugguccuccucuggggccuugccucgaggaagauggccucagaccacaggauaccuauaauucagaaacaaagaacaaagauuugcacuccagccucugguuccggaaaggugcccagccuacagauucuaacccgggacguccucagaccacgacaggggccucccacacacggcucgcagaacuugugcaaggagaaccacaaaggaugagcacucuggcccacccaaaaccauggcagcccugagggcacagacuggacacccugcagagucucacucugucauucaggguggagugcaauggcgcaaucucagcucacugcaaccucccacucccgggcucaagcaauucuccugccucagccucccgaguagcugggauuacaggcgcccgccaccaugcccagcucauuuuuguauuuuaguagagacgggguuucaccauguuggccaggcuggucucaagcaauggacuccuggacucaagcaauccucccgccucagucucucaaagugcugagauuacaggcaugagccaccacaccuggccaauuucuuuuaaauuuuaaaagaaaaagaaaugauaacacuucagaaaugaaaucaaauucucccauuuugaggccaagaauuucauuaaguugucuuaacggccgaguauagcugaaacuuuugacugaaaugauucacacaaacuacacauuuuaauaaaguccgucugaagccugagcccccacucccucaggaagugccagcccugcggagucugggaagccaggaagcacccccuuaccggagucaaggcacccccuuaccggagucagggcacccccuuaccggagucggggcacccccuuaccggaguuggggcacuccugcagcgccuuggccaugaguguauuugcgauguucuucagccccgcacgguacuccagccgcacggacuccaaccugaggagacaggcccccggaggucccacagccgucuaccaacagcacauauucugguagcuucugggaagccuugucugaaagggcucuccacccagucacagcagcaaaaacuccauucccuccacagcagagcucauccaccacagaaacaaggcgcuggggcccacaucccugccagccccacuggcaaccgccccaaggcaagaccucagauccugacgcuguccagaugcaggugaaggcauccagaacaaacaagaccagacugggagagccagggccgcacaaggcacccagaagcugccugucugcggcagugccugcacagugcuccagccccgucacccugagcuggacgcagcaccuccaugaacagagccugcaccuagcaggcuccuguccaccuccagggcucuccacgccaccuccucuguggagcuggcucuccgggguccauccuucccucgucccagccaucauuaaccccucccucucccaggcgcccuccaucagaacacaaauuaaacugcaucaaaccaucuacaggccugucacaguaccuaggccgaacucuccuaaggcagggaccgugauuuuucauggccagcaccuaccgccccccaagccccugagccuggaagcacugcacgagugacuccacacaagcagcugggugacggcggcccaccugauggggaagcugugcccagaggccaggcugcccccuccaggacucaccacagcccaggguucuuuggguucuucagacgagacuuuuccaaaauggcccgugcucgaguaagcugcccaaucuucuccuccagccgagagagcaaaagccacagggguguggaguggggacacuucuucaacugcaaccaacaaguaagagagcagcucagguggugucuaugaagaacugggacacagccaugcccagcuucucaucugcagugggugaccgagucccucagggcugccauguccauggaaaaacaccccucacacucugcauuuguggguguacaggugugcgguggugcuguggaccugugcacacaggucuguacguaccagccuuuacugcaggugugccacacucugcacuucugagcagugugugcagcuucauauaaggaaaagcacagaacucagcgaggggaccaggguuuggguccugagucugcagcuccaucagcuguaacccccagcccuccacaucuccucagaggcgaagggcaaugacccugcaccagggggcucaguuuugugaaugccgggucagcugcagccccagggugcaggcagagacguacccccugguuauaggcuucccgcgccuucuccaucaucuccuucugcuccucgaucugccccuucaucauccacagcuuggggaaguccucauagugccgcagggccuccucgcacagaucuugggcugcccugauguugucuugcacccacuccagcuucacagacuucaugaacaccuguggggcagacaugcacugucacgcagggcaucagcuccaggguacgugcuucaugguacacucauccucaacacuguuaccugcaguacuguguguacuuuuguaagcuuuucauagccuguuuguguacacaaaagguggggauaaauauauguuuuuguuuuguuuuguuuuuuuuugagauagagucucgcucugucacccaggcuggagugcaguggcacgaucucggcucacugcaagcuccaccugcuggguucacaccauucuccugccucagccucccaaguagcuggaacuacaggugcaagccaccacacccagcuaauuuuguauuuuuagcagaguuggucaggcuggugucgaacuccugaucucacaaucuaccugccuuggccucccaaagugcugggauuacaggcgugagccaccacacccggccguaugaacauguuuguuguuguuguuguugcugagacaguuucccucuugcugcccaggcuggagugcaguggcgcgaucucagcucaccgcaaccuccacccccgggguucaagcgauucuccugccucagccucccgagcagcugggauuacaggcacgcaccaccacgcccggcuaauuuuguauuuuuaguagagacgggguuucuccauguuggucaggcuggucucaaacucccacccucaggugaucuguccgccuuggccucccaaagugcugagauuacaggcgugagccaccgcgcccggccaccacgcccggccacaugaauguuuuagucacaucacaaagaugagugugcuguggucucguuugccugccgucaucucacucccaucaccacccaagccaggcguggggcccgcaugugcacaccaugcaccccagacggcccagcccugccugccacugcguacccgggcggugggggcacugcuccgcgccuuggccagcagccuccgggcccgcucguacucaucauucucggacuccagcuucacggcugccagccagaucuccucacuguugggguuggccugaagggcaaguacagcagcgucaagaggggucagaacacagggaccagcgccugaucacacuuaaucaaaagcaggcaggcaggaacugagccaggccuugcucugcuacaggauuagucugguccaagcccuucccagggaggagaugacagagccgacuccagugcaagaauccagacucaccuggaaacacacaggcccauguucacucugguacagugaggacagugaagaggcugcuaaagcacucgagcaauaacgggggcaggugcagggccaucuuacccaggauccacccacgcccucucaaagccccugaauggggcacucgcauccuauacugguagacucaucacacgcaaccucgcucuuuccccugagcuugaugaagggaagccagcuguccuguccucaugagcccacaugggcaggagagaggacucccagggugccacugacauguggagaaggcguccacaagccacggaagcucacacagcccagagcccaguggacacgcaggcucugcccucaaagccuccccagcccggugcccagggcugucugaaugcgucccaaucagcacagccgcccaagagagcggguggaaggaagccacgugacaggcagagagcgggcagguggaggggacgcugcaguuacucacaggagugaugccaucucaaacaggcagcugagagcgaaagguuaaacccaggccaguccccucucaugguauuugcucaaagaagggcacacucuaugauauuagccugagcuacaguaacagacuuuuauauagcauucuauagcuuauuaaaaaguauguuauaaacuauuaggauguuauaugugaaaauaaagacaagguacuuaaaaaaaacacacaccccccucaugacaaccaggcacccucaggccuggcucagugaggcggucugaauacauccauucacauaagggcgcccucagccugugugaccccguguuccauguucugaaacauuuacccguggucacacugaguggggggaccgagagguaaguaucugccaggugggcugcuuuccugcucucgggccccuucacggccccugcuccuguggagcagccccuggacuccagugcaccccaacaacagcacgugccacauuguaugugggagauuuucaggccccagucagcacccaggucagcuccugugugcacaggccccucaccacacaggcaacccucacccaccuggaaggccagggccaggaugcuccuugcugcaggcacauccccugccagccacuuggacuuggcgcccaugagccacagcaccucugcuuuggggcagugggccacagcccucugcaggagugcuuccagggacucccugcaagauaagaggccacggucaccagaggcagggccauaaaccagaacacacaucacacucagccauggcgugggcacgccagaaagacaguuacugcuccaaaguucgaugcuauaaaugauugaccagauuuuacaauggggagaguguggggaaaucuuuccucuccauaaagguucuaaaaucaacuacugaagaggguucuacaaaggaaugcauuguuuaaauagcagagcuggagagacgaacuucacaagagaaccuuuuacagccguguguccuggaagcagcaauaaccucagucugugacaggggaggccuuuucaucuugaaccacagagcacaagcgcaccccggacccacugauaaagauuaugaucccagguucacucucccggcauccaaaagaauuaucuuauaggaagaaagugauuucaggucacuauugagcaaaacugccagccgugggcaucaggucugaugcuccuggacucucauguggcccaccacccucagucacaucaaugaccccuuugggccucagugagugcgacagcaagacaaagugaccacacacaaucacacuguguggagcaagggccagcaaagcaaccgugcucuccagaggaccagcucccccagcacuacugccucuccucaucccugcaagcaugcacucgggagaaggcagggaagucggagggcacugcccacugugcccaggggucaagggcagcaguucauauucaggucacgggccgagagaccucagccuacaccuggcaccgcccuguucuucacucagacugccccaggugaccuucuacagaggggcaccauggcagccauuucaaaacguccccaaaggagaucacucccaaacacagaccagcuggugggcauggggagggggccaggucuucaggaggacacauggaaagacacccugaagaggcugagauuaaaucacaccagaaaagcaaagagacaauggcucaacauucucagcuguagccccagugaaaccagcagggccuguccucaccugguacagggagcaucacccgaggaccugggagaggacggacagagggugcguggggacacgagcccaaugcccuugagagcuauccauuuaaaacaauaaacugcaacgccaaauuuaaucagcauuuacagccaauaaagcggaccugaaagauguuuucaauuaaagagugcaguuaaauaaaauugucaaggaccuccucugagcacaaaaaccagucaaaacccaaagccagcacagcuuaaauggaaaauaugccugccugagcccagaugcugccccacccaccgcugcagccagugcucggccaugggccacgcgggcuccagccucaagucuauacccaggccacuccucaggcuacaggacacuuagcaggacgggcccccgggguuccuuguuucucagcuagaaaaugguaucauugcugucccagaaggggcuauaaagauggauccaguugcaaagucccaaaugccauaaaauccuucaucacaaccagagggccagaccucaaaugggcacaagacuggaugagcagacaugagagguuuaaauucagggcuacacaaauggagcuggagguuucauuagcacccuugggcaggcgggucccaccacauaccgagugccaugguucuucucgaaguacgcggcgcgcagccacacacucuucuugcuggggaacaccugcagggcguaggcguagauggcucgugcacacuccagggcauugugggcuacacacuagagcagagagagacaugagaaugggcagcccagcacuggccacagaacaaguggcaugaugcccuccccaggcucauacgauucugaaagaugauaucugcuagaagguguaccacaguguuuuaucuaauuagaaccacaauccaggccaggugcgguggcucacgccuguaaucucagcacuuugggaggccgaggcggguggaucaucugaagucaggaguucgagaccagccuaacuuacauagugaaaaccuaucucuacuaaaaauacaaaaauuaaccagacgugguggcaugcgccuguaaucccggcuauucggcagucugaggcaggagauucacuugaacccagaaggcaaagguugcagugagccgagaucacgccacugcacuccagccugggcgacagagucacacucuguccucccccuccagaaagaaaguagaaccacaauccaggacugggaaaccuacuucugggcacagaaaacacuguaguucuuacuccagcauuacaagcacuuugaaaaacagcugugcuuacuccaguguacaugaaagagacaagccugaggaugaggacaagaaacaagaacacugaaaaaggggcacauggggcugcuugcugcuuccuuggccugcgagaggugcacaagucacuagcugcaggugauggaggugugcacacacaugcacacacagggcuguggcugaggcauaugcauacgugcaugcacacacacacacacacacacacacacagggcuguggccgaggcauaugcauacgugcacacacacacacacgcacacacacggcuguggcugaggcauaugcauacgugcacacacacacacacacagacacggggcuguggccgaggcacaugcauacaugcacgcauacacacgcacacacacagggcuguggccgaggcauaugcauacgugcacgcauacacacgcacacacacagggcuguggccgaggcauaugcauacgugcacacacacacacgcacacacacggggcuguggcugaggcauaugcauacgugcacacacacgcacacacagacacggggcuguggcugaggcauaugcauaugugcacgcacacacacaaacacacgcacacacagacauggggcuguggcugaggcauaugcauaugugcacacacacacacagacacacacacacagacacggggcuguggcugaggcauaugcauacaugcacacacacagacacagggcuguggcugaggcauacgcauacaugcacacacaugcacgggggcuguggccgaggaauaugcauacgugcacacacacgcacacacagacacagggcuguggcucaggcauauacauacaugcacacacaugcacacgcacacacacacagacacacggcuguggcugaggcauaugcauacaugcacacacacacacacacacgcacggggcuguggccaaggcauaggcauacgugcacgcacacacgcacacacagacauggggcuguggccgagccauaugcacauacaagugcacacacacacagagggcuguggcccaggcauauguacguguacacacacacacacaugcuguaacugcagaucaaacauauugguuucuuuuuuaaaaaucagguauaguggcuacagcgguggcucacgccuguaauuccagcacccugggaggccaagcuggguggaucaccugaagucaggaguuugagaucagccugaccaacaugguaaaacccugucucuacuaaaaauacaaaaacuagcugggcaugguagugcauggcuguaaucccagcuacuugggaggcugaggcaugaaaauugcuugaacccaggaggcggagguugcagggugccaagauugcgccauugcgcuccagccugggcgacagagagagaccuugucucaaaaaaaaaaaaaaaaaaauuagguauaguauauauuuaccacgauaaaaaguuacauuaauuagaaaccuguaaaagacaagugaauacaaacaggaaaaaacccauccacucaacagaacuacaguaaacacaguucuauuuucuucaggcuuuuuuuucccuauacucaagaaugacuuuaucuuuugguuagcaucaacaacaaaagaaaacaaaaaagccagucaccauuugcagcgcuaaagccucuggggguucgucugacuggcgaucaugacaccuggagacucacugggccagguucagacaccuguucccacucagccucacacaggggcaagucaccguccucugcgcccugcagaugcugaaaggauuuuuuuuuaaagacagagucucgcuuugucacccaggcuggagugcaguggcgcgaucucagcucccugaaaccuccaccucccagguucaagcaguucuccugccucagccucccaaguagcugggauuacaagcgccugccaccacacccagcuaauuucuguauuuuuaguagagacgagguuucaccauguuggccaggcuggucucgaacuccugaccucaagugauccacccaccucggccucccaaaagugcugggauuccaggcaugagccacugcgcccggccgcugaaaggauucuuguaccaagaaggaguuuguugcugaagguaagugagaggccaccaggaagugggucaggaacaaaguuuugcaacuaugaacaugacaauggcaaagaucuggacuggcagcucaaagcuguccaaguccccacacaggggcacccaagaacaguucccagaggaacagcugccuucuacgagaggaagggacaacagugagccucccaguuaaggagccccagcaugaaaaugggucaggaggacgaggaguggggaugucacugagauuucuucacucagaccugaugccucccaagucacauggcuucagucugacucaaccagcacagaaaccagcaagggcccugccucaggcacuguguccugaccaggagcaucugagggggucagggaggaugccggugagggucaggcccuggauagagcacucuggucuaugccccucucugugauuucugauccaaguccugaggguuggugacaaagcauuucagauucuccaucgccuccuuggaccuucacaagcaacccgagaguggccugaacacccacaggaucaagugaugcugugcccagggcccugguguccgggagggaagcagcaccacagcacacuucugggcacagaaaacacuguccuccuuacucuagcaucacgagcacuuugaaaaacagcugugcuuacuccaguguaugugaaagagaugacaaaauaauaagagaaaaacaggccaggagcaguggcucugggaggcugaggcagguggauggccugaagucaggaguucgagaccagccuggccaacauggcgaaaccucaucucuauaaaaaauauaaaaauuagccaggugugguggcaggcaccuguagucccagcuacucaggaggcugaggcaggagaauugcuugaacccuugaaccugggaggcggagguugcagugagccaagaucgugccacuggacuccauccagccuaggagacagagugagacucugucccaaaaaaaaaaaaaaaaaaaaccaacaacaaaaacuauuaccgcugcccugcgucuuaacucaccuaaggauugauguguguauuuuagcauacauggggcaggaggauggcccagccggcacacaagcucugggucacgccacacggggugcaaaagaaucauguguguaucacacggucaaugccagcaguggggucugauuccaaggaccaaaggaggagccauugaccaauccagauggaaggaagugaacgcacacggaugaaggagaaagugaagcucuucguuacuguagaauuccaacuaauaaaauguaagagaaacuguucacaaaaucauuaugcaggugugaccaggcacagugacacgccuguaauccuacauacuuugggaggcugaggugggaucacuugaggccaggaguucgaaaccagccuggacaacauagugagauacuguuucuacaaaaaaaauuuaauauauaaaaaaagauuuaaaaaaaaucaccauuuagcaaacaccacagaaauaacugauucaggccaagaagcaucauuaauggauccucaaaauacuuauuaauaauaacaaagaaacaaacagcaaccauacaguggaaacaccugcggccacugcccgcaccagacggucggaguugaacaggugcacaccucuccguaugaugcaccaagaagccucaacccaacccggaggagacaccacagagaaccagaugaaagaggagucuacagcaucacuggcccgugguccucaaaaaauucacacucaggaacaacaaaggcugaggcucucuuccagacuagccugaggaugacccuguauuccucacagaagacaguugguuuuuucuucugcuaaaaggacacagagacaacgggugagacuuuuucuuuuuuugagauagggucuugcugucacucaggcugaagugcaguggcgcaaucacagcucacuacggccccaaacuccugagcucaagugauccucccaccucagccuccugaguagcugggacuacaagcgugcaccaccaugccuggcuuuuguuucuguaaagaugguguucugccauguugcccaggcugguuucaaacucccgagcucaagcgaucugcccaucucggccucccaaagugcuggaauuacaggcgucagccccaugcccagccugugggugagauuugaguaaggucugaaguuaccugacagcacugucccaacaucaauguccugauuuugauaacugagcuauggcuguguaagagaacguccucuuuuaaagaaauacacaccaaaguguuuaagguaaagggcaccacaucugcaacucauucauugucaaacaguuccagaaaaaaaaauaagagguaagugcaugagagcgaacagaguaagaaagcaaaucugcggccaggcguggcgccucacgccugugaucccagcacucugggaggccgggcgcggcggcucaugccugugaucccagcaccgugggaggccgggcgcggcagcucacgccugugaucccagcaccgugggaggccgggcgcggcggcucacgccugugaucccagcacucugggaggccgggcgcggcggcucacgccugugaucccagcacucugggaggccgggcagggcggcucacgccugugaucccagcacucugggaggccgggcgcggcggcucacgccugugaucccagcacucugggaggccgggcgcgguggcucacgccugugaucccagcacucugggaggccgggcgcgguggcucacgccugugaucccagcacuuugggaggccaggcauggcggcucacgccugugaucccagcacucugggaggccgggcgcgguggcucacgccugugaucccagcacuuugggaagccaaggcgggguggaucacgaggucaggagauuaagaccauccuggcuaacacggugaaaccccgucucuacuaaaaauacaaaaaauuagcugggcgugguggcacaugccuguagucccagcuacucgggaggcugaggcaggagaauggcgugaacccaggagguggagguuguagugagcugagauagcgccacugcacuccagccugggcgacagagcaagaccccgucucagauuuaaaaaaaaaaaaaaagaguuuuaaaauagccuaguaguuuauaaggugccugcuguucccacaagcagagacuccauauuacggacaaaggccccuguugccaacucacacugucagcauccuccauccagguaugcuuccgaucuuccuccucaaucccaaucccaaucacggcacgcaugacggccuggcagguggccacacucccagcccugucacauuccucggcauccugaaagaggaacacaaaacuuauuugugauuuuggaaaucagagcugcagauucccaacggggaguacggaguuccugaacgguuaaaacugacagacaucagcacaagaugcugacacugccuacuggggaucugaggaagugagucuacugcacgccaaucagaaaaaacaauagagaaaugucacaaaggacauaggcacacuguucacuagaaaauaaaaauacaaacaacuuucaaacaugugaaaagaaauguaaagccuuuuuauuuuauuuuuuuaagagacaaggucucagccaggugugggggcucacaccuguaaucccagcacuuugggaggucgaggguggaucacguggucaggaguucgagaccagccuggccaaccuggugaaacccugucucuacuaaaaaauaaaauacaaaaauuagccaggcgugguggugggugcccguaaucccagcuuacucgggaggccgaggcaggagaaucacuugaacccgggaggcggagguugcaguaagccaagaucacgccacuccacuccagccugggcaacggagcaagacuacgucucagaaaaaaaaaaaaaagagagagagucaaggucucucccugucacucaggcugaagugcugugguacaaucauaguucacugcagcuuccaacucccaggcucaagggauacucucaccucagccucccgaguagcacagacaugcaccaccaugcucaaugguacauuauguuucauagauacagggucuccuuauguugccuaggcugguguuaaacuccuggucucaaguaacccuccugcuuuagccucccaaagugcugggauuagugcauaagccaccacacccagccccuauucuuauuuucaagaugcuaauuaaacuauucuaaguaccauugugcacguaucagaugagcaacauugaaacaugugcugacuggcucacuuggugaagggggcauaaaucuuauacugcaaagaagcacauaucucuauggagggcaauuucucauucucuaucaaaauaaaacaggcacauauuugacccagcaguucuacuuuaaggcauucaugugacaaauauauucccaugugugcaagagaaugugucuaccaacaagagaacaauaacccagccagagcaacagggugcaggagcacaggcaccacugcggcaugccaacaugggggaccacgacauggaccgugagcaaagugcaaccggagccacaugccucccagacccucccagggcccugccagcaccagaaaaccaucccagacagaaagcagagccaagagcaaggaucugaggcagagacgcuggcacaaaggucaguggugagaagaaugcguggggcaaggacccagcacccagacccucaggggccugcggcaaaggugcuggcucuuccuccauggacaguuucuacugaacgcaaacugcgcuggcucuuccuccauggacaguuucuacugaaugcaaacugcuuuugaaccacggcaaaagucaaaccaugggaagucagggaccaucuguaguugcaaaucaugucucugauaagugacaauauauccagaauauauaaaaacaucucuuacaacucaauaauaaaacaacagacaaaaauaauacauagaccauaauaaagacacaauccaauguaaaaguaggcaaaggauuucaauaccuccaugcuacaacauggaggaacccugaaaacacacuaaguuaaggccagucacaaaagaccacgugucgugugauuccacucacggugucggacgaugcaaaagccaccacgcucaguagaagcaauacuuugacucaaaccaccagucuguuuuucacuuucaucguagcauucaauaaauuacgugaguuauucaacacuuuacguucgaugacucugcccaacuguaggcuaagguagguguucugagcauguuugacguaggcaggcuaagcuguaaaguucaguagguuagguguaucacacgcauuuuauuucauuuuauuuuauuuuauuuauuuuuugagacagagucucgcucuuuugcccaggcuggaguacagugucacgaucucggcucacugcaaccucugccuccgccagguucaagcaauucuccugccucagccucccgaguagcuggaauuauaggugcccaccaucaugccuggcuaauuuuuuuguaucuuuaguagagacaggguuuuaccauguuggccaggcuggucucaaacuccugaccucaagugauccacccgccucagccccgcaaugugcugagauuauaggugugagccacagcacccagccucaaauccauuuuagacuuaugauauuuucaacuuacaauggguuuaucaggauauaagcccauaaguugaacaucuguauauaaaauguccagaaaaaaauguguagagaaagaaaguaaaaaaacaagguuagacaggcacgguggcucacgcuuguaaucccagcacucugggaggccgaggcagguggaucaucugagcucaggaguuugagaccagccugaacaacauggcaaaaccgcgucucuacaaaaaauagaaaaaaauuagccaggugugguggcgcaugccuguagucccagcuacucaggaggcugaggcaggagaauugcuugagcccaggaagcaaauguggcagagagccaagauugauugcaccauacacuccagcuugggagacagagacccacccugucucaaaaaaaaaacaaaaacaaaaacaaaaggcuacagagguaugaaaauggggagcaacaacucacggacacaggauuucuuucuggggugaugagaagguucuaggauuguggugauagcgcauagcucugugaauauacuaaaaccacugaaucguaaacuuuaaauggguggauucuguagaacgcuaguuauagcuuaauaaccugucauaugcuggguauggcagcugaugccuguaaucucaacacuuugggaggcugaaguggcaggauugcuuaaggccaggaguuuaagaccagccugggcagcauaacaagacaaaaaauaaaaauaaaaaaaauuggccaagcaugguggcacacgccuguagucccagccacuugggagguuaaggcgggaggauugcuugagcccaggucaaggaugcagugagccaugacugcaccacugcacuccggccugagcaacacggcgagacccugucucaagaaagaaagaaggaaagaaagaaagaagaagaaaggaaggaaggaaagaaagacaaacugucauaaaauauaacagaaaauaguaauuucauuauuuauuuuucuugagagaaacauaacucagugggugacuccuuaaaagaaggcauuagagggaacccaagcccuacuuccuaaguuagaucaucuuuggaaacuuuucuauagccuuaagucuacagacaaagauaaaagacagggaagaccaaggcgggcagguugcuugaggucaggaguucgagaccaaccuggccaacauggugaaacucugucucuucuaaaaauacaaaaauuagcuggguaugguggcgggugccuguaaucccagcuacucaggugacugacguaggagaacugcuugaacccaagagguggagguugcaguaagccaagaucgugccacugcacucuagcccucuagccugggugacagaaagacucccucucaaaaaaaaaaaaaaaaaaagggugugggggagaggggaagaguaaaagaagccaugagacuuccuguccuccucucguagguguaucauuucuacuagcaaagaaagaagccaugagacuuccuguccuccucucguagguguaucauuucuacuagcaaagaaagaagccgugagacuuccuguccuccucucguagguguaucauuucuacuagcaaagaaagaagccgugagacuuccuguccuccucucguagguguaucauuucuacuagcaaagaaagaagccgugagacuuccuguccuccucucguagguguaucauuucuacuagcaaagaaagaagccgugagacuuccuguccuccucucguagguguaucauuucuacuagcaaagaaagccgugagacuuccuguccuccucucguagguguaucauuucuacuagcaaagaaagaagccgugagacuuccuguccuccucucguagguguaucauuucuacuagcaaagaaagaagccgugagacuuccuguccuccucucguagguguaucauuucuacuagcaaagaaagaagccgugagacuuccuguccuccucucguagguguaucauuucuacuagcaaagaaagaagccgugagacuuccuguccuccucucguagguguaucauuucuacuagcaaagaaagaagccgugagacuuccuguccuccucucguagguguaucauuucuacuagcaaagaaagaagccgugagacuuccuguccuccucucguagguguaucauuucuacuagcaaagaaagaagccgugagacuuccuguccuccucucguagguguaucauuucuacuagcaaagaaagaagccgugagacuuccuguccuccucucguagguguaucauuucuacuagcaaagaaagaagccgugagacuuccuguccuccucucguagguguaucauuucuacuagcaaagaaagaagccgugagacuuccuguccuccucucguagguguaucauuucuacuagcaaagaaagaagccgugagacuuccuguccuccucucguagguguaucauuucuacuagcaaagaaagaagccgugagacuuccuguccuccucucguagguguaucauuucuacuagcaaagaaagaagccaugagacuuccuguccuccucucguagguguaucauuucuacuagcaaagaaaugcagucaggugugcacacacugaaagggcuucugaaguguucaccccaagacgaacuccaggccugaauccaucaagagcgacagugggcaugcccaggucccucagggcccauucacaccugugccugcuucugguuuggcacaggacuccccaguaccauccagcaacccccaguccugcgugggacucucacgugcugcaugugcacuguuaaagcagacaccacgacacccgccugcggcccaccuggauccacugcucacgguugaucuccacaccguuggcccgcagcgaggugauggcucggucgaugaucuucuccaccaucugcguguucccauuggcuuccuccagcuuagcagccgugauccagauaugucggucuguaggaauguucucccgcgccuuguucaagaccuugcgggcauuuucauaggucuccagccuugccagagcaagccagagcuacgcggagaggacacgagaaaaaggagaggacacugugcuggggggacagcugcaggccagacagcgacccacccuccagcguuggccaccacguucuuucuuagcucucgagaaccaucugaacauggccugagaaguguccacagcagcacuucucaccugaccaacuguuccuuuaugcuucugacucauuuagugacucucgugagcaucaaaagauucucaguugaauguucacaaacacagccuccaggcacacagcacgccagaccugauaccaggggcuggcacagacgagcaggaugaggcuacugcccucacaggcuaaacacacagaaggguguucagccuccugaaguucccagacccuugguucugcagcauuccaucccuaagauguguacgggcuuuauucauuuuuauguaaauaaaauaagauuaauguuguuuggagaauuucacaauaccccuuaggauaauuaaagacauacuagguaucauaaaaccaagacuaaaaaucacugcacagaaugcugugaacuggaaugcuuaaaaccaaagaaaucccacuuagcuuagaggcaaagagcagucaugcggagcugacagaaagcaauguuuucuaucacgcugccaccuucggcucccaugacaaacucugggcugcugagaggaaauggccccugagcaacugcccaacagagaauuuucugcaguggucagguaugagcuaagauucucccugcacguccauuaagagcacagcuagcugaggccacugaccacccugccuagcggcuauguacagaacggcauccugggguuccacagggccuucugcucccagaaauugcagccugagugagcucaaugcuccacuuguaucaucacuuccagacacugaaccugggcucaggccuuggccacuuugggcucugguggcccugagcccgccagacucaccuccacgcugguggggcagcacuccacagcucggcucagcaugauucuagcaucuucagguucuuccagcucaacggcugcuuuccacaagcgaaccgaguuuggaacaugcucgagggcuaggaaaggucaaacgagaaaccacgucacagaaaaggagauaaaaacaggaggcucauguggugagcaugcugcuggucaggaugagacggacuucccugguugacagucagggaccacacaccugcccuuuauguggcuuccuucaggucuggggcagacacaaacaaggacaaacggagcaucuugugguagcagaaagcaaggaagugacugaagacugccagggucauaucaacaggacucaggaaaccagugaccacgggaaugaaccucaaaaacaugcugaacaaaagaaaccagucccaaaacaguuuauacuauaugacucccuuuaugugacgucugaaaagaggcaaaacuaaucuugguaaaauaagucagaagcaugacugccaacgaauggggauaguauggauugauugagaggcaccaggggacuuucugcggggauggaaauguuuuuguuuuuguuuugagacagagucucauucuauugcccaggcuggaguacaauggcacgaucucagcugacugcuaccuccgcuuccuggguucagagauucuccugucucagccucuaagguagcugggacuacaggugcgcaccaccacgccuggcuaauuuuuguauuuuuaguagggacgggguuucaccauauuggccaggcuggucucaaacuccugaucucaagugauccgcccgcuucggcuucccaaagugcugggauuaugggcgucagccacggugcccacccuggaaaugcucuaugccuuggucgaguguggguuacaggggugcaugcacuugugaagacaucaaacugcacacuuaagaucuacguaauucacuucaaauauuuacgaaaaaaugccagugucugaaauaccucucuuuuuuuuuuuuuuuuuuuuuuuugcgauggagucucgcucugucgccaggcuggagugcaguggcgugaucucggcucacugcaaccucugccacccggguucaagcgauucuccugccucagccucccaaguagcugaguacaggcgugcagccaccauacccagcuaauuuuugaaauuuuagcagagacaggguuucaccauguuggcuaggaugguuugaucucuugaccacaugauccgcccgccucggccucccgaagugcugggauuacaggcaugagccaccacgcccgaccuaaaauaccucauuauuacauguuuucccuuaaauaaaaauaccuaaaacuuaaaaaaaauucaagagcaaacuagaagagacuuccacuggacaaugaucagagagucugaaggucaauaagcauauuaagaauauuaccugcaauguauucaaacccaugaaauaccacagcauucaauaguucauaacaaagcuccaagagaccauuagucaccuuuggagaaugcuagagaaucaacgcaucaucccgaaaguugaaaggaagcaaaucaaauaucuauucugucuuucccaaauaaacucagaauaaccaaaucauggauauaggaaaauucuucucuuaagaauaauucuggcaauaaaagcaaagagugaccuaauuauaaugucaccguuuugcacacccuaaugaaggaacagaugcgggcacgggucaccagccacugccaaaggcaggagcugaaaggcuguggagaacuccaugaaggacacuggggccacugagcagugacagccucugcagcuccugacgcugcuugcauugccacgaauauuuccuugauaaaaaaagaaaaaaaaaacacaaagcuuacucuuaugagucuccaaaucuaccuuccaauuuacaagaggauacaggaaacagaggauacaggaaacgagacccacaugaaacaaucucacaggcugcagugagcaaacccugaugugaggaaucucaaggaaaaacaacccaauuccaucaacaaaccgagagaagacaucaaccaaacggcaauguucagacuuugcuuagauccugauucaaaccaaccaugugugcaugugguuaugcaugcaugugcccgugcagguacugacaugacagcuggaaaaauaugaaugcaguagacauuuaaugauguuaagaaauuaggccgggccagguacagcccguagcucacgccuguaaucccagcacuuugggaggucgaagugggcagaucaccugaggucaggaguucgagaccagcguggccaacacagugaaaccuugucucuacuaaaaauacaaaaauuagccagguaugguggcaugcaccuguaaucccagcuacuggggaggcugaggcaggagaaucgcuugaacccagaaggcgcaggugcaauaagcugagacugugacacugcacucuagccugggugacagagagagacuccaacucaaaaaaaagaaaaagaaauuaggccaggcagcugauuguggugguucacaccuauaaucccagcauuuugggaggcugaggugggaggaucgcuugagcccaggaauucgagacuagccuggacaacauggcgaaacccugucucuacaaaaaauacaaaaauuagcugggcgugguggcauguacuugugguuccagcuagcugggaggcagaggugggagaaucgcuugagcccaggagguggagguugcagugagccaaaacugcaccacugaacuccagcuccagccuaggcaaaagagggagacucagucucaaaaaaaaaaaaaagaggaaaagggcagggcaggggaggggaggcggggagggaagcggaggcggggaggggaagaggggacgggaggcagaggggaggggaggcggggaggggagagggcaagugagcuagcucuccugcagguaccugcucuccugcugagaaacagccccaggcuggcugugaggcccuggcagggaaugaacacucagcuaagggacauaaaaugacugagcaaccugcugcccacuccagguguuacugacagaccaagccacaagguugggcagaugcagcaguggccucauaggguggaaauggcacccaggagaugguguggaaggaaggcaggugcagcacagcugccuaagcuauggggcagaugccuccugcacugguggcugcucaaccgcuuuccucccucagcccacacugacaaccucuggggagucccuuagggucaagggacugagaagacaaaagucugcugugguuuacgcaugguucugcacagcacacuggcacugacaccccuggccuuauuaucuggauguccacuugaccaacugaaagacggccagaagacgaagcuauaugaauucaccgauucaggcagaacauggucuuaccaugugcccaucacucagagccauggccuggcagcccaguaggaugccacaaaugcugugaauagacaccaaucccggcuggaucucacagccagaacacacgggucuaggaauaaacagugaugucugaauggcucaagucccaucuccgcugccacaagucccgucuccacugccaagagucccgucuccgccuccuuggacccuccugucaagagagcugguccaaaggccgggugugguggcucacauuuguaaucccagcacuuugggaagcugaagcggguggaucaugaggucaggaguucgagaccagccuggccaacacagugaaaccaaaccccaucucuauuaaaaauacaaaaauuagucgggugugguggcaggugccuguaaucccaucuacuugggaggcugaggcaagagaauuccuugaacccaggaggcggagguugcagugagccgagauugcgccacugcacucuagccugggcaacagagcaagacucagucucaaaaaaaaaaaaaaaaaagagcaagcuacgagcuacuccaaagggaguaugugccaaccagggugcagaccacagcucccucuggccuccucauguaccagcccuggcuggagaggcuaacccugacucccaaagcgagacugaguugcugccacccacugugggagacuaucuagaggccaguccuaaaaacaguuuaguauuucugcuuuuaccaguaaaaguuaaugggaacuacagccaccaaaaaagcaaaacuaccaacaagucagacccuuuggggauaaagauauggguccuggcugagcacaguggcccccaucugcagucccagcauuuugggagacugaggugggaggaucacuugagcccaggaguuuaaaaccagccuggaugacacagggagaccucgucucuuugaaaaauuaaaaacucagccaggcauggugguaugucccuggagucccagcuauucaggaagcugagacuggaggauaguuugagucugggagguugaggcuucagugacccaugaucaugccacugcacuccagccuaggcaacagagcaagauccugucucaaaauaaaaauuauuuaggcaugguaguauguaccuauggucccagcuacucaagagccagaagcaggaggaucacuacagcccaggagguugaggcugcagugagcugauugcaacacugcucuccagccugggcaauaggacgaggcucugucuaaaacaaaaaaaagauuuggguuacucauccaggucaagaacccugaccaagcagggugacagcagagggcacagcaguaaagaaggaaaguccuaaccuccaaccaggcgacuaggcauagagagaagacacagaacgacccaguuguuuuuccugugcgcucucaccucgacugcgugggagaugagugcucuauuugucuaaauaugaacuacuucccuuaauacuuuguacauugguggagaugaacuucgcgucucuaaagaacagaauauucaugcgggacucaauuuauggagucauuaacuuacgacucccaggacucugugucuucaaguuuugggagagagcugacauaucuccauggcaucucaucagcagcccacaggcauggcacuaaaaccaacaaggucaccuuccccaggugcuuucggaagccacauggcacaccaugauacaauggccuucaaggagugugacuuuaugagcagaaguggaggaagcacacaccccugaaguuggccuagaacagaagaguauucugaaugcuagacacagccaugaagacgugaccgugcagaggccaacaugcucuccgggggucacgugacugcagggaagacccucaaccugaacugugccauuccugugcccccagagggacacgcuggcgacggccacugaaggaugccacgcuucacaggccagagcauauggcguuaguguaaaauaacuccacuuccacacaucugcauuaacuagcggaguacacagcaugugagugcauuauuguaggggagcugccagucgggccuccccaggggacucugcacgugggacaccccacccuggccaggaagcucacaugcugcacccuccccaauccugaaagcccucuucccuuuuacagaggaagacauggaagcucagaggccaagcaccaugccuaagguuacucagccuccucaggucucaagaucagcacccaaaacgcccauucucccaacaaaggacuaaggugucagcucagcccaacagcgacccagagcucacagagaccaugcacugccaggcucccuggcuggcagguguccuaagucaccaguggaaguagcugucaucuuaauuucaaaaaccagacccuucaagcaacguguaaguguuugcuaauaaccaaaugaagcagugcugggcuucaccccaggaaaagaauacaguuuuuggaaacacucuugggaaagggcaggccaggaccaguauuagggcagcggcaaaggccauccuggagauccuggguucauuccaccuuagcccagcuucucugccugagagagcacagccaggaggccacucccugagagaacagccguggaaacacagucccucaacacuccccgaaggcccccgccuccaacagcauacucccaucuccaaauccaaaccaacuggaaaugaacccagacaaucugguggugagcagggaguggccacaaagacauucaugaucauucaucaaacuguggcaggaagaauucaauagagcuuuucuaaguaaacaauacuaauuacccagacuuucaugggcucuucaucaaagaacuauuucuuccuagcugaaaaaagauaaacugauuucuacaaacccagacaggugcuaacuuucuguuccuggccaccucauuauaagacgcugucucuggccgggcgcgguggcucacgccuguaaucccagcacuuugagaggccgaggcggguggaucaugaggucaggagaucaagaccauccuggcuaacauggugaaaccccaucucuaauaaaaauacaaaaaaaaauuagccaggccugguggcgggcgccuguagucccagcuacuuggggggcugaggcaggagaauggcgugaaccugggaggcggagcuugcagagagccgaggucgugccacugcacuccaggcugggcgacagagcgagacucugucucaauaaaaaaaaauaaaagaggcugucucugagcauucacugagcagcugggcugcggucaagaaaccagccucgacagaggaaagcacguucacaugugagugcacagggucgggggaacaugcaucacaggcaagcagccuucaccugucuucuaacagacguagacaguaagugaaugaaacuauauuugauaaggggcuuucuaccaaagagcccucaucugcacgguccuaucagcacagaagccucaaugggauauuucgcuuaaagacauuuggaaaaacaagagcuggaaagcucucacugaaaacugcccuugauuccauaaaauacacuuuauuuuuccuaggcuauaaauucaggaagaauaggcuggaugcgacggcugaugccuguaaucccagcucucugggagaucaaggcaggaggaucacuugaggaugggaguuugagacaagcuuggacaacacagcaagaucccaucucuaccaaaaauuaaaaauagcugggcaugggggugggaccuauacucccagcuacuugggaggcuaagcugggaggaucgccugagccugggaggugguggcugcagugagccaagaucgugccacugcacuccagccugggugacagagcaagacgcugucucaaaaaaaaaaaaaaaaucuggccgggcacaguggcucacgccuguaaucccagcacuuugggaggucgagguggguggaucacuugaggugagaaguucaagaccagccuggucaacacagugaaaccccgucucuacuaaaaauacaaaaauuaagcaggcgugguggcaggugccuguagucccagcuccucagaaggcugaggcaagaggauugcuuaaacccaggaggcggagguugcagugagccaagauggugccauugcacuccagccugggggacaaagugagacuccaucucaaaaaaaaaaaaaaaagaaaagaaaaggccaggcacaggggcucacgccuguaaucccugcacuuugggaggccaaggcaggaggaucacuuguggucaggaguuugagaccagcccggccaacauggggaaaccccaucucuacuaaaaauacaaaaauuggccaggcauggaggcgcacaccuguaaucccggcuacucgggaggcugaggcaggagaaucacuugaacccgggaggcagaggcugcagugagccaagaucgugccccuguacuccagccugggcgacaaagcgagacucugucuaaaaaaaaaaaaauggauagaagccaccugcauaggccaggugcaguggcucacgccuggaaucccagcacuuugggaggccgaggcaggcagaucacaaggccaagagaucgagaccauccuggauaacacagugaaaccccaucucuacuaaaaauacaaaaagaaauuagccaggcgugguggcaggcgccuguagucccagcuacucaggaggcugaggcaggagaauggugugaacccgggaggcggagcuugcagugagccgagaucacgccacugcacuccagccugggcgacagggcgagacuccaucucaaaaaaaaaaaaaaaaaaaaaaccagaaaaaaaaaacaaaaaaugaaaaaaaagaagccaccugcacagauuagcuucagaacagcccccugacuagcacucguucuggacccaguucaagagcagcaucuacuacacacuuccagugacaggagaaacagugcuccuuuuaugaauccacaguaauaaaaauaaacaaacuacccacaaaagcucuacccuggcaggaaucccuggauggaaucagguugccugguaggcacaccgucugucguuaucugaccugagcugacggcacacgcugcaucgcgggagcagaaggcacagccucgucagcagcaggaaagaguucaaucaacguguggcucuggugccuucucaggagagaaaaugaguaacacccacaacgggucugcacgugccaggugccggcucagcucuucacacagaccaucuccagagccccaggacacaggcuuugagcuaccguuguucucacccugcagaugagggaagccuggaccagagugaccgcccaagcauccaagaucacacacuggaaaaaggcaggagugagggcucaacccaagcaucccuuccaggaugggaacuugcccaccacaguaucccucccccauggggguccaagggcagaggcaacccagccugagaaaaggccugaaaaaugucccugguuccuuauccacucucaccaaaagccugagccaggagcaggaaagcugcugagaggaggggccccaaggagggagaaagcagcaccuccgagggaggcucaccuuuccgaagaacccgcuucuuugcacgaauguccguuuccagcucugcggcucugauguaaauccugacagacugugggagaugacggacagcuugggcuaccacggccuuggcuguguccccaggcugcaaccuggcugcuuccagccagacaucuucacucugugaggcaagagauaagaccaauaaggcucagugcaggcuggaagccgcaacagggcagcaggcacagaucuccagagcagauccucgggccccagaauuuacgaaagccaauuagcucagccucuaacacaccugcaccaggagucgcccccuuauaaccacacuugggaacauggcuaccauaugucugacugaagaacaccuaauggccgggcgcgguggcucacgccuguaaucccagcccuuugggaggccgaggcagguggaucaugaggucaggaguuugagaccagccuggccaacauggcaaaacccugucucuacuaaaacuacaaaaauuagccgggugugguggcaggugccuauaaucccagguacucaggaggcugaggcaggagaauugcuugaacccgggaggcagagguugcagugagcugagaucacgccacuguacuucagccugggcaacagagcgagacucaaaaaaaaagaaaaaaaaaaaaugaaacaccacuuugugaaaagagcaugauuuccuucaggacaacuccauggacaaagcagagacugcacaucugcucgggucguucuuuuuuguuguuuuuuuuuuuuuuuuugagacggaaucucgcucugucgcccaggcuggagcagcauggugcaaucucagcucacugcaaccuccaccuaccgaauagcugggauuaugggcaccugucacgacgccuggcuaacuuucauauuuuuaguagagacgggguuucgccauguuggccaggcugguuucuaacuccugaccucaagugauccacccgccucagccucccaaagugcugggauuacaggcgugagccaccgugacuggccaccauuaggcgggugaagagcugaccaacugagcucuuuauaaugaagcuuagccugccgucaaaccagugguggauucaggcgugguggauucaggcaugguggcgggcgccuauagugccagcuacucuggaggcugagacaggacaauggugugaaccuggcagguggagcuugcggugagccgagaucgugccacugcacuccagccugggugacagagcgagacuccgucuccaaaaaaaaaaaaagugguggauuagccuucacuccacaugaaaacaagcaggaaaaagcccuuggcugcuuuucacauccucccccagccugcccuauugucuguaguuucaauaccaaaagacaaagagauuugcucuaacaaguuuacucccguaggggccacaaucacgcagccucccaggaaacgccucccaggaaauaccucaccuuggggcacaucuccguccccuucaugauaagguuccgagcuacuuguagcuucccagugacuucuuccaggcgggcugaugcaauccaggcuggcgggugaugaggguucgucucccgaacagacuugaggagcagucgcgccuucuugauaucacuaugagagggagagugcacacggcaucaggccaugcugucaggggugcacccgagaccugggaugagggcacccacuucacagucacaauguaagaacuaucaguccugauguccugaguuacaaaaaccaacucaaaaccucagugcgcacuauuccaagccucuguagccuccccgcagacaaacgcugagaaccgaagguccagaugggacaugugggacacagccagcugcuuuccugcccagcacaggcagggacuuugcaguaucauauguaacacauugaguguacgcaaugaauggauacagauacauuucaaauggaaaaaacaaacuacuccacuuuacauuucuuagaaccgccaugucccauuuugacagcauacuguccauauaaaauccaaaauacccuaggcaacuagagucuccaucccagcccagcgauucugcaaagcacucacuugaugucuccuccgugugucgggaucauggaauuuaaauccgucagguagccuuuggggucaacgacggucuguccacucacggagucagacaccugugagacaggccaagcuaagagucagcuggacaugaccaggugcaaaacaaaguucucagagggucccuggugccccucccacaacccugagagagcagucagaaggagaaggaaaacagccuucauuucacucagacaacaccuugugauaauaacaaauuucuucuguauggaaaaagaucuauuuuuuuuuuuuuuuugagauggagucucgcucugucgcccaggcuggagugcaguugugcaaucucggcucacugcaagcuccaccucccagguucacgccauccuccugccucagccucccgaguggcugggacuacaggcgcccgccaccacaccuggcuaauuuuuuuguauuuuuaguagagacgggguuucaccguguuagccaggauggucucgaucuccugaccucgugauccgcccgccucggccucccaaagugcugggauuacaggcgugagccaccgcgucuguccaagaucuauauuuuuauuuauuuuuuugagacagggucucacucugucacccaagcaggagugcaguggcaaucauagcucagugcagccuccagcuccugggcucaaggaauccuccugccucagccucccaagauucugucucuacaaaaaaaaguguaauuuuugaccaggcgugguggcucacgccuguaaacccagcacuuugggaggccaagguggguggaucacaagaucaggaguucgagaccagccuggccaggauggugaaaccccgugucuacuaaaaauacaaaaauuagccaggcgugguggcacaugccuguagucccagcuacucaggaggcugaggcaggagaaucacaugaaccugggaagcagaggcugcagugagccgagaucacgccacugcccuccagccugggugacagagcaagaccccgucucaaaaaaaaauaaauaaaauuuuuauuaaaaaagaaagaauagaaagcagggucucugacaaauaucuguacacccguauucacagcagcauuauucacaauagucaaaaggugaaagugguccaaguguccgucagcgaauaaacaggucagcgaaugcggucuacauagaugagcgaaugcgguccacacacaccaaagagucaagucucauccugccuuaaacugagaacaugcuggccggggcgccggggcucaugccuguaaucccagcacuuugggaggccgagccacguggaucacuggaggucaggaguucgagaccagccuggccaacauggugaaaucccaucucuaacuaaaaauacaaaaaaaucacacuucuaaucccagcauccugggaggcugaggcgaguggaucacgaggucaggagaucaagaccauccuggccaacaugaugaaaccccgucucuacuaaaaauacaaaaauuagccagacaugguggcacacgccuauaguuccagcuacucgggaggcugaggcaggagaaucaccugaacccaggagguggagguugcagugagccgagaucacaccacugcacuccagcucgggugacggugccaggcuccgucucaaaaaaaaaaaaaaaaauuagcugggcuugguggugcacaccuguagucccagcuacuugggaggcucaggugggagaaucauuugaacccgagaggcggaggcugcagugagccaagaccaugccauugaacuccagccugggugacagagagagacucugucucaaaaaaaaaaaaaaaaaaaagaacaugcugacgcaugcugcaccaugagcuaauugaaauaagccugucacaguaagguaaauacuguaugauuccagucauauaagauccagagaguagugacauuuauagaaacagagagaacgguggaugccaggggcuggggagaaagcgcacggggacucaauguuuaacagguacggaguuucaauuugggaagaugaaaacaguucuggagaugaauggugaugagguuguauaacaacaugaacauaauuaugucagugaagguauguacagucaagaaugauuaaaaugguaaauucuguguuacauauauuuuaccacaaaaaaauuacugugacaguuuuauuuauuuauugagacagucucacuccguaacccaggcuggugugcagaggcgcgaucauagcucauggcagccucaaacucccuagcucaagcaauccuuccaccucagccucucgaacagcugggacuacaggcaccaccaggcccagcuauuucuuuuaguuuuuguagagacagagucucaccaucaccauguugcccaggcuggucuugaacuccugaccucaagcaauccuccuaccuuggucucucaaagugcuaggauuacaggcaugagugccuggcccaaaaaguuuuacaauuucuauguaaacaaauuucaggcugggcaugguaguucacaccuguaaucccagcacuuugugaggccagcgcggacagaucacuugugcccaggagcuccagcccagguugggcaaccuagugacaccccaucucaacaaaaaauacaaaaauuaguuggguaugguggcacaugccuguaaucucagcuacuuggcaggcugagguggaaggaucgccuuagcccagggaggucaaggcuguauguagccagccaugauugugccacuuuuuguuuuuguuuuuguuuuuuauuuugagacagucucacucuguugcccaggccggagugcacuggugcaaucucggcucacugcaaccuccaacgcccggguucaagcaauucuccugccuuagccucccaaguagcugggauuacaggcgcccgccaccacaccuggccaauuucuguauuuuuaguagagacgggguuucaccauguuggccaggccaaaaguaguauguuccuucgugguaucugauaugcauaucagaaagaguucuguacuucacuggugucuagagcaccuagucuccagaucaaaguacacguuccaugcagggccacaagacaauuuacugagaggcaggaaaaaaacacacuuuuuaaaaaauuauuauuuuauauuuuaaaaaaaggccaagugcaguggcucacaccuguaauccccgcauuuugggaggccaaggcagacagaucaccugaggucaggaguucaagaccagccuggccaacaugguaaaaccccgucucuacaaaaaauacaaaaauuagccgggugugguggugggcaccuguaaucccagcuacucaggaggcugagguaggagaaucacuugaacccaggagguggagguugcagugagccaagaucacaccauugcacuccagccucugagugacacagcaagacucugggucaaaauuuuaaaaaucugcggaauuauucaggcaaaaaucaagccaaaaaaaaaaaaaggagaaggagaagaaggaggaggaggagaaggaggagaagaaaaaggagaagaagaagaaggagaaaaagaaaacaaaacaaaauuaaacugucuaaaccuguccacaggaaaaugcugugugacaaacucaccuggcucagccucauguccaucagaguguuccucgcuuggccaaucuuccucauguccagcucaccugugccaggugucaucaguccuggcgucauuccaccuggguauggaguguuuaguccaccuggauaggguguguuaagaccuccaaauugcuggaggggaagagaggaaaggcaagaauaaaacaacgguuugcacugcaugcccaagaaauuuacucucugaaauacuuccccaguggccugacauaugcacagcugugcagacagacucggccacagcauagccaugaccugcagaagcauugaauccaacaccacccaccauuccugccacugaucuaacaggacuaaaugggccacaugugcccuuuuuuggaagcucacaguuugucggggauccacugagguaugguucucuccggucuguaaauguuuggcaaagaaacugucaggaacaggggucagcuucucauagcguggguuccgcugacguuuauuucuggcaucgccaaccucggggaugcucagccacucuucuucugugacuucugccaacuuccucuggaaauauccagcccccaaaaacauuaauucucugacagaauuucaugugcccagguaggaccaugcccucucucaccccuagccuccagaucaccaagcuuuagaagggauuuggaugcagcaacuguuuuuuacuuuuguuuugagaugggucucauucuguugcccaggcuggauucaguggcacaaucacagcucacugcagccucaaccucccaggcucaagugauccucccacuucagcuucucaaguugcugggaccacaagcgugggccaccaugccuggcuaaguuuuuauuuuuuguaaagacagguucuccccaaggcuggucucaaacuccugggcucaagugauccucccaccucagccucccaaagugcugagauuacagaugugagccacuguacccagccccaaaaauaguuuucuacuucacuuagaaaaaucaauuuaggccgggcacgguggcucaugccuguuaaucccagcacuuugggaggccaaagcgggcagaucaccugaggucgggaguucgagaccagccugaccaacauggagaaaccccaucucuacuaaaaauacaaaauuagccgggcaugguggcacaugccuguaaucccagcuacuagggaggcugaggcaggagaaucguuugaaccugggaggcggagguugcggugagcugagaucgcgucauugcacuccagccugggcaacaagagccaaacuccgucucaaaaaaaaaaaaaaaagaaaaagaaaagaaaaaucaauuuauuggaucuguucaacuucacuaaaauguaaauuauucucucaaagcccaggggacacaguuuagaaaaucuuacguauaaauggggccagacgugguggcucacgccuguaaucccagcccuuugggaggcugaggugggcagaucacuagaguucaggaguuugagaccagccugguacacauggcgaaauccugucuuuacuaaaaauacaaaaauuagcuggguaugguggcaggcaccuguaaucccagcuacuuaggaggcugaggcacaagaauugcuugaaccuaggaggugaagguugcagugagcugagaccacgccacugcacuccagccagggcaacagagccagacugccuccaaaaaaaaaaagaaaaaagaaaaaagaaaaucuuagguauaaauggagucaaaauuacaaagaaaauaaguucauuuguccuaccuuuuacaguaggggaaggguuuuuuuuuacacacauauaauuaaacauacugaagcaaacacuuucuucuucuaagcaaugacccccuaaauuaaaaacguaaagucucauaaauuccacguaagagcagucugagucucugcggguuagggugagagcguuagaaaccgcacaccauucaccgcuucaucggcucaccuugaggucugagaacugcuguuggauuuuggggcguuccauacgauauuucucuauuucuucuuucucccuuugcucccuaggaaauaaaacaugcacacaucagaaacacugcaugucuguucugaagcaaauuuauuauccaucucaauuaaaucaccaaaaagaacaauuccauacucuuaguagcuaaaucaaauauauauauauauauauacauauacacacacacacacacacacacacacacacacacacauuuuuuuuuuugagauggagucuugcucugucacccaggcuaaagugcaguggcgcaaucucagcucacugcaaccuccaccuccuggguuuaagugauuuuccugccucagccucccaaguagcugggauuacaggugcucgccaccacucccagcuaauuuuuguguuuuuaguagagacgggguuucaccauccuggccaggcuguucucgaacuccugaccuugugaucuacccaccuuggccucccaaagugcugggauuacaggugugagccaccgcacccagcccaaaucaaauauauuuuaagguaacuaugaauacauucuuagcugggcaugguagcacacaccuguaaucacagcuacuugggaggcugaggcagaaucauuugaacccaggaggcagagggugcagugagccaagaucgcaccacugcacuccagccugggcaacacagagagacucugccucuaaauaaauaaauauaaauacauucguaagucuacuaauucaauuauccaccaaauaaaaacauguagaaauucauuaaaauaaaaaaaaaagaucuuacuuugaucuaaauaccuccauuuggacauguguauauuuacugcuugaaaauucacaaaaucccaaagguaggaccaucccauaaacaccuaagaaggccaggcgugguggcuuacaccuguaaucccaacgcuuugggaggccgaggugggcagaucaccugaggucaggaguucaagccuggccaaugugguaaaaccccaucuauacuaaaaauaugaaaauuagccaggcgugguggcgcaugccuguuaucccagcuacucaggaggcugagguaggagaauugcuugaaccugggagguggaaguugcagggagccaagaucaugccauugcacuccagccugggugacaagagugaaacuucgucucaaaaaaauaaaaauaaaaauaaaaauuagcugggcaugguggugggcaccuguaauccccagcuaccugggagacugaggcaggagaaucaucugaauccaggaaguggagguugcagugagccaaucuagccugggcgacagagcgagaccuugucgcaaaacaaaacaaaacaaaacaaaacaaaaaaacaccuacaaggaaaaacaguaacuauccuaguuaccaccaaacacuccaaacacucuacugaacucaucccaccuuuccuuccuugcuuccuucucuuccaaguaaauaguucaccucuaaccaacucagcucagcugcacagcucuaugugccagaacauaacccauguaauugcacuucgguguugagacuacaugugaggauaugguauucacaguacuguucuuccuacuuguuuguauuacgacaguuuucagaauaaaaaguuuuaauaaguacacuacuuuuuuuuuuuucuuugagacagucucacucugucaccaggcuggaaugcaguggugcgaucucagcucacugcaaccuccgccuccuggguuuaagugauucucgugccucagccuccugaguagcugggauuacaggcaugcaccaccacacccagcuaauuuuuguauuguuaguagagacgggguuucaccauguuggccaggauggucucgaucuccugaccucaugaucugcccgccucggccucccaaagugcugggauuauaggugugagccaccgugcucggccaaguacacuacuuuuuaaaaacauuuaauuuaauggcuuucuucauggguccgugucaccugcuguuuuuuguuuuguuuuuguuuuagagacacggccuuggucuguugcccaggcuggagcacaguggcauaagcauagcucacuguagccucuaauuccuaggcucaagcgaugcuccugccucagccuugggaauguagcuggaacuacgggcaugugcaacuggcuaauuuuaauuuuguuuuuguagagacaggguuucaccauguugcccaggcuggucucgaacuccuagacucaagugguccuccugccuuggccucccaagguacuaggauuacacauguaagccacugcacccagccugauguuuuuuaaaaugcauuaacccuggagguuccaaucaauuuuuaaaauguagggcugaguguaguaacucaugccuguaauccuagcacuuugggaggccaagguuaggggaggcagguggaucacuugaggccaggaguucaagaccagccugggcaacauagacaaaaauuagcugggugugagccuggcgugguggcucaagccuguaaucccagcaccuugggaggccaaggcaggcagaucacaagggcaggaguucaagaccagccuggcuaacauuggugaaaccccgucucuacuaaaaauacccaucucuacaaaaaucagccgggcguggcggugcaugccuguaaucccagccacuugggaggcugaggcaggagaaucacuugaacccuggaggcggagguugcaguaagccgagguugcgccauugcacuccagccugggcaauagagugagacuccaucucaaaaaaaaaaaaagaaaaaagaaaaauuagcugggugugguagcacgugcuuguaaucccagcuaccugggaggcugaagcaggagaaucgcuugagccaggaauugaagguuacagggagcuauaaucaagccaccgcgcuccacccugggugacagaguaagauccuguauccaaaaaaaaaaaaaagugaaaugcaaugccauucacguuuaauuacuauagguauaaaauuuaugcacaaugauuuaauaacgagcuucuaaaaagauguccaggccaggcacauugacuuaugucuguaaucccagcacucugggaggccaaaggauaugguuuacaucuguguccccaugaaaucucaugcugaauuauaauucccaauguuugagguggggccuggugggaggccacuugagucuugagggcagaccccugauggccuggugcuguccucgaggcagcaaguuuacaucacguaagaucugguuguuuaaaguguguggcaagacugggcacgguggcucauaccuguaauuccaacacuuugggaggcugaggcggguggaucacuuggggucaggaguucaagaccggccuggccaacaugguaaaacccugucucuacuaaaaacacaaaaauuagccaggugugguggcgcgugccuauaaucccggcuacuugggaggcugaggcagaagaaucacuugagccugggagacucaaaaaaauaaaaaauaaauaaaauuccagaagaacuauauuuuacuauucuaaaauuaucuucaaaaaauaaaacauucuacauacaucacaggaaguuaugauuacauguauaaaaagcaacagagcugggcgcaguggcucacgucuguaaucccagcacuuugggaggccgagguggauggagcacaaggccaggaguuugagaccauccuggccaacauggugaaaccccgucucuacuaaaauacaaaaacuagccaggcgugguggcaggcaccuguaaucccagcuacuugggaggcugaggcaggagaauugcuugaacccgggaggcagagguugcagugagccaagauaaaaaaaagcaacagaaagaggaaaugagccaaaauguuaacuguuacuuucuagacuuaugaauaaauguuaugcuuuuacccauacuuacucuuauuuuccuaauauucuauaaugagaacuuuuuauuuuuuuccuuuuugagacagucucuguggcccaggcuggagugcaguagcgcacucuuggcucacgggagcgagccaccacaccuggcuuccguucguugccugugcuugugggguauuacucaagaaaucuuugccuaguccaauguccuguagaguuucuccaauguuuucuucuaguaguuucagcuugaggucuuaaagucuuuuaauuugauuuuuguauguggugacagagaggggucuaguuucauucuucuguauauagauauccaguuuucccagcaccguuuauugaagagauugucuuuuccccaauaaauauuccugguacauuugucaagaaugaguucacuguagagguaccuauuuguuucuggguccauucuguuccauuggucuaugugucuguuuuucugccaguacuaugcuguuuuuguuacuacagcucuguaguauaauuugaagucaaguguucccccaguuuuguuccuuuugcucaggauagcuuugccuauucugggucuuuuuuggcuccauguacauuuuagaauuauuuuuucuuuuucuuuuuuuuuuuuugagacggagucucacucuguugcccaggccggagugcaauggcacgaucucagcugacugcaaccucugccuuccagguucaagugauucuccugccucagccucccaaguagcugggauuacaggcaccugucaccaugcccaacuaauuuuuguauuuuuaguagagaugggguuuagccaggcuggucucgaacugcugaccucaagugauccaccugccucagccucccaaaguguugggauuacaggcaugagccacugcaccuggcuauuuuuucacuaucuguuaauaauguccccaguauuuugauacggauugcauugaaucuguaaauuacuuuggguaguauggauauuuucuuuuauuuuaagauggagucucacucuguuacccaggcuggagugcaguggugcaaucucagcucacugcaaccucgaccuccuggguucaagcgauucuccugccucagccucccaacuagcugggacuacaggcgugcacccccacacccggcuaauuuuuguuuuuugguuuuuuuuuuuuuugagacagagucuugccccgucacucaggcuggagugcaguggugcaaucucagcucacuacaacauuugccuccuagguucaagcaauucucuugccucagccuccugaguagcugggauuacagacgugugccacuacacccagcuaauuuuuguauuuuuaguagagacaggguuucacuauguuggucagccuggucucaaacuccugaccucaagugauccacccaccucacucucccaaggugcugggauuacaggcgugagucccagcgccuggcaacuuuuguaauuuuuuuaguagagacaggguuucaccacguuggucaggcuggucucgaacuccugaccuccagucauccaccugccucggccucccaaagugcugggauuacaggcgugagccaccgugcccggccauuuuuguauucuuaauagugacaggguuucucuuuguuggccaggcuggucucaaacuccugaccucaggugauccacccacccucagccucccaaagugcugggauuacaggugugagccaccacaccugggggcauagccugcaacuuuaaucaauuugucaguuccaauaguguuuugguagagucuuuaggguuuucuaaauauaagaucauaucaucugcaaacaaggauaauuuaacuucuucuuuuccaaucuggaugcccuuuuauuuauuucucugguccgacugcucuagcuaggacuuccaguacaauguugaaucacaguggugaaagugggcauccuuguugcguuccaguuuuuccccauucaguaugauacgagcugugggccuaccauauguggcuuuuuuuuuucuuugcgacacagucucauuguguugcccaggcuggagugcaguggcacaaucucagcucacuguaaccuccaccuccugaguagcugaaauuauaggccugagccaccacacccaacuaaucuuuggauuuuuaguagagacaggguuuuaccauguuggucaggauggucucaaacuccugaccucaaaugaucugccugccugggccucccaaagggcugugauuacaggcgugaaccaccccauccagcuguauauagcuuuuauuguguuaugcucccccccccuuuuuuuuuuuuuuuuuuuugagacagggucucgcucuguggcccaggcugaaguguggugguaugaucucagcucacugcaaccucugccuccugggcucaaguaauucucccaucucagccuccugaguagcuaggacuacaggugugugccacgaagccuggcuaauuuuuguauuuuuuuguaaagaaaagguauuacccucuugccuaggcuggucucaaacuccugagaucaagcaguccucccgccucagccucccaaagugcugggauuacagacgugagccaccacacccagccugagguauguuucuucuauaugcaguuuuuugagaguuuuuaucaucaaggaauguugaaucuuaucaaaugcauuuucagaaucaauuaaaaugauuaggccgggcgcaguggcucacgccuguaaucccagcacuuugggaggccgaggcagguggaucaugaggucaggagaucaagaccauccuggcuaacacagugaaaucccgucucuacuaaaaauacaaaaaauuagccaggcgugguggcgggcaacuguagucccagcuacucaggaggcugaggcaggagaaucacuugaacccaggagguggagguugcagugagcugagauugcgccacugcacuccagccugggcaacagagcgagacuccgucucaaaaaaaaaaaaaaaaagaucauaugguuuuuguccuucauucuguugauaugauguauaacacugauuaauuugcauauguugaaccacccuugcacuuguauccccugggcaaaaugccacuuggucaugaugaacgaucuuuuuuuuuuuuuuuuuuugagauggagucuugcucuugucucccaggcuagagugcaguguugugaccucggcucacugcaaccuccaccucccgaguucaagcgauucucuugccucagccucccaaguagcugggauuauaggcguacaccacccaccaugcccggcuaauuuuuguauuuuuaguagagacuggguuucacuagguuggccagacuggucuugaacuccugaccucagaugacccaucauccgcccaccucggccucccaaagugcuagaauuacaggcgugauccacugcgcccagccgaugaaccaucuuucuaauguguuguugaauaugguuugcuaguauucugcugauuucugcaucaguguucaucagggauacugaccuaacauuuucuuuuuucagugugucuuugucugguuuugguaucaggguaauacugguucuguagaauaaguuuggaaguauucccuccucuauuuuucagaauagucugaguagaauugguauuaguucuucuucaaauauuugguaaaauucagcaaugaagcaaucagauccugagauguucucugcuaggacacuuucuguuacagcuuugaucucauuaccuuuuauuggucuguucagguuugggauuucuucaugguucaaucuugguagcuuguaugugucauuuaacaucuuuaauucauuugcaaauuacucaacauauaauaaucaagucaguaggcccuuuucauuucaaagaugguaacccugauguaucguaaaaguaauccacaaaauucugcugauuucuggaaaaacuuaagaguucuuaagcucuccacugcagcccccaggcccuaaggcuguucuguaacagcccagugcuuauccaggcauggcuacgacagaccaagacccucagguggccuaaaagcuaagcagacacacauacucuauugcaacuuuucuccaaauauaaaacaauucaaaacaaaacuuuuuuuuuuuuuugagacagggucucacuaugccaaccaggcuggaaugaucauggcucacugcaguuucuaccuccugggcuuaaacgguccuuccaccucagccacccaaguagcugggacuacagguguguaccaucuggcuaauuuuuaaauuauuuguagagauuaagucucccuacguugcccacacuggucucaaaccccugggcucuagcuaucguccuaccucagccucucaaagugcuaggauuacacacgugagccacugcgccuggccacaaaacuuuuuuuuaaacuuggauaaauauugugaaaggcaacaauuucuuuuaccgucuuucuuuucuucuuucauccauccuuuuauccagggcugcauagauagcaucugcuuccucaucaucuuucucguaggguccacuugagaagaggcucccagcauagccauuaaacugagaagcaaacaacacguguagaggucagcuuuuccuucaacaccauccccaccagcgaaacggagaucucuacuugugaaauacuugcuaaauuauuuucuucagccaacgaagccaaaucaagggacagucuaccauauaacuggugacuacucuucaagcgucaagggcauggaagacagaggagacccccaauuggaagggaccaaggagacaugacgaaaugcaaugggggauccuggacuaagccuaagccagaaagcggacauucauggaaaaacaugaaaugcaaauacgacugacaaauuaguuaauaguacugugucaauguuaacuccuucguuucaauaacugcacuaaggucauguaacaucgggagaagcuuggugaaagacaugcagaaacuuuuuuuugggggggcacuauuuuugcaaauuccugcaaauuuaaaauuauuucaaaacuaauuuuuuuuuuuuuucugagacagagucucgcacucucgccaaggcuggagugcaguggcgcaaucuuggcucaccgcaaccuccgccucccggguucacagcauucuucugccucagccucccgaguagcugggacuacaggcacaugccaccaugcccggcuaauuuuuguguaguuuuaguagagacgggguuucaccauguuaaacaggauggucucgauauccuggccucaugauccgcccaccucggccuccaaaagugccaggauuauaggugugagcuaccgcaccuggccucaaaacuaaaauuauuuuuaaaaauuuuccucagaggaaaaaugucaucuguuagaagacaguuaaucgguauucagucagcugaaguuuuucuuuagaugucuguuuagagggcaaucacuaaagcuaaaaaaagcaaauacuaucaccaauuccacuuuaaguuuuuaucauuaaagacuggcagccaggcgcaguggcucacgccuguaaucccaacacuuugggaagccgaagcgugcggacaaccugaagucaggaguucgagaccagccugaccaacauggagaaacccugucucuacuaaaaauacaaaauuagccaggcaugguggcgcaugccuguaaucccaguuacuuggagacugaggcaggagaaucgcuugaaauggggaggcagaggucacagugagcugagaucacaccacugcacuccagccuggccaacaagagcgaaaguccgucucaaaaaaaaaaaaaaaaaaagacuggccaauaggaaaugccaaggcagugguccuaacaccugcaagaacaucucuuccgacaagagcgaaauuccaucucaaaaaaaaaagacuggccaauaggaaaugccaaggcagugguccuaacaccugcaagaacaucucuuccgacaagagcgaaauuccgucucaaaaaaaaaaaagacugggcaauagaaaaugccaaggcagugguccuaacaccugcaagaacaucucuucugagggacaaaaagugcacauuucuccguguuuuuccugcucccucucacucucaguaaagauguuccaugaauagcuaaaauuuaaaugcaugagccacuccaagccauucauuacagacaccaacacacacugguuaggucagcugcucccagagacuggcuggaggagccacgaaagccggacacaucucaccucaucguaauuggugucauuuagauccucgucgucaucgucagcagccugauuuuucuucaucugguccccaacgguucucuugccugggggugcauggcgaucauccacagggucauuugcaucacgggcgggcccaaugucugaccgcguggugaagccaguggcgcugcaggagacccccaagacaccgggugucugaauaacucuguuccugugcucuucuccacuccugguuaucacuuacuaacaccucuuuuucuaacaccuuugggaaaccuccaaagauccuggugacaaugaacugcagucucaaacacuucugaucuucucugcuuaccugaaaguuucagccuacccugaugauguuaccaaggcaaucucucuccacccuaaggcuucgaucaucucccccuccacauccaaccaggcccuuaaacccaacuuggcccacacugagcucuuccgugcccaccuuacagcugcucugggggguuucagcugauaacagcugucccagaugccacgggaccaugauguaauuuuugccucccucucccacuuuccccauccugucuguccccaaguacuaaugaauccacuuucaaaaucccuccuucccagacuaugacucccaucacagcuggaaaccaaguuaccucucccugccuuuagccuuccucuacuucaacccaugcucugccagaugauucuucccaaaacacagcucugaguaaaaaauucugggccgggcgugguggcucacgccuguaaucccagcacuuugggagacggaggcggguggaucaugaggucaggaguucaagaccccccuggccaacauggugaaacccugucucuacuaaaaauacaaaaauuagccgggcgugguagcgggcaccuauaaucccagcuacucaggaggcugaggcagagaacugcuugaacccggggggcagagauugcagggagcugagaucgcaccauugcacuccagcuugggcgacagaacaagacuuugucucaaaaaauaauaauaauaauaauaauucugaagggucaugaucuuucuaacgucuccaggagcucuagccugacgcucaaggccccuccaaccuccugagcucuauucuauucgcuguacauuccacucacacuggacucccuccuguucccugggcuuccuccuugccucacuuuuuuugaacucccacacgcagaaugucaguuucucuucuaucgucaccguuucuacagcccuaaguccagcucucuuacuaaacuuggcuccaaugcuacucuccauuaagcacuggguucuaaaucugguccucuuuacguacuuauuuaugguaauagcaaacccuccuuagugagcuugugugugccccacagauuccaauauaauaccaccaccaagaaaaacccaguaguguuccucaucaaaugaauagccaaauaggauaauaacgacugcucacuuauccagcaacgcacgguggucaucuguguugcaggcauagaggacccaggcacgcuuaaggcggggcgggcgggcgggcggggggggggagugucagcccgaccugaggaagguggucgcguguuuccacuacacgucagauuccucuacuccucacugcagaccguauacagcauuacccaucuuacagaccaaaacacugggcugagagucaaugugucacaucuaggcggcaagcagggugcacacacagguauguccugaccccaaagcccguugcuuccugcagggauuaagccgauccaccaagcgucuuucagacugcgcggccauagacccccgcccccaaacacgccccaaagcacugcgcuccuguagccggguccccgccccucgcgcgccgccccaggccucacccccggcccagccccggcacguagccgaggggcgcgggcaucccuaggaacgguuucuucuucuuguucaugguggcggcgacgaccaaggcuaggaaggaaaggaaugaggcagcggaagagggaaagacgcagagacucuaggcuucgacguccgaugcacuccguagcaaagugucgccgucgucgcgucacccgcgccccggaagcagagcgcucaguccgcacacgccccgccc

SEQ ID NO: 191288 - RNA, 246331 nt, Homo sapiens
acacaagcucaggaguagcugccaugcacaucaguguccauuaaaaugacuuguagcaaaucucuacguucaaagucuaacuuugacagacaaccuuacuuccagcgaagucuacuccccucccuccggagggaagaaugggcugcgguuaagcguuugcccuggugucagggccaacugcuucgaagcgccagacuuucggagacuguggguaagagaaaaaaaaaauccaguccggguuuugucugagcggggggaccggaggguugugaggaauggcucgcgaagaggggggcggugguggaaaacauacaacacaaacagcucgcgccgaggcacggcagcgguaggcccggagcgcgcgggcgcagccggccgggagaggcgcgcgcgggcucggccgccggccgcauggagcgcagcgcggcccgcggcucccgggcggcggcggcggcggcggaggcggcagcgcgccgcucgcucacacccacccccgcccgcggccgccgcgccgccccgccguagccgccggccgccggcguccccgccggccgguccagcgaaggcggcgcccgcgccucugcagccaguggcagccgcggguccuggccggcggcuccugcagccccuugcggccgcgaguccccggcccugcggccaccggcggaggcagaggaggaagaggaggugacaaacucuccggccccgcgccgcggcccgcaaccccgcgcucaggcaugcaggcgcggcgucuagccaagcgcuccagccugggcagccgccgggggggcgccgcgcugcagccugccgggccggcgcccgcgcccgccaaggaagccgcccuacccgggcucccgcccccugucccgggcccggccccggcgcccgccccggagagcuggaggccgccgcugccgccgccgccgcgcagcgccgggaccggccccccucgggccaccggggccgccgccgccgccucgucgccggugcugcugcuucuaggggaggaagacgaggacgaggagggcgggagcaggcggcggagggggcucgggcguguggaggagaagccccgagggggcgcggaggaggaggaugacgacgaggaagaggaggacgaggagguggucgucgaggugguggacggcgacgaagacgacgaggacggcgaggagcguuucgugccccucggacccggccacgcaguccccaggggcccggcccggggcgcguugaaggugcguguugggcgcgguggcgcgcgugggacccgccagcccggggagggggacgggcccgggccccggggcaaggcgccuggccgaggacggucagcggcgccggggagagacccggccaggaggggugugucaggcggcgcgggcggccgcgcggggcagcgcgaggaacuguugauuugccugcgccuugggccccugcgucucucccaggcggcggcucccgcuuuccucaaaggccgugucggguuuguuguuuggugugggugccgggaaagggcgcuucuccccagugagguggggaacuugggugaugggaccacggaggcgccgguucgugcccgguggggacgggugaggcaggggagagugagauuuuauucucccccaaggaaggaguguccccuucuccuuauuuugagggcuauucaagcuuauugaaaccagaaagcgguguuucuugucaaucucucagccccuucuuccaaccaagaacaauugucgaugaguuuccaucacaggcgcuugugagagaaccgguaaacccaguacagcaaaauccaagcccuugguuuccacaugcauuuugcuagcaguuuuuggcauugacccucgcccucccguguuuccacucgacaucauuuagcguuugagguuuuuuucccuccucaaaauugcaaaugagaaaaaaagaggaaaccaggaaaagggggugggggguagcauuuaaauuggaugugaguuucugcugagaauucuagcgaaguccccuguacacugaagcgccgagagauuuuuccguuuguguaucuucaggagauaagggguuuauuauuacacaacugacugguugggcuuucaggcaugcuauuggacaaagcaaaccacguugagauucaugcacgguguauguugcuaagaaguuuugagggcagcaagugguaagcaauggagugagugauuuuucucaagagugguuccuaaaaucagcugaauaacauuuuaccagaguuuucagaagguauugguauuucaggaagaaaaaaaacucaugaacagcugagcuuaauaguuagagaccacuaaaaaaagcuuugggggcucaccaaaaaaagcuccucaaagcuugaaguugcauuuccaaagaaauguugaacaucggcaauuagaauagccccagaguagaugugggcagaaauuuauuuccuagaccacccuggaaguaccagcucugggagugagaaauuuucagcaaguaguuauuugggaugauaguuuuugacagcugcuuguugaaauccaaaccgugaccacauucauuaccauggucuguugaaaagccugcauuguauggcuacaagauauagcuggguuugaaaugaagucacauggugucagugacauugaauaucaagaguagugacuccuuagcauuuuuguccagaaauacugaaaguguguccugugguuugaauagugauugcacaauuugugauagaaacaauaauaauuuaugcucugugaugaaaacaagcuuaauauagggaaaaaaucaaauccguaaaaacagaauaaugagugugauaauucacuugaucaguaaagguuuuucacaucuucaaguaaauuuccuuuaaauucuuucaaaaugggcuucauuuuauaacacucucauuugcccacaacuucagaaauuuacacagaauguuggagucauuugagguuuaucuuuuaaauuacucuuuuaaagacacuguaucugaagagauuuucuaauggaauaucacuagauaauuuuauuauaaugcauauacgaauguuaaccucuuacauauauucaugcauucauuuauucaacaaauauuuauugaacaccuauuaugugcuagcagcuauucuagaacauagcaguggacaccuuccugaugcucacaucuagugagaggcaucauagcaacaaucaaauacauagaugcagauguacaugcauaagcaagaauaacacuucagauugugguguguccugugaagaaaaucaugauaucuuagaguuucaaaggaagaagagaaagcuacugugggugagaucucucugaggagggaacauuugaccugagauaugagacauuucgcaugggaagagcuuuccaggcagagggaguagcaguugcaagucuugagguggaaaggagaaaagggugaguguggcuggaacuugguagguaugagauaugucaaggaggcugggaggugccugcaaagagagccuggugggcccuuuaaaaggauagugaaaucuuugaaaaguuuuaagcaauaaagucuuacaagguaauuuguaguuuucaaaagauccaugcuguguggaggacaguaguagaggcagggaggccaguuggguggcugucacuacacagaccaagggagggagagggcagcuuggaguuagagauuggcaggagauggcaaauucagaaucuauugugaggaucaaccuacaagaacuuguggauggguugguugauggguaaugaaggaaagggaggaauccaggaugagaccaugauguaaauguugguugaagguaccauuuacuaagauuaggaaaaccgagagaacaaaaaucagguuuucuguuuugugcaugugaauucugagaugacuauuggacaaccagguggagggugugguuaggcagaugguggugagauggggaguggauaggagaggucagggauagugggaggaauuugagcgacaucaguauguuaaugucauguaaagccugggggcuuuaagggagugcagggggccaagagaggagagccuggggccugauucuggggcacagcacuauuuaaguuuggguguaaauggagaagccagcaaacacuauugagaagcagcagccaaauaaguagaaggaaaacuagaaaaucuaaaguccaauaagccaagagaagaaauaguuccaaaaaguggguggggaguaaugaacuguauugaaugcugcugagauauagaauaagaaagagagagagagauguucauuuggauuagauaagauggaacuuacuaguguccuugacaagagaaguuugagugaugugcuuggaguaggcugagcagccgaugagagguguggacagagggacacaggaaaaacucuuuugacaaguuuuuuggaaaggagaacaaagaggaggaggaauagcuggaaggccuauggccuagguuuuuuuaaaagaugggauacaguagacccuaguguuaugacuaaagcaucaugggaauuauguggaagagggguuauuaguuuucuauuguaguguaguguaacaaauuacuacaaauuuuuuuuugcuuuaaaacaguucuuagaguuucuguggguuaggagucuaggcucagcuuaacuagguuuucugugaagagucucacaaggcugcaaucagggugcuacauggguugaguucucaucugaaggcuugaccagggaauaauuaacuuguaagcuuacauagauuguuggcagaauucauucccuugcaucuguaggacugaggguccuagcuucuugcugguuaucaguuggaaguuguucucagcuuguagagcucuucucccccuccccuucccuacuuacugcuguuuuuugucacaugggacuccuuagcuuggccucuuacuucaucaagccagcaaggagaaucuuagagccugccugccagcaagauggagccuugcauaaugcaauguagucaggaggaauaggccagaaacuuggccauauucuguugguuagaaguaagucacagguuccacccacaaccuaaggagagggaauuuuacaagguuauaaacaccagguggugaggaucauugaggggucauuuagggaggaaccaaagauguagagaaaagaaaaaacuacaggaggaaaguccuuggaaagccuuagggagggaaccugaaacccaaguaaagggcuggccuuugggaaccuuccuccauuagauuggagagaagauggagaauaugaguccagauguggguauauuuucuauauugggugaugaucagaugacaguaguuuucugauggcuucuguuuucuccauguagcagaaaggaaggucaucagcugagggugagggagauuugaaguaagagcugaaggcauugagagcaaauguacuagggagaugaauagaguugccagacaguaucaaggacgcaacugagguuugugauuccacauuuauaguucaaguagucugucuggguaugugauuuucccaacuuuauuccauggccucaugcauagaguaauauaauaaaaauaaucccagcuaaauuuauugagugcuuaccagggccagcacaaauccaagugcauagucucauuuaaauuucauuacauauccucgagucaggcauuauuguuaucaacuucauucuacagaagggaugagcgacuuauuuaaagauaaaaagcuguuaggcaucagagcagggguuugaacccugcacagucaaaccccagagguggcacccacaugcauuacacuacguugccucuuguagagaaaguggaggacuggauugagcagaggugggguuuagccugaugagugagcaauagaaagaaagagauggaauuauuguugagagaguuggcaaguguaugaugauagacugagugacauaagaagagugagggcaggagggagugagggaaggcagaaaaaucaugugucaguggguuggagaaaacaaaggguaagccaaaaaaaucaauaaaagaaugggaaugaaauccacgacaguuuggguuccgcaguaauauuaauucaaacaaauauuuguuggguauuugugagacaggaacuuuacuaaaugcuuuauaugaaggaggaucuuacaaaaauuuaugacuugggaaucaguauagcucccauucgccaucugaugaugcugacuggaggugaaauaucacacuccaguauguggccacaaguggggagcaugggcucacauccauagccugugccuuuaaucacugaacuggcaucuuucuauauguauugggauucaugugcccauuuauuuccaggaagauuugagagggcugaggaaacagagauagaugcuacuaaguagcugagauuuguugcuugauuacucuaauggauacuaaugugggcuuuaaaugagauaagagaaacuuuguauuacaugguuuucaauuucugaucaaaagaagcuuaagcauuuaucugcagugguaacaguccugaacacacaaaccccucccuacuccccugccuaccaccaacuaaccccugggcgccuguauaaggaacauuaccaaaaaaccagaaaagaaacaaacacacaaacagacgaaaaacaaaggcacugucaaacauaagaaggauacaauaaauuguuacucagugaagggaaaacaguagcgaggcugagauaacaagcacagggcugugcucugcaauccugugcaacaguuuagggauaagaacacaagaaucuagaggguuugauaauuugcuaguguaauagacuuaugaaaagcuuggacacaaaagacugcuagaagccuaccaagauuuuaacuauugaaaaacugcugaagaaaggcuuuuaaaugagauaauauauguuaaaguucccacuuccagugcucaguaaauauuaauugaauggaaucugcuuccucugugccaguucuucagggaugguuaacacgucuauuagacuaucucuugaauaucagaugacuuuaagaagccuuuggcaggaacugugcagcaaacacugaauuccaauuugcuaacaaguaugugucuugcaaauggucuguguuggcucgagcaaaaggcauaugcuuaagauaccagacaaaguugucauucauugaaucguggacugcuggaguuggaaggcaaacagauauuaucuaguaauccaguacuuucauuugaccaccgagggcacugacuaugcagggugguaugccugguccaucuggggcugcuagcaaguuugcugcugccaugauuugugcccuggucugccaaccccaauuuauuguccucaguucuggguugguuucuuaugcucaggaaugaucuacagcucacucccuuagaguuguggguugaaaauccacaauuuucugaaguggucuacuacuuacugcuuaucaacuucuauuuuuggaauacuugucuuuuguaaaguaccucagcuagagguggacuuaacauguggcuguggugugauggauggaacccucugaauccugccugggccaacccccgcucccugugagcuuuccaagggacacguauacacagaggauaacagaugagaaaagagccccauuucacugggaagugagugcccauagucccugguguggugcugauaguaaacuugccuagaagaugucauuaccagucaacuguuagagccucuucuccuucaccagcauuuuacuacugguugaccauggagggccccauaacacaagcauuagagaaaagaagagaaaaagcaagaagucaagcccuacccugaaucugcuuacccccugccuccuaguagggaggagccaagccaggccuggugcaccuguaauccuagcuacuuggaagcuuuaagcccaggaguucaaggccaaccugggcaacauagugauaccccaucuaacacagccugagagagccacagcccuaugugaguuugaccuucuaaaauuaguaaaucugucccaguuagauuaauguaucccccccccaaccccgcaagaggggcuuagaggaguaagggagccuuucccuccccaugucauuguauaauauccaaacuucugauguuccugaaacaaucagccuuguuacaaugacuugauauguuugcagaagucaagcaaacuugacuuuuaguugcccugugccaucuuaucuuaagguaaauacaugauuucccuuagacuuucugaaauauuugugaauacuucaagacccucauaaccagccaaaucuauguuguugaaauaaggaugauuuucuuugggugugagguccauguuuuggucauucccucuguuaggagauauuuauugagccccacuguuuaccagguuccugcuguacacacaggauacaacaguaaauaggccuucuuccgcuuucagggagcccacauucuaacacauuccugccaaguugucuguaaagagguaugaagucgcuuuuccucuuuaucccuaaugagaucaagauuagaucugcccaaagccuuuucuuagcuaccacaauuugagauguaauucugaaauauaccuuuaaaacaacuguaaccaagugauccauaugaagaagauucugugguuuggccaggaggugauuccugaauagcugguuaaaagaugaguuuagaucacugaauuuggcaaauaacuccaguugcucuuauuuacuagaugaaauggaacagaauauaagucugauauauguguucauagaauuagaaugauuaaagucuuauacuucauggaagauacaguuuuggaaaaaucuagaguuacaauuuauauguaggaaacaagcuugacucuagaguuuucaaggagagucuguaauguucagacucuccuugaaagucagaacuuugcaguaacacacaaggaggguucguucauguugcagaacaccauggagccuugaggagcaaagaaguaguagagugcugccugggcacugcuccauggaggucuccgugccauaccugauggucaccagugacaacguuugcuuuacauauguucuugucauaauggaagguuaaaugaaagucauaucuccucgauucagacuaauuguacguggcuaguugaaguaagugaaugucaaaagugcuccaacauuuuaaauuaaacccaguguuuuaaaagguuguauacccugaaauaccaucugauaaaaccugcagaaaggauaauuuuaguucauaaaugugacccucauuguuggcgcaucagugagaugggagagaacaggcugagucaaaggagaugauccucccagcugcccccacccaacuguuacuucucuguagaucaagaagugauguggcacaggcucuggguucagauucuagcuucuccacucacuuguugcauggcuacaucaaguuacuuacugucucuacgcuuucauguuaucuucaaaauugggauaauaugauuccaucaguggcuaucguuuuuuuaauauggcccagagaccuccugaaauuagacauggguggcaauuuauuuuguuuugggauucagaaaggaaacauuuguaaaacugugcucaaggaucaaaaauccugcaguuauuuugacuguuacaaccuccuuauuaaugcuaccaaggcauuucagagaguugcuuccugaagugacuccauucaucugagcucugugguguuccgucauaauauguggugagcuuuaaucuucccuuucagcucaggaagcugugagucauuuaucuacuugugcaaagaggacagagacauccuaucucuuauguucaucaguuuguucagaucuauagugguuguauuggagaaaccuggcuguuauccaaaaggguagguuggaagaggcuuaccacacacauugaauauauuucuuaaagcugcuauggaaauaaagugaugucaccuucuaccucuaauuugcauguggcuggaaucucugaggcauggguuugcccuucccacccuccugugcguuggugucucagacuuguaaucuugcuuggugaagaagucauucuuuguuuuuuuggguagauggaaauggguggcccaaaguguaccucuaaacucauaucugcuugcucccacuguuagggagaugucuagacacggagaaaagggcuugguaauuaauugacuuugggaaauuccacuuaaaaguagagauacaauuuuuuuuauuuuauaaaauauuucaaacaaagaggaaauuggaagaguaauauaacacacacauguauauguaaaaguuacugacuauauaugccaagggccauuuugaguuucuaagagggugaauauagauugugauauuuacauauuuguuggacuuuuuucuagagcaucuuuccuuugggauacauuuugggaaauauugguuuauaauuuauuuucuuggugggaaagacauggauaaguaucuuauaccuugagauaaauaacuaaaacugcauaauuaaagaaauaaguugucaagugaauuucacaagcacaagggagaguuaaaguguuguagugggucauauaagcuuugacauauuuuuccucauaaagcugauaacucuucaguauugaguuucuaaaaaaggaaguauuuccugugguaaauuuucacuuguguaucugugaauaccauuauugugugugaaacuuaaaaacugguagagaacacuaccuuucucaauaaaucaguacccacgaugggucuaguguggaagacaggagggugugggaaguguuguuguaacagaauuuaaaagugccaagggagaagaaauucacaagguguuuauauccaggaaaguguauuuaauaauguuuuuuacauucucuaagaaaaaaagauugaaaauaucaggagagucucaaugaaaagaacauacaaaaagaacauaccaggauucuaggacugauacauuuucugucaacgcuauugcuauuacaaguaaagggauuaagcacuugugaauguugauaccauguauaauaacucuaauuggauauuguucaacguuuauuuccauauuacccaauauuuagugcauuguaacuaauagaaggcccucauagccaaccuuacuugaucuucuugauaaccuugagagguggauauuauuauccccauuuuauagauguguaaaauaagccucagagaagaauagaaguuucuguugaaaaauauauaugaagaauuuuauaccaaaugacagauauuugucaaacauuucagaaaacauuuggagaccggcagaguuuuuuaaauaauugaaauaauuggaauugguaccuaagcagcaaaggaaauuuaaggagaaagaauauuuugaaguaaauuauaaauuaaaacaaugugaaauacaguuuucauagguugucauaaaugcuuucauguaguuugugcaugcuuugcaacucagcugcaagugcuuacagaaacuaauuuuuuauuuuuaacaauuuuuugcaaguuuuugaaaauguuuugauugucagguucauagacuucuaacucaaaacuaauguaacaaaauauuagaaaaaguggaaauauuagaaaggggaucuuagaauuuauaaaaauaaauaucugaagaguaccuauuugaaaaaauguagucuuguuuuaucauauauuaguuacaguaaaaauuaucagaaaagggggggaaauggacaacugagccuauguaaacacugaacaaacacuguagcuuagugugggaaagaggaggugacagugggaaagggggggcauuugaaggguugacaugacccaagguagaguuuauagaaagacagcaaggucucuauuugcauaucuuaugacaugaguggcugguggguguucaagaggcucugaaagugugcuuuuagccaucugcugagugacaacaauucuuuuagcuccuuauucuuuuuuuuuuuuuuuuuuuuuuuuuuugagacggagucucacucuguugcccaggcuggaguacacuggugugaucucggcucacugcaaccuccgccuccuggguucaggcaguucuugugccucagccucccaaguagcugggauuacaggcaugugccaccguauuugacuaauuuuuuuuuuuuuuuuuugguagagacaaguuuucaucauguugaccaggcuggucucgaacucucgcccucaggugaucugccugccuuggccucccaaagugcuggagugcugggauuacagaugugagccacugugccaaguccuuuuugcucuuuauucugauucaaaaaagauaucuaaaagagaucuccauucaaauaggucuuccucucagcucccuguauugauuuuugucacuugaauuuuucuugcacucuagcacaagguuguuuggaaaaauuaucuuuauuuuuaaaacuauaauagaaaugauauaguuuucauuguuuguaaacuaugccuagcuuuauguguuaaacugagauaccucaaagaucuugguuaaauucauuuacaaguuaaugguuugauguuugaaaaagucauuuuuucuacaaaaaaguagccagaugugguggcgggugccuguaaucccagcuccucgggaggcugagacaggagaauugcuugaacccgggaggcagagguugcagugagccaagaucgcaccacugcacuccagccugggcgacaagaguaaaacucuaucucaaaaaaaaaaaaaaaaaaaaaaaaaaaaagguuauuuuuuucuaucuuguucaaccacauggcuauuuuauugaacuuuaguaaacuuuguggauagugguguauuacugagaugggauuguauggagaaggagaagauucagauugaaaggagaaucaaaagcucugucuuaaacauguuaaguuugacauaccuguuagaccuccaaauggagacgucagguaggcuggaauucaguggagaagauggagcuggagauggaaauucaaaagacaugggccacuagaugauauuuaagugaugggauugagggagcauaccaagggguacagcagguagagaagggaaggugacugggacugagcucuggagcacuucaaaugcagugcuacauuucucugucugucucugucucuuaacaguuuuauuguauuuaauucacauaccguauaacucuuaaaguguacaauugaguguucuuuaguauauucacagaguugugcagccaucaucacaaucuaauuuuggaacacuugugucaccccugaaagauaccccguacccauuagcaugcaaccacaguugcuuuggcuuuccauugccaauaacacuuuauucauucauugcauuuuucaggaaaaaaaagaaguggaggaaaggagaggguuaauguguuagaaaacacugggggaaguaagggaaaggaagaauccaguacagcaaaaucaaauauccaauaaauauacuccagugguggggucaucaaagcucaaggggguugucuucugcaguucagaaauaaggggaaauaaaagacaaagacaaguucucauuuucuuuccucacucuuucuuuuuguaaacucaagauaaagcuuugguuucuagcagugaacagaguugaauuacauucaaucugcaugcuacuagacagucuuguggcuacuuugacauuggucuuuugcaucagcagaagagucccugagugaauuugauggacauucuucuuucauuucuuugucacccacuucaaguuucuaaguggaagacuuccugcccccccaccacccaucucucauuucugucuacucuaggauuugagagcaguaaacagaccugguccauacaaauccagcaguaaaaguguuugacauaaacacaauaaggaauggacuucaaucauugggguauggauuggaaaugaaagcuacagagcuccuaauuuauucauaauuguaugcaagucuuuuauaauuuggaguugccccaagaauucaguauguacaugcaucuugucguuuugguuaaagguaggagaggagucaaguuuuugggacagaagaucuugucuaacauaggaaauaagggaaggagcauaaugagagaguggguaaagauguccaccuuguggaaagggucacacaggcuuacaaaucagauccuuuguguggugcauaaucuuuugacaaaaauauuugguauuuuuuccauacaaaauguugguaaacaauacccuaaaacaacaggagaaagaccaacacauuauaguuagacaaacuagaccauguagcagucacuaaaccagcaacuugugaaguucuacaaggcucagacauaucuaaaagcuagaagggguugauuuuggaaagacuggacucacagucaggcacacaucacccaguguguucuauuccacuugccccauuucaacacagacacagcggucaaugagguagguacacacugauuucauauguuguccaucaaauuuuccuuucucuguuagcucccuaggcucuguuaucacuacugcagcagaagaugcuggcccugcaccacaaagaagcucuuguuuacaguuuuaucugaaagccacacagaaguacagagguuugaaagguuaagguuccagugugugugcuucaaacauacauccccagcagcaugggaugaaaacagagguuucguucuuacaaucuuguuugccccacacugucuugggauuuuugcacgagugugugcacguguaggguagccuuagccucauccagugaaggaugacucuugugugaaaagugagccaaugaccuaggauuaaagguuugguucagaaacucuuaaauacauguauauaaaugcaagccucauucucacuguuuucauucugguccuuucaccaacccugaccucuucuaaucucucugugucgcuuuucuguucaggcucauuuccaaucauccaguagaaggaggcacagucaaagucauucuguggagugaaagucugcuugucauacagaccuggagucgcugcugacuuauccccgagauugcucauguccuugagaacacgguguaaaaauaagggucucucagguuaauguauugagaaauacaaaagcaaaauauuuguauuaagaaacauaaagaauucacacaacagcaucauucauacguggcuaguguuguuggcauccuggugggagccaucauucagguuaaggcuaagcaaauaaaaucaucauagaccagcauggcaugggagugaaccccaggggagcaagccugcagcuguuacuccaacacuugcuuucccacuaucacaacacauugcuuaggauaguuccuagcacccuguaccaauaguggccauauuagagacaagacagggauaacccuuuccuaccccugguagauuaacuucaacacaaaguaguggcuuuuugagucuagcagucuggucucauguuucaucuuuuuacuuuagcauagaauauauaucuugucuuagaaccuaaaaccuaugaucagagaugaagaaggauaucccacaaugcuaagagucaauuuaucaagaagacauaaaaauccuaaauauuuauauaucucauaggaaagcuucaaaauauaugaagcaaaagcccaaagagucaagaagagaaauagacaaauucacaauuaucauugaauaucuuuguuacauucaauuauugauggaauugguaacaaaaaguaagauuauagaauauuugaauaacaccaccaaacagcuuaaucuaguuaauacuuguagaaugcuauacugggcaauuuuaaaauaggcauuucuuucaguuuuacaaugaauaugaauguacacuauauacugggggcacaccaagucucaguaaauuccaaagaauugaaaucauaucauguagaggauauccuuugaccacaauggaauaaaauuagaaaucaauaauaaaaauuuaacuagaaaauucacgaauauuuaaaaaucaaucacuguauuucuuuuguuguuguuguuuuguuuguuuuuuguuuuuuuuuugagacagaaucucgcuguguugcccaggcuagagugcaguggcacggccucagccucccgaacagcugggauuacaggugugcacuaccacgcuuggcuaauuuuuguauuuuugguagagauggggguuucaccauguuggucaggcuggucuugaacuccugaccucaagugauuugcaugccucagccucccaaagugcugggauuacaggcaugagccaccgugcccagcuccaucaauauucuucuaaauaaaccauugaauaaagaagaagucacaagugauuaguaaaauaguuuaacugauugaaaaggaaaaugcaucaucaaaguuuauggaaguuuacaucagugcuuagagggaaauguauagccuuuaaucagugaucuuccauccaaagguguuagaaaaagaagaggaaggaaauaaaaagacaaacaguagagaaaaucugugaaaccaaaagcugauucuuuuagaaggucaauaaaauugauaaacuccuagcaauacugauuuuuuuuaaaaagagaaagcacagauugccaguucaggaaugaaagaaaggacguuacuauagaucuuauagauuuuaaaaggaaaauucagacauauuacuuuucugugacuaaaggauuuuugccuguaaauuugaaaacuuggaugaaaugggaaaauuccuugaagaacucaaguuaacaaaacugaccacaugaaguaauaggauaucugaauaaccuaccaucuguuaaagaaauaucccaugauuugaggggaaaaaaauaaaaauaaaagaaauggaauuuauaauuaagaaccuuuguacauagaaaacuccugaugagaauggcuuuaccagugaaaucuauaaaauacuuaaggaagauauaauaccaaucuuacaaaaaucuuuacaaaaaagaaguaagaugguauccuuccaauaaauuuuaugagaccagcauagccuugacauuaaaaccaugcaaugacauuacaaauaacauugcaaacuuucauguacauaggcaaaaacacuuaagaaaauauuagcaaaucaaaucuagugauauaaaauguaugauacauuaugaucaaagucauuucuucuccuaggaauguaaaguguaaauacuaaaaaucaaaugguguaauucacuguauuaguagauuacuguauuaauagauugaaaggguaacaccauaugauuaucucaauagaugcauaaacaagcauuugacaaaguucaauacucauucaugauuuaaaaacucaauaaauuggauggaaauuccccaaacugauaaaguauauguauaggaauccuauaauuaaccucacauuuaauagcaaaagguaauuuccucuaccaauaucaggaauaaggcaaggaugucugcccuguuuuauucaauaucaucuuggagguuuaagccagugugauaaggcaagaaaaauaagugaaaggcauaaauauuaggaaaaaagaaaauaucgcuguuucuauuugcagaugacaugcagagaaauccuaaggaaucaacaaaacugcuaaaaugagauuucaaauaucguuuacaguagcaucaaaaacuaaacagggauaaaauuaaugaaaaauguacaaaaaagguaugugaaaucuguaaaacauugaugagagagagcaaagaccuaaauaaaugaauugauauacuauguucauuuagaaacuuaauaugguuaagaugucaguucuccagaaauugauuaaaagauucagcacaaucccaauuaaaaucucagcaagauuuuuaguaagaaauugacaagcuaaucucaaauguauauggaaaugcaaaauaacuacaauaaucuaaacaauuuugaaaagcaagaccaaaauuggaagacuuaaucuacuugauuucagaacuuacuauacagugagaguaguccuaacagugugcuacugaugcuacaagauagacagauggauuuguguaauaaccccaaaauagacccaacagaaaugguuugacaaaggcaccaaagaaguuaaaaauuuuuucaacuaacaguccuggaaagacuauucaucuggaaggaagaaaaacaaaaaacaaacaaacccucaauuaccucuaccuugcaccauacacaaaaaaauuauuuaaaaauggaucauagauauaaauguaaaagcuaaaacuuacagagcuucuugaagaaacaggagaauaucuuuguaacuuugggauaggcaaggauuaauuuaauaaaauuaaauuaauuuuuaaauuucaaauaguuuuaaguuuuaguuuuuaggucaucauuuuagcauuuuccuuuaaacaaacaaaaaaaaucaagucaauugaaaggcagauacaaguuauucuucugaaguaauugcaguguuuaucaagaauugaacaggguccgggcacgguggcucauagcuauaauccuggcacuuugggaggcugaggcaggaggauugcuugaagccaggaguccaagaccagccccggcaaccaagcaagacccuuucucuacaaaaaauacaaagaauuggcugagcacagcagcaugugccuauagucccagcuacucaacaggcugaggugugaggaucacuugacacuaggaguuuaaggcuucagugagcuaugaucacgcaacugcacuccagcccaggugacaaagugagacccugucucaaaagaacugaacaggcauuagauguaacucugaccucugaccaaaugagagagcauuucuuugaagcaaauagacaauaaaaacacaaaacugguauuuucagagaccaagugaaugcaguuuguuucacuauagucuucguuaccuuaggagguugaacuucucugcuaugaucauuauuuuauuuuuuauuuuuuuauuuguguaaauguauggggguacaauuguaguuuuguuacauccauagauuguauaguggugaagucagaacuuuuaaguuaguuauccaucacuuaaauaacguacauuguauccauuaaguaaucucucaucauccaccucuuaccccauuacccuucccuguuacuguuguguaucauuccauacucuacguccauguguacacauuauuuagcucucacuuauaagugagaacaugugauauuugucuuucuguaucugaccuguuucacuuaugauaaugacccccaugucacugcaagaaacaggaucucauucuuuuuuauggcugaaugguauuccacuguguauauguaucacauuuucuuuauccagucauucauggaugggcauuuagguugauuccauaucuuaagcaaagauuuuuuagacaagaaccggauaacaauauuucuaaaugaaaagaaauugauaauuacacuuuuaucaaaauuaaacacuuuuacucaucaaaagacacaagaacauauaucaauaaucaaauaaauuuccucugcuaucacuuuuaucuugggauaucaaaacauuguauccauguagugcuuacuuuguaccagacacuuugcuggguacagacgauauacuauugaacaagaaaggcgugguucuuuuggaacauucaauuuagugaggaaauagucaaacaugauaacuuaauuguacauuuuuaaauaacuuaaagacuguauggauuguuuguaacucaaaggaguaaaugcuuuagggcauggauaccccauucuacaugaugugcuuauuucacauugcaugccuguaucaaaauaucucauguaccccauaaauauauacaccuacuguguacccacagaaauuuaaaaacuuuaaaaaaauuaaaaauaauagucaaacaaauaaguaauuacaauaugaaaugacaacugcaaggguagugaaaguacagaaugcauauuacaguuuucauuugacaaauguagaaagcuggcaguaguuaauaauuugcuaacuugcaaaaccagucuaagcuccaauuugcugacuccugcucccaccccucuuuuuuguuucuguuguucuaagcaaagggaguagaauuuuaaacuaagcuuaguggcuagguucagguagaaacuuauauucugauuuuaguuuauauaaagagaaauggauuuguagcuacuuaaagaaaucccaucuuaauguugcuaucuuacaagucuuuuagaaaaguaguuuuucagacuaugucacaguuaggcaaguuccucuaauuauauucuuuugcaguacagugcccagugaguuggaaaggagauccaagcucaagcagucccucuaaucuuugccuugcugaguauuuuuggugugucuuuuuuuaaaaaguugauaaaauugacaggaaggcacugaggggaaauggagaaaaauauagaacuggaacauaucacuagagagagaagcuuuacuuuuaaggguuaacauguaauggaaaugaaugcuuuuguccuuuuuuauccuuggacaucaugacagcaaagcauugauuaugucuuguguuuuuacagugccuuaacgcuguuuaccaucauuucauacacaauaucuuguguauuuccuauaauccucacagucauuauuauuucaauucagucacgaggcagugguggccagagaggguaaaugaguaguucaagaugacuuuaauaaauaacuuugcauccuuucuuucuaauuuuguaccugucuuuaucuuaucugcaaaguauuaguagauuuuuguguugauaucuuccuuuaugacuuauucuugcuuuggucuuuuguuuacucccguuaaccucgugacacaccucuuguuucccagugacuuccaggccaucagcauugcccuuccuuccccagaaaacacccauugcuucucauuuucuccaucaucauuagugguaccaguacucaauaaaaauacuuguuuaggaguaagcgcuugauaaauguuucaaugaauagaagaugaaagaacaagcaugucauuauacagacacucucugaugauuuuccugucaccuuucuuccuguguuucaucuauuaccaaguucuguuuguucuuucuacuguuuuuuucuuuuccaauaauaacuuucuugauuucuauaguuucguugucuuuuuuuuaauuuuuuuuuccuccauugcuuccucauuuaagucuguuuuccacagaacugcuaaaauaaucuuggguuuuauguaacuuuuucuuauuauagaagcaauacuuguagaacauuuuaaaguccuggaaagaaaaaagaaggaacuaauaaucaucuggaauuuaacucauuuuucauagauuguuguuuuuaaagaugguaucuugcucuguagcccaggcuggagugcaguggugcaaacguggcucacugcacccuugaccuccugggcccaagcggcccucccaccaccucaaccucccagguagugggauuacaggaacacaccaccaugccuggcuaauuuuugucuuuguuuuacagagggagucguucuguguugccuaggcugguaucgaacuccugggcucaagugauccuccugccucagcuucccaacguguugggguuauaggugugagccaaugcgccuuucacagauucuuucuguguauguccuagcagaccacaagagugaugucauuuauagagcgaucccucaucuagcaaacuauuauuggugaccuaccuuaaaacaaagcaagcaaccuaacagugcuugaguggccaaaauagauguaaaaauacagcucauauacuugcuuaauuuacaucagaaaauauuauuuaaugguaugguaugcaaaacaccaugcuaggcacuuuggggggcuaaaacauaaauauuauuauuucuuucuaggaguucugaauucagugagaaacauaaaucuauugccccacucacuccuacuuaagaugcaguccuagcaaaugugauuauguguuuuuucgaugcacaacaaaugaaaacuugggaauuaguaggaagagggcaauccucuacuaccagacaauguccuacgagcagcaagcgugaaacuguuauuaaaacacuguacaagugggcauguaaaauaagaaauuauaacauucggagucuguguaaggugguagcaaguagcuucugaggacauauuacucuguguuauaauuuaauuacaacauuuccacaaugaugacuuugugccaucaagaaaaguucauucuguucaauaggcaagaaagcaacuaaugcauuuuagagaaauuggcaacagaaauuauuaaaguuuaucagucaaaagggguagaaacuucuuuuauuaaaaauugauucauguggcauguauauacuaauauugaugggauuacuguacuauuauuuuuaucauaaguaugaaaauguggaagcacauccccaaaauauuucauucauucccaauaguuaucuuaggguucuugucaggaaagcccaguauugcauuccugcccuuccuuuucagugcagauuuuaaagguccaagagaugauauucuauccuuaaugugcaaaguauguugaacauuuaacauagaguguguuuuucaaggggucccuacuggcugggggcacuggauuccuuucuuagcuguugaucugugagugggauuacccucuagauucacuuaccagaaaaguucguuccacccuuuguauggcuaaaggaacacagacuuuuuuuuccucaguccuuacucucuaaaugggagucccgagaggucaugccuggaugagcuggaaaaaagaaaaaugaugucuagucuuuuuuguugucucaugccuuuuccuuaaaccaugagaauagauguguccuuauuuuucaaaaacugcagucaggaaccacauaacaauguuucggccaguaauggacuggguguacaaagcuggucucauaagauuauaacacuuuauuucuuuuuuuaaauuuuauuauuauuauacuuuaaguuuuaggguacaugugcacaacgugcagguuuguuacauauguauacaugugccauguuggugugcugcacccauuaacucgucauuuagcauuagguguaucuccuaaugcuaucccuccgcccuccccccaccccacaacaguccccagcgugugauguuccccuuccuguguccauguguucucauuguucaauucccaccuaugagugagaacaugugguguuugguuuuuuguccuugcgauaguuugcugagaaugugauaguuuccaguuucauccaugucccuacaaaggacaugaacucaucauuuuuuuauggcugcauaguauuccaugguguauaugugccacauuuucuuaauccagucuauuguuguuggacauuuagguugguuccaagucuuugcuauugugaauagugcugcuauaaacauacauuugcaugugucuuuauagcagcaugauuuauaauccuuuggguauauacgcaguaaugggauggcugggucaaaugguauuucuaguucuaguucccugaggaaucgccacaaacacuguauuucuuaccacuguguuaccauugucuacaguauucaaagcaguaacgugcguacaaguuuguagcuuaggagcaaugggcuauaccauauagccuagguguguaguaagcccuaccuucuagucuugugugaguauacucuaucaucacaaaacaaaauugucuaauuauuuauuucucagaagguauccccauuguuaagcaaugugcaacugugauagcccagcccagaaggcugauggcuaggauggucaggaaucaagccugcucaguuugucaccugcuucauguuaggcaauuucccaugguucccaggugagguguuucagucaagcaagggaaacaaacacauaugcauguauuugcaguauagccuuaugaguucuguaguaaugagcucaaaaguguucugggaacauaaaaagggaaaggucacuacuuaggggagucuguaaaggcuuuggaguaaaugauauuagagcuaaguuuaaagacugaaagagagauuauaaaguggagaaugagaugaauggcauucugggcaaaaagcaaaauaaaacaacaaaaagcauauagugagugcacagaccaagaaacaggaaggagggugaaaggaugggaugauggcugggguggagccugguguuagugccagaaccccaucagccuugugucugccagcaacacuccaugccagugucaugccgucauaucagaugcauuucacuuuuauauggaaguuuuuuuggggggaaauuaaguacuuuuuaucucaugcauguauuaugaaugagauuuuaaaauggaguucauauaagaaaagaagaagcugcagaaagauuaugauagucgauucauucugaaaaaaaaugaacaguuacauuucuauauuacagaaaaauaacggacaaaaaaagacaaguuucuggugaauuuaauuccauaccaagcauguaacauaaaacaaauaauggguaauuuuuaaaaugaaccauaauauaaaaugacuuuuaggagugaauuucuauccaguacauguaggaaaaguaaauauaaauaaaaguacaaacccagcaacauuauaauaaauuugugugaaauccuaaaaaguuaccauuacauaugaauacaauaaaauauuuuagaaaaacugauagaaagcauaacaaaacaaguuuaauggaaucucaguguuaugcacauagugcaguaaaagcaaauauuuuauugacagcaacagaaaaaguugaauuccaguaaaaacacauuucagcaaauauuuaagcuauauaaguguaaaaaacuagccccuaauguaaaaagcuauucccaaauguaaaaaacuaucauaaaaccuuucaucuucauccucagaucuuaaaaccucaucaucuucagagccagguaaacagagccugaaaauccaucacccuugccagaauccaaaugauauucuuucuuacuggaacucacucucuugcaaauugagucagccugauguauagaaagaacaccacuuuccaauccuuuuacaguguuugguugccaaguuuauacuauuaagcuagaacugaguauuauagcaaugccuuugucaccuuugagccauggauugcagugguaauaaauuuaaaucuagagucugugggaaauaaauuccaccucugaugggauagauuuguugugugugguuuauuucugugaagaaaaggaccuguacuuucugggauguuuucuguugcugugcuugccgugaggaggguggggaaagguaacauaguaggaucugguaaucauuagccauccauuucccuugguggucaaccuaccacccauaauaugguauccuaagcauagaugauauuuggggauaagucugugcaucuggauaagaggucccuuucuuacagguauucuguaauaaaugagguuuauuugccuuggauuuguugagauguugcaguagaauuuggugagaaacaagucuaugcauuuuucacugaguucuuauuauauuuaagauagaaucgugugauaccuaacuuuacuacucaccucuucccuuaauauuuauuccauguauccuccacuagauuuuuagcugcuuaaagguaucuaucuuuuuaaucccucaguaugagauggaacaguagugauggcuuauuuuaauauuuuauuuuaaggaguguggcauaguggaaaauucagaggccugagucuuauuuuuuaacuagcucuuaacuaauaguauaaucucaagcaaguucuuuuacugcuugugccuuuauugauuuaccuguaaaaggggguaauuugaauacauaucuaucucuuuuuuuuuuaaccuuuucuuuuaguuuuuaaaacuuuuuuuuugagacagggucucacuccaucacccaggcuggagugcaguggugaguagcugggacuacugacacacacuaccaugccuagcugauuuuuuguaaagaugggguuucaccauguuggucagguuggucucgaacuccugggcugaagggauccacccaccuuggccccccaaagugcugggauuacaggcaugaaccaccucacccagucuagguuuuaaaacuuuaaaagauaauuauaaauucaccugcaauuguaagaaauaauacagaaggauccuguucauccuucaccuguuucuuucaaugguaacaucuuguguaaccauaauauaucaccaccaggaaaucgacauugauacagcccacugacuuuauuuagauuuuaccaguuucaugugaacauguguaugcaugugugcgauauuaucauguguggagucaugugacccccaucauuguagacacagaacuuuucgccacauggaucccucauguugcccuuauauagccacagccucuccuugccucuccgccguuccuaaccccugggauaacuaaucuguuuuccauuucuaugauuuugucauuuugagaauguuauauacauggaauugcacagugaguaaacccuuugagauuggcuguuuucaugccccauaauuccuuugagauucauccagcuaucaguaccucauuccuuuugauuacugugaauauccacaguuuaccuuuucacccauugaaggacauguggguuggggauauuaugaauaaagcugugaugaacauucauguauacauuuuuguauaaacuuguuuucauuucucuuggauaaacaccuaaaaguacaauugcuuucuguaucuuaugguaagugcauguuuaguuuuauaagaaaaugucacagugcuuuccauaguggcuguaccauuuugcauuuguaccaacaauguauuuugaauuaauuuuuguagaacaugugagguuucggcugaaguucauguuuuuugccuauggagguucaaugcuucagacuguuuguuaaaacacucuuuccuccauugaauugccuuucuaccuuugacagaaaucaguuggagauauuugugugggucuauuucuagguccucuguucuguuucauugaugugcucugcugguaccauaccaucuugaguuaugguagcuguauaauaagccauaacuuagggaugggugacuuuucuuauuuuauucauuuuuaucaaaauuguuuuaguuuuucuagguccugugccuuuccauaugcauuuuagaacaagcaugucugugucuacaaaaauauugcuggaauuuugauagaaauuacauccaaccuauaaauaaauuuaggagaauugacauuuuuacuauguugacucuugagccauuaccacaauaugucccccaauuuauauaggucuuccuugauuuauuucaccaacaauuuguaauuuucaggauguagauccugaauaugucuuuguuagauuuguaucuaaauacuucucuuuuuugaggggugacuguaagugguacuauguuuuauuuuauuuuauauuuuauuuuauuuuauuuuuaagauggagucucacucugucacucagacuggaguacaguggcucagucucagcucacugcaaccucuguuucccagguucaagugauucuccugccucagccacccgaguagcugggauuacagacaugcgucaccacaccuggcuaauuuuuguauuuuuaguagagacaggguuucgccacguuggccaggcuggucuugaacuccugaccuugggugaucugccugccucagccucccaaaaugcugagauuacaggcgugagccacugugcccaaccugguacuguguuuuaaacuucagucuccacacauuuauuguaaguauauagaaaugugacuguuuuuuguauguugaucuuguauccugcaaucuugcugagcuggguaucuuuaggaguuccuuaggaguuugaaauucuacaacaauauugacuaauuauucuuugucucuaaugauguugaaaugaguaaaaauugaguuaaauuuuucuggagaaguuuuaaguccaaccuaaagaagaacuuauuaaccaaaaacaugaccacuucaacagucugccuagaaaauaccuccuucuuugagagcuuugacaauguuaaaauuaacugauugacuuauuuugcuuuccauggaagacuguugcuugacuuuaaagaguccuuccccauuaaaccucaaagaucuccuggucauuuuuaaaugaacugguaauaguauccucaaaguagaagaauuaacguguguguguguguguguguguguguguaugaaaucucuguauuuaaaaagcuggguuacucaauaagucuggaaugucuuuuaguucuuacccucuaagauaaaauaucaauuaugucuuaagguuaucugcuuaggaaaugaauaguugcugcuggaaaccacauguaagauuuacucaagagcaacuacuaaaaaauaucagugaaggugugcaagucauuagucaaugaauugaauacaucagugauauggccugcauuacuuagguggagaggcaaaucucuacaaaaucaaaaaacugguuuaaucaggcaugauucuugagcagcauucccucauaaaaauccaagauaguugagugauucguucuucaaaaucuugaauguuauacacaauacucagcagcauagaaaauaaagcgauucuuuaaagaguauaaaaauauacucuuuauuuaauauuacuaggaauuaauagugucagauaguuuuuaguauggcagaggagauaggcccauccauuuuacuuuagcaauuuuuauuaaaaucuucugaaguauaugcuucccugucccuugaugauaauaaacaguggugaauuaggaauaucagacaccaaccuguguuuuaauacagggacucuugcaucgcucaagccauuaacaucuggaucaaauggcccuagauugccguaauuuugcagauauuuuguguucuuccucuguuuggggguauuugggugugccucuugugcuucagaaucauacuuuauuagcaagucuaaauucaugguucugcggauagcuucuuacuguuuuacuaccaguaaaguccacaaucuuuaagacugauaauuucuucgucauugcugaaagaccuuccaaauccucaacaauugcagaaauuuacauguugacauguagaguauuucuguccuuaacagagggaugcagaauacuggagcaugcuaacucuuuuugaucugauuuaagccaggaaaauaguggaagaaaggugaguagcacaaguuggaucagcacuacuuuuaucaaauguugaaacuuccuaaauguagccaagacuguucuuaucaccagagucagcuuccagugugaggaaaucaaagugcaagugcaggaaauuaucuguauuggauuuggcauuggcauugaacccagcccaacugaccacucaguguuugcaaggaccucuaggggagucagaaucaguauaagagugaggaagggcauggccuacaugcuauaauauuuuuguucuauguauauuacuuuuugauguuccugaaaggcuaaaaauuuguggaggggagcagaaauguauaauaaagaaauagaauagaauaguucuguaacuuccauucagaucacuucaugguaagcaccucaaguacucagacuuucuugaaaucaaaaucaggaaauauuccaggcugggugcagugacucaugccuguaauaccagcacuuugggaggccgaggugggaggauugcuugagcccaugaguucaagacuggccugggcaacacagcgaaacccugucucaauaaauaaauaaauaaauaaauaaauaaauaaaaagagaagaaaaaaaauucaagcuucucauucaaaaagauuuuuuaaacuauaacuuuugauugucucuacauaaaauuuuaauagcauguuuaauuuggagguagauuucuaaaauuuaaaaacuauuuucauuccaagaugaaaugaaauaagaaaaauagcuuuugguuccugccuucaaaucuuuaaacaccuaguuggauuccugacuuccagaguguaaugguaaagccaccugcuccgcccuaucugguuguugugguagggaagcacuauagacggaauguuuguguccuucaagaauucauauguugaaaccuaaucuccagugugaugguauuaggagguaggaccuuugggaggugauuaggucaugagggugaaacucucaugaaugggguucgugugcuuaaaagaagaggccagagagcuagguagcccucuuuccaccaucugaggccauagcgagaagauggcugucugugaaccacaggaaucagguuuuuaccagacacccaaucugcuggugccuugaucuuguacuucccagccuuuagaacugugagaaacaaauuucuguuuauaagccacccagucugauauucuguuguaguggucugagcugacaaagacauuuccucagaauugcuuucccagaccucugauuuuucuccucucuugugugcccauagucugcaugagccuaucagagcacuuguugagguuuucauauuauacuugugugauucuuuuauuugugccccuucuuuccacugcauuguaagcuccaugaacauagacuuuuagugacacacacauauacauguguguauguguauauauauauauauauauacacauauauauacacauauauauacauacacauauauauauauuucacuguucucccuugugcuuacaauauguagcaaaaauauuuguugaauucaugaugacuuuucaagcgaaugcucuuuucaaaggucuacuaaaauauauuuguuccuuauuaucucuggggaaaaaaggagacugguguaugugugggcuggaauaaauauucaagcuuuacaauuuuuaucuucuuugaagucuuucauacaaccuccuuuaugaagagugccaugaaaaugaucuuuaaauaagaaaauuaagagguguuuuaguugggaauuaauguauuagcauauacuuuaaaauuguguguuacacagagauacagaagguguuuauauagugucuaucacuugucugcuguuucccuggaagaauguacauguuucuggcuguaaacaacuuauuugccuuuugaagcuagaguguaaauuguggcuuuugcauauuuuaccuucuuguuguggaauauccuucagaugcuaacacaugaacaagagacuucaacuuuuaaaaaacagaaugugugaccuuuggcauucauaaacacauaguaauaauuugcccuguauauggucuuaugauaaguacuguuuggcugccagccaagucucauuucuugugcuagggcugucagggccacaugguuguauuuguaaggagaauauaaguguaagaagucuguaaaacuauauauaaagucccaccgucuacagauucugucuuucaaaguacuaaauuaaaugacaucuucuuagaaaauacaaaugaauaauaaauuucuugcauuuacaaaauuguucauugaaucaguccauaggccaaauauaugagaaauauugguggaaaauaauaucuucuacaucguuagcagugguacagagcuguagguacauuuuagcuaauguagaguugucuuuugacucaccucuugaguugaagaugaaagcaggauguuagcagggaaaugguaucuggcuugcaggcuuguccccugugaagaagauccaagcauggaucccuuugguuuaagaaagauugcugcuguugcugaacaagcucagggacauagaauaaggcaaagaauggugugccauugcugaacacuuccucuuccagcuucucauccaucuuccacugugguucugauuuccugugcuuucuugagugugguuugagcuaaggaaguauaauaggaugauauggaugucagagacacugauggcuccccauugggcuuacuccaaacagaagcuuuuaaaagagugagaauggguuucauucucucuuccugguuugaucacuauuucuauuuucuuaugacccacugccgacugaaggcucacagaggccuuaccugucucucacugcugcugguggcccauacuguucuguuuaagcaaagcccuguucucucccaauauuacuucuuuuuucucugugugugcgaucccuuuuacacagggggcccaugucagauugcuagaaugcuucauucuucauuaaccaucacauuggauauuaaucagucuugcagacuaauucucaguaaagguauuaccagaaauacaguucauugcauauuuaucaguuacuuuacuagguauuuccauuuguuccuuuuagcuaaccuguccucccuaucuuauagaugaggacucgggguggaccuugaagugcagagagguuaaaaacuucuccagaucaaccuaguaaggggcagggcugggauuugauuccagcuuuauacaguuuugcagcaaacaaagacucuuuuccugggauauuuauaguuuagccaggaauacuggguuagugauaugaauaugauuuaggccaggcacaguagcucaugccugugauccuaacacuuugggaggcagaggcaagaggaucauuugagcccaggagcucaagaccaaccugggcgacaaagggagacccaaucgcuagaaaaaaugaaaaaauuaaaaaacuaaacaaggagugguggcaugugccugucauuccagguauuugagagguugaggcaggacgaucuugagcccaggaguuugaggcugccgugagcuaugaucaugccacugcauuccagccugggcaacagagcgagacccuuucucuagaaaaagaagaagaaaaagaaaagagacuuaaaccuauugauagaauuucuggcauuguuccuagucauuugauauguaucucugcuagggaucucucuggcaccuugaguucaugccagagggguagcuaucuacuuaaaugauauguuuaaaaauuuaauauuuauaacuaagaacaagucuauuagcagugauauuuuuauaugacauauuaaaguuacaacaucuuucucauuugauucucucaauaacacguggauucuuacaaguuaagagugaaagugagaaguuauugcaguagucuaagugaaaaaugaugauagcaauagaaauagagagaaguacacagauugaaaaauauguguuggggguagcagacagaggaggcugcaaagggaaaaaaaaagaaaugcagaaacauauggugguguggcagauacuguagcuuggcucauuuaauaccucugccguguauuauuuuccugugcugcuguggccuaaauuuccuagaaugcccuguagcuagaauucugugugugacuugguuucuuccaagacugugcauccauaugaugcgugugacaagaagcacaaggaagacagugaggucguugccaugugcagaagagauuuggcaaacacaguggcaaagguuccuggugcuacccaggcaucugugguggaaguucuagcuuucagacccuuuguggugggaggcagugcgggguauucuugcuagcucagacuugugaugugguuggacuucucuccuggcuaugugcaguugucuuguugaucaucccagccugauucuccaggcuucuaggagauugaggaacuaucaauaauccucuuuauguuuaagccagcuagggaagucugcugucugcagauagaaauugggaaugguacagcuacuauaaagcugagaaaauaugaugcuucaagggagcuaauuguguuuaguacuguuuaaaaauggaaauugaaaaguguuuauuaaacuuagugauaggcucauuugugacccuggagaaagcaugguuuuuugguuugguuuuguuguuguuuugauggaaguggaaaucaguuacaauaaauagaagaguacauaggagguagggaaguaaagacagccugggaagacgacucuauugauaacuugacugacggggaauagagcagaggagcaauaguugagcaggaucaggggauuuucucguauuggagugaaauaauauguaugaagcaauuuuuaaugaagugucuuauacuucguaagggcuuaguaacuggaacuguuauuauuaugauuguuacuacuauuauuguugucauuuuguccucuguauacuuuagagcggggguguccaaucuuuuggcuucccugggccacauuggaaaaagaauugucuugggccacacauaaaauacacuaacauugacgauagcugaugagcuaaaauaaaaacacacgcgcacacacacacacacgcacacaauuucauguuuuaagaaaguuuaugaauuuguguuggccacagucaaagccauccuggaccucaugcggcccgcaggccauggguuggacaagcuugcuuuagaguauugugaguaugggguagcaaucucuucugucuccugauuuuacagaucuuuuuuucagcucuugcaggcuggccucauugccauauuaucuuuacuuaauuacauuaauucaauaaacauuuaugaagcacccaguaugugccagguaaaaauauagcaggugccugggauucaaaacugagcaaaacuugcucucugccucuaaauaguuucugaagcacuaggggagagagaugguuaaagcauaaauaaaugcuuuaucucaagucaugcuucuaacagacgagcagaaccaccaggagaugugugugugucuguuguauuuauguauucauuuacucucucucucucucucucauuauggcuggcuuagcagcccagagcccacaggcaggaagacaggcaggaaggaucaggagcaggcuggaaccccucaagcaugucuuuuuaucuuaaggucccccuacagucaucuaucagggguuaacgcaauucuucuuuugagccaucucccuucuuaugaaagccucaguguugaagcaggaagcguuucucccuuauagucauuucuaucuacucucuuauauaccaguaagaccuguauuauaaagaauuacguuuaugauaagcagauaugcaaauuuauucuaauauguauugccuaauuucuugaauacacucuagcugcauuuauuaacauauuuuauuuagucaucugugcagcuaguaaaaauaauuggcuaucugugaauuagcacaauacaaguuaaaaugugaguucauuaguuuucaacuugaguuuuuaauuucaccugcuguuuacugcccaaaggaaugauaaauuguauuuuaaaugaaauguauuugaaggaagaaccuucagcaaucaauauucuuuuuuacuuaaaaucugcuucuaaucugcucugaaacuuuaaagauguuguguuagacuguggcaaccacugaugaauuugaaaaguuguguuucuaguucuuauugccaaaggaauuagaggcguuagguuaguuaguccaguuauuuuuauugaaagaaguugaaaccagcucauauaucuuaaaaaagaaagguaaaaugcagugaguggggugggaauuucaauuaugaaaaaggauaucaagacuuuaaagcccagagacagccgaagccaggccucugggccggaacucugcaaacucagccuggagcucugugggaagaggcagcucccacuacugcuggucugucccaggacucuccugcccucuguuucuguuucucuccaggguccgcucuccuccuccuccucuuccuucuccuucuccgccaccacuggggucugcuccccucuuccuccuccacucugccuccuguuccuuuccccuuucuccuccagggucugcucccugccgcugccuccauugccaccucggguggccuccuccuccuccuccuccuccuccagugucugcuccccucuuccuccuccuccagugucugcuccccuccuccuccuccuccuccagguucugcuucuuuccuccuccucccccucccuaacucuuccuccuccuccagggucugcucucuuccuccucuucccccuccuccccccuuuuccuccuccuccuugcccuugcucuuuccugguuuccucugcuuucuugugugcauguggccuggccugcucacccucacugccucagucugugcuucuucaucaccaccagccagcaccacuaacugacaucaguuucuaggucucucagaucagauuccugaaagaaaggauucaguuggcccuguuucugcccagagaaauuguguaauauauauuuuuugagaacugauuuggccuuuuauuuauacauaucagaaguauauucuccaacuugccuaaagguucuguucuaacugcguuuuugaaaugugugguuuagucagagaaacuaugucuuaaaguuucuguugauucccaggccagcugcaaugaacuauuuaacccaugaagaagaugagcuccggcauacugcuucuguucccacgaaucucucucuugcuguguguuugugccugggauuugagccagggaggauggggagcucagaguagagucuaagaugagagugggcucuggggagaugagggucggcucuaguaggggguauggaaaaguuggugaucuuuagagcaacccuucuguugauguaugauagguuuaggguaggguucaggugaggagagugugggaccccuuggcagaaacuccaguggggaaaagucaaagauagauguucuguucuguguccaggguccccggcucuggcuguggcaguggcagucagggggcccuguguggccaucauagcuauuagaaugggcagaccaucaguaguccagcuauucuucaguagaacagcugcuuggccuccuucgaaaagaaauaacuggguggggcucaaauuccaucugcauaaaauagucaccauaaacuaaauguggaagaaguaaaguugguguuuauuaucaugauuguucuugacuauaaauguuaaaacucauugggggaguagggggcuggauuuccugugauccauagaaaggaagaaguguuucgggcauaccuggggaccaggcagcucgauggucugccccuaacaauucaccuuggaggauggaauagucauuucccaggauuuugaaauuuauguaacuuuaaccaugucuugcuucugaaaauuugccuuuuaaucucucuacaagucuauccuguauuaaccucgugguauuugcagaaggaaguuucaaagucccauaauuuaaaaauaaaauaaacccaauuuucuccauaaauuuuauuauaaaauaaggcuuguauuccuggaggcaaaguccuccaugcacuaaaguugaauacuuugauaaggaaagaauugagaugcugaccauucugugcuuauauuaaaccuauuucuuccccccaaauuacuauuucccccaguuuacuauuuccuucucaguagcuuaggaaagugcuuuuagccugagggauucugugaucccacacuuuugcagcccuaggaacuuggcaucuauccuccuuagacuuuuaugaguaggucccaccauauaacaugcaucugcaccugaaacuccauuuauguaauaaugcuacaagagugcccaugcuguuucagaugcucuucuagcuccuggagauacaucaguauccaaagcaaaaaaaaaaaugccuguuaucuucauggagcgaauauucugguggagcagcuuggacaauaagcauaauaaauaauuaugcaguuuguaagaaaauaauaaguccugcagaaugauagaacuauagugcuguagaaagauaauucuguuuaguuuaguuuuguuuuuuugagauagguucucacucugucgcccaggcuggagugcaguggugugaucuuagcucauugcagccucaacuuccuaggcuaaaguaagucauccuccuaccucagccucccgaguagcugggacuaaaggcacguaccaccaugccuguagucccagcuaauuuuuuaauuuuuuguagagacgggggguugccagguuucccaggcuggucuugacucuugagcucaagugauccaccugccucagccucccaaagugcugggauuacaggcaugagcuaccacaccuggcuagaaugauaauucuguagcugauauagaauagaauauggggaaugaggagggagaggggaacauugcaauuuuaaauugaguggucaggguuggcuucacugagaaagacauuugaacaaagacugaaaagggugaggaagcaagcaauguggguaucugaaggaagaacccugcaggaagaugaggaagccaguaaaaaggccuggaugcagggguaugccuggcauguucaaggccagcaaggcuggggguagcugugagagugaagagaggaaguaggagagggagcaaaucggauagaggcggaccagauccuaugcgacuuuggaggcaaggacuuuggcuuuuguucugaauaaauggggagccauuggaggguucucagccaaggaggggcaugaucugacccugauuuuuaagggauaagucuggcuaccauuaggaggaacugggguucaugggaggcggugcaggaguggaaacagggcuccggggagggagacuauuguacagauccagguaagagacagugguggcuuaaccaggaugguaacuggaggcuguaagaagugauuggauuuuagauauauucugaagauaaaauucauaggauuucuacauggauugggugugaaugggugaguugaacuuugaauuauauaaaacaaauaaaauaucuaaguaacuaaugugauauuugaaauucuguauccugaaguuaaguucaauaagauuaacccacacugauaauggauuuucccucuguccugugaaagagucacuaugccaaacggaaaaaauuaagcugaaagcugagucaugcaagaaacugcuuuuccuuuuguuccuuagcauauagcuacagauaaagauuaaauaucuccacauguagcuacucuauguucacccuaucuugugugaagugcugauuuacugagcucaagaugaauauguaacugacucguccccucccugcuccuucucucuugcagcauguggauuaccuacccuccuucucuccccuccagccuacuuucccccuuuaaauauugaagcucucaagaucaucuuuggagaaaggcacaggucacagacuguuccuguggugucauguuguuuucuucaagacaaguucuuaaccuuggcaagauaaacuucuaaauugauugagacgugucucaugcauuuugguuuacaguccuuaccauaugguugggaaaaauauacaagugaauuuagcugagguuaaauuuaguauuggacuuuacagaaaugaauguuucuauccaagccuuuucagaaaggauuuaaaaaaaaauacccaaguugugugucucccuugcauaauguaaauaaaaggcuugaaacuuuagccaagcagucuuccacuaccaacuuuuccaauaacuuuccauccuaagugugcugcugacuaaucuuccaugcagcacgccaagucuugcuuuguugaauauuaaauugucgacauauuaaaguuaaaacuugcuguaguacacuauuuacaauagcaaagacuuggaaccaacccaaauguccaucaaugauaggcuggauaaagaaaauguggcacauauacaccauggaauacuaugcagccauaaaaaagaaugaguucauguccuuugcagggacauggaugaagcuggaaaccaucauccucagcaaacuaacacaggaacagaaaaccaaacaccacauguucucacucaugagugggaguucaacagugagaacacauggacacagggaggggaacaucacacaccggggccugucagggcaggugguggcaaggggagggagagcauuaugacaaauaccuaauacaugcagggcuuaaaaccuagaugacgggcggauagguacagcaaaccaccauggcacacguauaucuauguaacgaaccugcauguucugcacauguaucccagaacuuaaaguaaaaaacaaaaacaaacaaacaaaaacuugcugucguaaacccagcauuaacaacacugauuccugagauaguguaguugugugguuuggacauaugaugccaaaacauaacgcagggcuucaacucugucaugcugaauuuuacuucuuacuccaucauugaagcugcccucacaggguuaacaagaauuuuggacagaaauacuguaauuaagcauuaauuuggguuuccuuugacucacuuuuuuuuguaacugaaagucauggaacacuagauacugaccauuugcauccccacuguaccuguagauaggauuucucuuuuguuauuauuuuuuugagucagggucucgcucggccaccccagcuggagugcaguggcacaaucacggcucacugcagccuugacuuccugggcucuagugauccucccaccccagccucccgaguagcugggaccacaggcauauaccaccgugcccagcuaguaggauuucugacauuagaaucauaaggcuuuugcucaagauagauaggaccucugacauuagaaucauaggcuuccaguuaagaacugcuuaaacagaucuugaauuccaguagaacagcugaugucaacaaucuccacacuuuggcccauuccaaaaccccuaaaaacccuauucccaaacuccucuggcagacagauuugagguuuccucccaucuccuuguuuggcagcccuaugauuaaaccagugcaaccuggugucucggcauauugauuuaccauguacauagggcaacagaccuauugugguuacaucaccacuaccaccaaaccagucugauuuucaucagccacuuccucugucuugguauagaaaaauaauguauguacuuaaggaaaaagcagucaacaaacuucauugguuucagagggcuaagggaauaauauaaucaaugggcuaguaauuggaagcaauuguuuuuaaaguaguucuauuauagccauucauuaggacuauagauuugccguccaacauauuuuucuguguaccuagcaugaaauuugaagaauguaauuuaaaauaaggaguagaguucuguugacuguuuuugggugucauuuuuuaucaguuuauucuaagguucuggucuuucuuugaacaugauccuuagcaguaauuuuuuucucuuuuuuuugagacggagucuugcucugucgccaggcuggagugcaguggcacaaucuuggcuuacugcaaccuccaccucccagguucaagcgauucuccugccucagccucaugaguagcugggacuacacgugcacaccaccacgcccagcuaauuuguuuucguauuuuuaguagagacgggguuucaccauguuagccaggauggccuugaccucuugaccucgugauccacccgccuugaccucccaaagugcugagacuacaggcaugagccaccgcgccuggccagcaguaauauuuuaaauuaauugagagaaucaaauguuuuuauuauuaauaucaguuuugcuuaucuuuuuguaacauauuuuaaaucuauugggucugauuugcacuccacacagugguugaugugucauugucaucagucaccaaauaguaaugugucuuauuauguguuaugaaagcaaguucuuuaaauccugauguggaggggaauaaucugaaauagaaaaaauuuuauaaacuuuuucaggugugauuuuaugguuuccuggugaguggaagggccuuaaagaguugcucagccaagugguccucuuauuagccuccuauuguuugcuaagagugauuuuugcuguggccuaaauuucaugccuuuuuuuuuucuuuagaauuucuaaacuacuuuuuuacuauccagaaagccccagaaagcaaauggguuguuuucagauuauuccuggaaauguuguuaaucuccggagccaacuccucaaaucugauuugguugagaugaguaacugaggacaguuuccaagaguugaguguugacacaugcuuuuuagcauuucauuacuguaaaucuguaagaaaagugugaggauuaagguggcccagaguguacuugaguguaggcagaaggaaggauugaucaaauaagugggcugaagucagagacauucucuuuucugaugcgccguuaugaucuuccuguggaaaccagauguuuuuguaucaagaagaaaugaugagcuucagucccugucuuaggaaguugcaucgaauuuacaaaggauaccauuuagagaaauucaggacauaaauagauacuguuaacuucuuguuaaaaaaaaaauggcaauuuccccaaguauaucauauuuauauauacacuguuuaucuucuucuaggaaaacaaaagcuguucauuggaaugaaaauucugaguuuuauuuguccguuaacucaguaauuggugguauucucauauaauugaacauugaagcuuuguucccuugcaagaaauuauaugggauaauguguaugucugugauacacuauaugaagagcuucuguguuggguagggagaaagaauuugaugguagcuauuguaguacaauaugacuacaaagugcugaugagcaauagaaguuauaguguucggaaagcaaguucuuuaaaucaauccuaaugugggggaaauuaaucugaacaucagcaucagcucuucccugccacuuaggucucucuccuacaggaagcugucaguuucuuaccuauguuguguucucuuccugguccuuacaaggaauccuauagcugugagaagcccucccuucuuugguagauccccauuuaccccaaaaggugagcaucuucauuuguuagugcugugcauacugauucuucuuucucuugcccuuaccagcuuuaaugcugcuguugauuucuguccuucuaaccagauguuuuuguucuuucuggcugucuucuaucauugaacacuuuuccugcuuaggaccuauagcauagagugauuuuucagauugucucaaguuuuccauuaacaagaauaucagcucauauuuaugaaucacauaauugauaccagcuucaaagaagcagcaagcuaauuuagacuagaccuugcagaucaccaggaacaguuuugucaccagggcauuguacaaauugggaaaaaaaauaaaagcacccuauuuggacagaugaaguauaaaaaguugcucuccaggugcauggaucagaaaaaugucccucauccaaaguaaggaagccucgggauguggcuugaauggggacugaauuuuagccucauuugaccaguguuuaggguuuaauacacaacugcuugcagcagcuuggguugccaugccaucucuguuuuauuuuguuuucuuugguuuuguuuuuaagauccauagacuugguggcuaucucuuugcaucacaauuuccaaauuuuuguuucuagggguucuuagaaauacacccucuaggccgggugcaguggcucacgcuuguauucccagcacuuugggaggcugaggugggcagaucacgaggucaggaguucaagaccaaccuggccaacacagugaaaccuugucuguacuauaaauacaaaaaagcugggugugguggcaggugccuguaaucccagcuacuugggaggcugaggcaggagaauugcuugaaccugggaggcagagggugcagugaguugagauugugccacugcacuccagccugguugacagagcgagacuccaucugaaaaaaaaaaaaaaaaaaaaaagaaagaaacacacccucuauaucaauaguuacucugguuucccuccuuccuuaguuacucugguuuccuuccuuccuuccuuccguccauccuuccauccuuccuuccucagcucuauugugguauaauuuaaaugccacaacauuccucccauuguaagauacaauucaauaauuuuaaguaaacuuacuacucauacagauaucacuacagucuaguccuaggacauuuccaucaccccaaaaaguucucucaugcccauuugcaguuaguuccugcucccaccccagccccaggaaaucacugaucugcuuucuaucucuguagauuugccuuuucuggaaaucucauaugaauggaauuauauuuuccuuuugcuucuuucuucuguuaagcuaauguagguuccagucagugcucauuugcaauaacuggaugagccuugucaccuucuacugcugcugccaguccuugcuuaucccuuccuuuccauucugccucaguguacaaacauacucuuuuaccuccugucuuaaaauucucucucguccaucauccccuccagccaccacccuauuucucugggccauuuccgagcccagcuucuuaagacucgacguuauauaugcuuucuacucucuccucuccugugagcucucauuuuuuguuuuuuuugugugucuuaaauauaauaauugauaugaauaaaagacauuaaaaagaacaugugauacauauauacaugcuuuaaagcauagugauauaaugaguaucuacaucugccaucugccccuuccgcuagcauuacaaaugguggaacccaugauucauaguguccaaaauauuuuacuuaucuuuacaguuauuuugguccuuuuugaucauuuuaauucuacuuuuaaauaagaagucugggcuaaauuuucuuuaaaauccguuacauugcuaaauuucucugauuacuauugagagauuaauuuuuuuacuuagaaaguauuauagaagauuuauagcuugcuuuguuguauauuacuauauuuuauuaugaagccuuggcuaagagcaugcaugacauacaguuauaacaguauuucuauaggaaauguauucuauuugcauuaauuugcuucagguuuuuuuuuccuaaauuuuugaagcuaaaagcuagacuuccuguaauguuguuuccuuccuuuaaacuuuggauagaauucauuuaaucaauccauuuggccccaagggaggcauggaugucaauuuuuguuucaacuuaauacugugaagacuuaaauauuuaauuaacguaauacuugacacuuagaagcaauuuauaaucaucaaaacuaggccuuuguuuucuuuuuuuaucccuguuguuuagaguuuucuuguuguaacauagguuaggaauggacugguggagaagugaaaaacucuccccucuccccccaccuccaggcagagagaguuacgcagugcauugacuagugauggauguuuaacauacuuguccuuacaucuguugauuuucuaaacacauuuuuaucauuuauuucauuuguggaagucugaaauauuuuaugucuuucuauugcauauugaugucauuaaaacagugaacacuuaaaaacagacacuagauuuucuuuuaucuuuauuugauuucauuaauacagucuaagaaauauugugaguuuuuaaugaguuacaaguaaaccaaagugggugacaaucuuccuguggagcuggguauaugucugacaggaaaacuaugggaagagaaucuucuuuucuuccugguaggagaggccaagaugagaauggagcucuguguagugcucuaugugucauaggaaagauccaugccagccaaguggauuccaaggcccaagucaucccuggacucuggaaagucucauguuggggcagaugcagugacuucagcaugcauguauuucaguuuuccuuuagucugagaauuucuagucguuaauaccuuccuuuaccagucucugcuauuaucaaacacacauauucuccuuguauucugaaaaugauuuaugcuuauggccuuagauucuauaaaucuaaaucuauuugauuaaagccuuugugcuuuuucuccuaccgaaaauuaaaaagaaacaagcauguauucuauuuaaaugggagagugaagauuuacugacuucacagaugaccccacuggaggaaauggauuguaucacaggcccaugaaaugucucaugauugugcauauuuugaaauacaccccacugauuagugaggcuccagauuaccagauagacucaucuuuguacaauaggacuuuaacugguuuucuccaguccucauuuacaguaccaauuaccuuacagaaaccuuucuuuagcuucagucuccuuuuucaguuucacaaagucugaaguaacaagauucaguucauuaagguuuaauuuuauauuugucucccaccauaaucaucauuacauuuuguuacaagugauaggaaaaauuauucugacuucuuuaucauagggccuuagaagggauuuuguuaaaaucuuaacugcugaguagauuguaaaaauuuucucccauucuguagguugccuguucacucugaugguaguuucuuuugcucugcagaagcucuuuaguuuaguuagaucccauuugucaauuauggcuuuuguugccaaaauuuucuugcuuuugguguuuuagucaugaaguccuugcccaugccuauguccugaaucguauugccuagguuuucuucuaggguuuuuaugguuuuaggucuaacauugaagucuuuaauccaucuugaaauaauuuuuguauaagguguaaggaagggauccaguuucagcuuucuacauauggcuagccaguuuucccagcaccauuuacuaaauagggaauccuuuccccauuucuugcuuuugucaguuuugucaaagaucagaugguuguagaugugugguauuauuucugagggcucuguucuguuccauuggucuauaucucuguuuugguaccagcaccaugcuguucugguuacuguagccuuguaguauaguuugaagucagguagcgugaugccuccagccuuguucuuuuggcuuaggauugacuuggcaaugugggcucuuuuuugguuccauaugaacuuuaaaguaguuuuuuuccaauucugugaagaaagucuugguagcuugauagggauggcauugaaucuauaaauuaccuugggcaguauggccauuuucaugauauugauucuuccuauccaugagcauggaauauucuuccauuuguuuguguccucuucuauuuuguugagcagugguuuguaacucuccuugaagagguccuucacaucccuuguaaguuggauuccuagauauuuuauucucuuugaaguaauugugaaugggaauucacucaugauuuggcuguuugucuguuauugguguauaggaaugcuugugauuuuugcacauugauuuuguauccugacacuuuccugaaguugcuuaucagcuuaaggagauuuugggcugagaugaugggguuuucuaaauauacaaugaugucaucugcaaacagggacaauuuggcuuccucuuuuccuaauugaaugcccuuuauuucuuucuucugccugauugcccuggccagaacuuccaacacuguguugaauaggaguggagagagagggcauccaugucuugugccaguuugcaaagggaaugcuuccaguuuuugcccacucaguaugauauucgcuguggguuugucauaaauagcucuuauuauuuugagauaugucccaucaauaccuaauuuauugagaguuuuuagcaugaaggguuguugaauuuuguuaaaggccuuuucugcaucuauugagauaaucaugugguuuuuuucuuugguucuguuuauaugauggauuacauuuauugauuuguguauguugaaccagccuugcaucccagggaugaagccaacuugcuugugguggauaagcuuugugauaugcugcuggauucgguuugccaguauuuuacugaggauuuuugcauugauguucaucagggauauuggucuaaaauucuccuuuuuuguugugucucugcccggcuuugguaucaggaugaugcuggccucauaaaaugaguuagggaggauucccucuuuuucuauugauuggaauaguuucagaaggaaugguaccagcuccucuuuguaccucugguagaauucgccugugaauccgucuguuccuggacuuuuuuugguuuguaggcuauuauugcgucaauuucagagccuguuauuggucuauucagggauucaacuucuuccugguuuagucuugggaggguauauguguccaguuauuuauccauuucuucuagauuuucuaguuuauuugcauagagguguuuauaguauucucugaugguaguuuguauuucugugggaucgguggugauaucuccuuuaugauuuuuuauugugucuauuugauucuucucucuuuucuucuuuguuagucuugcuaguggucuaucaauuuuguugaucuuuucaaaaaaccaccuccuggauucauugauuuuuuugaaggguuuuuugugucucuauuucuuucaguucugcucugaucuuaguuauuucuugccuucugcuagcuuuuggauguguuugcucuugcuucucuaguucuuuuaauugugauguuagggugucaauuuuagaucuuuccuucuuucucuuguuggcauuuagugcaauaaauuucccuccagacacugcuuuaaaugugucccagagguucuuguauguggugucuuuguucucauugguuucaaagaacaucuuuauuucucccuucauuucgugauguacccaguagucauucaggagcaggguguucaguuuccauguaguugagugguuuugagugaguuucuuaauccugaguucuaguuugauugcacuguggucugagagacaguuuguuauaauuucuguucuuuuacauuugcugaggagugcuuuacuuccaacuauguggucaauuucggaauaagugcaguguggugcugagaagaguguauauucuguugauuugggguggagaguucuguagaugucuauuaggucugcuuggugcagagcugaguucaauuccugaauauccuuguuaacuuucugucuuguugaucugucuaacauugacagugggguguuaaagucucccauuauuauugugugggagucuaagucucuuuguaagucucuaaggacuugcuuuaugaaucugggugcuccuguauuggguauauaaauauuuaggauaguuagcucuucuuguugaauugaucccuuuaccauuauguaauggccuuccuugucucuuuuguucuuuguugguuuaaagucuguuuuaucagagacuaggauugcaaccccugcuuuuuuuuuguuuuccauuugcuugguagaucuuccuccaucccuuuauuuugagccuaugugugucucugcacgugagaugggucuccugaauacagcacacugauggaucuugacucuuuauccaauuugccagucuguguccuuuaauuggagcauuuagcccauuuacauuaaagguuaauauuguuaugugugaauuugauccugucauuaugauguuagcugguuauuuugcucauuaguugaugcgguuucuuccuagccucgauggucuuuacaauuuggcauguuuuugcaguggcugguaccaguuguuccuuuccauguuuagugcuuccuucaggagcucuuuuagggcaggccugguggugacaaaaucucucagcauuuguuuguuuguaaaggauuuuauuuccccuucacuuaugaagcuuaguuuggcugaauaugaaauucuggguugaaaauucuuuucuuuaacaauguuggauauuggcucccacucucuucuggcuuuuagaguuucugccgagagauacacuguuagucugaugggcuucccuuuguggguaacccaacuuuucucucuggcugcccuuaacauuuuuuccuucauuucagcuuuggugaaucugacaauuaugugucuuggaguugcucuucucaaggaguaucuuuguggcguucucuguauuucuugaauuugaauguuggccugccuugcuagguuggggaaguucuggauaauauccugcaguguguuuuccaacuugguuccauucuccccgucauuuucggguacaccagucagacauagauuuggucuuuucacauagucccauauuucuuggaggcuuuguuuguuucuuuuuacucuuuuuucucuaaacuucucuucucacuucauuucauucauuugagcuucaaucacugauacccuuuuuuccacuugaucaaaucggcuacugaagcuugugcaugcgucacguaguucucgugccaugguuuucagcuccaucaggucauuuaaggucuucuuuacacuguuuauucuaguuagccguucgucuaaucuuuuuucaagguuuuuagcuucuuugcaauggguucgaacauccuccuuuagcucggagaaguuuguuacuaccaaucaucugaagccuucucucaacucguuaaagucauucuccauccagcuuuguucuguugcuggcgaggaggugcauuucuuuggaggagaagaggugcucugauuuuuagaauuuucagcuuuucugcucugguuucuccccaccuuugugguuuuuaucuaccuuuggucuuugaugauggugacguacagaugggguuuugguguggauguccuuucuguuuguuaguuuuccuucuaacagucaggacucucagcugcaggucuguuggaguuugcuggagguccacuucagacccuguuugccuggguaucaccagcggaggcugcagaacagcaaauauuacagaauggcaaauguugcugccugauccuuccucuggaagcuucgucucagaggggcacccagcuguaugagguuucagucagccccuacugggagguaccucccaguuaggcuacucgguggucagggacccacuuaaggaggcagacuguacguuugcagaucucacacuccgugcugggagcaccacuacucucuucaaagcugucagacagggacguguaagucugcagaaguugcugcugccuuuuguucagcugugcccuacccccagagguggagucuacagaggcaggcaggcuuccuugagcugcagugggcuccaccagguucgagcuucccagccguugugcuuaccuacucaagccucagcaguggcugaugccccucccccagccuugcugccgccuugcaguuugaucucagacugcuguccuugcagugagcaagacuucgugggugugggacccuccgagccaggcacgggauauagucuccuggugugcuguuugcuaaggccauuggaaaagcgcaguguuagggugagaguguccugauuuuccagguaccaucugucacggcuucccuuggcuaggaaagggaauucccugacccuuugcacuucccggaugaggcgaugccccacccugcucugugggcugcacucacugugugacaagccccauugagaugaaccugguaccucaguuggcaaugcagaaauccccugucuucugcaucacucaggcugggagcuguagacuggagcuguuccuauauuuggccauuuuggaacuuccauccugacaaugggcuaauauccagaaucuacaaagaucuuaaacaaauuuacaagaaaacaucaaacaaccccaucaaaaaguaggcaaaggauaugaacagacacuucucaaaagaagacauuugugcagccaacagacacaugaaaaaaugcucaucaucacuggucaucagagaaaugcaaaucgaaaccacaaugagauaccaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauaugacccagccaucccauuacuggguauauacccaaaggauuauaaaucaugcugcuauaaagacacaugcacacauauguuuauuuuggcaugauucacaauagcaaagaguuggaaccaacccaaaugucccaucaaugauagacuggauuaagaaacuguggcacauauacaccauggaauacuaugcagccauaaaaaaggaugaguucaucacauguucucacucauaggugcgaauuaaacaaugagaacacuuggacacaggguggggaacaucauacaccggggccugucauggguugggggcgggggggaagggauagcauuaggagauauaccuaauguaaaugaugaguuaacgggugcagcacaccaacauggcacauguauacauauguaacaaaccugcacguugugcacauuuacccuagaacuuaaaguauaauuaaaaaauuaaaauaaauuaauaaaaaaaucuuaacuguuggggaugaaggauaagaaauaauucuucaugaacuacagagugugguuaagaccaguauuauuagccaaaaagaaaguuagauuuuauacauuagcucucuucuauuaaacaugauaaucagacugaaauauugaagaguuuacuugaauuuucuuaguugugggggauaaaacaaugauguuuuacauuuuaaaaaauuagagguauuacacuuuucaaaucuuuguuuuuguauaccugggaggcauuuuuuuguguguuugugauguuucuuauuugcauuauuacagaugcauugauuguauauuauuuugugaaguuauuuuauuucuauguugcauuuuucuuauuaaaauuauacaaucuuucagaugaacaggaaggacagugucuguaaucucuccucaccgccaucugcaguagucguacaaaggugauguuuuaugugaguaagaauuucuguguuucauuucacagguggggagcauuaagcgggaaaugaccuucacauuucagucagaggacuuaaaacgugacugugguaaaaaaaugucucaucaacacguguuuuccuuggccauggaggaagaugugaaaacagcagacaccaaaaaagccagccggauccuugaccaugaaaaagaaaacacucgcuccaucugucuccuugagcaaaaaagaaaaguuguuuccuccaacauugauguuccuccagcaagguaagggaacauuaaaucucacaugugucugccccaggaaguugguggagagcaugcauaaucucugccaguguacagacucucuucaguauauagacauaugaaagguuuucugccaagaaauuuuuucuauugcuugugugaaauagagcagguggccuuacucuucauaacugacuuugaggcugcuguaguuggaacuauuguagcucuagaaaagaaauguuuuauucaauuuuaauaaaugaauaauaaagagcaaaggaauaaaugcaaaaaauuaggaugaaacaucauauagaggacugagcauacauuaaguaggacuguagccacuucaaagcaaguguacacagaucuuuggucagagguugguaaacuauggcugcaggccaaauucagccccugaucuguuuuucuguggccuguaacauaagaaugguuuuacuuuuuuuuuuuuuccaaauagagauagggucugguucugucgcucaagcuggagugcagugacgcaaagguagcucacugcggccuugaacuucugggcacaagcaguccuccugccucaggcucuagaguagcuggcugggacuacaggcauaugcagccaugcccagcuaauuauuuuuauuuuuuguagagauggugucucacuguguuacccaggcaggucucaaacuccugagcucaagcgauucucccaccuucagccucccaaaguccugagauuacaggcaugaguuacugugccuggccugccuuuuuaacggcuuaaaagaaaugaagaauaggcgacacagagcacagguggucuguaaagucuaaaauauguaaaagaaaaaaaaagaaaaaaguuggugaugccugguuuauaucuugauaaucuuuguaugauagaucuacuuuaaaacucaaccaagaggguuuaucugaaauaucaaaaagccuuugucuuucuaaaaacaaguaaaaaaaaaggccuuugucacauuauaauuuuauuuaaaccacacccaauagcacugaaccaaaggacaauauucuggcagaaugacaguggcagugguggcacauacauauuagaccuuuuacuuucuugcauaucauuugucucaccuagaaaacaagcuccacgucagcagggauuuuagauuacucuguucaugcuuuaucccuagcccuggaacagugcuuaauuauguucuggggacucaugaauauuugucagaugaaaaaaagaaagaaaaugcuguagcaugagagauugcuuauuuguaauaugggugccacauuuuguugccaaaaaucauuuauaauggaacuuagagcuuauagcaauuguuugagaaguccugcauuuguccaagugguuucuaacaguuaaccaggaaaacaguaccuuuggaagaggaauaaaugugccuuuccugccuguucacguuuuguaauuaacguuucauuucuuucuauauuaaaucaaaaguaucuucucuagaaaauuauuauuuucucccauugccagauuugucagacuuucuaaaauuauaggccucuuaguuuucuuuaaccuuuaauugaaaauuuucacguauucauuacuucuguuuaacuacuuggaauuauuugcuuuucuaauguuuuucguauaaauacauguuaaguuauuuaggauuauuuccuucuacuguggcaugguugugaaacauuuuaucauacccugacccucauaggcaucucaauuuguauuuguuguuugguugucucauaggaaacugacauguuaacaauuugaaaugugaagaacugugcuuuuuuuuuuuuuuccuaagucuguagggcaaaaguuagacuucuagugucaguuuaauaccaacuugcaauucuauaggacuuauucuacauaaaauuuccauuagaccauuguauauguuaaaagaccuggaauuaaucauuuuaaauugccauagguuguuuuaaguauaccuuuauucuuuaauuccaccucacuuggagcacuugcuggggaaaauaaugaaaagaggaagaagaaagauguuuucugccuuuucugacucugguauguaggauauuuuccaccuuuuaugguucacugaauguacuuaaaaguacaugaucccacgccaguguuauugugagguucuuaaacagugugggaaaguuaauuagguuuuaaauccauuaaugcacagcaaaaaucccccaaugacaagauauaauuuagauguauuaaucuauuaugggaaauacuacuuaaggcuucauuguuugggguaucuacuaauauacuuguuuucauugcuauaguaggaauuuaaucaucauaaauacagugugccagcaguuggugagauaaguugcuuuuaaaaaaaaugaugaugagggaaucaagcauuguggauuauaaugaucaaacucucaaacucuauuuccauuuacugcuaccaaguuuaauaaaugucggacuucccacugucaccuaaguauaucaauauuuuguuuuaaagaaacuucuuuaccugauacaguaggaagauguaggauuuuccuuuuguuuacuaagaagaaauauaucuguugacagguauaaauaaugaacuuugaguaaaucuagaguauagugaaauuuaucaauacaaggaaaucuauauacaauuggcccuguguauccauggguucugcaccuguggguucaaccaaccacugacugaaaauaucuggaaaaaaauugucuauaccaaacauguacagauacauuuucuugucuuuauuuccuaaacaauacaguauaacaacuauuuacauaguguuuacauuguauuagauauuauaaguaauccagagcugcuuuaaaguauaccagaggaugugcuagguuauauuuaaauacuauggcauuuuauauaagagacuugagcaucugcugauuuugugucuauagggaggccuggaaccaacccccauggguacugaggaauaucuguauccauaucuuauaaaauauauaauaaauguuuaaaaauauauauaugauauuuuggccaaaaagcaggauaaucauuuuaggcccauagaaugcagaguucuucaaucauuuaaaaucaguucccuguaacguuucucacuuuaucuuuugcuuauucucauuaaagcuaagauuuuuguugaacuuuacuuucucugguuuguaaaaugaaacucaaaguuuauuuucugagguuuauauaauaaaagcaauacauguauuucaaucgcuuauuucauguaacuagagagaucugggaaccccuucccaccuuacucucuaccucacuguaguuucagaucuccugccuccauucaacagguuuuucuugaguaccugcuacaaacccaguacucaguaaaaaugaugagugaggugccagccuuccuggagguuacgguggaaugagagggacagacacauauguagcuaauuuuaaauaacaguuccugauuugcucccuucccauuaggacuggggguaaauuuguaauuaaaggaaaaucuuuuaguuuuaaggaaguuauuaauuugaaacaucuauuuaaaagcccaauuuuuuuauugauaucuuuuucaagauagggacaauugaaauagagaaggaagagcucaguaucaauacaaacucccuguuuguuuacccaauauuugagaaccaauuuuaaaguugcuaguuucagaaaaauauaaauuuaaguaaguuauuaauccagauguguuaggcugggucauuggagaagcaaaugccaagacaggauuaaacaugcaaacguuuuaguaagagaaacaccugagagagaaaugggacaggaggggcaaggacaggagggagaugcaugucaguuuagggugcuagucugagcgcagugauggagagagggcaggaaaguuggagggaagugucccagguagcugggcaaggcccucaggaguccugcauugguaauccugcuguacuccaucauuugcugggagcagcaugugggagcuguggccuuggcgcaaaugcagcagaugguuucagcggccagcagcugggcccuuccuuggucaguuagcucccuguuauuggagaucuguaaggugcguacucaugguugccuuccucccaccccacaauauuguacuuuauauauuaaaagugcccuaggcugugcgggcuugagacaggggccagucucccugcccuuugaguuaccagugcagacuaccuggaaucuucauuguuuaagagggcccuaagcuuccugugaaaaaauggcaacugauuguuuggcccuaggauccuaaaauuaauucuuuaauuaauuaauugagucaugagaggacagaauacaaacuaccucucuucugaguuucuugggguugguaggaacaaucuuuacuguaggagagucugcuuaccccugggauauugcuugauugauuucaagggaaaagcacuacuuucuuuuuugagcgugauuuggaguaagugcauuauagaguuggguacccaaaguauucuucaaauuauucaacuuuccucaggagagauaacuacacagaaagagagggcaagaguaugugagagcacaugagcaagcacuguuucucuuuagaauuaaagauuuaucauuaacagaaagaaaauuaauuccuagcuuuuaggaucauuggagagcaguaauuggguuggggguaacaaguacuaaaagugucgaugcuaauuguugggauagcaaucacucaagggcugaucucucucugagagagaugaaaauacuaguuucauugaucccuauggagaguugaggaaaauaggcuucaagaguuuaaggacaggaaaagagagcauguuugaaagguucauccaugugauagcaugugucaguacuucauucauuugccaaaauauuuuauuucauagacauaccacauuuuguuuauccacucaucaguuaauagacauucgaguuuggaaaagaaggcuggccagaucauguugagcuauacugauugugugaaggauguuuaaauuccauuuuuaugucacugagaaggauuuuguggaagagaauaugguuucauucaucucaguggaagaucacuuuagguguuauguguagaauggaucagaggaggacaagaaucgacaaaggaagaccaaucaggaagccaccacauuaguacaggaaagaaauuaugguaguuuagacaagagugacaguugagaucaagagaaguguacagaccagaccuugagguagaagugaggcuucuugguuguaagaacagacagugacucuggcugauuuaacaaagagugaaauuuuuugaaagaccaucaagguagcucacagaguugcugggaaggcuggggaaccaggucagaaaauggacaggagggugaacagcuagaaacauaguuauguucauucacucuacagaaccagugcuugcaacugggcuuuuuggcuucuaaagugagagacaucugugcuaggaaguucuccagacacagaagcaaauucagccaugaggcuuccaaaaaauugacaaaugucuauuaucauuagauuucuuaacuuccauuuugcaaaugaguaaacagauucagaaaguuaagugacucacccagaaacacauauuucaccaaugacagaccuaagacugggauagguuucugaucucaagugaauuuuuguuccuuaucaucaccauuuguguuuauuggagaccauuaacuuauugucauuuacaaauguaaugcucaaaauauauugauaagucaauuauuacuuauuguccagccucuaaaauaauucaacaguuaagcauuguuagauaaccuagaucauuagagccugacauuuguuauucuguuuuugccagacaucaugguuuugaagguacugaugcuuaaauucguuggauuucacccaaacaucaauuacaauuugauuaugcaaaguaguaacugucuucuaauuauaacucuaaagcuagagaaauguauuagcaaaccaguuauaacaaagaaaaaaggaaaauuuggccagaaguauucuuagaccuaacagcaguuuauuagaauaguacagauuguuaguuugugguuggaagaaaacaaaccauaugguacuauuuguuuuucaggguuuuaaaauacagugaugucauauuuaucacuugcugaauaaaaugaaaucaucuucuccuuauagcgugccauucugggaauuauauaguuuaaaagaacuucagaaacacauugaccuuugaguucaaaguuaggaaaugaucugagcuacaagcaaaauccuauaaauacgaugggaaacugugaacuaauuuggcucccauuuucaaugguagugucuacauuuucuccuuucuuuuauguacuuuagacaguuuaucggaaagucgcccaugucaaauuuguaauuaagugagauaagacaaaaaugguaucuuuuauuuuugaaucucuagaagccuagcaguuccuggaacaaauguuuaauguuuaaauguguuaaaaacuuuucaggucacaaacucuguaaccaguaugagacuacugaaaaaaagaaaaaaggucacuuuaccauuuuaaaauauuucuuuuuaaaaaauagagcauugaaauuuuagaacauuucuuuuuaaaaaauagauuuugaggggaauauaaauguacucacucauguuagagaaauacugguacuguauaauugguggacuccccuuaagaacugaagcaauacccauaaaguagcuauaaagaacaucuuuuccaagaaacuuuuauccauuuaucucuucccaucauuucaguaauucagggcagcaaauaacuguugucucugguuucuugcuacagucuauuugcuacacauuugccaaaauguucuuucuaaaacucaaguauagucauggagaugggggaugcagacagggaaaugguaggaaccaguauaauugacauuaugacuuaaugcagcacauugugccaucaguacacagucaagccccaucuugcugaggauuuagauucucacaucaacacacaaaucaaauacagacaaaauuguucuuuuuaauguccuccguuaccuguaagaacagaacucaguuugaaagacuugggaucugaaaccacuugaaaaagaagcaauucugucucccuucuuacucuggggcaaaauuucauugaauggaacgguggaaugguagguuuuuguuuguuguuuuuaaaaauagcccucucuuccugccaagugccuguagaugaauuucuguaaucuaaaugcacauaugcugccacuucacucuccuaauguucuauaaaaaugggaaggaagguaguaagguaagaugagaacuuuuuccagcaguucucuuucuuguacuaacccuaguaacauugauguuaucucaauuuucuuuucuuuucuuuuuuuuugagacagagucuugcucuauugcccaggcuggagugcaguggcaccaucucugcucacugcaagcucugccuucuggguucacgccauucuucugcuucagccuccugaguagcugggacuacaggcgcccaccaccacgccuggcuaauuuuuuuguauuuuuaguagagacgggguuucaccguguuaagacagcauggucucgaucuccugaccucaugaucugcccgccucggccucccaaagugcugggauuacaggcaugagccaccgcgcccggccucucaauuuucuuaauuauagcuuaggcaagcuuguuuuaugacacaaauuuggcccauguaguauguguguguauguauguguguguuuuaaagagaauuuaguacucuucuucuuuugguugauguuaaaaaugacauucaaaauucauaauuuuuuguguacuauaaguucuuuauuauaagcacacauuagugcuagauuauaaugugucaccuguuuagaauggcauugugaauuuagaauucugaucauaaauaugaauuuuuaaaauaauaauuuaugucacugccauuaaugaagguuaugcucucuguaucaacaaagcuugggcauuuucaaguaucacuuccaaagaguccuuggauaauuaguaaauguccuucuuuguaaaucaucauuggcagcaaaauggagaaaaguuaaaacugaaacuucagguggaccgguagcacugucguacaagguggaccauuggcuuuguugcacagauuggauauaugagaauguucuaaaauguuuaggaguaccauuauaccacuuuugugaugcccgugccguagguugccucugcagaauugguuuacauuuagaugugaugcagcaucuuuuuuccucccuauauccacucaaaauguaaauaaucaagaaauagaaauaaugagauucuuaaaacucuucaucuccccuugucauuauagauucuguacucugcuuuuauuauagaaaggcaaguaauaaccaagauauuggucauuuguuuaucuaaaaaggauaacauucaagcaaaacuguccaauagaaauuuaaugugaacuauaucuauaguauaaaaauuuaugguauaauagcuacauuaaaaauaggaaaaagagacagugauugagguacauugaacuccauagagacagugccagagaaaaugagagccagaagggcacugggugacucuugccuugcugaggaaaaauaacuaaacaggagcaaaggagauccuaagaagccuagaggcaaaauccuaagacgccaagaggcaaaaagucauuguaugcauucuuugcgcaaacuuguugggagaaaaggaagcagcgcccagaugcucccaucaacuucucagaguuuucuaagagacaugcacccaggagaccucuuucgaccuuucuucuguuccguucuaaguuucacccuaaaaucaaaguagaacaugcuggccuauccauugaugauguugcgaaaaaacugggagagaugugguaugacacugcugcagaugacaagcagccuuaagaaaagaaggcugcaaagcugcagaaaaaauacccaaagaauauugcugcauuucaaacuaaaaggaaagccugaugcuuucaaaaaagggagucaucaaggccaaaaaaaagcaagaaaauaaagaggaggaagauaaagaggaggaggaggaagaugaagaagacaauuaugauggauaaauugguucuauugcaguuuuuuucuugucuauaaagcagcuguccccggccuuuuuggcaccagggaccaguuucauggcagacaguuuuuccauggugggugggguaugguuucaggaugauucaagugcauuacauuuaucauuugauuauuauaaggagugugcaaacuagacaccucacaugcgcaguucacaauaggguucacgugccuuugagaaucuaaugccaccacugaucugacaggaggcagaacucaggugguaaugcuuacuugcccacugcagcucaccuucugcuuugcagcccaguuccuaacaggccauagacucuuggguugggggugacugaggaccccugcuauaaagcauuaagccccuuguacacaauucacuccuuuuaaagaaaaaaauugaaauguaaggcugcguaagauuuguuuuuaaacuguacagugccuuuuuuuguauaguuaacacacuaccacauaugucuuuagauagcccuguccuagugguauuuucgauagccacuaacugugccugguacaguaugaggguuauaaauuggcauggaaauuuaaagcagguucuuuuuggugcacagcacaaaugaguuauauauggggaugguaguuauuucaucuucaguuaucucugcugcagguuauaugaaauaauuguuuugucaacugaauaccauucuagucaccaaaaaaaaagguauagcucuuuuguugacauucugaaugcuucuaaguaaauacaauuuuuauuaaaaaauaggaaaaagaaacaggcaaaaauaauuuuaauaacucauauuauuuaacccaauguaucuuaaauaucauuauuugaacauaugucaauauaaaaagucauuaaugagacacuuuccauucuuuuuuuuugcaugcucaaucuuaaaaaucugcuguauauuuuauagcacaucucaguuuggacaaggcacauuucaagugaucuauagccacacauggcuagugaugacuguauugaacagugcagcuuuagaauaaagcauaaguuaauuuugcauuucaguccaacaucucauuuaucccaaaggcagugguuggucucuugcucucccucuuuuccuacucuaacacacaggaagaaaaugccucacucacacugcuagggguggaacauagcuuucuauggcaguguuuguugaggguugggguggcggggaggagcauccacgguaaggagggaagcguuucaucaacugugggccaggcaguauuuagcuggacuaguuggaacuaaauagauuaguuagaaaucugcagcaugauuccuguauguccccugaagggaaaugacucccaguugugcauaacugauguuuaguacaauuauaauuauugugaagauguuuaaauuccaucuaaaucaaaggaagguuaaauggguauuaccacaguucugguccuuuaaaaacaaagcaggcuucauuuccagaguuugagagagccucuuuaguuguuaccagauacucugacauuccucaugguagcuacuauuagagcaguucaaacauaccaaguaaacauacuguaggcuuggaccacaguuaucacacugaaugcauuuguucauacuuuuuuaauauuguuaaaaaaaagcucauuaauacauacugcuuauaaacuaggaagugcaacaaauaugucaaauauguauuuuaaagacuucuaaguacaaaggauuuauuuuguuacuugcuuaaacuguuauugauucuccuuuuaaauguuaaccuuuuuucucucuccuauaaauagaguucuggguggagaaaugauaagggauaaagcuggagagucaggcuuaacuuggaauacuuuuagaauuugauuuuuaucuguuaggugauggagagcuguucaggugauaccguaagauuggcauuucaaaaaugucaccugguacccugugggcaugaggagcuagggaguguauacaaguguugacacugaaagcagaaagaauaauuaagaggcagauguagaaaucugaaagaaguaauugugaaaccuuuggccaguacaaaagcaacagagaagagggcuguguucaagaggccauggugaggauaaagcugguagggagcauaguaaggaugaaggguacucaggauggugucacaaaugcuggcuugggcagcugcauggaaaaaaugguuggugaugccaauaaaaaaaauaagaauucaggaguaauacaaaagaaaguagauaugaguggagggaaaucagaaguuuguucuaagacaucuugaauuuaagaucccuuuaacaaagaccugcauacuuugagcaaaaaucaaaugaacaauaaauauauuuguaaagaaugguauguagacuuagucaaaccauagucguguuguaaauaaauguacuagaagugcuugcuauuuuaucguauuuuguuuuaauauauguaacuacuucucuacaucuugauuuucauacacuggcauuucucaaggcgagcuuugcuuguacagcuuaauuccuaaaugaugaaaagcuuuuguugcucucuccugcuaaggguuuguuuuggcuggauuuggcaaacacucacuucuucaaggaagcucacgaacucugcuuucuuaacccccaaaauaguauucaucucauaauagauuugcguaacguugcugcccuuuucuaagaguaacaucuuacaaggucaucugcuauuuuugcauccaauuugcuaucacauauuuuuuuaaagugaaguguggcuuuugucugcaggaugugagaguuuuguuuuguuuuugaaaugaagucucacucacuuuuguugcccaggcuggagugcaguggcacgaucucagcuuacuucaaccuccacuucccagguucaagcgauucuccugcuucagccuccugaguagcugggacugcagguguaugccaccacgccuggcuaacuuuuguguuuguaguaggacaggguuucaccguguuggccaaguuggucuagaacuccugaccucaagugaucugcccacguuggccucccaaagugcugggauuacagaugucaggcaccgcacccagcuggaugcaagguuuuaucaaaucuuuguagaaacuguauuuuuguucuucgggauugauuauuccaggauaacccuaaucguuaaugacacuuggaugugauuagacuuuaccaaauucaucaaaggcuacugaauaaaacagaaaacuaucuugaacacuggugacugugaacuguuuuuggaggaacuguucuuucuaaccacaguugauaaauacauuaugugguuuucaaaauaucaccucaauuauuugcacaugcaauguaauuuugcaaauacuaagcagguagcuagucuuaaugauuguaucaaacgaucacguugaaagugccagacagcugcaccacauuuguaaggagggaccaugaggagcauagaauuguagccucuguugggcuucuuaaccauaauagaaugcaucaccucccauuaaagcuauauuuaagaauuguguucuccuucauguuuauuuuuccggacuaacaaguuucucuuuugacucauuccuaacaaacaguguagucauauuuuccacauauccacaaauaaaguuacaacuugaaaauuaacauuuggaguugauguugcuacaaaccuaaaaagagaugcacuuugugauucaccaccaauguguuaagccucaaauccaucuucacauucaauuaauaacucccuuucuuuguaggcaauuuaaacaaaguauaguaagaucuacaacugaaaaaaacaaucuuucuaccuucaguugcagauaauuuggggaggaauauaauuucaaagaacaagagaguucuuggaaaguguguuuccacaucggagguaaaauaguuuaguaagucaaacugguaguuaggagggaggaauuguggaguucugcugcuccuugaucuuaaggaagucuuuggacuuaccccaugugugcacaggccaggaaccuccuguaccucugacacacaggaacuagccuuguagccaaagaguuuccuuucuccccacacuguuuguccgaagcugguggaauaaccuguuucucuuuuagaguagauaagaucaggcugaauagagaaaaccaagaauguuugggauuucacugccuccuucaaaacuagaaagaugcuuaacagucugcuaagguuaaaacgagguaaaagcccauuuuguuuuaaaaauauuuaaccuauguuuaacaaguguucauuugugauauuacuuauuaaauuguuaauacuuuuauaacugcaguaacagauuauaaaaaggcaggucauuuucucucaguggaucagacaauaguauacuacauauacauauacaaauaugaauauaaauauauacauuuacauuuuuauacuuuuuuaaaugcaaacaaaagaaauagauuaagcagagcugacauauucauaagcuaaacgagcgcauauauugaacacuuuuuuucuguaaauauugguucacuguuaacuuuuuuuuggggggggucaauuagaaauguuuauuggguacccacuuagaaguaauaguugugguaugcugucccaaggcuuauguucuaaagaauucaguaagcuuuuuuuccucauuauuuaaaaacaccuuuucacuggguaagaaucugaugaaauggcuucuuagccauuagcauuggcugggggcuuccugccucacacaauggcagacucuacucagcagugacaagcagcagccccuggacccgccugcauguggcacccagaggcagguuuaucuccuacccucugggcaagcaagagaccaguaaggaacaggcuuccauagcuuguuauugaugugcaugauguuucaggguucagaauugucuauauugagucacuccuucuauugccauccuuguaaauaaaggaagacauuauuacaauggaauuauggugcuguauucccuauggaaucauacccagcugagcugagugagucugauauuggcuuucuuugaucucaaaaaugaaaccacacuaguuugcaagguugcuccugcauauguagcaaaacaguagacuuucugcuuuggucauuccagcagugugugggaaaaccaugcaaaaaugaaaagucauuucuuuguguauauaugguaucagcuggaggacaguauggcccuauauugcaguugucacaguuaaaagugacccaguggcugaggccuuugccaugaaggaugcugcucuguuuggugucagccuuuucuuuaaccaguccuagucagaaucaggcagaauucccugcauuugcaaggcugugucuguggcauggcacagcucccacucuugguugugguauuuuguauccauguuguugaagcuccauuugguccuguucagaagagugagccuucauggaaaaaaggaaccuuuuuccaagaagagaaauuaaaaacugaguuauucugagccuguagcagaaacucugauguucaaauauguuuguugcuucuucauuucccagacucugaguaauauaauuacaugaauucggauuguccacauaaagaaaaaaacacaaaccuuuucaucuucugucuaccuaggcuggaaaugaaaugggauauuuaguccagauaauagcuguaaaacauaccaggcaucccauuguauauguugugagcaguguugacugugauggucauuacgugaugccaaggucagguuuuagaucucacggagcaaaaagaauuuugagcaucuugaacaucaucugcuccaucccccuuauuugaaagaugggaaaauugguuuuuuaaaaaaauuaagacuuuggguuugaauaauggacuuaauacauuuucaaagcugauuuuucaaacuuuaccacauuuucauuuaugaggcagcacuuaagauucaucaugcacgacuuucugugcugaugugcuaauagucuuccuucuuguuugagaagaagagaugcuacuuucugcuccauccuaugaaacacaccaccugcuucaccaagcuggaaugugguauuuuuccacugaggaguacgcuuguuuuugcaggcagaacacagcagugcuguuugaagacacugaugauggcaaaggaucaaaggugggaggcgauggcagguggcagcuuagggagagaucaaugcaaccaguguggugcauugcugucugcagacguacaggagccaagugagaauccuagggugagggaggacaauuaaaaaucaaagucaggcauauuuucauguaaaucugaccaugcuaggaaauaacagggcacuuuuaccauaaucagaauuaugaucaaucuuggaaaaugugaugcuuaauuugauagguagaacaccaaaccauuuaucuuuguuucuuauuccugugccuuuuggacacuaaaagcaaaugaacaaauuuuguuaaaauucaugagaaagaaaaaaaguaaaaauccuacagugaaaaaaagauaucuaguuuuguauguucauuccuugacuuucagggacuuucuacauuucucuuagguaagugaaauuauucccaaguaauguuuccuguuaucuaagaaaagauguuagcucaaggcugggucccccauaauuccagaauugauaaggcaguugauggcuauagugacuugucaccaaagacccuggaauugaguagguauggauuccagguugugugcuugggaauaugaugcaguaucuuaccaaaaaacaggaauuuucuugcuccaguuuguucuccauguuccccagagcuacagcaucacaagcuagaagugcuagggaaaagcaggggaugacuacuuaaaaggcaauaauaauuuuguuaagugacgagauggguccccaagcuugaaacuugcacaacagucaacuaauuggccuguugaugaaagguaagguuuuauguaccuaguccuugccuacuucagggguaagauauuuaauuuuuacaguuugauaaugacauuuauaguuacauuugaguagcauucuaaaaggaagaguaauaaacccuaguagucacuaccauuugucugcaaugaugauuagaaauaaggaauuaauagaaaaaucaaguaguauaccacaggucccucaccccaccaaucuaugaugaaauuuucagccagaugaacagcuuugcauuuuugguguuaaaauggcuuuuuuuuucuucaacuucuauuuuaaguucagggguacaugugcaggauguacaaguuuguuacagagguaaacaugugccauggugguuugcugcacagaucauaccaucaccuagauauuaagcccaguauccauuaacuauucuuccugaugcucuuccuccucccaccucccacucugacaggccccaauguguguuuuuccccaccauguguccauguguucucauccuucagcucccacuuauaagugagaacacgauguggugucugguuuucuguuccugcauuaguuugcugaggauaauggcuuccaccuccauccaugucccugcaaaggacauaaucucauucauuuucauggcugcauaguauuccaugguauauauguaucacauuuucuuuauucagucuauaauugaugggcauuuagguugauuucacgucuuugcuauugugaauagugcuucagugaacauaugcaugcaugugucuuuauaauagaauaacuuauauucccuugaguauauacccaguaaugggauugcuggguuaaaugguaugucugcuucuaggucugugaggaauugccauacugucuuccaccaugguuuaacuaauuuacacucccaacaguguaaaagcauuccuuuuucucugcaaccucaccagcaucuauuguucuuuaacuuuuuaauagccauucugaaugguguaagaugguaucucauuauggauuugauuugcauuucucuaaugaucagugauguugagguuuuuuuucauauguuuguuggccacauggaugucuucuuuugagaggugucuuuucauguucuuuccccacuuuuuaauggauuuuuuuguuucuucuaaauuuacuugagcuccuuguaaacuggauauuagaccuuugucagauggauagauggcaaaaaauuuucuccuauucuguagguuguguguucacucugaugauaguuucuuuugcuguacagaagcucuuuaguuuaauuagaucccauuugucaauuuuugcuuguguucugauugcuuuugguguuuucgccaugaagucuuugccugugccuauguccugaauguuauugccuagauuuucuucuagugauuuuguaauuuuggcuuuacauuuaagucuuuaauccaucuugaauuaauuuuuguauaugguguaaggaagggguccaguuuuaauauucugcauauggcuagccaguucucccagcaccauuuauuaaauaggaaauucuuuccccauugcuuguuuuugucaaguaugucaaagaucagaugguuguaggugugcagucuuauuccugaguucucuauucuguuccacuggucuauguaucuguucuuguaccaguaccaugcuguuuugguuacuguagccuugagguauaguuugaagauggguaguguaaugccuccagcuuuguucauuuuacuuaggacugucuuggcuauuugggcuuuuuuaauccauaugaaauuuaaaauaguuuuuucuaauucugugaagaaugucaaugguaguuuaaagggaacaggauugaaucuagaaauuacucugggcaguaugaccauuuuaaugauacggauucuuccuauccaugagcauggaauguuuuuccauuuguuuaguguccucugaugcuuugagcaguaguuuguauuucuccuugaagaguucucacuucccuuguuagcuguauuccuagguauuuuauuuuuuuguagcaauugugaaugagaguucauucaugauuuggcucucugcuuaccuguuguuacuauauaggaaugcuagugauuuuugcacguugauuuuuuuuuaucuugagacuuugcugaaguugcuuauuggcuugagaagcuuuugggcugagacgaugggauuuucuagauauaggaucuugucaucuguaaacaaagauaauuugacuuccucucuuccuauuugaauaccuuuauuucauucuuuugccugauugcccuggucauaacuuccaauaccguguugaacaggaguaaugagagggggcauacuugucuuguguugguuuucaaggggaugcuuccagcuuuugcccauucaguaugauauuggcuguggguuugucauauauggcucguauuauuuugagguauguuccuucaguaucuaguuuauugagaguuuuuaacaugaagugaucuugaauuuuaucaaaggccuuuucugcaucuauugagauaauuuuguguuuuuugucuuuaguuuuguuuaugugaugaaucacauuuauugguuuguguaugucgaaccgaccuugcauccugcagaugcagccaacuugauugugguggauaagcuuucuguugugcugcuggauuccguuugccaguauuuuauugaggaucuuugcauugauguucaucaagaauauuggcuugaaguuuuguuuuuguuuuuguuguaucucugccagguuuugauaucaggaugaugcuggccucauagaaugaguuagggaggagucccuccuuuucaguuuuuuggaauaguuucaguagaaauaguaccagcucuucuuuguaccucugguagaauucaucugugaaaccgucugguccugggcuuuuuuuuuuuuuuuuuuugguugguaggcguuuauuacugccucaauuucagaauuguuauuggucuauucagggauucuguuucuuccugguuccaucuugggaggguguauauguccaggaauuuauccauuucuuuuagauuuucuaguuuaugugcauagagguguuuauggucuucucugaugguuguuuauguuucuguggggucaguguugauaucccuguuaucauuucugauuguguuuauuugauuugucucuauuuucuucuuuauuagucuggccuggccaucuauccauuuuauuaguuuuuucaaaaaaccagcuccuggauucauuaauuuuuuaaggaguuuuuaauaucucuaucuccuucaguucaacucugaucuugguuauuucuugucuucugcuagcguugggguuuguuugcucuugguucucuaguucuuuuaguugcgacuuaguucuuuuagguuauuaauuugagaccuuucuagcuuuuugaugugggcauuuagugcuauaaauuucccccuuaacacugcuuuagcuacgucccagagauucugauguguugucucuuuguucucauuaguuucaaagaacuucuugauuucugccuuaauuucauuauuuaacuaacaguuauucaugaacagguuguucaauuuccauguaguugugugauuuugagugaguuucuuaaucuugaguucuaauuugauugugcuguggucugagagacugguaugauaucauuucuuuuccauuugcuguagaguguuuuuacuucugauuaugugaucaguuuuagaguaagugccuuguggucaugagaagaauguauauuuuguuguuuuguaguggagaguuuuguauauaucuaucaggaacacuugauccagagcugaguucaaguccugaauaucuuuguuaauuucugucuugaugaucugucuaauauugucagugggguguuaaagucucucacuauuauuuugugggagucuaagucucuuuguaggucucuaagaacuugcuuuaugaaucuggguucuccuguauugggugcauauauauuuaggauaguuaccucuucauguugaauccgaaugcuuuaccauuaccauuauggaaugcccuucuuugucuuuuuugagcuuuguugguuuaaaguguguuuugucaggaacuaggauugcaacaccugcuuuuuucuguguuccauuugcuugguacauuuuccuccaucccuuuauuuugagccuaugugugucuuuggccuugagaugggucucuugaacacagcauacugaugggucuuggcuccuuaucuagcuugccauucugugucuuuuaauugggguauuuagcccauuuaaguguaagguuaguauuguuauguauuaauuugauccuaucaucaugaugcuagcugguuguuuugcagaccuguuuaugugguugcuucauagugccacugaucuguguacuucaguguguuuuuguaguggcugguaacaguuuuuccucuucauauuuagugcuucccucagaagcucuugcaaggcaggccugguggugaugaauucccucagcauuugcuugucugaaaaggaucuuauuucuccuuugcuuaugaaguuuaauuuggccggaugugacauucuggguugaaaauuuuuucuuuaagaauuuuggguauuggcccucaaguucuucuggcuuguacgguuucugcugagagguccacuguuagucugaugggcuucccuuuguaggugaccuggccugacuguccuuaacauuuuuucuuugauuucgaccuuugaaaaucugaugauuuugugucuugggguuaaucuucucauggauuaucuuacugggguucucugcauuuccugaauuugaauguuggccugucuuucuaaguugggcaaguucuccuggaugauauccugaaguauguuuuccaacuugguuccauucuccccaucucuuucagauaccugaaucagucauagguucagucuccuuacauaaucccauauuucucagagguuuuguuuauucuuuuucguuauuuuuucucuguucuugucugccugucuuauuucagaaagaucaucuucaagcucugauauucuuuccucugcuuggucuauucugcucuugauacuuaugauugcauugugaaguucucauguuguuuucuucagcuccaucagacugguuauguuccucucuaaacuagcuauucuggcuaucagcuccuguauuguuuuuuuuaugacucuuagcuucuuugcauuggguuagacaugcuccuuuagcucggugaaguuuguuguuauuaccugcuuucugaagccuacuucugucaauucagccaucucagccucagcccaguucuuugccuuugcuggagagguguugcagucauuuggaggagaaaaggcagucuggcuuuuugaguuuucagcguuuuugcauugauucuuucucaucauugugggcgucucuaccuuugaucuuugagguugcugaccuuaaaaugggguuuuuguggggucuuuuuuguugaugucauugucauuguuguuuucuguuuguuuuucuuuuaacagucaagccacuguccuguaggauuacugugguuugcugggggucugcuccaaacccuagcugccucaguuuuuccuguaccuggagguaccaccaguggcuauuuugggcacuuguaucagucaaacucuuaaaaucccuucuaccuggacaaugaagaaacaucaggaugcaucauuaaguauuggcuagacucaagggaaauaagccuuuacuucagaguucaggucuaaaaauuaaaagagaaauucaauucaauuauaaaacaauuuaugacuuaauacuucagcauauugcaaaauaaauauugcauaauuauuccuuguaacuuuuuauauguauuauugucuagcauccuacaauuugaaauauuaacaguaauuuccaguuccuaugguuugaauguuuguucauuucaaaauucauguugaaacuuaauccccaagauggcaguuuugagaagugaggccuuuaagaggugaaugguuaauucuauuuauggaucaauggauuaauggguuaaugaauuaacaguuuaucacaggagugggacugauggcuuuauaaggagaggaagacagaccugaucuagcacacucagacucuuuugccaugucaugccaugagccacuuugggacucuguaaagaguucccaccagcaagaaagcccucaccagauacggccccuaaaccuuggacuucucagccuccauaacuguaagaaauaaauuccuuuucuuuauaaauuauucaguuucagguauucuguuuuaagcaacagaaaauggucuaagacagaaaaagguacugagagagggguguugcugauaucaaauuccugaaaauauggaagcagcuuuggaacugaguaaugagcagaggcuuggaagaauuucgaggagcaggcuagacaaagccuagauucuggugaaggcuuagaagacaagaagacuaggguaaguuuggaucuucuuagagacuggguaagugaucaugaccagaauucugauagaaauauggacaccagggccgggcaucguggcucacgccuauaaucccagcacuuugggaggccgagaugggcagaucaccugagguugagaguucgagaccagccugaccaacauggagaaacccugucucuacuaaaaauacaaaauuagcugggcgugguggcuagugccuguaauccuagcuacuugggaggcugaggcacgagaaucacuugaaccugggaggcggagguugcggugagcuaagauugugccaugguacuccagccugggcaacaagagcagaacuccaucucaaaaaaaaaaaaaauauggacacuaaaggccauuacaaugagguuucagauggaacugagaaacaagguauuggaaacauguguaaaggcccuucuuguuauaaacugacaacuuggcugcauuguguccaugucuaaggauauuauggaauguagaacuuaauacaccuacuguauauccacaaaaauuaaaaauuuuaaaaauuaaaaugaaaaaaagagcaaaaaaagauccaugaauuaggauaucuggcagaagaaauguugaagcaguaaaacauucaggcugcugcauggcuaccuuuaaccacuuacauuaagcugugagagggaaaaauugacuuaaaauggaauuuauaaucaagaaagaagcaaagcagaaggauuuggaaaacucuuagccuggccauguaaagagugaaaaaacauguucaggagaacgugcuuuuuuuuucagugaccuuuacugaggagaucaguacagagagaagggaugauuaagagacuagaagaaagacccugaagacauuuuagauaucuuugaagcugccucucccaucaugggccccagaggccuaggagggcaaaauaguuuugccagacaaauccaggaaacccuccgugggcuuccugcccaggguccuugcaggucucugcucccugcauucuagccucaucacuccuugaccaccccagcugugauucaaguggcaccagguauggcucaaccugccacucugaaagguacaagcuguaacaaccuuggaggcauacauaugauguuaauugugcaggcccacagaaugcaagagauauggaggcacagcagcuuucaccuagauuucaaagaaugugucaagcagcuuguggacucaggcagaagacuuuuugcaggggcggagccacugcagagagccccuacuagggcaaugccaagcagaaauaugggcuccaucuugccauagaguuccuaccagggcauugccuaguggagcugugagagcagggccaacaccaagaccccagaacuauaaagcuaccugugugcagugccagcaugggcugaacccaggaaugccaugggggcagagcugcccaaggccuuagagccccaacccucauaccaguauacauaggacacuggacguggagucaagggagauuauucuccagcuuuaugauuuaauguuuacccucuugggcuucagacuagcuuggggccuguuaccacuaucuuuugggcuauucccuccuuugcuugcuugcuugcuuccuuccuuccucccucccucccucccucccucccuuuccuucucucccucccucccuucuuuuccuuuucccuucccuuucucuuucccuuucccuuucucuuucccuuuccauuucccucucucuuucucucuuucauuucucuuuucuuucuuuuuucuuuucuuuucuuucuuuucuuucacaguguucauccaggcugaucucaaacuccugggcucaggcuauccuuuugccuuggccuuccagugugcugggauuacaagcaugagccaccacacccagucuucuuccuuuucaaaugggaauguccacucuaugccuguccugccauuguaucuuggaaguagauaacuuauuuugauuucacagaugagacuuuggacuuuugaguugauccuggaaccagugaggacuuuggagcuauggggagggaaugaauacauuuguuugugagaaaagaguuuauuugcggggagggcaugggcagaauucuaugguuugaauguuuguucccucauguugaagcuuaauuuccaauguggugguauugagaggugggaagaugauagagaucucuuuaagagaugauagugucaugagggcucugcccucaggaauggguuaaccuauuaguggauuaauggguuaaugaguuaucacaagagugagacugcuggcuuuauaaggugaggaagagagaccugagcuuacacacucaggccccucaacacgugauucccugugcugccuuacgacucugcagagaguucccaccagcaauaaggcugucaccagauguggcucuucaaccuuagacuucucagccucuacaacuguaagaaauaaaccccuuuugaaaaaaugaauuacccaguuucaaguauucuguuauaagcaacagaauauggacuaagacacccgguuucauuugguuucuagcuaaaggucaguuuuuccaagaagcaaauagcuauguuucuccauuuaaagggcacaaauuuuggagcagugaaaaucaguuguuuucaauaagugauuaguaucaucagcaccaccaagccccauucuacccacaagaggcauuuggaaaugucuaagggcuaauuuuaguuccacaaaguaguccugcacaauguguaauuuccuacuacaaaugccagugcacccucauugagaaacguugguugauuucauauuuaucauaaaaugguggaauaacaguugaacauaauuucauuguuauauuagcuacagaaauacuguuuuuuuuuuuuuuuuugagauggaguuccccucuuguugcccaggcuggagugcaauggcacgaucucggcucacugcagccucugccuccuggguucaagugacucuccugccgcagccucccgaguagcuaggaaucagaacacuguucagaugcagucuauugaggcauuuuauuucuuuuuuuuuaacuuaacauaauguaaaagcguauuuucaauguuccagucaguccuggauauauuuggcugauaguuuaaagaaauaaaaucuuccuacaggguucaguuauuaaaauagaaccaaccacccacucauuuuauuacauucuguggaauguuuuuggaugacagucuaaguaucuuaauuagucuccagcugauuuauaacgccuuguuuuauguuucacauuuaauaucucaaaauuacaaguuacagugccauuuuuauuccgugccauuaaaacagggugaacaauauuuuuuaaacagaaaaaggcagguuccauucagaaacccaaaggucauucauuugcauugucucuucauuuuuaggugcuggugcuucuugucugucccacugagucucuguguuguuauucaucuaagcucugugugugcgcuugugugagggcauugggaugggagauuccccuacagcuggauucugcauccaggaaauaaaaucugucgcucaucucaugguuugaacacacacuugcucaauuuaggguuuauccuaugcacuucugucucugugcaaugcuucauguaccauacauuuauacuguggccauuuguuuuuguuuucauaaacauguacaugaaaaaguuccucagaauucuacucauggcaucauagaaaccagacagggaaaauaauccuagaguuucucuccaaaccuaagccucaaguuuaguugcaauuuugucauuuuacacauuuaccaucaaugguucacuuauucagaauggcuaauuucacauccacuuguuuuguucccaggcacagcuuuguguguguccaaacagaaacaaaaucuguaauuaacugcauuuguuugcaaagaucuuggcaguuuuacuguuugaucuccuucaucuagaagcuuuaguuauguugcauagcuuuuuuccugagaauaaguuagacauauuggaaaauuaaaguaacuuuuugguuucuuucaaugugauaucuugcugcccaaaagagcugauuugucucaugaagaguauuuuuauauugggucguugucuuuuaugugagcuguuuccuggaaagauuuuugaaauguugagcuacaagauuaacagcaguuucuuuggugauuaaccugagcuauuaauaauugcucuuuuuacaucauugauauuaaaaucaaacugugaaugauuacuauaugagugucucuauaaagccaacaaaauugaagaagcucgaguuucucuccuaaaguuacuuguuuucuuaagaaacauaucugucaggcaaaaagucaaaauucaccaaaauaauauuaagauuuccugaaguaacaaauuucucuuccucuaugguuauauauacaucucguuuauucauaguuucauugccuaggcucucucuuuuuuuguagcuuuguuaccucuuaauuuuguccaacuaaugucaauuuucuuguuauuuauaacaaguauaaauuucagaugucuguacaaugaugccuguuuauaugcagcacuucuuaugaugucuuugccauguuauuuggaauucuuucaucccccuauuuguacuggauaccauucaauacauuuagcaaguaggaagacaucauuuaaccucuuccacuaaugagaagguggccauugcauugucuuagauaagcaguugcuuucuucuugccaaauaaaaaauaacuucucaguuuucauugugguacauagagaguggucaauaaaauuaaugaaaccuccuuaauuuauuguagcauucaauauuauuggugauuuuuuguuauuuucuuaugcaauuaauuguuuuuauuauaaugaaauauacaguuauuuuaaauaauuuguaaauauagauaaagaaaggaaauagaaagcauccauaaaccagccguuugguuuauggauacuacuauuaauacuuuguuauuauucuacccauuucuuuauauuaugcuuuacauaaacagcuuacuuuucuaaauaaugggcuuacaugguacaugauguuuugaacuuuuuaauauaauaauuaauauauuaugaauguauuucaugaauaucuacaucuagagcauaauuuuaaugaaugaauuguauuauagcauauguaugugccacuuuuuugggguuuaucucucccaucugagucuugagcccaucauauacuaaacaucuucacuuggauaaccuacagacccaucaauacuugguguucuccagauaacauguaucaucuucuccacacgcacuuuuucucccguguucccaugucaauugcuccuuauugcucaguacaggaagcuggacaucaucuuugauccacacucccauaccccaccuuaaaucagucaccacaucuuagguuauucaauuccaaauuucucucaaauccauugcuccucccuugucccuacauaugugccauuuuuagucagcaaauauucuaguagacauuuugguuguuuuauguauuuauaguuacaaauagcacugugguuaacugaauuaguuauauauugcuguguagcgaacaaauuacucccaaaccuauuggauugaaacaacaugcaucaguuucugugggucaggaaucugggcauggcuuagcuggguccuccgcuucaggaucucuugcaagucugaaauuaaaguguuggccagggcuaucugaaggcucaacuagggauaaauccacuucugagcacauaugauuguugcagaauucauuuccggaagaguaguuggacugagguccucaguucuuagguggcugucagcuggaaguggcugucaguuccuugccaugugugccuccccauauaccagcuugcuucagcaaagccagcaagaggaaaccuuuacuccugauguguuaaaaggaucucauguauuuacaaugcuagggagagaaucugcuagcacgacaggagucacagucuuuuuuguagccuaauuaaagaaaugacaucccaugccaucaacuuggcuacauucccuuugcuagaagcaggucacuaggccagcccacacucaaggggaagggauuauaucauggucugcaaaccaggagcagggaucuuugggggucauguuagaguaugcccccacauuaaccauccuguagccaagccuuguguauauucuuacauauuuccaaguguuaaaccugagaagaaauauuccuaauuaaaggguuugcauacuuuuuggguguucuaaugucuuuugccagaaguuguucaaauuugcauuucuaacagcaguuacacucccaccagcucagagagccuaaucaguuuuucucuuucucuguuuaaaaucuuguucaaucuaguaggggaaaaugggaccaccuugaaucucuuucccaugcuuucauggugccgagccuuccagaacuucuacccacugccuuuuccuuucugucucuauucuuuacuuuucuuuccuaccuccacaucagaugugcccccagggcugugccuuuggucuucuauuuuucuuucuccagucauucagcaaauguuugugggccaacacugagcucaccugcucucaagagucaggcacccauugugagcugauucccaagacucaaguccagccuaaucuuucccugggcuuuacacccauucuuccagccaccuacaaaccucucugcauggauguccugagaauaucuccaacuuaauguaccuggcugaacucaucacuuccuuaccccuuccuccuuccagaaaaugagcuuccccuccuugcuguucccugcucccuugcugaaagugcugccaucauuuuuuuuuucagcccagauaacuguagacagaguggagacuugucagcagaagccuuggcugcuucucccugcacagaguaaggaaguguuuugcuguguauagguaggagucacuuuuggaagagaggagcucagugagucauguucuccaacaaaucagagucugcuauuaagacugugguucccacaggcugagauucagcaguuaucuccccacuaaacaugccccugugugagccaccaaacuucuaagcauuuccugcaccugggacugcccacuggucugauaauuugugacucugggcccuguauuuuucaccuacuuugauuagagaugggaaucuccuucccccuuucugggcagauuccuaaggaucugcagggacagggauggcuagugauacacuaucacuccaccucaccuuugcaugcauucuucucucacaagugcagaguaugagcaggagguucuuguugauuauccucuucugcccaaaaagugaaaguaggcuugugccuggaaaauauccuuuuacauucuacacucucauccuaauuccauuuuaccugaagauauuagucagaacacucauuuucuuacucuugauaagcuguaaggauuucaugcauuuacugaaccagcuccacaucaauucagcaggauuugcuauagugcucccuuuucucucucccucaccccaaguuaauauugcauuuuaaaauacuggggacacuuucuuccuucauucacccucccugcccccugagacauggcccuggcaaugugcauuuucuuccaccguuuucauaagggucucucaccugaauuuuuaguaaacucuuucuuaguugucugugcugccuucaacauuuccucuucucacuuugccccuccucccuuuuuauuuuuuauugaugucccagagcauccuucaauaaacuuagcuucaugcccucagaacuucuuaacccucagauugcccacucugcccaguguggcuccacucaaucugugugucaccaucucaccccgggaccucugccacccaccuuucagcuggucuuccuauucccaccucccgcucuugcacuccucccuggguuccugcugugcuggccuucucccacuaguaucauugucaccugaucacuuucuugcauauaguuucccauuuccugucauuguuuuuuaaaaaagucuguaaacuggucccaccucauguauguguguguguauuuacauaggugauuuuuauuuccgguaccuuucuaacacaccaucugcacucaucaccaguccuuggcccucaggcauuccuaacucauccuuuuccuauuuucccuuccugaacacucaucuuccuucucuccacugauccauguccuccccauaaccaagguccaguucagggccaaccacuguaacucuaggccacggagucacaacccuaacugcacauuaaaauccccugagguguucuuaaaauaauauuuuagcugggcccaguccuugcacaguugaaacuuaaacucuuggguaagacucaagcaucuuuguuuuuuucaaaauaccccuaacccggaggauacugaugcacauugaagagugagaacaacagcuucuagcugacacagcacacuggaaaugcugugguauugauaaccagugccacacacuuccacaccaaucuuuucccaccuugccuaccuuuguuuucuuaccagauucugaaacgcauacuuguaaauaucuguucauggacaagucauuggauuuuaacguacaaauauccuuucucugacuauuucuucuugacaucuuucauugaguauaaucuuaucugcaucaaacagaaauggaagcauaaaccugagauacuggcagaagcuuugaagguacuuacuucauuuuauugcuuauuguugaaguugaaucauguguuauuuuuagggguuuuuuuuuguuauuaguuuuucagaggacagagucugacucugucacccaggcuggaguacagugguuccaucauagcuuacugcagccucaaacuccugugcucaagagauccucccacuuaagccuucugaguaacugggacugcaggcauaccuggccaauuuuuuaaaaacaauuuuguagagacagggucucacuguguugcucaggcuagucucaaaacucuuauccucaaccuauccucccucuguggccucccaaagugcugggauuacagacaugagccaccacacccagccuauuuuuaguuaugcucuuuguaguguucuuggguuuaccaucuuuaacaauuaauuuaacuuagcacauuacaauaccucauauaaguuauguuucaucuuugcugauauaucaauguaagaugguaacuaaauuagaccucauaaucaguagcuaguucuuccaccaccagaccauacuaauuaugcugugacacugucagaagugcaugaugauguccacacuguaccuguuuuuaaucauuuccucacuuuaaaacugucaucaaaaaugcuguuuuucucuuuuguagaaucauucugguuucuuccuaauaaguguuuuuggaguuguuuucuuaugguuucucuugguuuuagcauugaucauuguaggaaaucuaauugaaauuaaugguauauaucaucuuuuuacucuuuaacacuuugcaaugcuuuaauaauuuuuaaugaaaauaguauauuacuuuuaggagcacauauuuacccaaauacagucgauaguuuuucgaaguagagguccuugggagaucugguuuaagaaguagagaaaaaugggcagugguuaguacauaguuguuuuuaaguggggauuuugaaauucuuaaggguacgcaacacaauuuuuaucagaguugguuuggagcaugcaguagaaaccugacuaaagaguggcuuaaacaaauuuguuuuccccccuucagguaauaaaaaaucuuaaagaaaccacugcaguauaugcaguggcucaggugucguaaaggcccagacuccuugugacuucaugcuccgccuuccuucauagguggcugucauccucauagaccuaagauccuuucuacaguuuccaacagcacacuuuuugccaggcagacacaagaugaaauucagagaacaaaagguaaagaauugaguuugcccuuuuaagcagcuuucccugaauucuaccccuaugccuuccaguuacaucucauuggacagaauugucacuugaccacuuuuaucaccuaggagauauaauuuuuuagcugcaacuauugccaucccaaauaaacgaaacauucuguuagaaagaaagggagacugguuauagagcagguagcugguagugucugccauucuaguucauugagcauuuuaauuuuucuuuaugauuuguuguuaaaaguucugcauuuucuaguaguaaaagauugauuaacucaagaccagcauuugcuaauuuuuauaaauuauaaaugauuuugguuuaaaugagugaaguuuuauucuguugguuuuaccuuuuuguuuauaaaaguauucaacuacucuaauuauugcaacacuuuuuaaaaaucaugucacugcauauugcaugaaauucugacuaucauguuuggaauuuuauuaauaaaaauaaaauaugucauaaauuuaugcugccugguguuuugauuuugcaauuugcaaauaugcuugaaauccugcuaauaugggaaaguaggaaccggcuaaaucauaauggcuacaauauggcaaagaaacuguuuccuccucucauuggaguaggcaaauuuuagauggaaaauuauugcaguuaagauuuuauacaagauaauuuuuuaaaagaaauaaauuccuuuauaauuuguuuuucuccuuacaacauacugguggugcuuuuggggcauuuuaaauuauaaggugcaaugugaacugauaaccuaacuuaguuuuguacuacagaucucagaaguaggaaggagggagaguggaacugagcugugauuauugucaccagaaaauauacugggaagggguaaacaugaggcaauaaaaacucgccucacuguuaaaaaagaaaacuagaaaauuaaagaaaucagccauauugacucagcugaaauauauuuuuuucauuuaaauuccugaugauuuuauucugaauaguuuguaagacuauaggugcauguuuaaaaugcaguuacccuccacaggauguuggguuguguuuauuaaaagcuuagcauaggaagcgcuuugaucuccuaacucuuguaggguuuuguguuauugcuuuucugaguaagaacuccuggauugcuggugacaugucggugacaugauuagaccuuuaaggugagugugugugcacgcacauguagaugugcaaauguacauauacacacgugugcucucauaugcauaauuuuugaagaaagagguaaagagaaaaaaucuggcagcauuucuaaaaaagguguucugaauugccugauuuccuuggaugguaucccagaugcuuccuaucagaugaaguagcacauagaguacagcagauguaaaauagugcacaaaaucuuuucucuucaugagguuauugcagugguucaaauauuugccauaaucuuagcaauuaaaguguauacuauccaccucugcuucaaucacacuuauucaauaaaaacaagccucuucugugcuuuaguauauuuuacuaccauauuuaacaacuaacacggacuuacuaaaaauguauucuuuuuguauaauaaucaggagucuuauuuauucauuucuugauaauaaauccugaucuucugggcuaucagcacaugggcuuaguauauaagacuguuuauuuuaaaacagcucuuauuacagguucagacuuuuugcuuuaaaucugggcuaucggugaguccagucucugacccagagcaggaguuuccaucacaacauccaggacaagccauuggugauugucugacugagcacaccuauuuaugauacagaguucaugacuuuucaagaccagcacauuucucuuuaugauaaaguuuugauuuguacacaguuuuccucauauuaacuucagauuuucuuccauguaaguuacguggaugguucugauugugcccuagggagcaauugcagacugucucuucuacauggcagucacucaaauauuugaauacaauuauuauguccuuucuaaauaucuucuuuuucaaaccaaacauccuuguggaaguuugaagaaagagaggaaugguagguagcaguguagcagaaaauuguucaaguaaaaaucagucggccucagacagacacagaagcuggaucucuuuaggguuguccagauagcugacuguagcucagcacuuaagcaacucacaugaagagggacuguaaguguagaugccuuauuuacuuauuuaagacaggguccugcuuuauuacccagggaggagugcagcagcaugaucucaguucacuacaaccgcggccucccaggcauaagugauccucccacuucagccucccgaguagcuggaacuacagguguaugucaccaugccugacuaauguuuguggguuuuuuuauagagacagaguuuccccguguugcccaggcuggucucaaacuccugggcuugagcaauccaccugccucagccucccaaagugcugggauuacaggugugugccaccacaccuggccuagaugccauguuuauacauauuuauagauacguguauauauguggguuaguaugcacacauauauuuucuugcaucagccaagauggccuagaaacaauaccccaguagcaagaagaacacccaccaacuagaccuugguuuuuaauacuauuuucuaguaaaagaaaucagggccuggaaaaaugauugauucuaggaaugagucaggaaauauacaggaugagccuggagaaucuuauaauaccagaaagcagaaagugaggaaguaaaaaacaaaaacaaaccucacugauggcaacaugucaaaggagcacaagaucuaacagaaggaucugccaguggcuaaagcuggggacagcuuaagcaacaaaguaaaguaguauuggaugguuaacccaaacuauaaaauaaaugcccaugaguccguauguauauaaauaaaugauuugauaaauaaagaggaaaaaauggguaagucaccuugcagaagaaucccaaauaacuuuugucgauacucccaccucaaggaaguagaacauaacccuucacuuuuucaguauaggcugcucauaaugaccuuccaaagaguaaaguaugcaaaagaggaaaaaaagaguaaauacaguggagaaaccuaacaaauacuacuuuacccagaugugauggaaauaaugcuuuacuucuugugguuuucuucccaaaaacccauagccccaguguaaucaagugaaaaacaucagaccaaucccaauugagguguauucuguaaaauacuucaccaguacuccuugaaacagcaaggucaucaaaaacaaggaaagucugggaaacaucacagccagcaagagccugagggggcauaaagacuaaauguaauaugguauccaggaugagacccuggaacagagaaaggacauuaagcaaaucaaggaaaucugaauacaguguggacuuuaguuaauaaugauguaucaauauuguuucauuaguugugacaaauguaucuacuaauguaagauaauaggggaaacugcaugggggcuguaugggaacuccacacuaucgucucaguuuuucugucaaucaaaaacuguucuaaaaaauaaauuuuaaaaaauguuuaaagauaacuuggagaaagccuagaugaccuuggguauggugaugaccuuuuagaaacaacagcaaagacaaacuccaugaaagaggcaguuaauaagcuguacuucgucaaaauuaaaaacuucugcucugcaaaagacagugucaagcgaaggagaagacaagccacagacugggagaaaauauuugcaaggacuguuauccaaaauauacaaagaacucuuaaaucucaaaaauaaaaaaacaacccaauuaaaaaauaggcaaaagaccugaacagacaucuccucaaagaagacacgcagauggcaaauaagcauaugaaaagagguucaacaucauauguuauuaggaaauugcaaauugaaacaagaaaucacuauauaccuauuaaaauggccaagauccagaacacugacaacaccaaaugcugaugaggaaguggaacaacagaaacucugaguaguugcugguaggaaugcagaaugguacagucacuuuggaagacaguuuggcaguuucuuacaaaacuaaacauauucuuaucacucaacucaguaaucacacuccuugguguuuauccagaugaauuaaaaacuuauauccacaccaaaaccugcauauagaucuuuauagcagcuuuauuaauacuugccaaaacuuggaagcaaugacguccuucaguaggugaauggauaaacuguggcacauccagaaauggaauaccauucagugcuaaaaaggcaggagcuaucaagccacaaaaagacauauggaguaugaggacagagggugcucagcaaaaaagaaaagauauggaagaagcuuaaaugcacaccacuaagugaaagaagccaaucugaaaaggcuacauacuguaugauuccaacuauaugacauucuggaaaggacaaaauuguggagacaguaaaaagaucagugguugccagggguuggaggaagggagggaugaguagagagaacacagaggauuuuuaaggcagugaaacuaccuuguaugaugcuauaauggugacucugccugucauuaacccuuagaaggcacaauaccaagagugaccccuaguguaaacugugaucuuugggugauaaugucucaguguagguucaucaguuguaacuguguugaucgaugucggcagugggaaagguuguacagguugagggaagggggaacaugggaacuuucuguacuuuccucucaauuuuucugugaacuuaaaacugcucuaaaaaacaaaguuuauuaauucaaaaaugccaauaagaaaucuaugauguccccuucccccauuaggcaagcugaauggaagucacguuauccaaaggcuaccccaguugcuaggagaacauggagucagaacaagaauggacuuaagucaguugcugggcuuaauaccuaggugaugggauuaucugugcagcaaaccaccacagcacacauuuacccauguaacaaaccaccacaucaugcacagguaccgcugaacuuaaaagcugggggaaaaauaaaaagaauggacuaaagucacauaauuuaaaugugugauggcuucaaacuccuacaguugaauguuguggucuuucuuagauggacaggccuucucuucuggacagggcaggcuaggcaaggcaaauguuugcuucugucauccuacuuuugcuccugcucccuguggacauacacaccucugcugaacacacauguucagucugguuaucugguuuccaggagugcaaauguauagacuuuauccauuuauagcccugacccauuaugcuuugauuuuguaguuuaacuuucaaaccaugccauuucugugguuuccaaguacagugcccuugaacaacacaguuuucaacagcucagauccacuaauauguggauuuuuuucaauaagugcagucggcacuccauaugggcggguuccauguccacaaccaaacaccaaucaaaaauacaguauucacgggaugcaaaacccacauagagggacgacaggaggauuuugugaggauuuugguauccuugagggugggaagcauccuggugccauucaccugcgaauaccaagcagcgacuguacuuccucaaaagcacugcugacaacccaagaucccucagauguccuuaaugaaacccuuuuuucaggcucuuucuuacccuggucguccuccucuucugguuacacucccauuacuaaauaccauuccuacuauuguauauuaacguuccuuuuaaaaccuagugccuagaauagcagaaggacucuacauaucaugugauuauuucagaguacaguggacucuuguauucaucuggacaucguaauuguauuaaugcagccaaaauuauauuaaguacuucagcagccccaucucccuagcucuuguugagacucuaguuaaaaacaucccugaggccuuuuauccucugaacugcugcaucacgcagcugcuuguaaagccgucucuccuccaacuugugcuuuuauaauugaaucucuuuaaauguaaaugcagacaauuacauuuguccuaguuaaauuucaucuuguuauuucgagcccagagcuccagcuuguugagaucuuauugaaucuugguucugucauggauuucuguuaugcauacuugcuugugucugcaacccagguagagaggcuugaaaauaaauauaucccagcugcgcuaacucaaagcaagagguacugagagaagacagcagugaugauugcucggggauggggaaggcaacugcccauucucuaagcaguaauuuccuaauauuuuugguggcaguucacaguucaacauuaugagauauagcaaaagccauuuauugcuaauuacauuuaacugaugucuaugaaggacuauuccuauacauuagagugaauuugagacuaucuccaucauucuccagccauucuucagugggagaaaaacgguggaauuaaacuaguggaaacaaggcuuucucaucuagucccaauccagucgauaagcuguguuugccaaucacugcuccagcacaauggcccucaguuuauuuuuaagucuauggcaugccugaaggaccauguucccaugagugacacccuucuguaaaugugguggcacauuaugggcugcuguuuuagaagagacugccaacuugcuggggauuauccugguguauuccuuucucuccggcugguucgugacaugucacuggcuugaaaauucucagcccuaacauuuaaagcagcgauucgcaaagugcagcacuuuuaagcugagguuggcaaacuguggcccauagaccaaaucugguucaccaccuguuuuuaguacaucacuaaaugguugggggaaaaucaaaagaagaauaauauuucaugacgugaaaauuauaugaaauucaaauuucaguaugcauaaauaaaauauugaacacagucaugcuuauuuguuuauguauugucauuggcugcuuuugcaaauaguagcagaauugaguagcugugacagagacuauaugacccacaaagccuaaaauauuuacagauauggcccuuuacagaaaauguuugcccacucuuguguuaaugggaugguuuagaaacuguggauuuuugagccccaccucagaccagauaaaucagaaugucuacagauggggguccaagaauguacauuuuaagcaagcucuugaaauucaccccuaggcgaacagugagacaagacuaaugaucaugagcuaaggauaugggaaaggaaaagauucugcccuacuuuuucugccgaacuuauuguguuuuaauccaacgcuguaauuuugcuacagacuguauaaauuauguggaucaguuucuaagcacuucucuccaauucagcucucuuccaaacuuuucuauuuuguggaaagaagguuguauuaguuucuuagggcugcuguaacagauuaugaacuguggguugaccugaccaacagaaguuuguucuuucacaguucuggaggccagaaguccaaaauccagcaggggugugcucccucuugggggucuagggaaagaacccauucuuugccuuuuucagcuugugguggcugucagcgcucuugacuuguuaguaccucacugcagucucugccccagugaucgcauugccccuugcucuucucugugucuuauuuuucaucugccucaaaucuuccucugauuuucucuuauaaggacauuugucaugggaccuggggcucacacggcuaauccaaaugaucucaucucaagauccuuaauauaauuauaucagcaaagcuacaaagaccucuuuuccaaauaaggccacauucacagguuuuggggguuaggacagggacaucuuuuugaggccaccauccaacucaauacacaugccgcuguucuccucuucccccaacagccagucaguuuccaagucuugaagauuccauccgcuucucaaguccuacuugcaccauucugaucucuuucugccauaggaaucucuuagaaauuucugacgguuuccuacucuucgaaaaguucagaacauacuucuaagccugacauuuagggcucucugcaguaauguugccagcguauuuuccauuucuuucucuuucuucuucccuccauguaccuugcccuccagccacacugugccacuugccguugcccucacugcuccucccuucucucugaacccucucacacuguuccuucuuccuggaacacugguuguuccuccauccuuaucaccaugaccccuaccccuguaucaccuaacacccagauaucuuucaaaguccaucugagguccuaccuccccaugagagcuuugcugcuccuucccacuagggaugaaucucugagccuucggcaccucacaugguauauuauuauuauuauaauauuaauauuauuauuauauuuagcuauuuugacugcaaauguaggaaaauuaacaaaauaaaggaaauuaagaaaaguaauucuaaaguuuaguaaagugacagcaaacaagaucaacuuuuaaaaaagacgguuauccuguagagagugacucuaguuuauaaccaguaagaaaauauaauuuuaaaaugcucaguagugaaguaguguaacuaaaauauucuuaaugugaaauguauuauuaguaucuaugugaagauguuuuaaauuuugagagacaagugaagaugacuaaaagaaauacauacuauuuuccuuuagauaauguaaagaugucauucuuuauacauugauuuuaagguuuagugucguuuuuauggaauauuuuaaaauuuuauuuauauaauaggguacugaucaaaauuccaauaagaugagccucaucuuccaagagauaagacuaggacauaaaaggauuucaaaacuuguuaagaauaacccacaaaaauuagcuggauguaguggugugcuccuguggucccagcuacucgggaggcugaggcaagagaaucacuuaaaccugggaggcagggguugcagugagccaagaucgugccacugcacaccagccugggggagaauaacuacacaaaugaagauaagacacauccaaauuuaaaaggauuauguaaaacaacuggccuggaauuuuuuuuaaaugucaugucauaaaagauaaaaagagacaaaugggagaggaaggaggaggaggaaagaaggagaaagagaaaggaaagaaugaaggagaggaaggaaggaagagggggagggaggaaggaagacauauauugaaagauguuagagauacauaacuaauguaaugggugaucccuuuuuuuuuaaauuuuauuuucgguucagggguacaugugcagauuuguuauguaaguaaacuugugucaccaggguuuguuguacagauuauuuugucaccuagguacuaagccuaguacucaauaguuaucuuuucugcuccucucccuccuuccacgcuccacccucaaguaggccccagugucugucauucccuucuuuguguucaugaauucucauuguuuagcucccacuuguaagugagaagaugcggcauuugguuucuguuccugcauuaguuugcuaaggaugauggcccccagcuccauccaugauccugcaaaagacauuaucucauucuuuuuuauggcugcauaguauuccgugauggguauguaccacauuuucuuuauacagucuaccguuggugggcauuuagguugauuccaugucuuugcuguuaugaguaguauaguaaugaacauuugugugcaugugucuuuaugguagaaugauuucuauuccucuggguauauacccaguaaugggacuacuggguugaaugguaauucuguuuuuagcucuuugaggaauugccauucugcuuuccacaaugguugaacuaauuuacacucucaccaacaauguauuaaguguucccuuuucucugcaacccaaccagcaucuguuauuuuuugacuuucuaguaauagccauuuugaguggugugagaugguaucucauugugguuuuauuugcauuucucuaaugaucagugacacugagcuuuuuuuuaauaugcuuauuggccauauguaugucuucuuuagaaaagugucuguucauguccuuugcccacuuuuuaauguuuucuuucaauuuguuuaaguuccuuauagaugcuggauauuagacuuuuaucagaugugugguuugcaaauauuuucucaaugggugauucuugaucaguuuuuuaagcuuugaaguuaauuaugggaauauugaauuucaauauugaguguguauuggguaauaguauugaauacaguaauggcguugugguuacaaaaaacgcccuuguucuuaagagcgauauauugaaauauuuaggggugagguguuaugauauuuguggguuacuuucuucuuuuuuuuuuuuuuuguugagucgcagccucacucugucgccuaggcuggagugcaguggcgcgaucucggcucaaugcaaccucugccuccuggguucaagcaauucuccugccucagccucccgcguagcugggauuacaggugaccaucauuaugcccagcuaauuuuuguauuucuaguagagacgggauuuugccauguuggucaggcuggucuugaacuccugaccucagaugaucugccuaccucggccucccaaaguacugggauuacaggugugagcuaccaugccuggcccauggguuacuuucauaugauucaggaaaaaaguguauaugcauguguuguguguauauaaagauacacagagaaaauaaaaugugacaaacuauuaguaauuggugacugaaggugaaggauauauacagauguucauuguaguaugauuuuagcuuuucuguagguuugacauuguucaaaaauaacaacaagcaggggagagacuauuaaggaaaacucuuuaaaaauaguacugaaggcugucagcccugccagauucacuauucauuuaacaagcagauauuaacuuuauacuauuucuguguugcuacaauuauuaaaaacaguaaugauacaaggcuaaauagggauuaguggagugaaauaagcagccaaaggaccuggcauaacuagcaauuucugacgugauaaaacaauagggaagggcaggaauauuaauggaaaucauauugagauaaauucuuagcaauuuaaaaaaaauaacuuugcccuuccucuccaaacacugaacuaauuuauauuggauagaaaauuuuauaaauaaauaaauauaaaaagaaaaaaugcagaauuacagugaaugagauccuaagccuagaauaaacugaacaaaucacaaagaaaacaaucagcagggugugguggugcacaccuaucaucccagcuacucaggaggcugaggcagaaggaucacuugaguccaggaguucugggcuguagugcgcuacaucaguuggguguccacacuaaauuuggcaucauugugauuaccucccgggagccagggaccaccagguugcauaaggaggggugaaauggcacaaguugaaaauagagcaggucagagcucccaugcuuauuaguaaugggaucacaccugugaauagccacugcacuucagccugggcagcauagcaagaccccuucuaaaaaauaaucagaaaaagaaaagaaucagaaauuuuaacuguauaaaaaucauaaccuuauuacauuaacaaauuuuuaaagacuaaucuagaaaacaauuugcagguuuuuuauuauuauaaagaauugauucaaauugaugaaacucccaaaucucaaggaaugaaugacuaaggucaauaacagauaguucaccaaagaaauaaauguaguaaauaacugcuaauuaaaucauugcaaauuaaguuaugaauauuucaacuuaaaauugccuuuaaaaaauaagaguaacuugcuggagagggugcagacaugcuccuauuuucaugcauugguggugguauugcaaagcuguacaacucuauugggaaagaauuuagcaguucuuaugagaagucauaaaaauuauaccauugauucaguaauucuacuucagggucucuugcuuaaguaaauaauccaaaauagugauagggugaaaacuauaggcaaaacacuugucacucuuauuauuuauagaagugaaacacugcaagugagcuaaauauuuagcaauaauggauuacuuagagaauuaauuaugguauaaugcccaaaggacuaucaugcagcuauuaaaaaugacggcuauggagauugcauggaaaaauuauuuugaagugcgaaguuuuugaaaaauugugugcauaauacaaacgguauaaauuuuaaagcccacuuuaugagcuacucuuuaucacuaggauaaauauucauucuucuuaccaacauuuuuacuuucuuuguaguauauguuuuucccucuaaagaagauaaauaauuuaaugcagucucccauguaaggcaguguuuuauauuggagcacauuuuuaucacuugccauuucacucuggaguuguccauaaagauaaguauucaaacaacuguauuguauuguacucacaguauaauuuuugcauuucuuccacccuaucacuucuccaacacccugaguaaauuaagaaguaaacuaaagaaaauauuuucagcaaauaguuuauuugggauauucaacuuaaaugaugauuacuguucuaaaacuuuuaccuaccuuagguuuggccuuaucugaguauauagucaguacaggucuacaagucugcuccauacacacugaaaaauaacuugcugaaaauuucuuuaucauuuauuuuaccuuuaggcacuuugcauggcuucucagaugccaccauugugaauauaguaagaauagaccaauggaaugaccaaacauuagcauccaugcuuuaucuaacuauaaguggaaauguuuauauucuaauuuuaaaacuauuguaugucagguaaauagagaaagaaacaaaauucacaaaacccauaaucuuucuuacaggccuuauccgcaaauuccuugcaguugaucuagacugaauuguguuuuuauaaccaagauguuugauguuccuuaauuuuagcaagaauaccaacuacuuuguugggauccagugauuuuuguuuuuuaauuccuaagaugauaggaugguuaauaaaaauagcugaguaggagauuuccacuuuuggaagcucgaguagacauaguuuuuucuauuucuuccccuaagucaaacuaaaaacucuggacauuauguauuaaaaaauauaaagaugaaagguagagagaagaaaacagacuggcuagaaacccccgggccacagcagcagcauagcaguaaguuucauggguuuucauuucgcuucguguaucccagacuuggagcugaagaagcuggcaaauaggaaaugucaacagcauagacaaagcuccaauggagccugcucuuucuuagucaaaagaccaagacaggaacauccuagcgagacggaaaacuuuuagacaauccucuagccgaacaccacagaaggaaauguggacccacccucacccaugccagcaaaggccucguggggaacccagacaucuacccuaugaagcccuaaggaggugugcuaauacuccugcuggagugguuucagaaaaugccaagaaaggagcuuagauuuuuauccccccugggcaguaauuaccccuuucccuucauggugugagcagagacuguguggggaaucagaacucaccuccacacacaguaacgcagugcugcacaccucagcugucagcagaccugaguagaaaaccuagacuucuguccccaucuugcaguaacaaggcagcaccccacucuuuccuuugccagaggcauggcaaagaaagccaguuagaaaaagaagauuuaggcugguuguaguggcucacaccuguaaucccagcacuuugggagggcaagacaggaggauugcuugagcccaggaauucaggaucagccugaccaacauaaagagaccccaucucuaccaaaacaaacaaacaaacaaauagccaggcauggugacaugugccuguagucccagcuacuggagaggcugagaugggaggaucacuugagccugggagaucgagagaucgaggcugcagucagcuaugauugcaccacggcacuccagcuuggcagucggcgcaacagagugagacccuguauccaaaaaaaaaaaaaagaagauuuaaauaacauucagaaucucaucacauaauacaaaaauguccaguuuuauuuaauucagaauaacucauaauacaaaaagccaagaagaucuuagacugaaugaaaaaagaaggcagucaauauaggccaacaccaaaaugacagcaguguuagaauuaucugacaaagauuuuaaagcagucaugauaaaaaugcuucaaugaacaauuaggaacaugguugaaacaaaugaaaaaauagaaaggcucagcaaagaaaugucucugcugagaaacuauggaggugaaaaaaauagcaaaauauuuuucaugugcugaaagaaaagaacugucaauccagcauucauacccagagaaaauauccuucaguaaugaaucacaaaucaagacauucucagaugaaggaaaacuaagagaauuugucaccaucagaccuacccuaaaauaauggcuaaaaggaguucucuggaaugucagaaaagaggaaagagcaugguaagcaaaaacauguaaauauaacauucuccucuugaguuuacuaaauuauguuugaugguugaaacaaaaacuguaguaaugucugauguaauucuaaaugugcauagaggaaauauuuaaaacaauuaaaaaugggagacuaaaaggacauaagauaucuguacuccacuucaacugguaaagugaugacaccaguagacugugacaaguuauguacauauaauguaauaucuaaagcgaccacuaaagaaagcuauacaaagggauacacucaaaaacacuguacauaaauaaaaguaagagucucaaaaguguuuaauccacaggaaggcaggaaaagaaaacagaaauaaaaaacagugaaacaaacaguccauaccaugggccuuaauacaaaccucagaagauuuaacagaguuaaaaucauauacaguauguuuuuugaccacuauaaauguaaucuagaaaugaauaauagaaagguaacaggaaaauaaccaaacacuuggaaauuaaauaacacaccucuauauaacccaugaaucaaagaggaacucucaagagaaauuuuaaaaugcauuauacuaaaugaaaaugaaaauguagcauaucaaaauuuguaggacacagcuaaugcagugauaauacauacauuagaaaagaccaaaagucucaaaucaauaaucaaagcuuucaccuugagaacccaaaguaaaauaaauacaauaaaagaaaagcaaaauaaacacaaagcaaacaaaggaaagaaauaauaaagagcauaaaugaaauugaaaacagaaaaacaguggagaaaauuaaugaaacagagaucccugagaggauuuggcucuguguccccacccaaaucgcaugcugaauuguauuccccaauguugaaggugggguguggugggaggugauuggaucaugggggugguuucugaugguuuagcaccaucccccuagugcuguuagaguucucacaagaucugauuguuuaaaagcguguaacaccucuccucucucacucucuucuuccugcuucggccauguaagaugugccugcuuccccuuccccuuucgccaugauuguaaguuuccugagaccuccccagcaaugcuuccuguaagccugcagaaccgugagccaauuaaaccccuuuucuuuauaaauuacccagucucagguacuucuuuauagcagugcaagaacaaucuaauacaauuucguucuuugaaaagauuaauaaaucaacaaagcaauucuacacuucucuuccaaaaaauaaaaagagaacaguucccaauucauuuuaugaaacuaguauuacccuaauaccaaaaccaaugacaguacaaaaaaaauaagaauacagagaaauaucccuuauggcuacagauucaaaaauucguaacauauuggcaaauagaauucagcaauauauaaaauuaaugguacuccaugacaaguagaguuuauuccaggcugacucaauauuugaagaucaaucauuguagcaaaaaucacuggauugacuggaagucaaucagucgugagccuauuaaucaccacauuaauaggcuaaagaagaaacaucacauaaucauaucaaucacugcagaaaagcauuugacaaaauucaacacccauucaugauaaaaugcuaagaaaaauagaaauagaaggaacuuccuaaaccugauaaagggcaaauaauauuauacuucaugggggaaagcugaaugcuuuuccuauaugauuggaaaugaggcaaagaugucuggccucaauauugucauucaacauauugcuggaaguuuuagccagugcaauaaguugagaaaaugagcugaagacauacagacuggaaaggaaaaaaaccaaaacugucccuauuuguagauaaaauaauuguuuaaguagaauauuccaaggaauuuauuuuuaaaaagacuccuagaacuaauaaaagaguuaagcaaggucaaaggauacaaaauaaacacaaaaaucaguugcauuucuguauauuagcaaugaacacaugacaacuggaauuuaaaauacaguaucauuuaaaauuucucaaagaaaaaauauauacuuaauuguaaaucuaauaaaacauguacaggacuuauaugcuaaaaacuguaaaacugaugaaagaaaucaaagauauaaauaaauggagagacauaccauguuuauggauugcaagacucaacauaguaauaauagucaauucucacaaaaauauauacagguuuaaugcaguuccuaucaaaauucuaacaagauauuuuguagauacagagaagguuauucaaaaauuuauauggaaagucaaagaaaguaaaacaguuaaaacaauuuugaaacagaauaaaguaggaggaauaaauuucaagacuuauauagcuacaguaauccagacugugugcuauuuguggagagauagacacauagaugaaugcaacagaauaaagaauucagaaacagacacacaaaugagccuaacugguuuuugacaaaaguguaaaagaaacucagugcaagaaagguuaucuuucacaacaaaugguggagaagcaauuggauauccauagggaaaaacaaacaaacaacaacaaaaaacgaaauaaaacccugaucuaagucucauaccuuauacauaaauuaacuugaaauggaucaugaacuuaaauauaaaauguaugaccauaaaauuaaaagaaacaguaggagaaaaucuuuagaacucagggcuaggcaaaaaagucuuagaauugacacuaaagccacagucccuaaaacgaaaaacuguaaauugcacucuaucaaauaaaaacuuuuacucugcagaaacucucuuaagaggauauaaagacaaacugcagagugggaaaaauauuuucaaaccacauaccuaacaaaggacuaguaucuagaauauauaaaguuuuucaaaacucaacaguaaaaaacaauccucuagaaaaugggcaaacaacaugaacagacaguucaccaaggaggacauauagcaaauaagcacacagaacaagcaauuagcacacaaaaagauguucaacaucauuagccauuagggaaauacaaauuaaaaccacaaugggcugucacuacauaucuauuaaaacuaucaagauagagaacaaauuaaugguuaccaggagugaaggagggauggagacagaagguaagucgauuuggcuauaauaggacaucgugaggaauccucauaauagaaguguucucucuugacuauauuaaugucacuauccugguuuuaauaguggacagugguuuuacaagagguuacugauaugauuuggcuauguccccacugaaauuucaucuugaauucccacguguugugggagggaccuggugagagguaauugaaucaugggggcaggucuuuccugugcuguucucaugauggugaauacaucucacaagaucugaugguuucauaagggggaguuucccugcacaaguucuuuucucuugucugccaccaugugaggcgugccuuucaccuucugccaugauugugaggccuccccagccacguggaacuguaaauccaauaaaccucuuuccuuuguaaauugcccagucuuagguaugucuuagcagcaugaaaaugggcuaauacaguaaauugguaccaguagaguggggcacugcugaaaagauaccugaaaauguggaagcagcuuuggacccggguaacaggcagagguuggaacaguuuggaaggcuuggaagaagacagaaaaugugggaaaguuuggaacuuucuagacacuuguugaaugacuuugacaaaaaugcugauagcaguauguacaacaagguccaggcugagguggucucagauggagaugaggaacuuguugggaacuggagcaaaggucacucuuguuauguuuuagcaaagagacugguggcauuuugccccugcccuagugauuccuggaacuuugaacuugagagagaugauuuaggguaucuggaggaagaaauuucuaagcagcaaagcauucaagaacauguggaacuguaaguccaauaaaccucuuucuuuuguaaauugcccagucucagguaugucuuuagucuuuuaucagcagugugaaaacagacuaauacaguuaccauugggagaaacugggugaauuauacaugggaacucucuauauuauuuucuugcaacuuacugugaaucuacaauuaucucaaaauaaaaaguuuaauuuaauaauugcugaguaagugggccucugcagaaucaccaaaucaggaguuucaucaauaagucuuaauucucuccagcaagaacuagugcaguuuuccuagacuccacuucauuugcuaauagaguucuuuagaaucucuaaagauuugaacaucaucaugaaccaucuaacucagcugggaaagaaaaucauauaccaguauuuuuguugguccacacauuuuaggaaacuaaaauguaugcuguuuuauggcacagacuguguagguuguguacucuuagggcuuaucacaaggucuuagcuugugauauguuagauuucaguaaauacauguuagauggcuggaugaauggaugaaacuagugauguucuaguaaauauuugacaacuagcucuccagaagaagaaagaagugcucauuuguaucauuugcugauuucucugguguaaauacuccucuauggccaauuucaggcuacuaaaaugacaugucuaaacacgggguugggaagagauguauccauuacccuucauaagcuaguauaagcugacuccagcacaccacuggauggaguugaguuagauagcaugcgauguuaaccgccuuuauuuucugaugccaaccuuguguuauuaaaauuacaaagaaaaucugggcuuugaguuacugccuaaucccuucucauuaaaagugugagagauccauugagaaucaguaguugucucaaagcaaacccauggccuucaccuagagaagaaaauuaaaaagaauaugccuuauuauuauugaauacaaaccuuuuuguguucauguggagcacugagaaaggcaugaauuacaguaacuugccaguguccaacucaugguggaagcaggcugauuuuuuccaguuuagccucuuaauuucuucuugagggugauuggcuuaugggagauguacugacaaggacauaucacauaaagcuuuauuuuuuaaggagucugaaaggaaaaaaaaaccuaauuaguuuuguacuguagucuuguuucuuaguauuaaagaaucauuucugacaucugauuaaucacacuuacuccugcuuguuuucaaucuuguuggauguuuccaaaaacuaucucauagacaguauuuucuccucacacuaucuugcagcugcaauauaaucuacacucaaagcuuguguugcaacaugcaugcccuugggccacaaucucugcuugcuuuggcaugguuuauuuauuccaaagacaucuaugccuuuagguugcuauagagauuucaagugaacuaaacuguucaagaaaaccucagggaagccuguuuaguuucuucuaaaacucaaggcgauuaguaggcccagauauucuuaaaauguguacugcaagcaaaggaaccucugcgaaaaguggguugaugaccuuaguuauagaggguuucaaggagaagguaauuuuaauagcagcaaaaaagcugaguagagcgaagugaauuucuuuguaaaggugcuuauaagagaacaccugggguauugauuaacauauuaacaacugccucuuuggaguauuggauuguagcugcuuaguaucaauaaguuuacaaaaacuagccaaagcauuauauaguucaggguuauugcuuacaccaauuucagacauuaagcaugagugaauguuuuucuuucugcuuuucuguuucuauauuuucuucaacaugcacuauuuuaugauuaaaauuauaugugaguagaaaacgaggcaguguuauugauuauauaguaaauuuugaauuauucuuauuuguuuagcaacuauuaugcagucuagaagugaagagguuaaacuaaaccagaguguagaggagggaacauggaguuccuuauauuuuacauaauuuuaacacugguggccauguguuucucgguguccuuagaauugagaaugaacaaugaauacuuuaaugggugaaaucaaauaaacuguuauuauaagauauuuauuaauuaaccaaguuaauuacaagucuuugaaagaugacagauuugugaggcaucuuuagaacaaaggucaaauucuuuaagccuccauuaauuccugggaccucaacguaauguuauauaugauagcacucacuggaauggguguagaaggucaaauuuuaggaaauucuggcauggacuuuuauuguggaaaguagcuuaaccucuguauggugugguuuccuuauuuaaaacuaagagucacgcgccggguucaguggcucacgccuauaaucccagcacuuugggaggcugaggugggcagaucaccugaggucaggaguucaagacgagccuggccaguguguugaaacccccucucuacuaaaaauacaaaaauuagccaagcauggugacgcaugccuguaaucccagcuacuccggaggcugaggcaggagaauugcuugaauccaggaggcaaagguugcaaugagccgagauugugccacugcacuccagccugggucacagagcgagacucagucacaaaaaauaaaaaauaaaaauaagagucagacuggauaacgguaauguccuucuaacucuaauauucugugauacagaagucagcuaagugugguaguaauuaauuaguaauagaaaauuuguuuccaaacaauauaaaggauccacauauuucaaaauaucaguaacauaguuuaggaaauuguauuaacuaaagucucuuuuaauuggagauaacugaagcuaaauuaagcuugcuuugaucccaaagggaguuuauaguaaggcuucugugaccccaggaaaggacaggggugcagcuagacaccaggaaauagcagcaaugacuggaaggaaccagauugccccuuucuggguguucguaucauuauucccaucugaagaaugacuuccugcacacagcagggaaccuggccauugagaguucauguuugacccuugcugcuuuggaacucaaggaauuuucauuacucucuucugccccacauuaaaaaaaaauauuggagaagggugccuguuggccgaguuuggaugaggugccuacccuuggaucaguuacugugaacagggaagcgagucacauaagauaaagacccacuagaauaauauaacugguauuauuaauagaagaaguagcauauucuagaaggaaagaguauauuuaccaaaacaagagaaggaguaguaauuggacaaggaaauaguaaaguucacuaaacuuuuuuuuuaauugcuaaaugaaaucaucacuuacuguuucuuacauacgcaguaaacuacacuaaugaauuauugcuugguagauguggccauaguugcacuaauacaugcuggaauuuaccuggcuuuuaauggauacucgguaaaugguagcuauuauuuuuauaaucuagccaagagaucgguguugaucauaauucuuaucuauaauuuuuaugaucuaaugaagagauaggugcugcugaaaaucucaaaagaugcaaucccaaaugccauaauucugaaugucaaaaucccaaaaggucaaaaucccuaaacuguaaaaucccuaacaucuaaaaaucccaaaaaucacaauugcaagagauuaaaaucccaaauguuaaaauccugacaucuaaauucuggggaauaaaauagugugaguuuucggcuauaugcaggauaguuacaucauguugguuaccucauguugggcugaacuauuaccuuguuauugucuuuauuuggaaauuaacuauggcauaaggauguggguuugggugccaaguugacaaggaguggacuuguggacugaauuuuaggcaucaauuugcuaaauuaaggaauacauggaaaccuguuaaagcaugauuugggguguguaugugaggguauuuccauaggagauuagugugagugagucggaguggaccagguggggaggaucugcccucaaugcuggcaggcaccauccaguugguugggggccuggagagaacaaauacagaaggccucucucuuugagagcuggggcagacuuuucuccuguugucauggccagaacauuaggcucaccagccuuuggaccccagggcuuucaccaguggcccccccaaggccugaggauuuugacuuaaaacugagaguuauaccauuagcuucccugguucugagaccuuuggacuugggacugaaccaggcuaucagcaucccaagagucuccaguuuucagacagccugucaugggacuucucaaccaccauaauccuaugggccaauuccccuaauaaauaucuucucauaugcauaugcuauugguuccaucucccuggagaacccugacugauacagauuugguauggagaagcugaauaucauuccuucuuacuguauuucuuauaacaaaauguaagagauauaugaaauuauucucuugaauaaaagucugugauaagcguacgaggcucucuuaauggugaaagauaaaaguuuaaaagcuaauuauuauuggugcugcaaaagcagaaaaucacuuaauuacaauggccaagcaauaaccaaacuuucaguuggacagcauauacauagaaaauuugcagaccacaaccacucuccaaauguaaaugcagugaguuuugaagaucauggaagaagugaaaacacaagugaaaaacacaaaaaaucuccccugcuauaauaagguuuaguucucuguccccauccaaaucucaucucaaauuguaauccccaugugucgagggagggacgugauuggaugauggggcaguuucccccauguauucuugugauagugaguucucaugagaucugaugguuuuauaagcaucugggauuuccccugcuggcacuucucucucuugccgucaugcaaagaagguccuugcuuccccuucaucuuccaccaugacucuaaguuuccugagaccuccucagccauguggaacuguggaucuuuccuuuauaaauuacccagucuccguuauuucuuuauaguggugugaaaacugcugauucuuuauagcaguguauuuaccaauacaauaaauugguaccacagagagugggguacugccacuacccaaaaauguagaagcaacuuuggaacuggguaacaggcagagguuggaacaguuuggaaugcucagaagaagacaggaaaaugugggaaaguuuggcacuugcuagagauuuguugaaugguuuugagcaaaaugcugauacugauguggacaaugaaguccaggcugaggugaucucagauggagaugaggaacuuacugggaacuggagcaaaggucacucuugcugugcuuuaacaaaaauacuggcagcauuuugccccuguccuagagagaccuguguaacuuugaacuugagagagaugauuuaggguaucugguggaagaaauuucugagcagcaaagcauucaagaggugacagaucauaaaaguuuggaaaaugugcagccugacaaugugauagaaaagagaaaccuauuuucuggggagaaauucaagccugcuguagaaauuuacauagguaaugaggagccgaauguuaauagccaugaaaugggggaaaugucuccaggacaugucagagaccuucacgggagccccucucaucacaggcccagaggccuaggagggaaaaugguuuucugagccagguccaggacccccugcugugugcagccuaggcacuuggugcccugugucccaguugcucuaguuauggcuaaaaagggccaagguacaccacaggccaugguuucagagggugcaagccccaagccuuggcagcuuccauuugguguugagccugcaggugcacagaagucaagaauugagguuugagaaccuccaccuagauuucagagaauguaugaaaacaccuggaugucuggaauguaaggaaaugcuugcugcaggggugggacccucauggagaaccucugcuagggcaguguggaagggaaaugugggguuggagcccccaccagaguccccacugggacacugccaaguggagcugugagaagagagccacuuuccuccagaccccagaaugguagauccaccaacagcuggcaccgugcaccuagaaaagcugcagacacucaaugccagcccaugaaagcaaccaggaggaagguuguacccugcaaagccacaggggcagagcugccuaaaaccauggcaacccaccucuugcaucagcaugcgcugaauaugagauauggagucaaaagagguuauuuaggagcuuuaagauuuaauaacugccccacuggauuuuggacuuacauggggccuauagccccuguguuuuggccagcuucucccauuuggaaugggagcauuuauccaaucuguacccucauuguaccuugcaaggaacuaacuugcuuuugauaggcugauagguggaaaggacuugccuugucuuagaugagacuuuggacuuggacauugaguuaaugcuugaaugacuuaagacuuuggaggacuguugggaaggcaugauugguuuggaaauguauaagggacgugagauuugagaggggccagggcagaauaauaugguuuggcuaugucccuacccaaaucucaucuugaauuauaauacccacauguugagguagggaccuguaauccccacaugucaagggagggaggugauuagauaaugggaccaguuucccccaugcuguucucgugacagugaguggguucucaugagaucugaugguuuuauaagcaucuggcauuuccucugcuugcacuucagucuccugccaccaugugaagaagguccuuacuuccccuucaccuuucaccaugauuguaaguuugcugaggccuccccagucauguggaacugugaguuaauuaaaccucuuuccuuuauaaauuaccuagucucagauauuucuuuguaacaguaugaaaaugaaguaauacaccugccaaacuauucagucacuuaugacuucugccccuucacacauaguaucaauuugcuaugugauguauuucauuuucacaucauguccaauacuggagguauaaauugugucaagauuuuuagagacaucuaauucauuuuaugcuuuuuuuuggccaauuugacuucacaaaagugcauuaucacaacauuggguauaagcauugugcgcauauguagaaauauugaaacuuccucaguaaaugaagauguccuuuuguacaccugcauuuguuaaagauaaaauuucuuuagaucuugguucuuugggcaacugcauauaugguggugacccauugaaguuuauuaacagaucucaucaaaagacuuagguuaucuaucaagguauuucagaugccacaguuauaaagcuggguguacacaauuaccaaccacagugacuuuguuuauacauuuugccuuuugaccuauuuaugaauaugauuugucuucucauaacuuuuacacccaugugaccauuguuaguauaccugaguguuuaugcuuacaaauaucuguauauuaguucuugccuauuuuauuguguaaaguggccuacaacauauuuuaucauguuuuuagauguuucucaaaucuccuuuucaaaaauguaaauaaaugucucaaggaauuuuuauuaaguuauuuuuucagaauuauauuuucaagauuuugaucucucaggauugugauuuccaggauuuuagauguuagggauuaugauuuuuggggauuucaguguucaggauuauaguguuuaggauugugucuuucaggauuauggcccaaacccccaaaaagguuaaauuuauaguuagaauuuuuagugccaguuauuugagagcaccacaaaugucugugacacaaagaaauuuaccuuuuaaccaauuguacuaguucuuuccugcucuauaacaaaauagcugagacugggguaaguuguaaaaacagaaacuuauuucucacaguucugaaggcugagaagucuaagaucaaggugucggcauuugguaucuggugaagcugcucucugcuuccauaauagcaccuucuugcuguguccucauguaguggaagaguggaagggcaagagggccucuguaauuccuugcagcccuuguauaaggguacugguacaguuuggaucugugucuccacccaaaucucauguugaauuguaguccccaguguugaagguggggccuggugggaggugacuggaucauggggguggauuuuucaugaaugguuuagcaccaucucccuuggugcuguccucgugauagugaaugaguucuugugagaucuggugauuugaaagugugcagcaguucccugcucgcucucuugcuucugcuguggccaugugacaugccugcuuccacuucaccuucugccaugauuauaaguuuccucugcagaaaccaagcagaugccagcaucauguuuccuguacagccugcaggaccuaugacucuuuucuuuauaaaugaaaccucuuuucuuuacaaauuacccagacucagguuuuguuuuuuguuuuuugguuuuuuuuuuuuuuuuuuuugagauggagucucgcucugucaccaggcuggaguacagugacacaaucucggcucacugcaaccucugccuccuggguucaagcaauucuccugccucagccuccugaguagcugggacuacaggcguaugccaccacacccagccaauuuuuguauuuuuaguagagacaggguuucaccauguuggccaggauggucucgaucucuugaccucgugauccacccgccucagccucccaaaguguugggauuacaggugugagccaccgugcccggccagguauuucuuuauagcaaugcaagaacagacuaauacaggugcuuaucccauccaugagaauucagccucauuaaucaaaauaucacacuggaucuuagguuccaaucugugaauuuuggagacaccuguacauucaaaacauaguaccaaguguauuauuuauuacuggauaacaaauuuccacaaauuuagcagcuuaaaacaauacaaacuuauucucucguaguaucugugggucaggaauaggggcacagcuuagcugggucaacugcucaucagggucuuucucaugggccuaaaguuaaagugucagccagggcuggaugcaaugguucaugccuauaaucucagcacuuugggaggcaggggcaagaggaucacuugaagccaggcauucaagacagccugaguaacauaguaagauccccaucucuacaaaauguauuuuuuuaauuagcuggguguggugguaugcaucuguggucagcuacuugggaggcuaagaugggaggacugauggaaaccaggagguugaggcugcaguaagccaugaucagaccacugcacuccagucugggaaacagagcaagauccugucccaaaaauaaaauacagugucagccagggcuggaguaucaucuggaagcucaaguggggagggauccucucccaagcucacuuaugugguuguuggcaggauccacuuccuuuuggguuguuggucugagggccuuaauuccuagcugcuauugacuagaguuagaccucuccucagucucuuguuaugugggccuccccaccaugacaacgucaucagagccagcaagguggaaccccagucuguauagccuaauuaugaaggugacacaucgucaccuuugccauauucucuugguuacaaacaagucguagguccugccacacuaguaaagaggguauuaaaaaggguaugaacuguaggaggugagaucauuggggggcaucuuaaagucuguuugccacaccaaaauguugauuuaaauauuacucacccaguccaaagcuuguaugcaggugugagauauuuugcuaguggaaaaaaaaaaaaaaggcccuggaaaaaaaagcucaggcuuaacuauaauguuacucuaggguccaucaaaagucuacaaagcugaacauucuaguuaacugcucaggugcccacagucccuaaucagucacauuaaaagcuguugugcucauguuucuacuccuugcauuccuaguauagugucuuauucaugauagauacuaagugcugaauggaugaauguuuuuuaaaucuaguguuucuaugugaugggaagcaguauaguguaccaguucagagcaugaacuuuggagucagaaaaaccugggaucacaugcuuccuuugccacuuacuugcuauauaaccuuuggcaaguuacucaaauucuguaaggcucaguuucuuucucuguaaaauggggauaauacuaccauauuuuauuacaucuaaggcacuauguauuuuaagauacagcauuauuuucuguguaauucauaaagaaaaauaaugcugccaauuaaacugugauauaacuugauugauuauaaaaugcaccugauuucaaacauauuaaaauaugaaaaaaguguaugcuuuagaauugauaaaaugcaaggaugccuaccuuaugugguuuugauaaaguuuaaaugagauagcacacguaagacaguauauguagcuuucaucuaguaagagccuaauaaguauuagcuauuuuauuauuagcgauuaugguccucuucuugcaaacucuuaaaaugagucaguauauuuugcuuucuuuucuaauauuugaaacugaguuauagaacagaucuacaaaaccauuguugguuuuuuucaaagaaggagggagguauuaacaaaauggcugucucagaccagaugauauauaaugaccuguaguucugugcaaaaugcuuaauaagggugacacuugacaaaggccuuuuuguggaaagugugcuucccacacuucaucagucucuuaagugaagguagaauaaaggcccaaauuaugcuuaguaauucaacagguugagagccagcuuuuaaugcaccucugcuccgcuugccgguuccugugauaacugauaauuuggugacuagcugagccuuugcuccacagugaacugaaggaagcccuuuauacuugagacuggaaauacuuccgaugacagugaagauguauuugaagcaaugugauauugauacaaauugcuccaaaggcacagcuauaauacaacaccauaguaggccaaagucuggacaaugaguguaucuguuaaauuggccauagguauaagaaagaaagcccagugcccuucaauuacagucaugugucacuuaacuauggggauaggcauucugagaaaugcgucauuaggcaauuuugucauugugcaagcaucauagaauacuuaacacaaaccuugaugguagaggcuacuauacaccuaggcuauauggucuagccuguugcucccaggcuacaaacuuguacagcguguuauuguacggaauacugcaggcaauuguaacacaaugguauuuguguauuuaaaucuaucuaaacauuaaaaagguacgguaaaaauauaaaggauuaaaaaugguauaccuguguagggcauuuaccaugaguggagcuugcaggaccgggggcugugcugggugagucagugagugaguggugagugaagugaagggcuaggaccuuauuguacacuacuggagacucuauaaacacuguacacuuaggcuacaccaaauuuauuuuuuaaaauuucuucagcaauauauuaaccuuagcuuacugugacuuuuuuaguuuauaaacauuuaagguuuuuuuuuuuaacuuuuugacucuuuuaauaacacuuagcuuaaaacacagauacauuauauagcuacacaaaauauuuucuuuacguccuuauucuauaagcuuccauuuuuaaaauuuuuaauuuuuuacauuuuaaaccuuuuugcugaaaacuaagacauaaauacacacauuagccugggccuauacaaggucaggauuaucaauaucacugucuuccaccuccacaucuuguucuacuggaagguguucaggggcaauaacaugcauggagcugucaucuccuaugauaacaaugccuucuucugaaauaccucuaaaggaccugccucaggcuguuuuaugguuaacuuuuauuuuuaccuaaguagaaggacuguacucugaaacaacaauaaaaaguacaguaugguaaguacuagucaauaggaauuuuucagcucuauuauaaucuuacaagaccaccaugguacaugacugcauauggaaggacagcuggccacucaugugucuccuuggccaccuugagagacuucauaauacuugccccuuugcacacucuucuugcugccuaauugcccgugugccuagcuggacuguaagcucgcagagggcagugacuguguguccugcucgccauuuuuucugcaguuaacuagcacucagaagguuaaaucaucacuuggugaaugcaugaacacuguuuaaccucagguaaagaagugaauuacauaugaugaugccagacuuuaucaaaauucaaauaauaaucauuuuuuaugcagugcauauucaccaaaauuaugcauuguggucuaccauuaauaagacauguucuuuagguuguuaaaccaagugaguuucugaaaaauagguauugugacaacuagaagugcauauacagaaauuguuccaaacaaccuguuccucaguuuuacaccauauuauggggcaguauaugaaccucuucauuuucaaacacauaaacacagugggucccuuaagcuuauagucucaacuaccuagucuguaaaauggaaaugauaacaauaccuccucaugggguugaugugaagauaagaugaaauuguaucuuuuaaauaauaauaucccugguacauaaucaguaaugaaugaguaguaaauaacaauaucauuguuuccauuguaguggaaacuuguguguucacagaucugggugccaggaaacuuugguuuucuuagagggagugagauacugcucuuggauaugucugucuugauaucuaaaagacuuggguuucuggugcagcgacauguguucuuugaugggcucugaugauacuauagcucuucagcuacauuuuuuuuuuuuugagacgaggucucccucuguuacacaggcuggagugcaguggcgugaucacuucucacugcagccuugcucucccaggcuaaagccauccuuccuucucagccucccacguagcugggacugcagauguguaccagcacacucagcugauuuauugauuuuuuuuuuuaagagauggggucuugaguguugcccaggcugguacugaacuucugaguucaagugauccucccuccguggccucccaaagugcuggaauuacagaugugagccacugcagcuggccuucagcuacauuuggcuacaacacgaacugcuguuuggggguacuguuguuugugcauugcuuaccuaaacuauucaguguccugggacugaguuuuggaaaaugguaaagcccagucaugugaagccaugguucucaagccuggcugcacgcugaaaucaccaggggaggcagggaagcaccauagaugccuggauucuaccuagaacucaguacuuggaauaguuccgauugaaccuggaugagcaguauugagaaccagagauuuagagacacugggaaucacuguuucucaguagucaugucuguuuuccucagcuggaccauucuguucuguuuuuuggguuuuuuguuuguuuguuuguuuuugagauggagucucacucagucacccaggcuggagugcaguggcacgaucucggcucacugcuaucuccaccucccaggcucaagcaauucuccugccucaaccuccugaguagcugggauuacaggcacccaccaccacacguggcuaauuuaguagagacaggguuucacccuguuggccaggcuggucuugaacuccugaccucaugaucugcccgucuuggccucccaaagugcugggauuacaggugugagcuacugugccaggcccuguuuuuucuuuuuaaguguuuuauuugcuuuggguuucaauagauccuggauauauccuggaaguugagugcaugcaaaucuuaagccauggugggaagggacacuguggaaggagugacacaauugagugccuucuugguacuagaccuaugaugaacuuuuacccuauuaucuucugcuaauuguuguuaauuuuuuacuaauuuacuauauuggucagaguagucuaggucugccauggugacaagcagccccaaaucucaguagacuuaaacagcaaagucucuuaaacagucgaagucuuuaauauauuucuggcuuaugcuucaugcccauccacaggauucagguaaauguagcgaagaagagaacacagagaacugagcaccagcguuagagaagcaacacaugucacuucugcucacuuuccacugacccaggcagaucauggggucaugccuaacugcaggggagcagggcuuacaaucuacccuaggccuggaaggaggaggccuugugaacagucuuuaagaccugagcaaugagaaugguuuuuuguuuggcagcaagucaguuucuuuuugcauuuauccauuuaugaaauccuaaacuggaauagguauuauauggaacuauucugggcuuucagaaguguucauauuucaugucaaguggaguuaauuugcauacauacauaucauuucguaauuuuaagaaauuuuguggaggguuuucaaaagaaauuuaauacuuguuuuaauuuucuguuauaauuuuagcaggggaaaauggcugcaaagcugcagauauuuuuguucuuuccuuuucuauauuuguuggacuaguuagaggugacugcacauaccagugcggaggaaauacuuauccaaaccacuaaauggcuguccugcuugguguugcauuuaugggagauacuggcugucccguuaguauucuacauuucugagcagucagcaccaugacaagauauuaaacugaaagaaauguuaaaaauaguucagaaaauacaauuguaaggaaaaaaaaacagaagaaagucaggaaaggcccuuuagguuugggaguagacaggagagacguuuguuuugcucauuucugauagacaguggcauuccacaguucgaagccaagugaguaagacuggcagcugcuugcuuaggguguacacacuaaggucucugccugcaucacuucgccuggaagugaagagcccugaaauucccagacgcuagauguucauguagcaaaacagcaaaugcuagagagcaucucucauggggucugccuuugagggucggagaggccuagcuauuuggcacugcauauuuuuuccaucaacccuguagcugacuuugggcucuaacuuuucucagggguuacugcauguuuguggaagcugacagccccagcauggaugauauuacuuuaaacauuuuuaaaacauucuguccuuuucagauaaauuugcuucauugcuuccuucuuuauaaaauguccccuuagagaguaggacacauuuuacucguuagaauuggaaggggaaaaaagcauuccauucuuuagagccacauccaguguucacugcuuuugaagaaggagugauguuugacacagaaaugcaucaauggggaaggccacauuuaacuuuuguuguuugggcucagcacuggaaccaaaccaguuuuucuuguccccccuccuuuuuuuuuuuuguccaaguggcagaaagcccagaaauauaaguuugcauugccaagagauggcucuaaauauagugcuggugggcaggaagauuguuuccucaugaaugcaacuggugugugcuguauauuccuugcccuccuccagcaggaaggaagaguuuggcuuugcugcacugcaagccucaggcgcuccuggcuggaggaguuuagaaacaggagccugggcagguuugcuuugcacucucaucuccagccaagacgugcagaucaaacagucacuaccuagcuggcuguuuuauucuuuaggauuuaggaguauaaugaaacacauaacaguggccagcuuuuagagacuggaaagaaagcauuguguaugccuuguuuaaacacagauuguuuauaaaagguauaaaaaaacaucgcuuugccuuguguuugcuuggaaauacaagaggaguuggcuggcuacugucuaccagccagcuuugaaacaugaauacuuuuuacuuguucaccagggcagcauuuugcucuuuccuacugcaacugaaaggaaauggaacuggugggauuauuagacuggcuugaaaaugccaacuuuaaaagauuauuuuuuuggccaggcgcgguggcucaugccuguaaucccagcacuuugggaggccaaggcgggcagaucaccugaggucgggaguuugagaccagccugaccaacauggagaaacccuuucucuacuaaaaauacagaauuagccaggcgugguggcacaggccuguaauccuagccacuagggaggcugaugcuggagaaucacuugaacccgggagguggaaguugcagugagccaaaaucacaccauugcacuccagccugggcaacaagaacgaaacucuguuucguuuuuuuuuuuuuuaaguuuuuuuaaguuuacccccaaagcagagcaggcuagcauuauaaagagcuuggcucaaaaccuccuacuguucucuugcccucagcaauuaaauaaaauacacuuugaaaccucagcuuauaaaucagauugccccaaagggauggagagagcugguuugaucauuguauugguccaguuccuugauaaagguuuacuuuaucucacuuuguguuguuuuuuuuuuccuuuuuaucuuuuucccuugacagugcauauaaagugacaguuuugcagaucaauguugauuuggcuuuuaugguaaaagcuuauuaugccuaaggaaauacugcaaaguagugagugcauuuauauaaugaaaucaucuguguugaauguauuaacauugaauaauuaaacucagcccauaguugguucuaaaacccagugcugcuuaacaagagaccauuaacucaauaacaagcaauggguagaucucaucucagaauccugacuggggccaggcaugguggcucacaccuguaaucccagcacuuuuggagauggaggugggcggaucaccugaggucaggaguuugagaccagccuggccaacauggugaaaccccauuucuacuaaaaaaaauacacaaauuagcugggcgugguggugggcaccuguaaucccagcuacuugggaggcugagaaucgcuugaacccaggagguggagguugcagugagccaagaccgugccacugcacuccagcuugggcaacaagaacaaaacucugucucaaaaacaaacaaacaaaaaagaauccuggcugacuucaagucaugccacucacaccacuugaaggagagcaaaacagugauuuuugaugcugaaagaucacacuuuagcaucaagcaauuucaagaaucuuuacauguauguacuuuuagauuccauugauugggaaaaugcaaaggagaaacagcugcugggaauuaaugcuuguguaugaauuuuuauuuuacucauacuaucuuccauguacauuuggaaaauaauacaaauaugugguggguaaauagcagcaccugaaacagugcuugccucauauuagcauuugguaaauaguuuugacugaaaauuaaacauuguuccgucaagagacaguuguuaguguccaagcagacugacagaaacuucaggcccacagguuagaaaccaagauccagucuauuucucuuccucucuuccuuauagggcucuuguauugucacuguaaacaaacaccaggaaagaaccagcacgcuggcccagggagucauucuuuggucagggaagggcgcccuaagagugagaagucuuuccagugugauuauuuaugugauuucaagcugacaguugacuucuuccaccuugccucuuuucuaauaaauauguccagauauuaagauuugagugguuaaaaaaaagcaaaaguuuucucauuaacauuguuuuauuaaaacacaguuaucuacauugcaagaauaaacauuuucccacacaagaauuauuagagugauucguucauaaauauuuuuauuuuuccuaaacugauuuuuagucgaaaagauuuguuuaggaacagucaccccaagaugucuucagagauuccugaacucuucagcgcugugccauccaggacaguagccacacauggcuuuugagcaucugagaugaugcuagucagaacuggaaugugcuaaaaguuuaaaauaagguugggcucacaccuguaaucccagcacuuugggaggcugagguggguggaucaccugaggucaggcauucaagaccagccuggccaacauggugaaaccccgucucuacuaaaaauacaaaauuagccagaugugguggugcacaccuauaaucccagcuacucgggaggcugaggcaggagaauggcgugaacccaggaggcagagagugcagugagccgagaucgcaccauugcacuccagccugggcaacaagagcaaaacaacuucucaaaaaaagaaaaaaaaaaaaguuuaaaguacaugcuggauuuugaagaguuguaugaggaaaaggauauaaauuaucuugucaauuuuuaauauugauuucacauugaaauaacauauugcauauguuauacuaaauaagauauguuauuaaaauuaauuucuccuuuuuuuuuuaguguagcuaccaggaaauucagaauuacauaugugacuugcauuguguuuuuauugaguagcguuguguuacaguuugaggagaucccaccccuccgagucagagugagaaaucauagcuggcccccaauugcacacaaguuggcagucauugccuguggugccaacccuguuccauguugcagcugccuggggggaugugugaggacugugagaccauaccuuggcugagcaggcaggaauauccugaacuccuggccugauaccacuugcccauccaggaggaguucuugauuagccuaagggauaguuaacuagaagcuuccaggacacaggacuaaguucaagcugaaguuaaggugauucugugagaaggcaaacaccuuacacaguguaggugaggggagauucacgcaccuggaaccacccaggcuggccgaauuaagccuaagucaccucugguaaagagggaaggaggguccaucccugguucaguuacugacaccauagguguagaucacaggugccuauguccugcugcucuccacagggacacuuuuccuuggaagagauuuaccaaaugcuaauugaguguuuguuaaauguuuacuaugggccaagcccuggguuuuucucuaugcauuaaaagugugaguaaaggggaaaaaagggcuucugucaugaguggcacacauaggacaacucaauuucucuucaugcagaauaaacaucaagagauuuuggaagcguaauuuuugguaguugggcagcuggugaucacuggugccagcacccuuacuccuugucuaaaucagagguugcagcucuggucauguuauauuagaugauuccgcacucuaaaccuccguaguagauccugccccaccucagggcuaugugguaggauauaugcuguuuccacauuaugcgacugcaugcuaucuuacugguuuaaaugguguaggugaccauaacacaauggcaagcauccuguguauacaaguacagaaaagauacaguaaaaaucacuauaaaagacaaaaaguggggcgaggugcaggggcucacaccuguaauuccaacacuuugggaggcugaggcaggaguaucucuugaggucaggaauucaagaccaaccuggucaacauagugagaccccaucucuacgaauaaaagaguaaauaaagggcuccugaucuacuagggaggugaaggcuguuggucauuugcagguaguuaaaauuauauaguaguuaggaaguagauggggccauuccguugugggcacaggggcugaacucacaucacaccucacucauuaguagaugacuguagauaucaaauugcuuuaaaccaguuucugcuucuucacugcugaauccccagcaccaggaaaaaugauuggaaccauuaguugcuaaauaaguauuuguuaaaugaaccaggguuugaauggaauuucugcguuucuccuacuccccagaaaaaagggccugaccaugucucucagaggcggccuagaagcuggagaacaugucucagaacuaguaacuuccuucuucucucccuuccucguuuuuuaacuuccuuccaaauuuuggugucuuuccgacucuaagccaaguuccccucaccaaucuuucuguuucuagaacuuuuuccuauucuuuuccuuggguucgucccacccaagaauaaguugcuuucacucuugcuauuugcuacagcaaugcccauuccccuaccauuuccacuagucuaaaauauggauuuuacacagugguuuaaaaaaagaacgacguugcuaauacguugguuugggccuagggggaucuucugagauccuuccgggcagaggaagaacucuuaaagucauauuugaaggcacugaugcuggagcugagaggacuggaugauggccuuaacucagaugccauggcaccagguagcugccuccuacuguuggucaguuucucccuucaaggaacaaaaacuuccccauucucacuucaccagacacauuucuucuguuuacaugaggcucucaagcauacuuaggcuggagaagaggguuccauuagacuuugcauggugcccacuuuuauuagauauaccaaugauuuuguucugguuauauacuugccauuauuuugggaaugggcauuucuacaucacaaucucuuuucuucugacaauccaggaaacaucucugacaucugacuauaaaacagauguuucugaagauggaguauagccuucacauaaagccuugccguuuguaggagaauugcuguaucuaacaacuguugcaacuucccaagaggaaaaugaagugcuuuaaacauuuuuucaugguggcucacaccuguaauccuggcacuuugggaggccgaggugggcagaucacgaggucaggagaucaggaccauccuggccaacaaggugaaacccugucucuacuaaaauacaaaaaauuagccaggugugguggcaugcaccuguagucccagcuagucaggaugcugaagcaggggaaucgcuugaaucggggagguggagguuguagugagccgagauagcaccacugcacuccagccuggcgaccgagcgagacuccgucucaaaaaaacaaacaaacaaaaaaaccauuuuuucaaaaaucuacuuaaaugguucagaguucuugugguuggaguggcuuucaucauaauugcugaugcaauuauaaggucuucauucagccugaguguacaccauggaaugaggaugugcugaauguagucuguauuucucuaaugacauccuucauccaaguuuauuuuaaugccacaguauuuggaaagaguaauuuacuaagcccuuguccccagucccacucccuacuuccauuuuucagagguuuguguagcauauaaaauaaaagagcaaaugcaaaucaaaagucuuccagcagagcuagcguuuccuguacugcuuuguaguucuggcuauuuaugguauaaacuauauucaagucccauaaacagggcuuuucaauuagcuugaaaaaaauuauuaaauguuugguggguaccagaauagcaagauucgugguuauuuggaaggcuuguuuuaugcuuugaggccacuguggccuaccacagagcuacaccgcagaccgugaauuuagcaaaucccaggaacuugccuggaagucagaauuggucccauaugauuaaaaacaauuuauucaaguacccaguuucuucaagcagaaagcuagaagcauugggaucgaggaagcagauguggaaaguccagaugaagcacauauucggaagacagcauguugucaaagacaguauaaacuggauucaggacuacaccaugauuuuccaguuuaauacuauugccuuuaaaauagaaauagugcugcuuuauauuaugaaggacuuuauggacugauugauguguacuuucccaacuauauuuucauuucaccuuauuaauaaugugaauugugaggaccuuuugccugguuuacucugcagacugcauuuaaaugccuuucuccaagaagccuucuuugacucacuccugagaccaaucuccauggcacccaggacugaguuugcuauugcccguaacaauggguccugaucccucucacagcaccugaauuugcgugauuauuugucugcugcccccauuggacuuguaaaaguacuugaaaacguagguucuaucuaguugguucuugugcugccaaacuuaguguaauacccagcaugucauaggugcugaauuuacuugaacuguuggaggcaaaaaugagguucagaaaacuuaaacaucuugcccaaggugcuagaaugugaaccccauaagaguaaagccucaaacuaucacauucaguacaauauccccaauaucuagaagagugcuuugcacagaguagguccgaaaaagguugaaucagugaauacaauggguaauagaccaggacauaaacccaggucugcccuauuaaaacccuguacuuuuuuauauuacauccaaaaauauauacugugcuuucucuucagaugguauaaaucuuucgccuuuuauuauacauucaaaacauaaaaggcgauugaaccuauuuaauaagcuccucccacaugcccaacccuguguaagcaacuuucuuguuuaugauuuuauuuaaucuuuccaacagugcuggaaacauuguaugagguuacacuucgcuuggguaaauaccugaaagcauaaaguagacauuuguuuaauuuuauaagaagcugucaguuucccaaagugauuaaagugauuguuccauuuuacaaucuucacaacaaucaugagaaagucugaguugugagaaaguccgagcugucccaggaaauuaaaucuacuuucccuugacagaaauauauuuaaucaguuaagaguaguugagacgauuuugauguuuuccuuaucuuuccaaagggccugcuuguuccuguuuuguacacacugucuuuagagucugcuugguucugagcucguguuugacuucauuuugaaguacaaaguuuuugcagcuguaaucugauauguggaauuuggucaugcucaugugcauuuacugguauuuuaagauaugaaaguucuuccaaaauuauagaaagaggaauugcagaggaauauuuuuaauagacacauucauauauaguaauccccuugugauaugcauguuuucuagcaaaguugauuguacauuuuauagaguauucuauuauuuacaaguuuaagguauaucacuuacuuaaaacuuugguugagguagguggcaagucuauuaagauacugggcauuauccauacauaaugguauuucuccugaagaugucauuucccccucauaguuaaauuuccccucagagcauuuuucuaguccuggaacuuagcugcauaauugccacagcccuaccaaccaaaacugcagaauuucucccugugcuugggaauuccgugaaauuucucuaucuugacuaucuauaaagcuuaauauagccaacgauaacauugcagaaguagggacugccaucaaaaauacaaugugacauggcuuuaaaauuccauaggagcccaaaaagaaguaaaacuauuuagcuccugaauuaugaauuuggaaauuugaaauguuuauaucaaauauauugagacacugauaccuauauuuacagcgaaacuaaggaaaaagaaugcugcaggagguuguaggaauagaagaaauggguguccucuuaaagcacacaguuuuuauucuaaacuuaaacauuuuaaaaguugaucauucaaauuguaaauguuuuucuuaauuauugaccacagauuuuuuaaaguacaguuuuuaaugcauacaagugucauuucuguuuguuuuguauuacuuucauuuucucauagcaauuuacuacuacaagggaauaaguaaaaauuuagguacuuaugagcuuugaggaucaguaaaaaauaaagauauaucuguuugucuucuaguuuaaaccacauaauuagcuacuugaauguuuaauauugguuaguucaugugugucuccucauuacuucuggccuccccaaugguaaaagggaugguccauuaguuaagcacauuauuuugagcaaagaucacccguucccuggcucugugcauaaauaaaagcguauuugugccaguugagugcccuugugaauugugaugaagaugucaugcacuaauuugcagccagauuagauuaugacaaacuuagcagggaugacacgauuuuuugaauggauauuugaaauuuuucaugauuugaaagucccugagcccuuuauuuucaugaaugauuauacucugcaacaagggagacuauauuuaaugaugugauuagcaguuugugacauauuucauuuuguguucucauguaauugaguuauuuucaaauaguaccuuggggagaugaauuaacuauuuuagugcccuaggauuuaguuuaaugaaguacuucucucaauguuacuucaauguucuagaacagugccauccaaauauauauauauaaaauguugugagacacauguuaaguuuuccaguagccacauuuuuaaaaacugaaaagaaauaggugauauuaauuuuaauaauauaaauuuaaccaccgugucuaaaauguuauuucaauauguaaucaguauuuuaaaaauauuaaugauguaguuuagauucuuuuuuuaaauacaucuuagaaaucugguguuuauuuuaaacucacaguacaucucaauucagacuagccacguuucaagucuagaaagaucucccugucuugcagucuggaauccucacacuggguuuugcuaugaaaauuacuaaguuuuguuuuuucuuagagucacauuucacuaucuuuaagucuugagaucauuggaaagggaaguuuugaucauuacaaaagccagcacuuacugaaccauccacugugugaagcauguuacaccuauucauuaucuaauuuaauuuucacagggacccuaugaaguuagacaucucuaucucuauguuacacaugaggaaauugaggcacagagauugaacuguuugaggucacauuggguaguaagaggcacagucaggauucuaaucuagguuugcugggcccacccccagcucucugcugagaaaggaauggagacuccaggcaugcugguugcugagcuaccaggagccuuuccagaucagcgagaauggagggugugccgagcggcagcagccaggagagccacugcucucagcgcugaagcccaccugcuucucugaacauccuaggcaugugauucucucucuccagacaacauuuaguuuauauuuauuuauuuaucauuacauguggagauguuuacccacuauuaguuuauauuuauuuauuuaucguuacauguggagauguuuacccacuaaguucauacaaacacauccuuaagcauguuuauaaauaugccugaguaccuaugccucauauuguugugaugaauaaccccuuaaccuuugcacugauaagaacguguuaaugucauucaaacauauuuuuaauguggaguuguuuuuuuuuuauuuuaauaggagauuuuuuuuuuuuuuuuuuuuuuuuugcaguugcaagauguaauagagugaaaacagagcucccauacaaagggaggggacccaaaguggguagccauugccagcucaaaugccuggguuuauaucccgaucauuguuccuuccccugugcucucaggcaggcgauagauguuuggcuauuucuuuaccuccuguuuuugccuaauuagcauuuuagugagcucucuuuacuacuugauugguugggugugagcuaaguugcaagcccuguguuuaaagguggaugcgucaccuucccagcuaggcuuggggauucuuagucggccuaggaaauccagcuagucuugucucucgguaccuccucucaacaggaaaacccaagugcucuuggggagguuggccgacaaccgcucuaacugcuuccugcugaauuggaguguaguaggggucaugcagggguccuugggaggggugccuucgaugucaucaacauuggagcauggucuagcaggcugguccagggguccucgguagaucuuagucauggacugcaucuggggcuccauuugaagaacgauuuguaguuuuacaccuuugauucuggaagagacaaacuuaacaaggagguuaaagauacagggauucaaauguauucaaauaauacccugcagugcaggggauuauuucuuuggcacacgucacaggccuugacuaucugcuugauaguuuugaaaaggccugguccaguaaauaaugauuuggccaucugaugggugcuaucaaugccuaagugaaagguguggugaaggguuuuaaguaauuuccauugguuagcugcaggcaaaaguauuuuuccuucuuucguggcuagccauccugaggggaggaaacuauguccucgugagguuccccauucgauuucuucugcugaguauuggggcuugguuuccuggaggggguuaccccauaagagggguccuucuauaagcauuucuaauggagggucccgccuugcagcucuuuuggcuucaauauccgcuuggcgguucccuucuauuucccuuuccuuuccuuucugaugaccccggcaguguaagacugccaccucuuuagguuucuguagagccaauaauaaucuccuaauggcuuccugauguuugauagguguucucggaaguuagaaauucccuuucucuccauauugcugugugggcauggaggacuagguaagcauacuuagagucuguauauauauuuaccauuuuuccuuuuccuaauucugaugcccgagugagggcuauuaguuuugccagcugaaugcuaguucuuggagugaggggauuacuuucaaguauucuauuaucacugaccacugcauacuccacuuuuugaaguccuuuuuucacaaaggaacuuccaucaguauacaaguugagguugggaucagucaagggaaccucuagaagguccccucgagcggcguagguuugagcaaucaccuguugacaguuauguucuaucuuuucuucauugucuggaagaaacguggcuggguuaagaguugcacaagugcgcagucgcagcacuggcccuucaaauaagagccugauauuuaagcuaaugguugucugacagccacaagucuccuuuagcagugaguaugcuguucacaucaugagauguccacacacauaagaucucuuccuuguauuauuuuaacugcuucggaggcuaagacugcuacugcugccacuaccuguaaacaaugaggccaacccuuugccacuacaucaauuuucuuacucaaguaugccacagguugcaagcuggucccucagaccuguguaaggacuccuagagcuauuccuauuuuuuuucugugacauauaaagaaaagucuugccccguuggcaagcuuaacacuggggcuuggguuagggccuuccuuagggccuggaaagccgcuucugcuucagguguccaucuuacuaaauggguauuggcuuucugaguuuccuuaauuaguguauuuaauggccugacuauuuugccauaccugggaauccauauucggcagaagccuguuaugccaaggagcccucuuaguugcuuuaggguuuugggaugaggauaagccaguauaugcuggauacauuccucacugagggcccuagugccuuuggauaauuuuagccuuaaguauuuaaccugcuguaagcagagcugagccuuugguuuggaaaccuuguagccacaaguggcaaggaaguuuaaaagcgcuuggguggcuugauggagcaagguuucugaaugggcggcuagaaguaaaucauccacguaccaaaggacaagaguguccaaguaugagaacuggcuaaagucuugggcuaaugccuggccaaauagaugggggcuaucccugaacccuugggauaagacaguccaggugaguugagacguuggguuugaaggaucuucaaaggcaaagaagaauugagaguugggauguacagggaugcagaaaaaggcauccuuaagguccaugacuguaaaccacucugguuccucugguauuugggaaagcagaguacaaggguuagguacagcuggguauagagggauaagagccucauugauaauccugagaucuugcacugaccuccacugucuguuggguuucuguacuccuaaaauuggaguauugcaggagcuauugcaugguuuuacuaggccuugggcuuuuagguccuuaacaauuuuuuggaguccuuguugggccuugggucuaagaggguacugccuuugguagggaaaggaggcagaauccuuuaguuuaauuugaacaggacaggcauucuuuguucguccauauuguccuucuguugcccagacuucaggauggauuaauuccuuccucaagcaggggacaacaaauggauguucuuucuccuauguucagguguauaauggccccugcuuuugcuagaaugucucucccuaacaagggaguggggcuuucaggcauaauuagaaaaguauaugaaaagaauaaaguuccccagucacagcuuaguggcugggagaaguaucuagugacugccuguccuaggacccuuuggauagugacagaucuggaggacaguugucugggacaggagaguaaaacugagaaggucgugccagcauccaggagacaguuaaccuccugacccucaauggucaagcauacccgggguucugugagggugauggcaugggcuggcacuuggcccgggcacccucaguccugcugcuggaucaucugguuaguggcuucugacucggaggacuuucauccccuggggcagugggccuuccagugauucccuugacauaagggacauggacgagggggcggcuuauuucuauuuggacaaucuuuuuuaaaguguccuuguagaccgcacuggaagcaagcccuauuagcauucaguuugcccagcucuucccuuuuccagagccuaauaggagucauuuuaacagaagucauuuucuuuuucccuggagucuauaaguagggauguggagcugggaaucuccuaacuauagacauagguaaggagaaagaaacuagcgaugucuuccaagcauacuuucuugcuagaagacugaagagaagaaaaauguuuuucaauauaguuggucaggugaacuagagucuucucuuggaagacuuugccaagccucccugaguuuguuagcauacugagcauaguaggaacuagcccuuuccuuugggcugcuuccauuucuccaucuacacagcaaauaagagaaggggaggagaaauaggagaggagcuuggaggcuuucugcccaccucuccauaaguuagcugucauaucccagggagacagaguuccaauuuaaccaagugugggacauaucccugagccaucugagcaccugauguauaagaagagauugcucgaaagacuaucgugguucuccugggauccgggcuuccaaaugcccaagauuuggagaaaaugacuuauuauguaugacccagaaauaugauguguaaucuuugauaugaugaaaacaacccauuacuuuagcaauccaaaaauuauacucauuaccugaguggauuuuggggcugaguauuugcuaaauaaccugaaucuucaguuauaauuguucaguaaaguaugaacagggaaagaguaaacuaacaguuccugcuuguccuacccuucuagccugcagguucuauccagucaugcuggugugagcccugucauaucucagauuucaucccugggucugagcauaaagggauugaccaucuuaaguuuuggcaucccaugauagacauucaggacaguguagauaacuuguaagaaggaagagucauuuucuuuucagccaauaaguaucugcugaguaccuguguaccaggugcucaggggagacagaaguauaugugacagauacauaucugggaaagaacaauauucaacaagauaccaucaaguaagcucuguauugccguuucuacuaaguucuugaaaaucuuguagaauauuaaaauauguuucaauuauauuaguagguucuuaucagugcaaagguuaaaagguucaguaaagaaaaaaaaaaagacucuggagucaaaccaaccucaugucaaaugccaagucucgcuagcugugucaccuuggguacaguacuuaacuuuuuuaagccauauauuuaucuagaaaguaggaacaacgauaguccuuauaggauuguuguaaacauuaaauaauagaauaaaugugugugguuuuaaaaugugucuauaaaaaccuuuuuuacaaaagaaucccaaguguaauaugugcagauacuucuucuccaggagguagagaaggaguaucuauaucccugaaccuuaaguaugggcuagacguagugacuggcuuccaaggaagacauguggaaagggaaaaauacuuuaccuggagaaaccugguagauaacucuuugaccaaaugaucaaguuaacaugaucagagagaauguaccuccugaaaugguaugaugaaaagggcacuucaucuuugugguaaucuuuccaaaaacucauaaccccagugugaccaugagaaaauacaucagacaaacccaaauugagggacauuuuuaaauaccugaccagcacuccucaaaacuaucaaggucaagaaacacauggaaaaacugagaaacuguuccagacuagaagaaacaugccaacuaaaugcaauuuaguauccuggauuuggaucuuggaagagaaaaagggacauuaaugaaaacauuggugaaucugaauacagucuagaguuuaaugaguaauagucuacuaaugcugcuuucuuagguuucacaauguaccacaguaacauaagauaauauuaagaaaaaaaaugaaaccauguuaaggguauauagaaacucccuguauuauuuuugcaaccuuuccuuaaaucuaucauaaguccagaaaaauuauucaaaauuuuuaaaaaauuuauuuuaaaaacauauguucacaaauucuuucauaccccuuccuucaaaagauagagagauugccucuccuugaguaggcuguauuuaguauuucacuucuaaugaauacaauguggcauaauugauaauauguaaauuccaaggcaaggucauaaaaccugcugucugggaucacuugcucuggaggaagccagcugccaugucaugaagucacucaagcagccuucuucacaaagcgacccacaggguaagggacuagguuccccuaccaacaguuagcaagggacuguguccuccuagcaacagucaugucagugagccuuuuuauaaaaggaccauccagccucagucaggccuucugacaauugcaguccuggcucaucgcuugccuaaaacuucaugagaaaccuugaaccagagcacucagccaaguggcucccaaauuccugaccacagaaacugugagauacuaauguuuguuguuuuaagccacuaaacuuuaaaaugaucuguuauauguaaguagauaacgaacaugagaugaaacaugguuagcaaaucaccuaguguauauagguaugcaaugaauuuuuguuccuacuauagcguuauuguucaaaaacuguuauuuuucuuccccugauauucugguccucccauuuccucucuacuuggaagaguaauucuuaacccuggcuggauaugagaaucacuugaugagcuuuuuaaaaaaaaaaacaccagggcccaaagcccuagaccauauuaauugaaucacaaauuuugggaugggacacaagcaccaauuuuuuuaaauuuauuuuuuauuucaguagguuuugggggaacaggugguguuugauuacaugaauaaguucuuuaguggugauuccugagauuuuggugcacucauuacccaagcaguguacacuauacccaauauguagucuuuuaucccuuacccuccucccacuauuuccccugaguccccaaaguccauuguaucauucuuaugccuuugcauccccauagccaggcaccaauuuuuuuuaaguucccuucguaguuuucaugggcagccacgauaaaggacuacugcuguagaaacaguaacauuccuguaaucccagcacuuugggaggcuuaggcggguggaucacgaggucaggaaaucaagaccagccuggccaacauggugaaacccugucucuacuaaaaauacaaaaauuagcugggcgugguggcgcgugccuguaaucccagcuacucgggaggcugaggcaggagaaucgcuugaaccagggagucagagguugcagugagcugagauugugccacugcacuccagccuggugauagagcgagacugcgucucaaaaaaauaacaaaaaaguaacguuuaaauaugggcuaccaacauuccggcuucugaacuuaggaguagaaaguuauauuucuugauauuuuaucaaaacuggcuuuaugcuuaagagaaaauguguuaugcaaaagagauucaaaaacuguccauugaaauagcauguaauuauauguagccuucuuugaagaaaauuaaacaagcuuuacuauaagaguuugccacuugacaggcagaaaccacaggacaauucuauagaccuuauggcaggaagcauacuauuuguagacaguauuucaaaggguaguuaaugcuugcuugguuaguauacuaaacuggaauuccuuccuuccuguuuauauuuucuuucucuuuguaaagcauacauaccaaagcaacauuugcugcauaugaguuuaagaaaaucaccugcugaagguaauuuucuaagaaaaaauaaauuacuaguuuguuuaaauagaaggucugcauauuuuacauugaaaacauggagccaggaaauagacaaccuacaauuaguguggaggaguuuaucauuucaucccauuguauaacccauggaaaaaaaauaaucuauguguuguggccaggaaccaggucucuaccaaagugaguuuugaccuuucuguuuugucaucugggcagcucauuuaccaaaagggagaagcaaaugguaauuccugggcuaagcaggcucaucgcuguccaaugaaacuccuuuacuuagauuuggacacuaaguugaauauauuuaaaaggcauuuguugaacauggauuuugugugggaacuuuagaagauuuugaagauucugccccuggcuccacagguuuguaaccuguguauaggauguacuuugaguuuuugccuucuaaaucaugaguaaaaugcaaguucaaagaacgauaagcauggaucaguuuggacagaaaagauguguaggagaagguagcauuugaucuucauaaauaagaguaguaggucuuugauauuugacccaagucauggguauaguuuggauagguaaggaggaaagagagcaccuaagccagaagagaaucacaacagcaaaacuaagcaucauguggacaguggugacaugacuaacuuauauaaaguggagguuuauuucaaaaguaauggaagugauuuugaauaaguagaucaggugaucugaucgggugaucuucagaugaugcugaagccuugaaggccaaggugaggacccaguaaccauugaaaguuccugagcaaauugaaauuggggggauguguacagaaggaaggggagaaggaaguaaccugcaggaugguuugaaaagaauaaaacaguagaaggaugaacaaaucugagacauaauagagaaaauuaagaaacuugauuaauuggaagcauacucuccuuuuaagggauauguccuaggcugaaggccagcuccaaauggcagacagccauaaauagauagugacgauagugaaaacacaaucaacaaauaaccuacuuugaacauuugaaucuaaaauuuguaaauuaggaauauaauuuuauaaucuuauagcucaaguggaauacaugcuaaaacuuauaaagguguugugguaaaaugcucaucuuucuauuguugauaaacucaaacuguauuucaacaggaaauaagguuuuaucugcaaauauacauauacuuaaaauauuccuuuuaaagugacagcaucacaucuggcaauuuguuuccuuccuuucuaaugaaaauuaucugaauuuuuaaguuccaguuuaucuuguucaguauuauacugaacaguuagacaucuaauucuuguuauggauagucauaguacuucaaauauaagacuuccuuauauauuugaaacauuucuuccuuucaucuuuuagguaacuaaccauuagguaggcauccugauauaaugguaauauuaaacaauccagaaaacguggaaauauucccaggguccuguggaccuuuccauaugacugauugaguauccuuacaacauggcuacugguuuuccacagaacuggagucuguguccuucucugaagacuaaagagaagcaauggccagcuugucuagugaucugguccugcaggaaacugcuugacagucucuguagaaacgauuuguuucuaucaauagugguuucucacauuuugcuaugaccaguugacuugucauaaaugaguagauuggcaguuuuucgaaacaccaucuggagaauacugguuuguaucauaugggagugguuuugaauaaguuauacuaucagauccauagcaaaaaaaaugcauaucgucuuuuguuuucugaggugacuauaauucuagauuagcuaauaaaacaauacaaagauuuccacuuuuuuguaggguucaaaguuuaaaccauccuucccucugagaacaauaaaagcuggacaaaauauacuaaaaggaauugcucagagacaugggaagucuaaaauuaugggaaaauauggaaaaugaguaagaaauagagaggugaaucugccauguagggccacuuuuccacucagauaucuuaugguccuggaagagguaaccgagaagcugagaaauguagcagggcuuuugacagcccuguaggauaagggaauaaaauuugaaauccagaaaccaaccaaagcugggagugaagcuaguaaaugccccacacuuuggauugagacauggcuggcuacugccaggaauaagagugaaguagauuggcccacucagagucugaagcucaacuucaaaucaguuuuaauccuugaaauugaaucaagauuaucuuggauugcugguuucuauaccugccaauagcaaaguaaaguacaucucaaaaaaauguguuuuaucaaagccucaaauuauuucuacagauuuuauauaaaguauccacuacucagguaauaauaaccaggaucaugaggagauaaggcagugugcaugggaaaagaaaacaaugaaaauaacagauaauggaaacacagggcuccacauaacacauuuacuauacacacuuuuaaaaauguuuaauauguucuaugagauuaaaaaagacugggaauuuuagaagagagcuugaaacuaccaaaauaaaccaacugaaaaauucaaaaacugaaauuaaaaacuuaauggguggguggauuugcuuuuauugcuguguucacaaaucaccccaagccucagugacuuaaagcagcaaaaaucauuuaaucuuucucauaggaaagauuaaaugagucgagauuuaaggauuauaauuuggcugguucucuuuuuuuuuuuuuuuuuuuuuaggcaaggucucacucugucacccaggccggagugcaguggugcaaucuuggcucacugcaaccuugaccuccuggacucaaguaacuccugccucagccucucgaguagcugggcauacaggcgcaugccaccacgcccggcuaauuuuuguauuuuuaguagagaugggguuucaccauguagcccaagauagucucaaacuccugggcucaagcagucuacccaccucagccucccaaagugcugggauuacaggcgugagccacugcacccaguuuggcugguucuugcucaagaucucucaugagguugccaucagaucuugccugggggcagucaucuaaagacuuaagugagacuaaagccaucugaaaggagcucccucauauggguggcagggugguuccuuuugaugagggcuucuccagagggcugcuugaguguccuuaugacaugguggcugguuuuccucagaacuagaaauccaagcaagcaaaacagaaguuauaaggucuuuggcagccaagccucaaaaguggcacacuguugcuucugccauauucuauuagucacacagauaaucccucagcuacuaugacagaagacuaccagaagucccuugguagcuggcuacuaugauggauuuaacuaaagauuaagcagaagagaaaauuaguaaccaggaaaggggaauaauaaacagaauagaacaccaagagacaaaaucccgaaaauggguguaguauauaauuggauuaucauaggagagcacagagagaugaagguggaaacagucauauauuugaagagaugaugaccccaaaccuuccaaaaccaaugaaaaaucucaaggcacaaauucaggaagccuugugaaauagugcaaaaccagaguuucuguuauacuaugugcacauauaauuggucuuuaguauuuuuagccucuguuugaagacauuaucauuaguuugaacauggcuguucauuuuuauuuuggaaaagucucaccuucaugugauaugcaauguuagcacuguuuguguuucauucuuguuucuagcccuugguaacuaaccuuuggaucagccugaagcacuauaaaaagggaaaaugugcauuauaacagagaauaaaacuccacuuaacuugauguguuugggggguuuucugguuuguuuguuuuuuucuagagauggagucucacucugucacucaggcuggagugcaguggcaugauuauagcucaccacagccuuggauuccugggaucaagaaguccugccucagccuuccaaguagcugggacuauaggcacaugucaccacacccggcugacuugauguuaucuagcuauaaaacauucagcuauuacuaaugauauagauaucuuucauacauauagaaaguagugauaguugaaauucauaaagaugauuuugaaguauugaaaucccauuaguauguauauuuuaauguuaugguguauuuaugauuuuuuucuuuaaauacaucaugauguaguccaggucuuuaaaaauugaucauguauguauaccauugauaacugauuauuugaaucaccacauauaccauuccuuggucuuauaucagcaggaguuaauuugauauauacccagcucguuuauuuagaaaaacugccaauuuugcuuuuaccagcuguuuuuaaguggcaaguauuuuaaauaauagauuuaccaauagaaaucuauugguagaaaucuaccaaucaagaucccuaaauuuugguauggauuauuaaacaguagaugcugucuguuuagcaauggaaccugguucuuguucaugcagguagggacagauggccauucuggcuucaaaugucaauuugguggcaaacauaagaauauaacuaccuuaaaucagauuggguuuaauccauuaucucuuagacgggugguuccucauucauuuaaaaguauucuccagugaacuuuuucuucaaauauaaauuugaaauaaaugucuuaaaaaguugguuucaguuaucaaauuauaugaaucuauuuguuucuucaguuuaaucagaauuugaauauaugagacauucaugucacaucuuucauuucucaauuuauaacuaauucaacucauguuguuuguguggcuaccuuuucauuacagagauuaacuucucccugguauaaaccaccagcuuuacuaaaccagggcaaaguuuagaaguaauguuguuugcaaaguuauagcuuuaaaaaauggaaggagaugcucccaccauuggagaaaaaaaaucuaaucuauuuuuuagaaauuaaaauacauuauuauuguugguaauuauuauacuuuaucacccgugaccacaauuaacuaaugcacaacuuuuuuuuuuuuuuuuuuuuuuuuuuuuuuaagauguagucuugcucugucacccaggcuggagugcaauggcacgaccucggcucacugcaaccuccgccuccuggguucaagugauucuccugccucagccucccuaguagcugggacuacaggcacgcaccaccaugccuggcuaauuuuuuguauuuuuaguagagauggcauuucaccauguuggccagguuggucucaaacuccugacuucaggugaucugcccacuucggccucccaaagugcugggauuuaaaugcacaacuguuuaaaugaacuaaacagcaugauuucauguauagucauggagcacacaaacaauauuuucuggacacacguguuucuucuuuuaacuguaaaagaaaaaaugauuucacaggaauuacauuauuuaaaucuauuuccuucucaugugacugaaguuuaaaguucuuagugcugcaaucgcaucuucucagguguguucuguuuccguccaccuaugcauagguguugguguuguucaugucaagcugccuaauuuguuuaguagguguucgaauggggcauacaauucucuagacauguggcaagcacacgggagaagccaccauccaggugauucgcagcaguaaggcugaucagaaauuugauccuggcucagggggguuccggcaguaaucaaacucuauucaccuugggugagauuucguuauaccuauucagcccugcuucagugaaaucucacucaggaaaauagauucugucuccaacuggaaucucccaaagccaugacuauguuucugaucagcacuacagcucagaugaagcguucaguuaccugccagccagucagcauuuccccagacugcaaccaguguuggaaccaaucugcaggaguggguggauugguagugaaacugguucuggugaaaaaacuucaaaaaauuuucacagaaaaaugauugacucccacuuaauucaaugaagcaggauuacucucugggacccaagaagaggaugccagguuucagcugugguggaggggauucuaggucccuguucuuaguccucauacccuucccauuauugagcuccuucugcacgccaggcaguagguucagaacuauauguuaucuuacuuggcaccucacgacacuaugaagaguacauuaucaccccauuuauagcuaagaaaacaggcucagcgcaauucaguguguuaucugaggccacccggcuuuugugguauagauuguacccaaauccaaauccuucuaaccugacagcccccacccaaccacucauuuugccacccuuccccauuuuaguaguuuacaucucaccuccuccaucugcucuuucuuaucuaccugucuuucauccucucuguuccuauguuuucuucccauucuuucuuucccuuaccuucauuuacuuuucuuuucccuaaaacccuagcucaaauaguucaacagagguuacuugaggagugaggggagggaaugaugaaaacugcagguguauuccguuuguuccuucgucuuccuuaaauauuuucauaacggucguuucgguucgugcaaagaaaaaaagaaugaaucaacucuuaaugacugccuccuacugcugagcucucuggacuagucacuucauuuauauuuucucauuuucuuuauuccuuacuauauuucucugaagugucauucccauuucauaguugaggaagcugggacucaggaggauuaauaacuuguccagcguuacaaagugaguuuaggagccacaauucagauucagauuuauugacuccaaaauuuuugcagguuuuaccauagcauguugcuucagaaauaaacagaccuggcugcaaaccccagacccaauuacucugugccuuuaaacaaguuacuucacuucuuugguuuuugucaccuauaaauuagggauaauaauaauaaauacaacauggaacaguuacaguguuaaaugauugaggcauguaauuugccuuacgaaaugccuaacucauggggugcccuuaagaaauacuacucucccccaccuccuuuacaaaauugcaugucuaaugcagugagaaaugccaggcguggaagauauucuagguuugaucaucugugguuucuuggccaaaacaagaaguuugaguucuacauuuuauuuugaguuauuaaacauugccaugcauccacaagagcuguauuguggccuguagagaaacauagcauaguaaucaagagugcaggcuuugggcccacagcucugaccugaggcaaauucccuaccucucuggcccucaguuuccuaauuuguaaaguguguauauguguggagguggcaaugacuacuuuguaggguuauaauuuggauuaaauuagauaaaauauauaaaacauuuagcauaguuucuagcauaaaacaagagcuaaauaaaugauaaugauuacuauauuauuuaauauuauugcugugguguuuuuuauacucuugagcuaaaaaauuuugaagaaucacacagacuguaacucaugcccuuguaauuggacccuauuuuugaagaaugcugguuaccuuuguaguuugguaagugcagcaaucagugacuuauuuacugauaagcucugcuuuccucuugcucaggagcugauacuaaugcaggcaauguguuauguuucccacgacacccuugaauaaaaugccauuuccucaggaacagcuagaaauaccgaugcuaauuuuuccuaugcucaggaaaagcaagagcucuccugcugcagugggcuggaaggagcucuccagaaauauuaugucauccuaauuugcacugccaagggaugagcucaucggggcggggucucaugaggcugcagcugugccaguuccucacuuguaugaugugcguccuccaagcucgccucucccucguuacccgcuccauccacccccugccugccugcgccaaacaagagccacugcaugaugaauuauuuaaaacccgaaggcgaacucuugcaaaauauaaccaggcaucagaaggcacaaaaaaagcaaacugugcguuuugguuauuuuguauuauuuuuaaaaacgaaaaaaaaaaacaaaaacaaaaaccaguugcagaacugcuguugucacugagaagagacuucuguuguuucuuuugcaucuccuucuuugucugagagcagaaucuuuccccucuuccacuuaaaacaacaacuugaucuaugacugaaccgaugcugggucugagccgaucguaagucuggcccugagccacauggcuauagcaagggagaaaugugugcgauuucccacauucuuuucauuauaauauguauugugaguaucuuuauuuaaucucuugcuauucuaccuggcaguauagguugugguuaaagucaggcaaccuaaguuuguauuccaacacagauauauguacuaucauuaugauggaauuguguugcugcuccaggccucaguuucuccaucuguaaaauggggauaauaaucaauccuagaucaaaagauuauugcaaacauuaaaugacuauuacaugguaaucuuuaagaacagugccugguccauagaauguacucaauaaaugagugaucauuaauaauauacagaugcauaacugcuuuauuaaccauuauaggaaacugugugugucugugugugugugugugugugugugcauguguguguguauuuuuaacaugaauuggaagauguaaaggcauuagaugauguacuuucaaggaaauuauucucucaugaaaaaggccuguuuuguuuuuaccuguuguuacggaaauuuuuaaacauacacugaaauaggaucaauauugaacucccuguauguccaucaucccaguucaguaauuaucaacauuuuggcaacuuuguuucaucuacugucuccacccuuuuuuucaagguggaguauuuuaagagcaaaucccagacauuauaucauugcacccauaaucuuuugaguauguaccuccaacagaaaaggauguuauuuuuaacuuaaccacaguuauucugacaccucacaacauuaaaauaguucuucauuauuaauauccaauguccaguucaucuucaaaucuccccuguagcugaaaagugucuuuuuacaccuucaaaaaaucauagaaaauauuccucauugcuuaaauuuuuuaaaaaaggaauuucuaaauaugucguaaauucuugcuuuuacagagcugaauuucaaacugauuaaaaaacacauguguugauauuuaugcaguaagaaaaaaauugcaaauuuauuuuuaucauuguuaaucugaauaauuuguuuuaaaguaagagguucuguacugguuaaaguaacuaauaaauauguauuaauuuuauaauuauuaauuuuauaucuguaagucagauggccaauauuuugauaugcucuguaucuaaacauacgacuuaaaaucuuauuuaaaucaacacgguauauaaacaagaccauaauuuauugacucuuucccuauuguagacauuaauuagcuuguuucaucuuagauuuaauguguguuacucacuaccuacauuagacauuuguuuagaaaaauauuuaauguucacuauuuccuuuuuaaaagaaauuucuuuuacuuuuaagcuguuccugcuuaaauguauauauuuaauuuuuagaaaauacaucucucuccauuuaagggcaagcucuguauggcuccagauguguuuagaauucauauaagcauuguuaacaguaagcccccagggagacaugagcuagguccacaaaaacuuauauguacagucuauuuuucaugaaggauauugucucuguuucauugcugacucuaaguuugcaggaugacaucaucaucuuggacaaaucaaggucauucagaagccucucugcuggggcccucauuacuuuuccagcaucgucucccauaacuuccucuuuuccccauccccuauguaucugagacuccaaaugcauuagacaauuuggcauaaucuuuguguuuucguguccauguucuucuuguucuuaauuccauauacgugauguagggcugcuguauuaaguaaauaaaaauacaggaggcccacugaaaauugaauuuaacauaaacuaaaaaucuauggucauuguuuauguuccaauauuguaugggauauacuuauacaaaaauuuuguuuguuauuuaucugagaugaaaauuuaauuggaaguccuggguuuuaucugacaauuuaaccuaaggaaacccuucaaggacuggccuuuuuuccagaaagccuuccccacuauacuccuucugcccuccuaccacaguacuuugcuggaaccucuaauaaaauauuuaagugcccuaacauuucauagugauauguaugugucucccuaccacuuuguaacacaaacacuaugucuuauucuucaaguccuaggauuuagcauuugcacuuuggugaagggguaggagguguugcucuaaaaguagauagagaguaggucauaaacacuuuauaaaccacacuuagaaaucugccuuuaaaugauaaacaguggagagccacuggaaauuguucagaccuggaauggcaugauuuuauuuaacuucugaagagacugcuugaacggcauuguggggcgcagaaugaauggagcagagacuagggcagggaaaucaguuaagggguuaucguuuugaggggaaggacucggcagagagacaaugagugccugaauuaggcagugguggugaaaaaucagaauggagaaggauuuuagggauuuguugaaguaaaaucaguagaacuuggguucagucggguauaaggaggaaagaaggggaacgaagccugacaacuccuaaguuucuggcuucuacaaccauuuagugaagguuucauuaauggcaggcaggaguacaguuuuagaaggucuggacuggagagacauuugggggaaucauccgugaguaucgagaguuaaagacaugccaggaauaguguauacaauuaaaauagacaggggcuugggaaaugccaguucgcagauauauauuugucauaagugaacuaaagaaaagguauaugguuggaugagcuuaaacccagcaugagcuuuaaagaagaaacuuugaguuauuaacaugaccuugcuguucugcauccagaauguuuuuauagauaggaagagucauggguuuuauuugauuuauuauugacaccaucuuugacucccuaaaggaguaucacuuaaccucugucaaacuaccuccuacauauuucaucagaauuuguuaaagacuaauugaauauaauggagaaaguacuuugaauugcauagaagaaaaaauaucacaaaagucccagcaucaccagauaauuauugaugaugacauacuaugaaaaaguaaucccaucuaagaaucuucaaaacaacaccauuuuuguauacauuacuugcguaaauauaauacaguuccaccuaaaaggcuuguaaugguuuuagaaaguguaaaagcugaugagaaucagugugagccaccaccaaauagcauuucccucauuaacaacuaacuaauagugcuaaaggucauuugaaauguuggaacaguugaacaucuaucagucggcucccuggauuaaccaguguuuuccauucuguugcccaaaauuaacagcugacaggcuguucuagauugguggucuucaaacuuuuugcucaugaauccucugcaaggauuuugaaaaccauguacccucucgcauuuuaaaguugacaucuuagauuuuuacauuuuaggucuaaauaguugaaaaggauguaauauugauauuuuaacuaaaaaaauauaguauuacuuuuaagguuauccaguggaaucuaaauaccauagagauuugauucucaccaucauccauuuuuaaaaauacacaaauaagcucuuuuuuaacuggcagaaauuuuacuuguuucuuuuuguuuuaacucauuuuccauuucacuuucuccgcagaacuuuauccuauuuaugauuucaauguuuuuuuaccaaucacauacuucucuaaaacacauuuguaaauuucaguuaaaauacuuugcauuuccuuugacuauauaauccugacgguuuaacguuuuuuucugguaugaguuauacuuacaguuacuaguaguggauauuugaucaacacaacauguauuaauuaaaagucugaugaagaagugaauacaaaaaauaaaauugucuuaaaaccaugacuuaaugagauugaggagcuuuuaaaauucauuuaucuuuugauaaauauuauauauuacuggaaugacacuauucagcuuuaauuuuauucccuuuuuaaugggaagaaaacuuuguaguuuuguuauuaguaucauucaguuauuugaacugguuucacaagagcaugucaaauaugacauaguacuguaucuucaaauauuauuucuagguuaucuuucaauuuucuugaaaccaaagaauuggaaaccacaugcaaaagaauuguuuuuauucgauacuuagggucauucacuguuugcuacaccaacacugaucuuccuaauugacaccuugauugccacccuggagggcuuuccuuccugaggcaauucacaggaagacagauaaagggugccuuuuuucuuaaagugggagagagugguuugggaugcugacaaagagaacccacucuucccaacaguaaauauauucuccgaucacuuguaggagagagaacacaguagagaguguacauagaaguugaggagucuaaaaaugcauuauuucuauaaaaacuaaguugauugcuuuaaaaaagcugaguugcuuuuaaaauugaugacaaacuaggugcugcaaacacuacaaaagauggaaaauauuuuuuaaauguaaaggauuauguacuucuuuugcuuuuaaauaacuuuaaauucuuguuucacuuuaaaucacaacuaaauauuuucuauauuucaugauuuaugcagugauaacuuacacuuauugagaggugaccaugugccaggaccuggccugauuaauuuguuuguauucguuaaucuucaugacagcccugugagguaaauaucuuuucaucccuguuuuacagaugaggaaauugagguacagaaaauguaaucugccugagauuacguagcuaauaagagaaacaaacaggcagucguuuuuuguuuguuuguuuguuuuguuuuguuuuguuuuuuuggaguggggacagggucucacucugucagccaggcuggagugugguagccucaucuuggcucacugaaaccucugucucccagacucaggcaauccuccuuccucagccuccagaguagcugggacuacaggcaugugccaccacucccagcuacguuuuuuuguauuuauuguagagacagggucuugccauguugcacaggcuggucuugaacuccuggauucaagccauccuucuaccucugccucccaaagugcugggauuauaggugugagccacagcgccuggccaaggcagucuuucuuuggagucuauguucuuaauaaguaagccucuccucuaaaaccuuagccuagauuacauuuaaauuuugaguuaaaaauaaaauguguaaaguccauauauguaacauuuuuaugguuuuccucuuuaauagcuuuuuugguuaacugaccaagcauguguacuacaguucuuccacuggacuauaaguguuaaauaauaauaguaacaguuuuauaaacuaugagccaggaaugauguagaacauccaaaaacugccuagucaauuugguuacaaaugcauaauaaaucauuuuguauaugguggaaguggauauuaaaaaguuuuaaggaacucugagcagauuuucaaccaauugaaaauuuuaaccaaauuuuacauauuucucugauuucauuaugccuuugaaaaacaauucucagaauaccuuuaggcauacugcagaguaagauuaacaauauaaauaucaauauauuuuaauuaaacucuugugaaacuucgaaugcaaaacaucuaggacuacuuauguucucuccuacccagcugccacucacuccuuccacaacucccaguuugcauuucacguaucuaagauguucagaccaugaacaucugcauuuuucuuccuuuuuauuauaaaggaaucucaagcucucuccucuauuuccuuaaaguuaccacaucauuccaaaauaaauucagcuuuauccagauuuaacauuuaaauugcaaaucucuguucaaacaucuacuacaguucauacucucuauuagacucugaaggcagagcagugagcauaggagacagugcugagcaaaggagaaugugcuuccucccucacagauccuauaggcuagaagaggguguaagcaauugacccacaaucaaaguacggugagauaagugauacaagaagggugguggucacacaaugcgaaugggacccuggcgguugugcuacucugcgggccccauugaugagccauugaaaacucagccuuugugcuaagucccuggccccugccuggcccaggcauggcaggcugccuguuggcugagugacuucaugagcucccugggugacuggcugcaugacugagauuggugagacuaaccaaugggcaguugcauuuaagcuuccaaguggcuguagcugacuauggggcuuugguccgcuucugaguuuucccucugagaugaggugagggcugugggaauacaguucuuugugguauuuccuucuuuacccucguggggaaugagaggagauuucuguugguuuccuguagcccacccauccaugguuuugacagcucuugcugcugcuguggcuuagaacaaaaaaagggccaugggcagcagaagaacaauuccuuuccuuacccagauaguuagccaucucuauugcugaguuauucaaauagaacuuucuagacuaauacagaaagugcuauuaguauauauaggaaguuccuguggcuacaaaacagagacuguugcauaaacuagucuugaaauuuaccucauauuuuagcauugccuauauauaaacauuaugagaagaaaguucagaaauccucuuauaaccugcaugaccuuggcugugaaacuuugagaacagguaggaaaagaaaaagaaagcagaaguggcuugguggcucuggcuaaaagccuuagggaugacuuccaaaggagaugggcagagauauaaaucuccguacaagggagcuugucaaccucagaugccacauggacugaggcugauguccaaggagucacaucugggugaugggggcacacagcagggggaaugcagugggaagcaguguccugggaaaugcguggauuuuagaggcaggcagacagacucgaauuuaaauccuggcuuugccauuuaauagcugugugaccuuggacaaauuaacaucuuuaaagcucuucacuuuucucgugguguuauugugaggaggaaaugagacaacguguauagaauauuagaccagugacuacauuccaucaaucucgguacuuuccauuucaaguaagcugaaugauuucccaagaucacauccauuauguggaaaccaguucggagcuggaaggcagauucaguucucagccuggagugugcucauuucucuugugcucaguaacuugcuucugccagcugcagcagugaccugcuuucucccaucccucagcuccuaacacauuuccuaaaaacagugacaagcaucugugugaaacauccaugaauuuacuaaaauucauagugaaaaggcagaaaaugcccccacagaagauuuaugggagcaagaagcccuucugaguacaugugcaagaccccaaaucugcugcuuacaauagaguagcagcuccuuuguccuggcuccuuaaagcuuugugauaauugaccggugcacauuuugaaaagggccacccugccauuauugcccuaguaacuaacaguuauuuguauacuaauaguaguuauuguuacuuugaucuuuucuggaagcauuucauggaaguuugucaaacuauuuugguaccaccacaugaagcccacuagguagucuuugaugauaaucaagaugucacuaaugacuuccucuguuuauuuuaaaccucaguaaauuguucauuauccaauugaaaccaacaaaaauguauagauggccaggagcaguggcucacaccuguaaucccagcauuuugggaggaucauuuaagcccaggaguuugagagcagccugggcaacauggcaaaaccccaucucuacaaaaaaauuaaaaaauuuaaaaaauuagcuggucaugguggcacguaccuguagucccaacuacuagggaggcugagguggagaauugaucgagccugggagguagaggcugcagugcaagccaugaucaugccacugcacuccagccuggacaacagagugagacccugucucaaaaaaaaagaaaaaaaauguagagugcucacucugugcaagaaauggacuaagucacugaagaacacaaagaugaggacaacggguuauugccaaccagaacuuuacauguggggaagaggaauagauguguacuguacuuggaaaacuaaaauacaaaacuguacaaaaauuguaucagcuguuggcauaauaaugcugaguagcaagccacccccgacuuaauggauuaaaaccucaguuacguacuuauuuauuaauuagcagguuguuuggggguggguugaucuagacuggacuuggcaggucugggcuucaaacugcaguuuggguuuagguucacuccucaugacucucaucugccuuggaucagcaagccagcccaggcguguucuucucauaacaauggcagaagugcaagaggggcaaacagaaacaugugaugcuccaugaagccuagauucagaacaggcacaccauccugucuguccaauuuuacgggcugaagcaagucccuagccaaccccaacaacaacuggugaggaagaauacucuaccucuagagggagaaacuacaauguuagcugauaaaggggauggagacagggaggagugagaaacagagaagaaugauuuagccuuccacaguaagauaauaaaaguucaaagcauuagggggcaugauauagagauuaauuaauuuugauggaggauaucaguguuacuuucuggagaacauggcauuugagauaaccuugaagagaaagcagaauuucaauaagccaagcuggggguuuggacauucuagauagagugaguaccacaaagaaaaucauaaaccauacugacuuuaauaaaaugaugaaaaaucuuauggaguagcuaaaacccuagagcacgggaucauuggaagguggagacaaaaacgaggaaggcacagcuuagcagguuuuaagcauuuuggguucauuugagaauucguugaaugcucugaagccuuaaccuagaaaaaugcaccuuugcacacuaacacauuuguaugcaaguucagcucuguaaauaugugagagagaaggagacaguucuagaugggaauuagcugaugaauggccucgaauggcaugcuaagagguuuagcuuucauucaguaaguaauauagagucaucaaagauuuaguuuauaaagggagcagugucaugaugagagcuacauuucaacaagaucacuaggaggcaguuugaagaauugauuaaaguaaaaaaggagaaaaaaacuagugguagaccagcuagccaacugguaauaaucccaacaagaggacagaaccuaggaaaggggacuuaaaaagcagggaaugcauuggcaagaacuugcagaaacagaagcaaaagaaccuagaguucagauuggcaaagaggaagagggaggcagcaaagguuuuugugcacauucucucucgaaucucacaacgcccuaggaagcagguauuacuauuuccauuuguaguugagaaaauugaguuacggaauaaguagaaaaacagaacuucaacccaguuuugcagucugcagagucucuguuugccccauuuuauccuucuaaaauauaagcuucaggaaugcagcucgcugcauccucagugccuggcaugaacuugcacauaguaggaaccagugaauauuuacagaagaaauuauaaaaugaguaagugguacugcaugugugaauggugguguggcagagcaaccagagaguugaacaucucacagugguacauaacagcccugcuguugaugcaaugaccaugaagugauggguggacuacaguuggauuuaagacauuucacacauguauuuucuacuuaaaucuuucccugccaagguuuuacauuagcuaaaagugucagagaggcuuuaaauacuggagcuauuuaaagaguauagagugccuuugcaacuuaaaaauggaagugugauaaaguuuaagcaguguuuuaauuggccuuucuuagcuuucccugaggcagauaaaccaaaccuacagaggaagcugacagugaauagcagcaaguaacaaaucuugcugagcagcacuuagguauuguuucugacagcauaugcccuccauguagaauuuaauauaaagcuccuucaguagguuaaaacugaugaauaguauaaucccagucugaauagauucuugaguucuuguuuucagauuuuaggaacagacgugcaaucccaaagauagagaacagagaccagugccaaaaauggaacuauuuugcuugaacuugcuaaguuaugaacaaaaacaguuuaaaggacuuaacauguauuagaaguuuucugaacaugcaauuagacaucuauccaaaaacuuucuguagaucagauccugacaucauaagcuuccuaugcacagucaguaucaguuauaauguuuaggaaugguaaaugucuuuuaaaugacuugggcuccaggugcuagaaggcuaagagaugucuugggacgauccaaggauagagggucacagaugaacuaugauuccuuuugugaguugcugauuucuguuuaagugaccugauuuccuuugacccuaucaagagaaagaagugcuuuagaaagcaggcugggcagaagauugauccugcuaaguguuggagaaaauucaaauguuucuugaccugugagcaccaaggccuuugaaguuaacucccauaauuccaauaugucauaugacuugauuuaaugcuccuguacguggugucuaugaugaaggaugaaggcaguuagauaauguuaagggagccccuccaaagguguugguagaacaggagucaggagggauccaucuguucaucucuaaaucagacucaauaauucuuuuuuuuuuuuuucgagacagagucucacuuugucgcccaggcuggagugcagugacacaaucucagcucacugcaaccucugccucccagguucaagugauucuugugccucagccucucaaguagcugggauuacaggcaugagccaccaugcccaacuaauuuuuguauuuuuaguagagaugggguuucaccauguugcccaggcuggucucaaacuccugaccucaggugauccaccugccucggccuuccaaagugcuaggauugcaggcaugagccacggcgcccagcccagacucaauaauucuuaaucugacuuuguauuagagucuccuggagaguuuucaaaauaucagugccccagccccacucccagagauucuaauuuaauuagucuggguugaagcugagcaucuguguuauauuuuaaaguucuccaaaggagucuaaugugcaagaaguuuugagacaugcaggaucagaccaaucuuacaagcaagacugggcaguagaauagggaaccucuggccccacccacuuccuugggccucaugcucccacguagcuucacauccccaaaacagaaauuggaagacacaauacagagggcuuaggaauaugccaguccaauccaaauagcaaaaccacugccauaaauaaguugcugccagggaauauugucccaaagcacugagcucucuggaaccugcucugaggcuuguggagcccccuguugaaucucaguaucuuucucagaagaaaaagaauaaaacguucacuuugggaagcagcaaauacauccauuucagguaguguuacauugaaaacaaaggacaagggcaauaauuuaauucacauuuugugugggcuuauacauuaauaguguccgaaaaugcauccuguauuucugcucaugaaaacggggaagugaauuauuuuuuugcaauauuauuucauucccugucccaucugauagauaucaguaccugaaugcagaguauaguuauuuggccuguauuuuaaugaguaauuuaauuugaugggucagaguuuugguuuuugcagccaagaaaugugaucaguauggauccauaauucuuuuuaaucuuagaaaucacuauuguuuccauggaaucaguugaauugaugaauauuaaaucugacuucugcuuguaugcauggaggcaaaauggcagaaaagaaagacuaguggugauagagugauuuugugccaaacaaaauauuuauacugaaagaucacaauccuggcccuaccugccucuugccacccucuccccaacuuaccgccgccaugugacuuaaaaugggaccaguguguuaccuaaaauugcacuuagaaggugacuuaucagucaaauagaaacuaauggucgcuaagagaaauucaauuuuugagcuaucuuuucuugaggaaaacugccaauguaaauaugugaagcuaggaaggaaaagaucaaaggcacacaaaggaggccggaggaggagaucauuagaguauucaguaaugccauguaaugauucaugcuugccuagagguaccaagagcuuccuggagguuucuaauaccaccucagagccuugguaguagucaaugguuuauugaucaagaaggaauuaaaaacaaaaucagacaaaaaaaggaagguuugauacucaaaugaacuuucgaaaaagagucucaugacuacaagaaucuucagaagaggcaaaacuuuugaauagugcagaauuuuucauucuuucauuucguucaacaaauauuuguuggaugcuacaugucaggcauuguguucagcucuagggauacagcugcuuuucaucaguauugauagacuuucaucucaagagaugaucaagagucaggaaaagguuuuuccucugguacauuucauuucccuuggccucaguaggacuuccugcuaagucaacuguuacucugauuuggcucuacaaauucucugcaagaucgcgcuuguuacggagaaggagagcauguguauaaugcugcagcugaugguaaaagaauguggaccaacacccaagacagcugguauuaaguauacaggaaaaaguagcagcaguguuagcaugcccuguguaacguaucaaguuaaaguaaucauuuuaggauugcaguguauucuucuagaacccaaaacaacccaucccuguagugcaugccugaggggugcugaagaggauauucuacucgaugucagcaucagauacaaggagggucaauuucagagugaagcacuuugcugaaaucaaucuuaaacaaugacauuuagacacagccagcuucuaagaugacagcgaagaaauaauugcuauaaaaagaaauguguagauuaaggggauuccccugaaugaccuguggcugaagaagcucaccauuugaaguuaucuugcucauuaguuuacuucugcauuaucucucuucucccugcuuccuccauacggcaggugccuugucuuauucaugaauacuuaguucaaguugccugauacgaauuuuaucaaauauuuuaugacugauaagaaaaacugaagauguagaugauacaaacguggaaaagacaucagacuccacauccuaaaguucccaacuuaguggaaugaccagcugaacugaaaaggugacauuuaagaggaauaaagaugaaaucuauaauucgagccgcaguuaccaccugcacaagggcaagauggggagacuugguuuaacagcaacaccuaugaaacacuuaggggauuuagguggcaauaaacucaguaacacgucaacaguaugaaaaacaaauauccaacaucauuacuagaagugaguuucccauuacagucaacugauugugaacaagggugacaaaacaauucaagaauugucuuuuuaacgucauuuaauuuuuuaaaugaugccgaggcgagugaaucaccugagaucaggaguuggagaccagccugaccaaaauggugaaaccucaucucuacugaaaauauaaaaaauuagccgggcaugguggugggugccuguaaucccagcuacucaggaggcugaggcaggagaaucccuugaaccucggaggugaacauugcggugagccgaggucaugccauugcacuccagccuggguaacaagagcaaaauucugucucaaaaaaccaaaccaaaccaaaacaaacaaacaaacaaaaaaaccccuacuucaaccaucuacaaaaauuaacucaaaauggauuaaagagcuaauuucuuuuuuuucuguuuuuugacacagaguuucacucuuguugcccaggcuggagugcaauggcacgaucucggcucacuggugauacuuuuuuuuuuauucauuaccucacauuuucccacauuaaaacacaccaacauacuauccauuuaguauaaucuuaaaauaucuucugaaaucuauccucaucaggugagaagucaggaucaucaacagauccaaacauuuuccugugcccugcuccagaacauuuauaaaaugauccuaagcagcaguucuacaggaacucaguuuuugacaugucucuggggagaugugcccauucauuuccacuuucccuccgucucuaaacugguucucuaugaaaguuuccuucaauuucaugcuaauucccuuuuuaaaaaaaauagucuauaagauugagccuaucuuugucugguuuauauugcuauaacagaauaccuggguauuuacaaacaauagaauuuuauuuggcuuacaguuuuggaggcugggaaguccaagauggaggggcuguaucuggugagggccuuguugcugugucauaaagugccggaaggcaucacaugguuagagaguacacaagagagggagguaguagggccaaacucguccuuuuccucaggaacccacuccugggauaacuaacccacucucacaauaacagcauuaauccauuccugagggcugagcccucaugacccaaacaccucuuaaaggucucaccuccgaacauuguugcauuggggauuaaguuuccaacacguggacuuuguggggagcaaauucaaaccauagcagagcauuuguuaagggcauuuuuaaagacuaaagagauuaccuucaauguacuacuuuucacaauuugaauugcuuuggguguuguuuguggucuguccugcuagauacuauaguuaugcaucgauagagacagugggugcugugagccauuaccuucacugcuuccccuuuucccacaugcauauuuacauccucaaaauuauaauagaugaaucagacauaauuugcuuuuauggaagucauguaguucacuuaguguuuuguggccccacccuuuuaauuucuccagcauaaaaaguaaaaaaucugagccucaguaguugguaguuucucguauccccuggaaaaccuuauaaaacagucacacugguguucuguccuuuaucacaggaccuuuaaagacagguuauauauuuugaacuccacagguacucccucaaguuucuuuaaagcagugagucuuuaaccugcuggagguuauggaucaauuucaaagaaucuguuaacccacugaaauaauauacaaaauuuuuuugcauguaucuauacauuuuccuuuccugauacagaguuuaccccugaccucccauucauaguggguuucucuauucuuaguggaugugacaaaaacaucacuaaccccaauauccaugagaccgcugccauuugccacuauugacuccuguugccacugcugcuacugucagaaucaucacugccacugggacuguugucaguguccauuuucccuaugacugcuuagcuagagccucugaugucugucacuagaaggcuagaacauacagagcuguugaaacaauuauggcuggaaguacaguaggaaccaccauaggauggugucaggaaacgcuauguuagccuaggccugagauucaugugccuauuugcaaugccacagcauaccccaagcucacccaggugggccuccugcuaccaagcuggccuccagcuuuugguauuccugucucccggaagaauuagcccuaugcgaaacugcagcucacaugccugguacccucucuacuugccuaauucuuaccaaccucccuccccaguauacuggauaaaaauguugucuuauucaaccuaagaaagcugauugcaagcaaauauaaaauaaaaacagaaaaccgcugucuuagucugcucaggcuacuauaacaaaauaucagacuuguggcauaaacaacauuuauuucucacaguucuagaggcagggaaguccaagaucaagguccuggcagauucaguuuuugguugaagguccucuuccuggcuugcacauagcuaccuuuugcuguguccucacacgguagagagaggaggcucuggugucucuucuucuuauaagacacaaaugcuauccugggggcucuaccuucaugaccucaucgaaaccuaacuaccucccaaagacuucaucuccaaauacuaucaugucgagggguagggcuucaacauaugaauauuguggagauagaaucacugucguaacacauacauacuguagugccagcugccuggguggaaauccaaaccccaccacuuacuucacuuuaccucucuguggcuguuuccucaucccuaaaaaaaugaagagaguaauauugaccucauagacuuaagaggaguaacugaguuaaugaauauacaggcugaacaguggcugacaaauagggaaugcugcaugauguuuacuauuaugauuuauuuaaagagguugauuauacccuggguuugaccugguaggacuguaaccuaaacagguuaauaaggguaacucuugggcaaauauuggagugacucucaaacaguucuggaagauaggagguaggaaggucaccccagaggcuuuauuuaaccugaccaucuuuuuccccuuuaccaugacagcaagugccacccaggcuggguaggaaaagcacauaagcagacaacugguccucagggaagcuggcaaagaugucuagcccagggauuuuggagcuuuguuugaaagauaugagauccuagggacaaaacuacauaaucaccaaaaggaaauagcacuuguggaggggauggaaguacaccccugauaucuuacaagcgaagcugcuacuguggggagcauggugguggacagccuccugcugcugcugcuucagauccacggcagccaccgaggccauccucccuggggcugcuccucuccaagguccuagcacgguagagcaggcuauccuaccugacacaggagcccucuaaugggcaaccuuuucucaggaugccccauugccucgggcugacacuuucuuagaacuacuccaaaguucuucccacccaauccugccuuucucacaggggucaaaccugccugguggucuggcuggcucucccugccuucucuggcucucacuccaccauccuucauaggcaccuuccccaguaagucccuuauagaacugauccugucuuggugucugcuucuuggaagagucaaacugacaugccauuacugcuuuuuuuuuuuuuuuuuuuuuuuuuuuuuuugagauggagucucgcacuguugccaagguggagugcaguggugccaucucugcuuauugcaaucuccgccucccagguucacgccauucuccugccucagccuccugaguagcugggacuacacgcgcccgccaccaugcucggcuaauuuuuuguauuuuuaauagagacgggguuucaccguguuagccagcaugaucuugaucuccugaccucgugaucugccuuccucggccucccaaagugcugggauuacaggcgugagccuccacaccuggccugaacuuuuagaaguuuuuccuacuuacaaaggaaagcacgugcuuauuucugucuaugguagaugaaccuucauagaaauaacauaccaaguaggaagagaaauguuaauguuagugaugugucauauugaaaacacuuuuuucucuauauuuuuauaauaauuuuuaguuggcuuacuuucccaucaaauuccaaguaaaucccaguucuguggucuaugugcuugcuaacuccuuaucauaagcucauggguucacuugaaguauguggaaaguugauuuuaaucagccuuccuaauaauucaaaacaaaaaaaaaaaggaaagaagacagauagguagccacugagcuguugacuaauagaggccuauuaguauucgaaauauuuagaacuucauaauaguguagaacuggaagauagauugaaugaguaauuccaacauaguugaaucaacaugcuauuacaguaagugcgccuauaaacugcugcuacacaaguaugacaaccuaaaugagcuacaaauuauuagcagagguggaaauuauuauuuauaccugauagcuauacaaucacuuuuagcaaugcuuuccacauuaaauauuaauuccagcauccuaggcuuagaagccacguguauuguuuucagaagaaauguuaaauaguagcugcaaaugcuuugcuuucucuggacuguggacuucacuuggcuuuugccuaagcccuguuuggcauuacuaaccuguauucauccaccuccuauuacacgaaacuggauaugcccuggccaguagccacccagccauguuacugaucugcuguuaugcccagcgguaaacucugcauuguguuucuggcuguaucagauucuucugcuuauucguuuggggaagucauguuccuugagcacggaguauacguaucuaggugugcaauuguccagccuguggauauucaauaaauagauuugauuucauagugcuuagaucuauuacgaacaaauuuuuaaaugacagaauuaccguuuucuagggacaggauaccuauauugaaaguucaaauugaucagucaucaaauaagagcuguaugaacugacagaaacauauauugguaaugcaauuaaaauauaaauaaaagaacacaggaaauaaagccaguaauguuauguguguaugagaauccuccagacggcaacauaggugcuuccacccauuuccccaaauuuggacacuccaagugucuuaugaagagcacugacaagcuuuggagcaaggaauucugcguaaagcaauauuuugugcaugguagguauuacugaauugaggccugcuugaauuaauaguauugaagauuaucuucaauaaaagccagcuccagaaauaaaacuauugacuauacacacccuagaaaagagaaccauugucuggcucauugauugaaacaaucgaauuuaaaugagaauaaacugguucacuucugaccugugaaacaaaagauaaauaguauuugaauuagcacaaauaucaggcugaaccauaugaaauugccauuuuuauagacaaaaagauuaaugaagacucacaauuucauaugguucaaccuaauaacacagaacaggugucaguguagagguuagaguuugaguauaugaguugaauugaaauuuaauuauucaaaacauuuuagauauauuauaagaauacuauuuaaagaaaacccacagagauccuuuugaaagcaaaacacucuuuuuaaaugaguagucggccuauaauccauauauuauguucucauuaauguggacccaccucuauauuauaaaggaaauacuuuucauuauaacauaauuuuaaauguaugaccuaaaaggaauugcauuuaguucacauauauauuucaauuauaggaaauuacauguuugucuuaaauuaaaaacaaagugauagggauggucaugcaaacagcauuaguguguaguauaaagaccccauugcgccucugaagagcacaggccuggcugacuggccaaguacuguuagaaaguuaccaaagucuccauguuuauaaaaugggggagugacaucaacccacaguggcaguuuaaaauaguguauacgugucaugaaugcucaauaaauauuagcuauuaggagaaagaagaugcaguuuuuuuaaaaagaugacaauuuuuuuucucuuuaaaacuaaaucuggaacuuaagcagcuuaaaaggggauugauucaguagucugucacucaucgguuugucccgcucuucacaguguaagacaguggagguaucagcccugucccagguguauccagaaguggcugaaaucugcaggcaggucccagacaggcugaaggugaaauaaaccaaaauuuaaaguuacaaugaaaaacucugaauaacucucagccuaaagcaucucagcaaauuagcccacuugacuugagucuuucauuucucuguccaaguagagcagcugcuccugaagggcaaggccauuacccagagcccaggccccacugccuuuguggcacacaagcuaggauggcuccacagcugcucucugaggggagacacauccccccuugcuccuggggagcccaauauggguggcucuguuaggaaugaugugagucuucucucuuugaaaaaacaaaaagguaaaauagcuacaacugucacuucuagcccauguuucagucuguugccaacauaaugaugauacuauuucagguaagagaagcagcagaaauaagaagucuggucuuuuuaaaaucuguuuuuucuauuaaaaaaaaaacuagggaaaaaaaucaccuuauuuuucuugcauuguaaaauaagaaaaugcuggauuuguuuucuccuaauugcccucaugaaauaacugcuaucaccaugaaaauguagcuggaaguucuuuacauuauuggggcuuaaguggauuugaggcuccaagcaauaacauacuuaaccccaucaguaagccuggaaugacucaaaauggacacagacguaagagugagaggugcaacuuugauuaguuuucuucuugagaauaaucgugacauuuaccaggcggaucguuaaccugcagacuucccaaaugacacaggguacuucaaccccauuagccugggccaugccgccccugcacauacgacaggcucugcuggaugaggugcuccccaggacuccaggagugacugguugacagccuggacagacagcaguccagcuaaaugcagcccagccagcagcuuccugcaacaaucaagagcacuuuccagaguuugauagccuuucuuuggccaugacugaguagcaagcucauauuuagugggugcaaagaagcaagcaaggacuuugccaucccagagagcuagaagaaagaggcuggcugcccuggcagccagagacagggcaggagacagggucugcggcacagccaccucccacucccucaucuccuccuccaugcacagagcacacccaaguccacacagaagcacugacccacacagacacggagauugacacacacacacacaaaugcauacacggauacacacaggaccgaaacacacacacagacacacacacaggacaccaacccacauagauacaaaugcagagauacacaugcacacacacacacagaggacccagacacacauagcugugcacacagagagagacacacacccaggacaucaacccacaugaacacaaacacagacagacacacauacacaaaggaccaagacacacacacacaaggccccgacacacaacugugcagaaacacacacccaggacaccaacccacacagacauagacgcagauauacacacacccauacacagagacacacaaaacacacacuauccaaauaaauucaggaauuugcuguguucccucuggucuuuuuucaucauaugcagccucaguggcagucccagaagggagcucuugagaauucagggguaaacgcucaggcucucccacugcacucccacaacacacuucugacaccaaaugugugggaguuuuccccauacaucaagcaagcaaccaguucugcagggggguguccuccaauucaaaugugacacugucuaccugaagaagugucagucccacaagaauuccccacuugugaugccagucccaagccccagguuguuucagguuguuuuacugugcuucugaccaacuggcuauaaaucaggguucccaggacacccuccucagguuugauuaauuugcuagagcugcccacagaacucagagaaacugacuuauauuuacugguuuauuaugaagguuauuauaaaggauacagaugaggagauguguagggcacagcaugugggaagggguguggcauuucucugcccuuccugggggcaccucccccugggaaccuccacuugucccgcugucuggaagcucuccaaacucuguccuuuuggguuuuauggaggcuuuguauguaggcaugauuuaguaaaucguuggccauuggugaucagcccuuucccccaccacccccagagguuggggucggggucggugcccggaaguccaacccucuaauccuggcuuggucuuuccugugacuggcaccauccagaagcaacauagaagcugccugccaccagucaucucguuagcauacaaaaagaugccuaucacuggagauuccaaggauuuuaggaguuguacagcaggagacagggauggaggaaaacaaaauaucuauuucacaauaugacaggcacucaacaugcacacagagggcuuucuguuaguuuaagacuggccuugugacuccugggagaaaauguuggcugcaaucaaaagcgcuaaaccuacaaagcaaaaaggccaucaaggaauguucgagaugccucccugagcugugcuuugcagccugcucacaucaagaaguccagcuaaucacacagaauuauuuucaggggauuugaaacuuauuauuuaauaauguuauugcugacauucuagaguucacugaugugucugugagccuuugugaauauagaagaauuaucacagacacuggaacaaaauccauuugcuuagauaagccaacaauuuuuagggccaguaaaaaggaaaaaaaaaauccuaugaacgauuuauuuaauacuugaauuuuugaggaauugucuuccacaagaggaaacaaauaagucaccaggucugacaagaugaaagagagugagcagaggagaacugcagaaguuuuucagauacguguucuaugcuucccccugccacuucuccgggacugucaccauccuuacuuaaugcuuauuuguccacaaaaccuucauuaugaacuuacuccaaggcugggcacaguggcucaugccuguaaucccagcacuuugggaggcugaggcaggaggaucacuugaguccaggaguuugagaccagccugggcaacauagugagaccccgucucuacagaaacuuaaaaaauuagccgggcaugguggcguuugccuguagucccaaccacucaggaggcugaggcagaaggaucauuugagcccugcagguggaagcuacagugagccauguucacaccacugcacuccagucugggugacagagcaagacccugccucaacaaacaaaaacaaaacuuacccuaagcaaggguuugugcuagaaguugggaauaaaaagaugcaagacuaagcccugaucuucgcauggggaggaggaggaagcacaggcagucuaacaacagcacagcagucagugccccuggcccuuggcagguggaaggcggcuuccaggagcaggauggagcugaguacuaaggguaaguagaagcaggcaagcacagaaagagaagaaagcuuguuccaagcagagggcacagcuuauucacagguauggagaggagaaagugagucuucuuauggagaauuuucacgaguuggaagaguugccccgcagaggacuugugggaaaauggguagagagucgggagaccagagcagagagggccagguguuuccugcauuggaguuaagucucaugugagggcaauggggagccucccaagagugaauuucuguguccccgcggcuguuaccaagccuuugcccuccacucucagguaaagcccugcugcuugaaggcuucuuccaccucccgcuuccuuaacucugcugacauccugcucauuugcccuuuauggaaggcuugagccaccuggccacaacuuuucucuccucaaugcugccaucaucccggaugacaucagccucgccauuuccgauccagcgacuuucaccucugcccugccucugcccucuacucccacggccauaccuuggacucggccaucucucagaauuuuucuacauagaaaaucuccauccccaguaucuccuuccuacucauaaccuccuggucuuccaucucgccuucgcuuuuguguccucggcaccugauuuugaccccaucaagaucucugguuucucucaauuuguccccaucuuuucccuccaaccuucacacauugcccaguccagccaagaaccuauggcucucucuccaaaaccuugcacucuccaugcccuuacucacuguaaaaccuggcauagggcuaguccagcagccuccucucacacucccaccccaggcuucuggcacagccaucagacccccucuccagugaccaucacaacaggaucaagcuuucuaaccucagcugagccucgguugcugcuugauagacuuuugguguccugcuccauuuucucucccaguacccauaacagcaauuccaaaccuuaagcauggcaauguccucuccacucuccacagagaaaccuaccugcuucugaggagagaccuccagagagaagcaucagcuuccccagccccacaccuacaagcaugcuugcacccagcccaucuuuguucuccucacuccagguagacggggugguuguuccuccuuuugucuaaagcuacuuccauuggagcccaggacccucaucaugcugccccaguaaagaccuuguccauuccucaucccuucucuccuguaucuucaaccuauucaucccuacuagcuccuuccugucagcauuuaaauaugcuagaguuccuuucaucugaagaacaaacaggaaaacacucuaacuuccucaaagaaccauguuucccuucccuucauggccaagcucuuuaagaguccucuacaaugacugccucuaauuucucaaccucccaguuuccauccaccccacaacccacagcaguccacuuccacuccugcuagagucucuaccugcuuccuugcugcuaauuucaagggaauuaaguuaaauucccugucuguccucaucuggcuugaucucucuacaucacuuaaugcugucaaccuguucuuccugaaauucucuucccucucuucccucuuguaucuguaaucacuggacuccucuccucauuucuuuccuaucucucuguccaguccuguuuggucccuugcauguaaguggggagaaaacagaagccuauuaauagagaagggccagugggaacaggagagaggaggucuuguugaaggaggauaaagacagcacagguggaggcaguggcuucaaaaagcaaaauaccaugcuaaccucccugcgagacugaagcaagaagguaagaaaggcagaaugugacaaagaccuugccuagaggccucaauucucucuauaaucuaggaggaaagggcgucugcugcuuggguuggcaggagcugagccuugcagagagaggugaagauaaggcagaauccuggcuagaagcgggcaguuguggugagcgagggcgggugaagggccugcugaggccaagugcagguaggaugcgugccgaggaugggcccggccagcagagucauucgcuguuucccaucagcacugacugcccugagguggacaguaaagagcagcacaggaggauucagccaggguuugguucuucugggccaguggagcagaaggcuagcaaggccagggauucagggaugcugguaaagggagaaccccgcugagccaccaguggaccuggcgggagggaagcaguagccagcagcaagcuguucuaggucagaaguacuagccucuaacugccuaggaggaaaggagaaauccagagacuggcugucucugggagauggaggagcagaugcagugacagagaguagagcuagacagaaaaggggaggggggaguugaaguggggcaauggcaagugaccgccaaaauccaggugugugcucaugcuguauucuuguuuuaaaucguauuauggaaguuucaaaucuacacagauagagagagaauggucuaaugauucccucaguacccauucccuggcuucaacaauuguuaacauuuuguccaucuuacuucaucuaaucacccccaacucacacuuuugaggaagggguugugggaggcugcaguauauucacacaaauccaagauuucauguuauuucaccuauaaauacuuaaauagguagaacucagguuuuuaaccugagaaucguucacugaaauaacaguuuuagguaaaagaggaggauaauaauaacuugaguguuuaguauaugccagauauuuuacacaucuuauuuaacucuuccaaacccucuaaggucuguauuauugucauuuccauuuuacagaugaggaaucugaaguuuugugaagcugcaagauuugccuaaaagcacucacuaauaaauggagguuuuggggauuaaacugcagucugucagacugcaacgucuuuucucuccagcucagcacucugcugaauguuggcugggggugguggguuaaggagacagaaguuacgaaguuaggauauuggcuaacuucaguauaucuccuaggauuauaauuccaagcaauuuaaaaaaggcuguaauuuaugugccaaaguauuuuaugaauauuaggggagagagguccugacaggaaggucaaugccugaaauagaaaagagaacaagauaagugcauggccugugccucaaagaaccaggagcuuuugcaugugggugaagggagauggucuccuaagggaggcagaugaaaggcccacaccccaccugaccucacuggggguaaagggaugaguaacuccaguggaaaggaggagugaccuacaagggagagccuggguaugguaaaaggggagagggugaggucaugcaagggucaauuugcaauggaacauaggguccagugggcagaguggguggggagagaaguuguagaggguccaugaggcaagaacagaaagcgggagaaagagggacaggagggagucuuuucaaaguuuaauggaaauuaaagcaacugccuagcuucaugcuacucaaaguguggaccaugggccagugccagucugcaagcucuuuguuacagccauguugagccagguacagaaauuaagaggaaggggugcagaaauuuuccacaggccauaguuuuuuuguauaguaucgauccaugacauauuaaaaauuucuuaaaaaugacccuucaccacagauggcuucagauguacugguguauauugccuuauguauuaugauguauucacucuaauuuuccaucuuguucgauccaggccagugaacacuuuauugcaauaggcagcuuucuaaucuucccuuugauuuuuuuuucuuuuuccaucaauuuugaugaauacugacuucccuauagucuuaaaagaaauagcagcuaaaauuaauucggaagaguuaacauuuaccacuuuuucuacaagauuucuucaaaauggaaaugaaguuuugugcuuuauauuuaauaguuacugaauccaguuuuccaaacucuuaguaaaagcuuucucagaauuccaagauuggggaugauuauuauagccuuuccaguaaaagauuuuauuuucagacauuauuccuuauuuuaagaauaucacaaguuuuuaaaagugacugaacuuggucuagacagcagauuucaauaguugcuaagaaacuagauuagugcuaaucuaaggaauauauuauucauuuuuacuuccauuuguuacuauagcacuuuaauugccgauaaaugucuuuuauggcucuccaagguguaaaacaucucucccuuagcuagucacaggagacaguguuuaugugcacccuccaagcaggcaguauucaggcaggaaguggcucaaaagaaggaaaaggcuucuugcggcacaaacaauagcuggguuuguaagcacaggccauagcugagcgcucaagggcagaccagccacacccacccaugcaugagaccuggccgggcugccucugcugaugcugcgcacugcgcugauugccucuucauguaguagaugaugucauucugcaaccugcugccacagucaucagacaaucaauuccucagauaaaagauugguugucaaacccaagaaacucauuuuccacacggcagccaaaaugagcuuuuugaaaagcuaaucugauagcaucaccccaaccuuacccaaccucucccaaccccauuccacuugaaacacuucagugcuucccagggccuuuaagauaaggauaaagcccuuauagagcauggaaggcccucccugggcugccccucccaagcacacugcacuucauguucagucuucccuuuccuuuuuaaaggaagccuugcccuggcucuuccacugcccaaaagcucuucuguccucugaggcaacacccauacucacuuccagucucagcccuguucuccuguuagcuagaaguaccuagguugguccucaucaaaucaauaguacucuuccuggcauuuaucacauuuguaaguuuauguuuauuuguguguguguuugauuaaggucuaguucuccaauagaccgcagcugaagaggguagagacuguucauuuuuacaaagacuguuaauucuccugucuagcacagcccuagugcuccaagagugaguauugaaagcauaaacucuuaaacguagaauccaaacaagcacucuaggcuuuucuauuuguggacagucuggccaagacucauuauguaaugagcaguaucuuugccaaagcaccgacuggaaacucuagugagggaccagcagcugcuucuccaugagccaguugccagcucuuacagaguuauagcagucuuuucauuaucaaaaauaauauaccugccuuacaaaaagaaaauccacaacugcuagugcuggugcugaacaagaaaagcaagugaagucaucuaaugcucuccucccucacggaggacacacgcuauggauguagucaggaauuggaagguuaguaauagcugagauaacaugaacucugacuguggcugaggcucaugcuggugcucauauacuuuucucauuuaacccucucaacaagucuauguuuauccuucuuuuacagauaaggaaacagugaguuuaaguaauuugcccaaggucacacaggugguaaugcagagaguggaucugaagccacauuaucuaacucauucuggagccuaaacucuuaaucauuaccguugcugccucuccuggagagguccagaacacagcuucagcagaaauccaggaagguccguacucacagacugaauaguaucgcugcauggaggggcagugucccucuuaaucuaauacuuugagguugaaaugagacuuuacuaaaaacagcugaauagccugccucccauuuccucccuuuccuuaaauuuuccauuuucacucauuucuuaaauacagauugaucaccuuacucccggguucaugaauguuccauggaugcgcuuugcuuauaggaauacaacaaaccacucauccuggcacacacacccccauagucuggcucaggcucugcucuccuuuuccaccacaucccucacguaggacccuugaguagucucccaguaagcccagggcucaccggcuucccuuccuugauguguuucucccaucuugaaauccuguucauccacagaagccaggucagcuucaggaacaaaucauguauagagugacaacgaauacuucuguuacagauugaguaucucucauuccaaaaucugaaaucugaagcacuccaaagcccaaaacuuuuugagcaccaacgugacaccacaaauggaaaaguccacaccugaccucaugcagcaagucacagucacacaacacacaguuuguucagcguccccuaggguaaaauaaacuuaccucaggcuacguggguaagguguauaugaaacauaaaucaauuuuguguuuaggcuugcgucccauccccaauaucuuacauuauauauaugcaaauauuucaaaaucaaagaaaucuggccgggcgcauuggcucacgccuguaaucccagcacuucaggaggcuaaggcagguagaucaccugaggucaggaguuugagaccagcguggucaacauggugaaaccccgucucuacugaaaauacaaaaaucagcugaggguggugacacaugccuguaaucccagcuacucgggaggcugaagcagaagaaucgcuugaacccgggagguggagguugcagugaggcaagauaacaccacugcacuccagccugggugacagagcaagacuccaucucaaaacaaaacaaaaaaaaucugaaauccaaaacacuucuggucucaaacauucuggauaaggaauacucaaccuguauuuuuaaauaauuccaaauuuaagucccauacuauucaaguauggcuggaggaaagauuaauugaaaagguaaaagccuuuagcaaacaugagucuuaagguuuuaaguuguagauugaaauucaaauuaggagagaauauuuaauaucaccucuagugguuuguuuuuuaucaauaacuccaaaucuaccagaagggcuuugcagcaguuuucucaaaguguaacaaauucuacuuuguauaucaucucuucauguuuaauuauaaggauuugaauuuacaguaccaguuaaucaguaauuagauaguaguguaccaaaagaaauuaaacaaagauaaaaacaaaaacacaacuuagcacaaggccauaucaucugguaauguuucauguagcaugauuaaaauauucccugagaaaugcagguuaacugagucauugugauguauuccuuugacuuuguuguuguuguuagugauuuccagugccagcaggaaacuuaaagguaauccaaauccaaaaacacucugauuauacuaauuauuccuuuuuucauucuucauuguaaaucucuuuaugaugcucaauaauuauuuugaaaugugguagauuuucgcaaugcaaaauaaauguauauuuuauaaugaugcauucuguauugauugucauauuuuaaaaaacacauaaaucaguauuugaguuaauuaucaauuagaccucuaaagcaaaauguucaccuuagguguggaaaaucaaaaaagauacaaagcagauugagagaggggcaaaaaggucccugaaaccaagauguagaagacggaaaaagguuguuuagcaagucauuguaagaaucaggggagggggcgaggggacccucuccuuaccaaaucaugucauccaccuauaccaggugcacgggccuccuauccugguucuuaaaccuuugguuaguaagggaauaaaaguggacuggccguuggaaagagaagucaacagcccuccuaauucagucuuggaagagaugugggcagcagccagcucaggugugccccacucugggugauccuggagcugggcucugggaagggcagacaguuggaggagccccaagguagauuaguggauaugcagcaagccccaacuuaucccuucugugaccagcguuacaugggcagauugagccaacaaaacacucagaauuaccugaaggugcuuugcauucuuucccuggugccauuucaagaggcuuugucuguuuuaagaaaauggcuuuaccuuuacucccaaguacagggaucuuguaaacugugaauacuguaaaaucuuuaaaugguaugccaaaugaaugaacaguuuuuuuugccucuaaguguaugagguugucuugaaaacuuuguauggaguggauuucauugugcacucuuaagcuuguuuuacagaaguauuuuaauugucagccucugaaacaaguaauuugucuuuugauagaagaauuugcuaaaaaagagcauaaggugcuuugagaagaauuauugaagaaaauuucaaagauuuccaucuguugguaccuuggauugaaagaauaggcuuuguuuaacaauuuaguaucauggguggacaucagagagccaaacuguaacaauuuuuguaacuucaugaugaaauuaauugagcagccccccaauaauugggaaccauuuguuuuuuucuccaauuuaagaauuucucuucccacuguuuugugaagcagugcuaugaaguuucuaucucuaagaguucauugcuuuuacaaauuagacagcacaccugugaaugaaagccacauuugucaaagugacaauucauuuguggauauggcuuauuaauccucuguugggcuucuucaacuguucucuaauuugaaaauguucgucucucaggaggugguacaauuuauuugauuucaucguacgacacaaacuuuugccucucaauuuuaccuccuuuauugaaauaagcuuaaacaaguugacuccggucaccaugaucauaaucuuaugaaccuuuauucaggguuaacuggccaaaauuaaugaaccagagcaaccucuucaucucagugaaugauuaccaguggcucuucacuuuaacaacaugguaacuauucccaugaccuacucuuucuauaguaaguaguuuuaaaaaauuuuuuuaaagcucaggaguucaaacaccccuaguugcauuucuccuccagccucucccaucucaguaaauggcucuaguuagugcuucagccaacaccugacagccuuccucgcucccuuuugcucaucucccauguccaagugcaucagccaguccugcugggucuccugccacuguccccacccuaguccaagcucgccuggacuccuagcagucaucuccuaaguggccucccuccuucuauucuaccuucucuaagauccauucuccauauagcagcucagcuaauuauauuacaaauauucaucauauuacuucacuaggccugcuuaaagccucccagggacuucccauuucacuuagaauaaaauuaaaacaccuuccauggccacuggaccccgucugacuagcucugcaccgcucuccccuucucacacucuaggaucagccuuuaaacauucccgcacauuccugcugccaugccuuucugcaggcugcugccucugcuugggauguacuucccugccccucaggacagacucucccugaccuucacaguucaccucagacgucacugccucagagaaacaucugaucaccuuagaugcagccccuacaggcaggcacugucacguuagccuguuuaugcgcuucauagcccuugucacuaucagaaaugacuuuguuccuccuagcuuguuuguuuccugauaaguguguugcuucccaccguccucuaggcuccaugaaagcaagaaccuugucugcuguucaccucauaucacucguggcuagaacagagucuagcccacagcacacucucaaugaacaguuguuagaugaaguauggaugauggaauccuugucuuccuaauacuguaugacuuugacugaaacacuucacuucaugggcuucagcuuccucaucuauaaaauaaagcuaacagaacaucgguuguucauggggauaaguuaauggaguaaaugcgugacagcgugucacaccuuguguggcccacagcagaugcagagugaacagucaccagugucccuuccuguuuuacaggaaaucuucagaggaacuagacauggacaaggugacagcagcaaugguacuaaccagcuugucgacuagcccuuugguucgaaguccucccgugcggccgaacgguaagcccaggauaugggacuuagggaagggccccuugacaccaagagcagggccuuucuuugagaugucucauuccugucaagcgcuaugaaccacugacccucacccauuagcaggaagcaaagagaaacguggaagaagucgaggcccccagagcugucagcccccucuucaucuucccagggagcccacugcuucucauucacccaucccuccauucaacucacuuuuauugagcuccuuuguuuucugccuugccaggacgucuuugcaguacuugugucccuuuuuucccagguaaaugaagauugagcuaaugaauuauuuucccuagcauuauuucuguuugacuggggaggcaguuggaucaaagaacucucagauuaaauaauuuuuaaaaacauuuucucagacuccuuaaucaaauagaauuauuuaggucauucauuuauuccacacacauuuaucagguaccaugcuagaugaauugaauaccucauugaaaaaguauccacacucccagguaguauacuaucucuuuggggaagaaagaccaucaaucauagccauauuaguggcuagcauuuauuaagcauuacuaugugucaguaaacaaauacuaugcuugccuuaucgccuguaauucccacaacaauucuaugagguauuauuaucacuauuuuacagaugaguaaacuaaggcucacagagauuaacuggcagaacugaaauucuccauaucuuuuugauuccagauuuauucucuuaaucaugauaugauuuugucucauauaauccaauacaauaaauaaggaggucaggcaguaggaggugaaguuggagagacugggagaccuaucaggaggggucauuuaugccuggcuaggaguuuggacuuuaugcugaggcuaugggagcacuauuaaagugauucuagcacugcaaaguuaugauuagguuuaucagccaaaggaaaaaaaaagaucuugguggucacagugcagguagauacgacauaaucgagaaaugugaagaaugcagaaucaagaguuuggugcuggacagagagagugagcaggagggugugucaaggaugacuuccaggcaguuggugugcuucagcaaggggaggacauucacuggggcaggugacagacgcacaggaagagauguauuggcaaauguuugguucaagagcugaaguugcugaagaagacaauaggaaacauguuuaauaggcagugccugaggaucauucaaggggcaacaucugguagagauuugggcacaucuugggagagagaucugggcugaagguacagaauuagaaggcaacauuuggaagccaugagaguagaugagaucaucaugagagaguuauguaaaagcagagugagaagagaagauggccgaggaaggaagcagugaagcucaccaucaugcaagggauuggcagugggaaaagagccgaggaagacccugaggugaccagagagguagaggaagaccaggagagugugguuucauggaaaccaagggaaaagcauguuuuaaggagaagugucugaugcuucagaaggucacgcauuaaaaagacugaguuuuccaucaagaagguggucacugguggcuuugucaagagcacuccccaagggagaaagccaguugcagauugcaguucacugaaauguaaugcacugagaccacugaaugagacuuaggaucaaugaaaaccuucucucaaaaaccagcauggucaaugaugagauuaagauaugguucacacacaauuugguuuuaagcaugagguguuaaaauaaauuuguugaacauacauugaggccuuaccaaaacuuacuccaaccucauuauaagagggaaagaaugauuaagaugcuaggaauucaaauuaaugucaugaaucaguauugcccaacaacaucaugauucaucaagcugggauaacacuuccucuuuuuuuuuuuuuuuaauuugagauggagucucgcucugucacccaggcuggagugcaguggcacuaucuuggcucacugcaacugccgccuccuggguucaagugauucucaugccucagucucccaaguagcugagauuacuggcaugugccaccacacccagguaauuuuuguauuuuuaguagagacaggguuucaccauguuggucaggcuggucccgaacuccugacaucaggugauccgccugccuuggccucccaaaguguugggauuacaggugggagccaccauaccuagccgacaccuccucuuuauauagcaguagaaaaguugcucuugaaaugggccugacuacucccauucagugaccugacugcucuucuggggggucucuggcaaauggguacucugauuuaccuuucucacuuuggcagugcuaaagaaggauuauaguaaaggcaaaacuauagucagguaugguaacacgccuguagucccggccuaggauuuugggguugcauugagcuuauggugccacugcacuucagccugagugacagagcaagacuccaacucuaaaaaauaaaaaauuuuaaaacccuggaaaacccccaagacauauucuagggaaaaggaauuguagaauuucauggaauccuucgaggaaaaagaaaaguguauuuuaaaguaaucauuauuuuuaccauuggcuucauuuuuuaauugagaacauuuuuaguguuccuuuguacuuaaaggucagaauuaaaauaaaccuuuuggcucuucaaugcaaacuuucguuagcacaguaauaaaguaauucagugcucauuuaugguuuaaaaacuaacuacucaacuaauaaccccaaauugucugcugucucucauuuagucuguaagaaaaagcaaauucuuaaauaggggaagcaauuuauuauaaugaaggcuuuuuuuuuuuuuaggaaaaaaagauuuucucuagaauuauugcacaucaaugaguuuuuggaaacuguugugaucauuuucugugccuaaaaaggaucauucuaucaggaagugagucugcaaagagggugagaguccagcagugccugucuccauucuugacaaacagagguuuaauauaaggaggcucuguccccuaagaauauuauaaaucagaccugacuuuuuuucugagaaaaaucauuucuauaucacuuauaguccuucugacuaaauagucuuucuaaaggaaaugucauucacaaaucaguaagcaaauucacuuuuggcauugacaugaagccauguaaccacacuguaauaauaguugguuuucaaaauaaauucagugccucauacuuaacaugauuauacaucuagcaccauuagcuuuauuuuauuuuacaaaugcauacuacaguauauuuguaagccacccgggccugccaagggaguuuuucacacuaaguaaaaucaucaagccuuauauuaugcucuucuugaacuccuguuguacuaaauggagcuuucuuauuuacaauaggcaaaucuagucuggugagcguaucagucucuguguagacugcagggagugagaugcuaguuugguuuuguugaugcuggcaaagcaugagacugcauaaaugaccauuucauucuaaaagaaccuagcuguaaugagauggguaguuucuccuauuucaacuuaaagcuucacuccucuaacuuaacuuuuugcuugacauaguugaggaauaugguagaaauccauaaauagguaaagguaguuaugaaaucuccccaugaaugauaaucuaccauuugucuucacuccauuacuaauuacacagacauuaacaguauuuuuuuaaugaggcauuuggggauguuuuuuccucguaguuagaacauaguuuuaauauauucaaaaugcacauaaauauggaggagaaauuauccaaaaaaaaguaaaauuuauauaaaugcuaauuaaggucgugcaucuugaaagguaaagcaaaucuucagugauuaaaagagcacccagaagacuuuuuuuuuuuuuuuuuuuuuugagacagagucucacucuguugcccaggcuggagugcaguggcaccaugucagcucacugcaaccuccgccucccaaguucaagugauccuccugccucagcucccccaguagcugggauuacaggcacgcaccaccauguccagcuaauuuuuguauuuuuaguagagacgggguuucgccauauaggccaggcuggcagaagacauucuaacugggcagaaaucucuccacauuagcaaacauuucauaaugcuuuccaccacaaaugggaagguaauagccaauagcaaucuuagaguaauuauugccaauaaauucuuauccuaucccagcuuugccagagagaauggagguuguuuacagcccagggacugcaugcacugaagaaauagguccaaccucuuccugguggccugggcccaugagggauacuuaccagucauguagcaagucacuuugcuuccugcugccucaggguccucaucuauaaaacugggauaauaauccuuauucugaaggacagauguugugagaaugcuugagacugugcgaauaagcuuuguaaaauguaaaacacucacaaaauguaaggcauuacuauuuguuguaauaagcagaauggaaaggggcuuuagauaacuauccagaaauuauuucucuuagauucuuaaguguuagacuaacuuccuauaaauguauucuaagaauaacaguccuauaagaaccccccaccccccaacuuuuuuucugaaacaggaucucgcucuuucacccaggcuagagugcagugacccagucauagcucacugcagccucaaaccccugggcucaaguaauccucccuccucagccuccagaguagcugggacuauaggugcaugccaccacgccgggcuaaucauuucauuuuuucuguacagacagggucucacuauguaacccaggcuggccucgaauuccuggccucaagcgauccuccuaccucagccucucaaaaugcuaggauaagagaagugagccacugcccucagcuaagaaaucccuuuuuaaaaaaauguugaaaucggagggguuggggugagagggaacucugugaccaaaccauucaggagaauacugcaaaugauauuucuuucuuagaaauacuguagucgauaaacccagagcuccccaaacuuagugaacaagaaaaucuuuuuuuucauauaauccccacuaugaucccaaggaauuuguguugcacaauacaaaaacacaucagaaaacucuuagaaaaaccuauuaucaugagguuaaaauaauuaaauguuuauaaacuacaauguggcuuuugggagggggcguauaaauagaacaaaaacuuacauacccagcuguugcagaugauugagagggcuggggugguuucacugguguagaaccaaggcucccauuuccccacugaaccaugcccgggcacgcagggguccuggcacugacuguguuugugugcaugcagagagccucagcggauccuggaaggagggcggcugcgugccuuccagcaccagcagcagcggcuacuggagcuggagcgcccccagcgaccaguccaacccguccacgccgucgccgccgcucucggcugacagcuucaagcccuuccgcagccccgcgcagccagacgacggcaucgacgaggcggaggccagcaaccugcucuucgacgagcccauucccaggaaaagaaagguugguggucagccacgcggucuucugcauucaguuuccugaaggugcuuucuguccccucugaagggccggugugagcuuaaccuuggaccuacacccccuuucuguggaaagaagcagcuuacguuccucuuuaauguucuugaaguuugaauagaaauuguuauggugauaauuuaaaaaugacaaauacugguaaguuuccugaagguauauacacacguaucccauccauccucugguuauaaauugcugaccugggacuuaccaguauuuguaaguuagaaaauuggaccucaggcuugcuucgguaugaacucgcucucuucgugggacuuauuuuuuucauauguaaaauauaauuaauauauuuuucucuuuucucaaucagcccugaaggguuauugggaagaauauuuuguaucucauuuuuaugcagucaucugugaaauauacauaaaagcugagauauaaacaaacuuccauucuuacauccuagagauuauauauuaacuaaauaaaaagugaaaaagggccaggcacaguggcucacaccuguagucccacugcuuugggagacagaggcaggaagauugcuugagaccaggaguuggagaccagccugugcaacauagcaagacccugucucuacaaaaaaaaauuaaauaaaaaaaaaauuagcucaguguaguggcaugcaccuguagucucaucuacucaggaggcugaggugggaggaucgcuuuaguccaagaguucaagacugcagugagcuaugaucuggccacugcacuccagucugggcaacagagugagacccugcugcuuuaaacaaaacaaaaaggaguagaagaaaaaaaagacaucuaauuaauugauuuagcaaauuaauugauuacacauuuguuuaauccucccagcaguccuauaugguaaguuuugcauuuccaucuuguuaugaggaaacugaggaucagagagauugauuguacauuuaacuggccccugucaggcagguuagaaagggacagagccaccauucaaacccagaucugccugagccucaaguucauauucuuuucauucucuuuagguacauuucaguuauguucacucauaauuuuucgaaaacauuuccauuucacagaauaaaggaaaacuaccacuauacuaccacuaaaucugaagacauuuggcauuauuuuuaaaaucaccacauaaauguaaaacuguuguuauauguauugguuuuuaaauguuguauugguagcuucauuaugaauggcuguucacaaacaaaaauccaauacaaagcccugaggacugcagugcaaacuuuuuuccucccccaauucauuucaaagaggaaaacaaagagauggcauugauccaacaaugccuucccucccugcaucucucagcaucauuccacauguguaacaguggaggugauaugggcacucucucugaguguguacaugugaaaaaggcugacauuuuuguccagaaaagaggauauuacuguaguccccugaccuucccagaggcaguggccugaagaguugcuguuucacaccagucugucaugcaaaggggcugaaguuguucuggcacccuguggguccccagggacacugggucuucacuugaccaguaggggagagaggcuggcacuuguaucaguggguaccugcaggcaggacagugguagggaccugaagucuuuuccuguuacuuugagcuucacagacugucucccugggguuuucugaguguguaguucgaacacucaauaggcauggcccaggguugugacaaggacucacggcccaggguugugacaaggacucacaguacagggaaccccaauguuauuuaaggcacauuaaugaaagccugucauacccuuccauuucugauguagccacugagccaaaauucacacucuuccaucacaauuagacugcacuuguuagccucauauggaaggucuacaggcuuuaacuaaauuaagguaaagucaccaaaggaaaaggaaaaaagcuuccuuuuuuacauuuuuuauuuuuuuauuuuuuuauuauauauauuuauuuuuauuggaugagcacaggcccacuccagaagaagcuggauagugggaaggaaugaacaaauaagaauaguguuuauccuucuuucuuuaugacuucucccucuauucagacuuuagauguccccaagccgagacgaauaggaugcugauuguagccacuaauguuuaaugcauggauuuuacacagaccaaguuguuaccuuggccuuuugaauuuaaaguuacuuugaacagugaaaauaacaagaaggugaggcugaugcuauucuuuuuuaaauuuauuaggugaaccaauauuuauugagcacguaucaggcaaaaugcuuauugcccugagaauaaugcauaguuuuuuccuucaaggugucaaaaguuggguggcuggaaauugauguguaaaaaggcaauaauuacaagugguaaaugcuguguucgugaugugacagaacacaguaacuguaauacaguuauuuuagagauuuaaaaaaucauguuucaaaagauuucuaagaguuaauuugcuuaaaccagacaauauguucugucuaguugguagaacuuucugaguucaucuuauuuuccucuccuuucccucaguuucauaguacccauuuaaaacccauugugauagucacuuguucuguggguauuguuugagaaccuucuagaucaguuuuuuccaacugcacgucucaauccaccagaggguugugaaucaauuuaaugagucacucuuuaaucaauaaaacagaauagaauacacuguacauaauaaggauaaguauuguuucuugacaauuuuguuucaguguauacauauguguaugugcugugcaaaauguauuucuuauuguggcucaugagcaaaaaaguuuggaagcuucuguucuuuguuauaaagagauaauacaauuugugguaaauuaagauguccugauuggaaaucaaaagauucacauucuuaacucugcuacccugagaaccuaagaauaucauuucaccucucugaucaucaacuucuucaucuguaaaacaggcaaacagguauuaacaugccccucucaggauaguuaugaagauuaaauguggucuuaagugcuggaauguggcaacauuuuaauagacauuugaggacucuaaacaaaaggggagggagcauugccuauaucugacuaugaagcaaugauccugaccuuugucauuauuauggaagcuuccuuaucucuucucccaccuccccccacacagagauggcucacucccaccucuuguggagauccauguuccacuuauguaaagaagaugacagugugugauacacugcauagacaaggcauucucucuuacuaucaguagugaggaggaaauauuugcugauaaucacuauauuugcuuauuuaguuacaguuuaccaaaugcuuuuaaauguagcauuucauuucaucaucccccaaaucuuugguguauucuuauccccauugugccaagaggcucauugagguuauguuaacuguccaagguuguguagcuuauaauguggcagagaucaguuuaacuuaaauagcagaggaaacguuugaggccaaguuaauucagugaauccauauuuccuucagcccacagaggagaaaaacguggagagaaaauaaucagacauagcuacagcuauguggcagggugggagcaagggugcagaaaguucagaaagaaauggagagcagagauaggaacuccaggcugucugccggagagcuuacuucccacaugaaguauccgucacccauaaggaaccugcagccaagguaggugagagugugagaagggaaaugaaaggcuucucuauccuagcucuggaggucagccagccaacuuugucaagcccaggucuagcagaauuuuuccucugggauuucaagacagacuggcagaacuuccaagcucagagaaaaaccagguugugugagccaggacucuugacuuuggggaggugcaauuuccgucaugaccacaaggugaugcagugacccuaaauacagccauucggggaguucgugggagaaaaugaauucuauggaaggccaaagaguuaaccaucaauuccacaagaccccaagaaagucaagaagcgcugaucagaaaugauuugugugcccuuuccaugccagaucccugauucugucagauucuggauucugugcauuccaaaauugucaugccagcuuuaggacuuacaugacuuaagcaagucacuuggccucuucagcaucaguuuccucaucuguaaaauaaggaaaaugguggcaccauauugauguggcuguugucaggaauauacgagaggcccuguaaagagcaauaaauguuagcugcuaauacuuugccuuuccuccuccccccucccccaccgccguuuggcaacugccugaauggggaauuugagaagcauagguguggagagaagggggugcuugccuccacccuccacccugacccacacugaccgugccaaugccacaguggcucaggauaacuccagaucccucagccacccugugcucaauugggugugcauuagccccccugcaaugcacugggugagugcagcaaggacaguagcagaaauugggggcauaaaaggaaaucugacucaggacucugcauuucagaacauuggcagcaucucagaggcaauuucuaaauuucagccuucaucauuuccauuuauuucacagguaugugucuuaaccaugaacaguuguaccuguguacuaggaagaaccucaaguuagagaagaaagcacugaguuaacauaaggugcuucaguaauaguuguacaguagcaaacaauuaaucauuugcuccacucuguauuuuuaaucuuccagagccaaaaagcuaugaaucacuuuaaauugugaauggcugcuccaagaagaaaacaaacccguaaaacccucacgaauaagcauguugccagucucucugcugacuuaauuccuaacccacuaauuuugagcagagagugccucuugcaaaaagaacggcuguuccagaaauagauccaucuguuaaaacugcuggggagggcgaugcuaagaacagcagcuuggaucaacugcauggauuucauggugaugguacauacagcauugucagccagggcagggagcugauuggccucauagagaaaauucaggauaaagaggagugauaucuagguaacuuagugacaagaucuuagaauaaccugccaugcaguauauaggcucugggacauuggaguucgaaggacuuuggaaaucuucuagcccagucucaaucuuuccaaguuaaaggacuacucaguaugucuagaaauguccagacguccccaaagaugagaugcacuuuuagaauucauugauugaggaagcacagaaugacuagggauuucuguuaauucagaaaucguuuuguuguuugguguugcuguuauagaaaucauuuaaaaucaacuuuauuagguauaauuuucacagaauaaaaugaacccauuuuaaguauaccauuuagugaguuuugacugucucuaccugaguaaccaccacucuaaccaaggccagcacuccucauacgccgcuucagucaaaggcaccaccaagccccagacaggcaaccaaccacugguauaacuuucaucacuauagauuaaugcugccuguuguagaauuucaaguaaauggaauuauacaguguguauuuuuaguauacaaaauaccaaauguuggcaacaggaacucucauuuauugccgguagaaauguaaaaugguacaaccacuuuguaaaacaguuuggcaguuucuuagaaaguuaaauauacacuuaccauaugacccagcaauuccacucuuagguauguauuuaccuaagagauaagaaaacacauguccacaaaaaaacuugcagacaaauguuuauagcagcuuuauucauuaucaccccaaacuggaaacaacccaaaugcccaucaacagguaccuggauaaacaaauugcauuauaaccauacaaugggauacuucaccacauaaaagggagcaaacuacugauacaagaaacagugagugaaucaaaaaaaacauuaugcagagggggaaaaaaagccaggcacaaaagaauacauucuggguuauuccauuuacagaacuguuuuguuaauuuuguauacacguaucaccacagcaucuauaaacagcacauggaggugggagguguuucauccgugcuugguauacauugaauucaccuguuacuuuguauuaaccccacacaccuugaagauccaaaaucucuacucucauucaguccccucaucuuacaaauaaauaaauaaagcccccaaaagguaaggcaacauguauacuguguaaccgugagguagcaugagguaacauagcugcuucuggaaccccuaccagcuucuaggaaguuacuaauuuuuaaauacacgagcgcauuuacugaucuuuuggcaccugcuggggaucuguguggaccucuugacccugaaagagccauuggagccgcugccaagguguguggguuuucaugagacaggcagaggaaguuuguauaaugcagccaacucaccugcacagaauaacuuggcccucucuguccgucaaggucccugguccucucuggagaggcuuggauguguaagccccugucccugcccugccauuccaaaaccacacacacaagucacaauacaaaaaaaaaaaaaauaccugaagauccuuuuagucaccucagaacaugacguuaacuccaggcugcugacugauaaagugacguucaugugcuuucuagaauauagcuuuaguuggacuuacacgucauaugcauguuauacaauacuuugaagcacuucaaaaauguuacauaauucuucaaauuccagccauguuuccacucuuggaacugaaggugaccuucagcagucacuauaucaauccuaaguaucacucuggguucugucaagaaaauagaagcuacuucguauauuccaaguaugaaaccauuuuuuagaaacaggauugaggcuuacuauugguagggcaagcagagagaaaaucagggacaccuuggccaaaggucucagccaauagacccaaggaaguucuagagacaguucagaagcugcugcaaaggcgaaaaucucugggaaguucucuccaaccauuguggcccacagcaucaauguugagaaauucuaaagaguuugucuggaagcugcuaugcaucucacaucaggcauaugugagauuccaggagucugcucacgacugcguggagcuucagcuccuccugggccuguugcggguguuaaauaaaguacacguggaagcugcuagcacaggaccaggcacagagugguucccaaucaaugguggccucccucuguucccuuugcuuuacaugaagaagaccauucuguuagacuugaggucuuugcugacguugguguucugcagaagugcuuuccacuggugugaauuuucagcuguuauccaugagaugguggacauuccagcuuugcaaacaucuguuagcucugcgaggagaagcuaggguagaagcacagaugggaccauucagauuuggcugccgcaacucugccagaagcuuugcuugguuuggcuuucuugggcaggcuuggacccaugcagcaaucugggcguuguuuauuuagcuauuuuuucauguucuccuccucccauggcuugcuuuucuuuaguguaacagcaacuagucuguuuguagacaaaggauuuguuucaacuggauauaguuaggggacuuugaaaaguacugaacuaccauuuaaagagccucaugcuuugcugcaagaaugucuuuggccuauguagagacaaaucacuuuacaaagguguagacaggguuaggggaaaucaguaggggguggugcaggacuccaggggcuaacaaccuuggaaggccauuauuaacccuaacccguagagccuuaagaggcucuacaagggaggaauuucuacaauccagaagguuaccagaacucuggaaauauagcuguuggagagguuacccaacagauaggguaacuuuuggaggagagauguagccacugcccaccuguggccaggcagaaggagagagccaggaggaaucaauaccuuccugcuuuccaaucucuccugccucccagcugccugccggugccucucauuagccaaauccaaccagagaucuaugaaccagaagcccuguuaaugcagccuccugggacccugagcauggugcagaaaaggcaugguguagaccugacaggucaaauacgacaggucaucaagucccuuaauagauauguaacuuuucacaucaaagaagcuuuucuuacaacuucauguuuaagguuuaauauacagucauauggcauaauuuaaccaauccccuguugucaaccuugagguuguuucuuauuuuuaucuaguguaaaaaucugugugaugaaugaauauacauaugucuuugcaaauauuuugaauuacugucuuuggaaagauuccuacaaauugaauuggcucaaaguuauagguguuucuuaagcucuuauugccuuaaccuguauugcccucaaauuuaaagauggccccuaucugugcauguguaaacuaugaagguagagcucugacagucuggacuaaaaugggauaauaaaugugagaugagauauucaaaaggaaugucaaaaggaagaggaaugcaaaaggaagaggucgaggagaaagcagaacuuuguuuugcgauugcccccuccuccaaaacaguugacagucuucccacuauauguaauuauguuucugaguccacauuugcaacugccuugcaaauccacagcaacuuucuauaucucuaggaugcaacauuguuuucuaaucacuuuugcuaaugaccugagucauuauaaauuaguaauuuuuccuacagcagauuuuccauugucugguggugaacucagacuuuccucagguagcuaccaguguaggguaugcaagauuggaagagaaauguacgauauaaagugaagagaaaaccaucuuauaauucaauccucacaaugcagggcaucaccauggauguccccugagaaguuaauuuacagccagguaggauaagcaaguguuaaucauacugagaaacauuaaauucuacagaacaaaucuuuuugacaaacauucuuugaacacagaugauucacuaaguaaauuuuacaaagugcuauuuaaacaaauuaagauaucccaaauguggcucaucucugaggucccaaaacacaaccuuucugagauugaacauaacaaauauuuauugagccagacacugugaggcacugggauagaauauagucuauccccaaagugccucuugaaaacccagcaaaaggaaaaaaggaaagaggagacaaaguucaucauguuucuuaauaucauuaccuaauuuucuuuggguaacagauuucuuuggaaccuuuagcagggguucaaggaagguguguguaugugugaggaggagauaaacaauugcuguugguaguuauccuaauuccaagugacuugacagaggauaauggucagcuuccuuggauucuggggguuugaugccuccaaaauguaucaucuaccugaaguaacaaaugaaaauuauggaaagaaguuaaaccaaugauauuuauuuuucuguaaucaggaccaaccuuaacuacuugucaauuuaaaaaacaaaugcuugacauauuauugcaaggacgaacaguaaucuuguaaauaguacuuguuauggcacaaaaauaccacugugauuaucauauccuaaaacaaucagcaauuugaggccuuaaaaaagucccaugauguaggaggaauuuggcuuuauaugucguacaauaauuacuauuauauucaguaugaaagccuacaucugacugacucauugguaagagccaucagaugacacuggguaagucuuguaacuuucuggagucuuguuucccaucaugaauaucagaaauauggaaauaguaucuuaugcuuugcccauuccuuucccacucucuaaggcggggguccccaacucccgggccucgggcugguuaucaguccgcacacagccgguuaggaaccccgccacacagcaggaggcaagcgagcauuaccgccugugcuccgccuccugcaggucaacagccgcauuagauucucauaggagcaugaacccuauugugaaccagauugcgcgcuccuuaugagaaucuuaacuaaugccugauggaacaguuucaucccgaccugugccauccucucccaaccugcgccacagucccuggaaaaauugccuuccaugaaaccgguccuggugccaaaaagguuggggacugcugcuguaaggcaaguauuuuauccuucucaaguauccucaaacuucauacacaaccuucccucuuugucaucaguucugaccccacuuccugccucauugaaaaauuagaaacagucauacaggaauuccuuuuuuucccuucuccaccaaauuagcaaauuaacugcaucugcagccaccaucugguuucccuccuuuuuccagcagagaacuguccugucucauccaaggcagccccucucccugugcuguguguauuggcgcugcucuccugaccuucugaagaaccucauccuguagcuaaccccugcuucucuacugcaccaucaguuucccugucuuugcagucacucccaucagcauagaaacgcaccuuaguauaacuuaucuuuacaaacccucccuugacugcucauaggucagcaaaauuucuugaaaacauuggcacuuacucucucuguuuuccuaaaucccacuuacucuccagucuauuaccaaucugauuuccauccacaacacucuacgagauuuacugcuauuugggccaccagcauccuccauaugccaaauccaaggaacauucccaguccuuguucaacacaguuggucacaucuuccuuccuaagacacuuucuucuauuugugcuuuuaauaucaugaucugcugaccacuucucucucuuacugcuccuucucaaucuccaacauaaaauauuggaugcugcagugcacccuaaucaucucuaacugcauuuuucccuagaugggcucauccacacccaagcuuucagugcuccaucuccugaccccaaauuuauaucucuaucccugacucucccugauuccagguucacauauccaguguccugcgugcaaucuccuuuugauacauaauaggcaucucaaaauuaacauauccaaaacucacccacaacucacccagucauucaaaccuaaaacauggaagucaucuuuaacaccaucccucuuaucauuccucauagucaacccaacagcaaguauuauuggaucugccuccaaacuaugucuugaaugugucuauuuuucuccauccucucugcccaaagccucuaagccaccaucucuucucaccugcagugacuucaugcacugacuccaugcuggugauuacauuuguuuucuaucccaaaacagaguaauauuaaaaaaaaaaacaaaacaaaacuuaagucauacagugucacucucuuccuucaguaacuucucuuuuauuuuagaagaaaauccaaauuccuuaccuuugucugcaaagucccacaugaucugacccugcuucugcacuuuaucucaaacaaaucacucccucccacauuucauucuaaacacaccgucauucuuucuggccuccaagaggcaaggucuuucucaucuucaggccucugcuuuuaacucuucgcuaugccuggaaaacucuagcucuuagcuuggcuggcuccuucuccaacuuucaggucccagcucaauagucaccuucuacaggccucaugcuauaucugaaauggucaucauguauuauaauuuaugucucuccccuacuagaauuucacuuccuugaaagaagccucauuucuuuuuuuguucucuauccccagaacguagaauauuccuugcuaaauagauauuugguuuaaugaaugaaagaaugccaucagcaaaaagguuaggaaugaaucaaaaaguguuuucaucuaucaugacuucauuuccagacagauacuuggacuguuggguacguguauuuuugcuugagucauugguucucuuaaguggaagauauuuucuacaauauagcuucaucauuugaaaaaugggcaggaagcauuuguagugugaggacuuguucauuaauguuugccauaguuugauaugguucauuuaccuccaccaaaaucucauguuggaauuugauccccagcauagggguguugggagguggggccuagugggagguguuugggucauuggggugcaucccucuugaauggcguggugccauucucacauggcaugagagucucacucucaugagacuggauugguuuuugagagaauggauuaguucccuggagaguggguuguuguaaagccagaacaccccuuggguuagaucccucuuggcauauuccugcaucaccuuugaccuccacuaugauuuaacucaacacaaaaacccucaccagaaccugagcaggugcuggcgccaugcuucauaugcagccugcagaaccacuaccuaaauaaaccucuuuucuuuauacccagcaucagguauucuuuuauggcaaugcaaaauggacuaagacaguauuguuaaguuauaugcuuugaauaaaauaguauuuugaauucugcagaauuccuuuuugugaaccuagcagguuugaaggugggauuuaaaucgccccaucuggcgcaucuuacauuucauguguuuagaucacuggcccaaggaggucaggaaggcugaaauuugugaaccgucuccuuggaauaaauacaggcucauaaggaucauguacuuaaagucuccuaauugugucuuugcuucuccgcauuuucacgucccucaaagagcuucagcuguaacucauguagcucuggguccuacgcccagcacugcacacugcagguagaacaucauggagcugggugugugugcccaggagcugcagaagaaacagcaagauugcugugcugugaaugcuggccacccaggcagagccucuggggcacagugggcccugggcucacgaagcccaugugaacagugggcuccuuccgugguugguaaucugcucuagcagacugcugcaaugugcugccacauuuguccucugcuugccaugcuuaaggcaaccauucaccaacacaugagcacucuucaauucuggaagcucccaaguaccauuuucaauucagaaaccuauggaaaaucuucagcaugggguggcuguccagauaaaucaucuggauacugauuccaucaguaauagcugaugagucgucuucuaaauaugugaaugauugcuucauagacucaagaguaugauggugugaaccagaaguacuugauggcagauauucuagcaggcacauaaaucaagcuacaucaguuccaucaguuugggaaagaugccaccacugcuguauguguuggucagggugggcuuacuauuggaacaacccauuuuucucacaugucaguagcuuaacacaauaaacguuuguuuauucucaugucacaauccagucaggucaguggagguuccgaagaggguggaugucuucgcuccaaacagcccucuggggauccaggcuucuuccuucuagugcagaccuucuuaaccuggaauccacagauccccaaauggauacacagaauccaggaagucggugaaccugcaugggggaaaaaguguaucuuuauuuucaccaaccucuuaaccauaauuuaacauuuccuguaauuaugauuuaaggcaugaagccauaauaauguuagcaccaccugugacuuuaauacccaucaaaaucauagauguuucauaucacauuacaauuuuaguagauaucaugaaauaucauuuauucauaacacuacuuuaaaauuaugguaggcauuaggcccacuucaagguauuguuauuuacuacguuaauuagagaguaugcauauugccguauuacaaaauuuuuuuuuuuuaaguucaacuuuuauuuuagauucaggguaccuaugcagguucguuacauggguauauugcgugaugcugggguuugggauacaauugagccuaucacccagguagugaacauaguacccaauagauaguuuuucaacacuuaccccacucccuauuucccuccucuaguaguccccagugucuguuauuuccaucuuuauguccauguggacccaucguuuagcucccacuuagaagugagagcaugcaguauuugcuuuucuguuuccgcaucaauucacuuaggauaauggccuccagcugcguccauuuugcugcaagggacauaauuucauucuuuuucauggcuuuguaguacuccaugauguauguguaacacauuuuauuuauucauuacacugacaccuagguugauuccaugucuuugcuacugugaauagugcugcgaugaacauacaaguacaugggucuuuuugguagaaugauucauuuuccuuuggguauacacccaguaaugggauugcugggucgaaugguacuucuauuuuuaguucuuugagaaaucuccaaacugccuuccacaguggcugaacuaauucacacucccgucaccaguguauaugcauccucguuucucugcagccucgccagcauguauuauuuuuugacauuuugguaauagccauucugacuggugugagaugguaucucauugugguuuucauuugcauuucucugaugauuagugauauugagcgucuuuuuccuauuuuuuuggccacuuguaugucuucuuugagaaaugucuguucauguccuuugaccacuuuuuaaugggguuacaaaauauuuaauguuuuuuucuagcuguauuucaauacacuugcauuucuuuauaauuuuguguauuuuauuuuaaacauuaaaaaccacuauucugagaaggauucguagguuucaccagacugccaaaaggguucauggcaaacaaaaaauuaagaacucugaucuggugguuuugcuauacccuaagaccuuuguguccuuugcaucuagccagcagagcagacugggggugacacugggaaguaguugaggggcaaggcuuagaaggaaugugugucacuucucauccaucagcccuaauucagugaugugaucccauuugacugcaagggagucugggaaucaaggucuagcuguguacccagcaggaaaaggaaauggggcuuggugaacacauggaagugacugucaccauacccaagggaacagucagcaaagagguggcaucccaaggacaagggaccucccuggagaaaacucacuuucuauaaaauuuacucuaggaugcauaaucauaauaauccuguaauagcugcuguugguugaaugguuauuccugucagcauucugcuaacugauucacuuccaugaugucauuuaauccucauaauaaugcugugaaacagguacuguuauuauuccuauuuuauaaauaagagcacugagaacucaagaaauaagcccaaaaucagugcucucaaucauggcacuggacuguuuuagaaaauauugccgcagccugggcaacauggcaaaacccugucuuuaccaaaaauacaaaaaauuagcuaggcaugguggcauguaccuauggucccaacuacuugggaggcuaacgugggaggaucucuugagcccaggaggcggaggcugcagugauccaagauugugccgcugcacuccagccugggugacagagugggacccaucucugaaaaaaaaggaaaagaaaauacugugacccuuguugaagagguggaauuuuguacugguggaggggaugguuucuggagccagagucccuggauucguauuucaacuuugccaguagcugguucauugacuggacacuuuuuauggagcuuucuaugcgucuguaaaauggagauuaauauuaguaucugucuuuuaggauuaaaggagauaaacacuuaagacagcaccuggcacauaguaagugcucagugaauguuauccacuguuuagacagccagaauggcccugugacuaccuucaugaacaugaucugaaauauuccagcagagcccauuucucuugaaggauaugaggaaauaacugaggucaccaagauacucacaaaccuagggaugccuacaauagugugcugaguuauagucaagaggcuggggaugcugcuacuuuucuaaugaaggaaaaaaauauguugggaugacauaaagaaaauguuguuagaaaauaguuuccauucuaauaucacucucuccccuuuacagaauuccaugaaggugauguucaaaugccucuggaaaaacugugggaaggugcugagcacugcagcagguauccagaaacacauccgaaccauccaucugggguaaggcagcucucucuucagggaugcagcccccaucugcucagucuagggccacccgcacucagaaauugcacaccacacugugccuuaaagguucuggacacugggcuggcuuggucuuccuaaucucuagagagauggccacugcagaucaucuaagccaauauggcacaguggaaagaacaaggauauaacauccuagagccucauuaguucacuuacugagucacuuuaggcaagcugcugcccugagccccaguucccuauggaaauuuauaauaaugucagcucuucagggucaagugugagugccaaagauaaaauguaugugagagagacuuuaaaguacaaaacacuagaguaaccuggaaucugugauuggacuucaagggguccuugaacccacugaaauuaccuguggaaugaaauguacauuuauuuuccaguggagaguauucaugacuuuaagccucacaagcauauauagccuaaaaagaguucaagagucaccacaccaaucgaugcugcuguugcuguucuuacgaaaucacuuucuguugcucagauaagccauuuauuuguaaaaucuguacuuuuccucauuauauaacagccuucuaaaggaaagauaaaaugaagguuuaggagccauagcaguuacaggucaccccaggggggcagugguauuccgucagucuugugcuuuuugcccugagucuaucuugcccagggaucugagaagggaccuugagaggcuguaagucagaaccaguguucauaaggcaaacacaaaugcacggccaggcuccugugugcuuggacacagaggaguccuuuccacaagauaagugcagagaaauaaaugcagcagucacuuuacccagcaagggauacauuuagaaaaugcuucaugcccaacaagugauauaggcagaaggugaaaauagcuucuaagguaaucuaugaggguggcuccauagugaccauggagagaaacagggaucuagcucucuaaucauccaggcugauguuuggggacacaccagagccuuccagagcauauggccuggagagcacuggagauaggaccugguaaggcuucccuggccagagucuaccuuauguguaagaaauaccaauugaaauaccucagggaagaacacccuccuucugcuccucaagccuucagggaaggaaauccugcagugucuccccugaaaucucaucgucaagacaauucacaauguaagcagcucaguuuuuuuaaagguuuagaaagaacuucccaaagcuagagccaggagguaggguauuuguuuuaaagucugucugcccagaaaauugaguccuauucggucccaucagaagcauaugcuguuuauauguauuuauagacccuggaauugguaucacguguuaguccugugaguuccuggggugcucucacaguggguggaaucuaacaugcaaccacuuugcuuuccugggauccccuuuuuccugaugugcuuuuagaauuucccuggugaauuaugguucauagcccugccaggcaccguacaggaaugggccuggguuagcaggacucugaggcuaaucuaugcuuaugaagcccggggccugugcucucugaugcacugggagagggaacauacauuugccuuuauccaugaacucaauuacauggcuguaggaugauggggcauuuuuaaugaguauuagcuggugaggggaugaggagggaaacgugucaaagccagaagaaaauaugccgucaccucugaugugucugcaguacacaccaugccuguauaaaaagcacacacuuuucaaucucacuccauucuuguacaccaggggcugguccugauuuaaccccacgugggacacgcagugucccccaggccuaugugucuauuagcagcacuuggcagccagcagcagcucaaccugccuuuaacugaaaaggaaguggggacaggaauagaacagaugcucguucuucuucccacucucuggggucuuuaaugguaugcuggucacaaggccaagcccugccagaccugauacgguacaaagacaccuccccaggcgccucagccugggagcucaggggaaauggagcuaggcugggacaagccacugauuugaacaaaaagacaggccugugaagaggugaggcauggauuuuauguuagauucuaugcagggcucauuaguggggaaaagguauguuccgagucagggaucugcugcugcugcugcagugaggggacacccguggccucugcccagccauccccaaagccagguuucuagagaagagaagcaccacuucucuacaaacucacaaauuaucuaauaaacauuuucugacauuauagggaguuauuuuauuuuacucaaaacuuucuguggaaaaguauaauguucuauguuucagggagaggaacuuugaaaacaccuaagaagcuacuuuuccuggugauggugaaaauugagaccuucuaacaucaucuuucuuuuuauuuaauaagcauuuuacguaguguuuauauuguguaagaucugcuucuaagcacccuauauuuauuagcuuaaucaucacaaaaucugguacuauaauuaaugauccccauuuuauaaguggagaaacugaggaacgggggcuauauguaggccaccaaaaucaugcacacaacuagaauguguaggagucaggguuugaaccuaggaagucuaaccucagaauccauucucuuaaucacugugccacaacaacgucagcuccauucauucacucauucauucaggcaacauuugcuagguaccuacccucugccaaauacaccgauguguguggagugacacaugaugaacaaaacacaucccuagagaaucagucauagugaagcgacaaagagguuuaacaaaauacagacagguagccagugauuaacaaaacgaugaguaaacacacuucagagggagcacagagcacuaacaguuaggagugaaguccuaacucccaaccuucagaauacacccaggacuuaacgucucagcccuugcacugcuugccuguccugcucaucuggaauauugcugacaacagcuccuugguggcgucugcuuuugcuuuugucuuccuguccucuauuucccagacaguauccagagugauccuuuuaaaauuaaguuagaguucugaaaacccccaguggcuuccaccacauucagaaugcaagccaaagccaucgccgugggcugcaggcccuggaugaccuugccucugcccuguucucacuccucccgucacucccuggggucccgagcuccagccucuggccucucugccaggcccacccacuugagagcugugugucacuucucccugguguguucucacugcgggugccagcauggugucucccucacuuccuccaggcaggucucuacucaaacgucaccuccucagagaggcuuccucuggccacucucuuuaaaagacaaaauugacaaaugggaucuaauuaaaauaaagagcuucugcacagcaaaagaaacuaccaucagagugaacaggcaaccuacaaaaugggagaaaauuuucgcaaccuacucaucugacaaagggcuaauauccagaaucuacaaugaacuccaacaaauuuacaagaaaaaaacaaacaaccccaucaaaaagugggcgaaggacaugaacagacacuucucaaaagaagacauuuaugcagccaaaaaacacaugaaaaaaugcucaucaucacuggccaucagagaaaugcaaaucaaaaccacaaugagauaccaucucacaccaguuagaauggcagucauuaaagagucaggaaacaacaggugcuggagaggauguggagaaacaggaacacuuuuacacuguuggugggacuguaaacuaguucaaccauuguggaagucaguguggcgauuccucagggaucuagaacuagaaauaccauuugacccagccaucccauuacuggguauauacccaaaugacuauaaaucaugcugcuauaaagacacaugcacacguauguuuauugcggcauuauucacaauagcaaagacuuggaauaaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaaccaaacacugcauauucucacucauaggugggaauugaacaaugagaucacauggacacaggaaggggaauaucacacucuggggacuguggugggguggggggcgggggaagggauagcguugggagauauaccuaaugcuagaugacgaguuagugggugcagcgcaccagcacggcacauguauacauauguaacuaaccugcacaaugugcacauguacccuaaaacuuaaaguauaauaaaaaaauaaauaaauaaaaaauaaagaacuaucugagacuggguaauuuauaaagaaaaaagguuuaauuggcucaugguucacaggcugugcaggaaguauggcugaggaggucucaggaaacuuacaaucaugaaaaaaaaauaaaauaaaauaaaauaaaauagugcccgcauuacuaauccugcuuaacaacacuguuaugcuguugaauuuuucuuucugggacuuaguaacaccugauauauuaaauaucuauuuuuuaaauuauuuuuuaauuuuuuaaaucucuguuuucagagguugaauggggggguacaagugcaguuuuguuacauggcuguguugcacagugauaaagccugggcuuuuaguguaaccagcauccaaauagugaacgugguaccccuuaagucauuucucaucccucaccucccucccacccuccccguuucgaagucucuaaugucuauuauuucacuuucuguguccauguauacacauuauuuagcuuccacuuaauaucuguuucuuuagggguuucuugucugccuguaaguucccacuauaaguuccaucagggcggagucuauauuuuauucacuguguuaucaggagacccuggaacagugccugaacauauuagauucucaauaaaucguuguugaauaauugauugaaugagugaaugaauuaaugaauugcuuuaagacaucaaggaaggguucccuggaaguggacaguugaacugagugcugcaggauaaggaagaguuugcaaggcaaacaagagggaggaaaagcauuccagacagaggggaaaugcaugugcaagauuucaaggcaagaaaacagauuggcuuaguaugauuguuuuacucucuuuugcauuaggcgcguuggagacucugacuacagugauggagaagaggacuuuuacuacacugagaucaagcucaacacagacucaguggcagacgggcugagcagccuggccccggucucaccuucccagucccuggcuucaccuccuacuuuccccaucccagauucaagccgaacagaaacuccuugugccaaaacggagacuaaguugaugacgccguugagccgcucagcucccaccacccucuaccucgugcacacugaccaugcuuaccaggugacuugcaggggacugugagagcaaucacuuugaccuugaccaaaaccaggggccaucuggccuaugaguaaaagacaacucaguggaaaaacagcaucacacacggcagcccgguagcuuugauuuuucucccuuuaaagccuaagaucucacacagauaggguccuauggucuagucucagauugcccaaugcugccuguggauucgaucccguagagauuguuaugaugauaaaaaucccuugggcacaguggcucacgccuguaaucccaaacacucugggaggcugaggcgggcggaucaccugaggucgggaguucgagaccagccugaccaacauggugaaaccccaucucuacuaaaaauacaaaauuagcugggugugguggcacaugccuguaaucccagcuacugaggaggcugaggcaggagaaucacuugaacccaggaggcagagguugcggugagccgagaucccaccauugcacuccagccugggcaacaagaaaaacucugucucaaaaaaaaaaaaaaaaaaucccuaauguuaucugggcaugguggcgugugccuguagucccagcuacuugggaggcugaggcgggagaauugcuugaacccgagagacggagguugcagugagccaagaucgcaccacuguacuccagccuggcgacagagcgagacucuguuucaaaaacaaaaaaaaucccuaauguugcaaagcccucaaaauggugccuggcacauuacauaaguaucuguuuaaaaaaaaaauaaggccgggcacaguggcucacaccuguaaucccagaacuuugggaggcugaggcaaguggauugcuugaacucaggaguucgagaccagcgugggcaacauggugagacccccauaucuacaaaaaauacaaaaauuagccaggcaugguggugcguaccuguagucccagcuacuugggaggcugaggugugggaggaucaccugagcccagggaguuugaggcugcagugagcugugaucauggcacugcacuccagccugggugacagaguaagacccugucucaaaaaaauaaauaaaauguaagcauuggaaagcuuuggcacaguggcagaaucacacuccaaauccgggacuucaugcccugccuucuaaauggauaauuaagcauuucagauuagaguagucguucucaauguuccccaaaucaacagugccagcaucaccugggaacuuguuagaaaugaaaauucuugggaccaccccucuuccacacccuccucugugccccccaccaacccugcauucuguuuuaacaggcccuccagggaauccugagucaugcuaaagucugagaagaccuuagggacaaauccugcaaauuuaggacauggguaaaacucccuuuuuuccugccagaaguuacuuuuuuuuuuuuuuuuugagacagggucucuaucuuucucucaggcuggagugcaauucacugcagccucgaacuccugggcucaagcaauccuccugccucagcuucccaagcagcugggacuacaggugugcacuaccacauccagcuaauuuuuuaaauuuuuuguagagacgagcucucacuacauugcccaggcuggucucgaacuccugucuucaagcaguccucccauguuggccucccaacaugcuaggauuauaggcuugagccaccaugccuggccauuaauucuuuuaaauguugauuuguuuuuauacaauguuaauacauucaaauuuuaagaaaauauuuuucacauaauucucaacuaccuuauucaacuuuuuaaaaucuccuuuacauacuuguaauuauguucucccacccuuguuuuauaaaaacuuuucauguaacuaaauaauauccaauuaaauugaaacaccaaauuguuuuaaucauucuuauuguuagguauuuacuuuuuaaucuauccuguuuuuucgucauuaauaacuccacuguaaacaucucugugccugcuguguuuuguuuuuuguuuaaauucucagaagaauaauuauugaguccgaggauguaauaugagggaacaguuuauggcucuuacuauguauugccagaaugcuuuccagugguaccaaguacaaagccacugccacuagcaaauauauuuguaauuagaaaauuacaccuauagaggaaaaauuuagccacuuauuuagcagacuuaaacucaagaguaauugaauagagcuaauauuugaauuaguuaguguaauaaauuucauuccugacucuuauuauguuggucaaaacgaauaauucauucaucuucauuuaucacuguuucacuuaggucagaaauccuggguacuaacuuaguuaaaucauuuugcucaucuauauaaugagagaguuggaacacacacuaguugaucuacaagguccuucccaaagcauaaacuuagaaauauugagacuuuucuguuuauagaaauuauaaauguucagcauagaaaauauuaaacacaguaaagaaagaaaauucaucccuaauuccaaaccuuaguuaauauuuuuuguauguacuucaagacuuuguucuguguuuauacauuugcaguuuuuaaaagggaucuguugcagaacuguuuuuacuguauuuuauuuuuucuauuuaauauaucaugaacauuuucccaugccaaugaaucuucuucaacaacaguauuuuaaaaauugaugccuaauauuuauacguauuugugggguacacagaacauuuuguuauaugcauaggauguguaacagucaagucaggguauuuugaauauuaaucgccuuguguauuuaucauuucuguguguugggaacauuuccaguccucucuucuagguauuuugaaauauaaaauacauuguuguuagcuauagccauccuacucugcuaucaaacauuaguacucauucuuucuaucuaacuguauguuuguaccuacuaaccaacaucucucccuaccuugucccaucacacccuuccccaucuccuguaacuaucauuuuauucucuaccuccaugacaucaauuauuguauuucccacauaugagugagaacaugugauguuuaucuucaagugccuagcuuauuucacuuacauagugaccucuaguuccauucauauggcugaaaaugacaggauaucauucuuuuuaauggcugaauaguacuccauuguguucuuaccacauuuugacacuucaucuguugauggacacuuagguugauuccauauuaucuuugcuauugugaauagugcugcaauaaacaugagagugcaggugucccuuugauaggcugauuuccuuuccuuuagauaaauacccaguagugagauugcuggauuauaugguaguucuguuuuuagauuuugagaaaucuccauacuguuuuccauaauagguguauuaauuuacauucuuaccaacaguauauaaaagaucccuuuucucugcuuccucaccagcaucuguuauuuuuugucuuuuuaauaauagccaaucuaacuagggugagacgauacuucauugugguuuugauacacauuuuucugauauuagugacguugagcauuuuuucauguaccuauuggucauuuguaugugugcuuuugaaaaauuuuuauucagguccuuugcccacuuuuuaauggaauuauuugguuuuugcuauugaguuguuugaauucauuguauauucuggauaguagucucuugucagaugaauaguuuguggauauuuucucacauucaacagguugcucuucacgcuguugauuguuucuugugccgugcagaagcuuuuuaguuuaauauagucacauuugucuauuuuguuuguuuguuuguuucuugugcuuuugaagucuuagccauaaaaauauuugccugggcccauguccuagaguguuuuucuuguguuuucuuccaguaguuuuauaguuuaggaucuuacauuuaaguuuuuaauccauuuugaguggauguuuguaaaugacaagagcuaggggucuaguuucauguuucugcacguggauauccaguuuucccagcagcauuuauugaagaggauguccuuuccccaguguauguucucaucgccuuggucaaaaaucaguugguuguaaauauguggacuuauuucuugguucccuguuuugcuccauugguauaugugucuguuuuuaugccauuuuaacaacauuuugaauuacucuguagguauaucaugauuuauuuaccuuuuucccuauuacugggcauuuguguuauuuccagguuuuuuuuuuuuuuuuugagacaagauuucacucuguugucaggcuggagugcaguggcaugaucauaguucacugcaaccucgaacuccugggcucacauaaucuuccugccuccaucuccaaaguagcuagaacuacagauacacuccaccaccccuggcuaauuuuuuuuaauuuuaguagagacgaagucucacuguguugcccucgcuggucucaaacucugggcucaagcgauccuccugcuucugacucuuaagugcugggauuacaggcaugagccaccacgcccagccccaauuguuuuuuauaauauauaguugugcaaggaacauucuugcguacauuucuuuagaaugaaugccuagaguggaauagcuaacacagagaaugcuaagaauuuuuauauguauugucaaauuaccuuccaagaacauuguacuaguucacacccacccucacaguauagcaggguguauuccccaauuuuauagugaagaauucuaccucacagguauccuaaaauagguauauguacauauaauaaaauuucuuuucagaaaucaacagucaaaaaccaucucuuuuuauaccuuagauagcuugcuuagguauauauacaaaguuuauuucuggcuacucccuuuaaccuuguuuaaucucuuccuauuagauaauuaguccaaguuauuaauauagcugagaccauuucugagguccuccuuugguaauaagagcuuaaagcuccgaaggaaaauauuccuucauaacagcuuucucuguuuuuuauuugacaggccacacccccugugaccauuccaggaucggccaaguucacccccaauggcagcagcuucagcauuuccuggcaaucuccuccggucacuuucacaggcaucccaguaaguagaaaaacgaaaaagccaaaaaucuggucaaagccaauguagacuaaauuuagcgaacaaauaguagaggcaugcaagaaaaauacaaacaucagaaugccagaaguacuauauuucuuaaaugauauuuguaaacucaucagcagauaucacuucuuuucgaaaagguguuuugacuggcauuucagaaaacuauaagagaguuucaacuguucauaaacaacuuguuggaaauauaucaagauuuuuuguguguugguaguguguuuguauguuuccaaaagacuguaaaauuaauagcugaacucagaucuuauauggaaaaaaugguguuuaucauuauaaguaacuauaaaauuuauuacuuaggaaguguucuguacguaugucauuuugaaggcucaaaaaauacaucaaaaucauuuuuucuuucagagucugaauaauccaugcugauggauaaucugaaacuaaaugagugcuaaaauaugcaaucagacuuaaguaguacauaagaauugauuugacauauuaaaugauuccugucugauaaaucacugugaauuaacuugauuccuaaccauucauuuaaaaaauauauuggaucuuuuauaguuuaucacagaacagccacaugcaugcacacuguugaugcucacagugguguauaacuccugauaagguucaggaaguggcuuaugauaacagauauuaaccuuauuuucucuucuccacccgucuccccaaggaccucacaaaagcuucuuauugucaaccacuggcaucucccggagguuuccagcaaagucuaacgccuucuguggaacugauaaaaaugaaaguggcugaaugaauugugcugugcucuguugaugaauauuuauuaaauuccauagaggaauagccaagaauaaaaagcauacugcuagaggcaauuugggaaaugguggcuuccagaaaagacucugggaaugugauuuguaaacaacaccaugggucugaagucauuuuuaaaguuguauuuucauugaauagugguaacuucugguagcucugcaagagugaccuuguuaguagacguuagaagagggcagcuuagacguguugguauuaguuuugcuucuggcaagaacacugauccacugauguaggugucagggguuaacaaucuguuuggggacuuuuuuuuuuuuuugguagacauaaaaagacccagaguggcucuugauacauuuuugagacagccacucuguauuaaccuaaaauggcagccacaguuacagaauuauugagaccaucuuuucugcauccuauuaauuccugccuuugacuugggaagaauuuucaaugauguaugggaagcauacaccauguugcucaucugguacuauagcauguagauggaacagcccaguucaaaccucuuucagacuaccucuguggccaagcaaacuggaauguuuuuccccuuugcuuuucuaacuaaauuaucuucugaaguauagggaaaucacucugaggggcucuuuacuagcuccauguccuccaugguucuuaugugucuuacacacuaggauaccagccaggauaccuuauaucacucguuuuucaacaauagaauguuaaaacucugcuauggacacuguguauuucuacccucaucucagugcccuugauuuuuuacagaaucccucauuucacucuguguugauuaccugggacauucuagacaaaagcuuugacagaaaguauauauaugauauauaaaacauaccauauauacgauauauaaaacauuccguauauaugauauauaaaacauaccauagcuggguuaaguagguauuccacuaaaauccuaugugagcuuuuuuuuuuuuuuuuucuugaaacagggucucaguccaugacccaggcuuagagugcaguggugccaucacggcucacugcagccucaaccucccugggcucaucuuccccacuucagccuccugaguagcugggacuacagaagcacaccaucacaccuggcuaauuuuuguauuuuuaguagauacggggguuucccauguugcccaggcuggucuugaacuccugagcucaagcaaucugcccaccucagccucccaaagugcugggauuacaggcuugagccacugcgcccagcugagagcuucuaauuuauucuuucaccagagaauucccaauugugcugauuguguaaccuguuucagcaaagacuuuagacugauuuuagcagucaagcuugccauuccuauuuaaagauaaaguaagggugggguggaauuuucaaagguuuuuguuuuacccuagaaagacaagaaggcuacaacuaagaauguucuuuuuguugcuaaacucucuggccaugcucuaaaaaaaacaagcaggugcugcuguccuccuccuccuccuucuccuggugggcuagcucucauaacagcccacccacacagaugcaggacuguuguacacccacggacagcaugccagcagcugucccugaaugcuccaggagugccaggcaagccacguagaauuuaaaaacgugaauucuuacccucuaaauugguguaauaggguuuucagaccaaagcucuaaaaguuguaaguuauaaugaauuuguauuagugauggcuucaauuguguccaaacugaagaacagagaaauauucaugugauaaaaugcuuuucaaaaaaaaaauaccuuuauccuuguacucuaaaauaaauacccugagguugucaacccuguuuagaguucacuuuucucccacaucuuugagacgugguauugaagagggauacuuuuguacacuuccuagaaagugagaaaaaccccuuucugaaaaaucccaaggguugcaggauuuuauuuauucauuugccuaugcuagauuuccugaacauuggacuuuaauaaguucccuggguaagaccucuucccggagguguguagcugagaaggcugaacugcauauuuaacaaauguaacuggaaguucagucuuuuguagccuaaggcuguggggagagggguaggaaagagaacauccuuaauuacaacuuucuuugacauguuuuucccuaaugaccugccuucucuccuaauuaucuccauuucuuucucucucuuuucaugacagaaaacuaagagccguuggccccuuuauuaaucagcucaagacugccauaaaauaccacagacuuggcagcuuaaacaacagaaauuuauuuucucacaguucuagaggcuagaaguccaaaucaacgugucggccaauucaguucuggugaagaccccuuccugcuuguagauggcugccuucucacugugcaugcacagucgagagagaaagagagagagagagaaaucgagagagagagcacaagcacaugccagggcacuggcaagccagggagagcaagcauggaggaaugcaccagccucugcuaucccuucuuaaaggacacuaauccuguugggucagggccccacccuuaugaccuccuuaaaggcccuauguccaaauacaaccacacuggggauuagagcuuuaucauaugaauuugagggacacaaacauucgaucuauaacagccccuaggaaagcaaguauaagcuagucaaccugcuauccaaguucuaggaggcuucaggcuguuggggagggucuccaaagcugaaauagcagugcuuauuugucaaaugcuuagcugguuugagguuucuuuuuuaaugccuugagggaagauucagaauuauaugagguuaaaaccaagccagaggccuuuuuuuccucccucuuaagagaaaaacuuacaagaaaagaaauuucuccugcauacuuacagaagggcacagcaucuuuagugugaggcuuacuugcaaauccuggcucuggcauuugugaacgccaugugauccuucuaaaguaauauccucuacucuaguucuaccucuuagaguugugucguucacacagugccuggcauguagcugacaaugcagauuuccuaccaucauugcugccuuuacugugucuaagcacuguauaaugggucagagaaagcggcuccucccuauuuaggauugauuccuguaacacagauauacucaacacaugggagagauuagucacaauuuuuacagacuauaauuuaaaauucuuuuuuuuuuuauacugggaacuuuccaaauacguuuuguuuuuguucuuuuuuuuaaauuaaaguuuuaggguacaugugcccaacgugcagguuuguuacauauguauacaugugccauguuggugugcugcacccauuaacucuucauuuaacauuagauaugucuccuaaugcuaucccucccccgccccccacaacaggcccuggugugugauguuccccuuccuguguccauguauucucauuguucaauucccaucuaugagugagaacaugcagcguuugguuuuuugucuuugcgauaguuugcugagaaugaugguuuccagcuucauccaugucccuacaaaggacaugaacucaucauuuuuuauggcugcauaguauuccaugguguauaugugccacauuuucuuaauccagucuuucauuguuggacauuuggguugguuccaagucuuugcuauugugaauaguguccaaauaaacauacgugugcaugugucuuuauagcagcaugauuuauacuccuuuggguauauacccaguaaugggauggcugggucaaaugguauuucuaguucuagaucccugaggaaucgcuacacugacuuccacaaugguugaacuaguuuacagucccaccaacaguguaaaaguguuccuguuucuccacauccucuccagcaccuguuguuuccugacuuuuuaaugaucaccauucuaacugaugugagaugguaucucauugugguuuugauuugcauuucucugauggccagugaugaugaacauuuuuucaugugucuuuuggccgcauaaaugucuucuuuugagaagugucuguucauauccuucgcccacuuuuugaugggguuguuuguuuuuuucuuguaaauuuguuggaguucauuguagauucuggauauuagcccuuugucagaugaguaaauugcaaaaauuuucucccauucuguagguugccuguucacucugaugguaguuucuuuugcugugcagaagcucuuuaguuuaauuagaucccauuugucaauuuuggcuuuuguugccauugcuuuugguguuuuagacaugaaguccuuguccaugccuauguccugaaugguacugccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuauuaaauagggaauccuuuccccauuucuuguuuuugucagguuugucaaagaucagauaauuguagauauguggcauuauuucugagggcuccguucuguuccauuggucuauaucucuguuuugguaccauuaccaugcuauuuugguuacuguagccuuguaguauaguuugaagucagguagcgugaugccuccagcuuuguucuuuuggcuuaggauugacuuggcaaugcgggcucuuuuuugguuccauaugaacuuuaaaguaguuuuuuccgauucgugaagaaagucauugguagcuugauggggaugacauugaaucuaugaauuaccuugggcaguauggccauuuucacgauauugauucuuccuauccaugagcauggaauguucuuccauuuguuuguauccucuuuuauuucauugagcagugguuuguaguucuccuugaagagguccuucgcaucccuuguaaguuggauuccuagguauuuuauucucuuugaagcaauugugaaugggaguucacucaugauuuggcucucuguuugucuguuauugguuuuaagaaugcuuauaauugguuauaagaaugcuugugauuuuugcacauugauuuuguauccugagacuuugcugaaguuacuuaucagcuuaaggagauuuugggcugagacuaugggguuuucuagauauacaaucaugucaucugcaaacaggggcaauuugacuuccucuuuuccuaauugaauacccuuuauuuccuucuccugccugauugcccuggccagaacuuccaacacuauguugaauaggaguggugagagagggcaucccugucuugugccaguuuucaaagggaaugcuuccaguuuuugcccauucaguaugauauuggcuauggguuugccauagauagcucuuauuauuuugagauaugucccaucaauaccuaauuuauugagaguuuuuagcaugaaggguuguugaauuuugucgaaggccuuuucugcaucuauugagauaaucaugugguuuuugucuuugguucuguuuauaugcuggauuacguuuauugauuuguguauguugaaccagccuugcaucccagggaugaagcccacuugaucaugguggauaagcuuuuugaugugcugcuggauuugguuugccaguauuuuauuaaggauuuuugcaucaauguucaucagggauauuggucuaaaauucucuuuuuuuguugugucucugccaggcuuugguaucaggaugauguuggccucauaaaaugaguuagggaggauuuccucuuuuucuguugauuggaauaguuucagaaggaaugguaccagcuccuccuuguaccucugguagaauuuggcugugaauccaucugguccuggacuuuuuuugguugguaagcuauuaaugauugccugaauuucagagccuauuauuggucuauucagagauucaacuucuuccugguuuagucuugggagggugugugugucgaggaauuuauccauuucuucuagauuuucuaguuuauuugcauagagguguuuauaguauucucugaugguaguuuguauuucugugggaucgguggugauauccccuuuaucauuuuuuguugcgucuauuugauucuucucucuuuucuucuuuauuagucuugcuagcagucuaucaauuuuguugaucuuuuaaaaaaaacagcuccuggauucauugauuuuuugaaggguuuuuugugucucuauuucuuucaguucugcucugaucuuaguuauuucuugccuucugcuagcuuuugaauguguuugcucuugcuucucuaguucuuuuaauugugauguuagggugucaauuuuagaucuuuccugcuuucucuugugggcauuuagugcuauaaauuucccucuacacacugcuuugaaugugacccagagauucugguauguugugucuuuguucucauugguuucaaagaacauuuuuauuucugccuucauuucgugauguacccaguagucauucaggagcagguuguucaguuuccauguaguugagcgguuuugagugaguuucuuaauccugaguucuaguuugauugcacuguggucugagagacaguuuguuauaauuucuguucuuuuacauuugcugaggagugcuuuacuuccaacuauguggucaauuuuggaauaggugugguguggugcugagaagaauguauauucuguugauuugggguggagaguucuguagaugucuauuagguccacuuggugcagagcugaguucaguuccuggauauccuuguaaauuuucugucucguugaucugucuaauguugacagugggguguuaaagucucccauuauuauugugugggagucuaagucucuuuguaggucucuaaggacuugcuuuaugaaucuggcugcuccuguauugggugcauauauauuuaggauaguuagcucuucuucuugaauugaucccuucaccauuauguaauggccuucuuugucucuuuugaucuuuguugguuuaaagucuguuuuaucagagaccaggguugcaaccccugccuuuuuuuguuuuccauuugcuugguagaucuuucuccaucccuuuauuuugagccuaugugugucucugcacaugagauggguuuccugaauacagcacacugaugggucuugacucuuuauccaauuugccagucugugucuuuuaauuggagcauuuagcccauuuacauuugagguuaauauuguuaugugugaauuugauccugucauuaugauguuagcugguuguuuugcucguuacuugaugcaguuucuuccuagccucgauggucuuuacaauuuggcauguuuuugcaguggcugguaccaguuguuccuuuccauguuuagcacuuccuucaggagcucuuuuagggcaggccugguggugacaaaaucucucagcauuugcuugucuguaaaguauuuuauuucuccuucacuuaugaagcuuaguuuggcugaauaugaacuucuggguugaaaauucuuuucuuuaagaauguugaauauuggcccccacucucuucuggcuuguauaguuucugcugagagaucagcuguuaguccgaugggcuucccuuuguggguaacccaaccuuucucucuggcugcccuuaauauuuuuuccuucauuucagcuuuggugaaucugacaauuaugugucuuggaguugcucuucucaaggaguaucuuuguggcauucucuguauuuccugaauuugaauauuggccugccuugcuagauuggggaaguucuccuggauaauauccugcagaguguuuuccaacuugguuccauucucccugucacuuucggguacaccagucagacauagauuuggucuuuucacauagucccauauuucuuggaggcuuuguucauuucuuuuuauucuuuuuugucuaaacuucucuucucacuuccuuucauucauuugaucuuccaucacugauacccuuucuuccacuugaucgaaucagcuacugaggcuugugcauucgucacguaguucuugcgccuugguuuucaguuccaacagguccuuuaaggacuucucugcauugguuauucugguuagccauucgucuaaauuuuuuucaauguuuuuaacuucuuugccauggguucgaacuuccuccuuuagcucggaguaguuugaucgucugaagccuucuucucucaacuugucaaagucauuuuccauccagcuuuguuccguugcuggugaguagcugcgcugcguuccuuuggaggaggagaggcgcucugauuuuuagaguuuccaguuuuucugcuguuuuuuccccaucuuugugguuuuaucuaccuuuggucuuugaugauggugauauacagaugggguuuugguguggauguccuuucuguuuguuaguuuuccuucuaacagucaggacccucagcugcaggucuguuggaguuugcuggcgguccacuccagacccuguuugccuggguaucagcagcggaggcugcagaacagugguuauuggugaacagcaaauguugcugccugaucguuccucuggaaguuuugucucagagaaguacccggccgugugaggugucagucugccccuacugggggaugccucccaguuaggcuacucgggggucauggacccacuugaggaggcagucuguccguccucagaucuccagcugcgugcugggagaaucacugcucucuucaaagcugucagacagggacauuuaagucugcaaaguuuucugcugccuuuuguuuggcuaugcccugcccccagagguggagucuacagaggcaggcaggccuccuugagcuguggugggcuccacccuguucgagcuuccuggcugcuuuguuuaccuacucaagccucggcaauggcgggugccccuccccagccucacugccaccuugcaguuugaucucagacugcugugguagcaaugagugaggcuccaugggcguaggacccuccgagccaggugcaggauauaaucuccuggugugccguuugcuaagacuguuggaaaagcgcaguauuagggugggagagacccaauuuuccaggugcugucugucaccccuuucuuugacuaggaaagggaauucccugagcccuugcgcuucccgggugaggcgaugccucauccugcuucggcucacacucggugugcugcacccacugucgugcacccacuaucugacacuucccagugaguugaacccgguaccucaguuggaaaugcagaaaucacccaucuucugcaucacucaugcugggagcuguagacuggagcuguuccuauuuggccaucuaauuuaaaauucuuuagacucuucugaggucacaccuaaccaacaaacuauguacauauagcccaauaauuuuauuuagcuagaaauauuaucauauuauacuguccaagcacauuauaugcuuuauaaaacaugcuacaaaauagaacuuggaaaugguuaagaaauaaacaaauugaaaugcagagaccacuaagagagagaguauuugcuuuauagggcuuuauuuuagggcacacauuauuuacaucaacgauauggcaggauggaagagugcaaaaagcagggcuuugacaucauucggaagugaguuccaaggccagcuguguucaagucagacaaugguguucaaacccugaguccauuuacuguguggacuggacagugcacuuaacuucuccauuuucucaucuauaaaauggaaauuauggcuaugauaggguuguugcgaagauuaaaauagauaacauauggaagacacuuagcuuauauagcaggcucucagcaaauuacuucugcugcuacuuuugccucugggauguucugcaggccauuucccugcucaaagccuaaauuucucuaucuguaagauguagauauagauuauuuauuuugcaaguuuucugugagaauuaaaagagauaauagauaaccuacuugccugucuuucacauucgcaagcacugaauaaaugguaguugacugccccaguuacucccuugguuucuccacccucauccucaacuaaaauaagaagcugaaacaugacugucuugccauuaaaagucugaagaaaaaacucacaugucauauugagccuccuacugaacucagccacauauggaaguuugaaguggguccucgaaaugcauguacugaacuccagaguuaagagagccauuagcaggaagaaggacuuuggcgaggggucauuccugcaggagguccauguugugguuugcaagugucccccaaaguucauguguuggaaauauaauccccagugcagcaguguugagagguggaacccuuaagaggugaugggguccagaggacucuacucucaugaauggauuagugucauuaucaggagaguggguuuguuauaaaaacaagcucagccuucucuuaagugaacuguuacccuuccacccuuugcccugggaugacacagcgagaaggccguugucacaugccggccccucaaccuuggacuuuccagccuccagaacuuuaaaaaauaaauuucugcuuauuauaaaucauccagucucagguacucuguuauagcagcacaaaaccgcugaagacaauccaugucccucaaacccuguuccuggaauuuucaaaagccuguuccucaugccuccccgacccugcugcuucuguaacuuucucaucucagaaaguggcaccacugugccuccugccacuugggccagaaccugggauucauccuugacuccucaauucauccuugauucaucuagagaugcaauuuucuuugugccccauccuaacccacaaguccuaggcugugccucuaaacaacaggaauccagacccuccccaccacugccgccauaccuagucuaaaccaccaguaugucuuugccugguauacugcaaaagccucuuaacuccagggcuccuuuccaggcugucugcuguccauucuccaaagugccaaagugaucuguuuaaagcauuaaucagaugucuuacuuuuaaaaacacuccaauggcuuacuuauugccguuagaauaacauucagaucccuuauugcaggucagaggcauagcuugauacuuccgucuccucuccucccacccuccaccucccacaaagugcccaccccuuuuucugcagugccuuguaggugaaagguaaccuccucaggaagccuucucuuaccacucaagauaaauaaauguccucuccuucuauuacacuuuagccuguuauccuauuucauuucugucagcuacuuaucacuaaaaugaucuugugugauuucguauuuauugucugucuucucacuagaacguaagcuccaugagggcagagaauuuguuuuguucacagcuauauccucagaaucuguaacaaugccugguacauagcaaguacuuaauaaauaucuguugaaugaagaguauccaauaaucucauaucacuucaugcaaaagggcuauggcaacuuugcaugaucuagaaacuuccacauuauccguggcugaugggaguaguguuacugucaugucaaccaaacuuuuccaguucucugacuaaaugaaguacaguguucuugggauucuauaaguucuacaagaauuguuaauuuuuauguuuauuuuccugauaauuuaaaacaauucauauaagcauaucagagaucaucuacagugacuguagaugucucagguauucacucccucuaguuugcuguuauucauccuguacaaaaccaaagccauuaugagauggggugaggaggauucugcucuuggaggaagcugcguaucuauacacaugaaaugaaugcacugaacuccaaagcuuuuauuuuuaaaaacucugaauguuaccucugcuggcccuugcuccacccaacuuuagcaugaagaccagugguauagaauaguucaaacucauggcaacaaugguuccaaauguuagauuuuuacuuaccuguauaauuuuuuuuuuuuuuuuugagaugugucucacucuguugcccaggcuagagugcaacggcacaaucucgacucacugcucccuugaacucuccacacucaggugauccucccaccucagcugaguagcugggacuuuaggugcacaucaccaaucuggcuaauuuguguauuuuuaguagagaugggguuucaccauguugcccagacugggcucaaacuccuggacucaagugauccauucaccuuggccucccaaagugcuaggauuacaggcauaagcuaccacuccuggcccuaccuguauaauuuuuuaaaugucuaaguuuugugcugcuauaacagaauaccuuagacuggguaaucuauaaugaacagaaauuuacugacuaacaaccuggaggcggggaaguccaacaucaacaugccagccucuguuagggccuuuaugcugcaucaucacauggcagaaggugagagggugaggggggccaaacuggcccuugcagaacacuaaucccacccaugggaguggagcccucauagccuaaucaccucuuaagggccccaccucuuaauacuauuacaauggcaaguaaguuucaacauaaguuuuggaggggacaaacauucaagccauagcauuaaaauuaaugucugggaaaauaacacugaugaucucuauuaggccauacuugcauugcuauaaagaaauaccugagauaggguaaguuauaaagaaaagagguuuaauuggcucuacaggcuguacaggaagcacaguggcaucugcuucuggggaggccucagggagcuuuuacucaugguggaaggugaagcaggagcaggcacgucauguaugaaagcaggaaugggcauaaaacaaccacagucuuauguaaacucaagagugagaggucacauaucaccaagggaaugguccaagcuauucaugagggauccauccccauaauccacacaccucccaccaggccccaccuccagcauuggggauuacuuuucaacaugaaauucaggcagagacacacauccgaacugugucaugugcauuccuuuacguugaaagagaagagaaaguacuaauaccuguacuagagaaaagcaauucucuaaggauguuuggggaauguucccaugacuuuuaagugacaaugcuauuccugugaccacguuggcuccuagguuuuuaaauuuauuaaaugucuauccuccuacauauggcaauacugauuaauuaguugaaacauucuuuuuccgggagguuggcggcgcggggcugaaggcuagcaaaccgagcgaucaugucgcacaaacaaauuuacuauuuggacaaauacgacgacgaggaguuugaguaucgacaugucaugcugcccaaggacauagccaagcuggucccuaaaacccauuugaugucugaaucugaauggaggaaucuuggcauucagcagagucagggauggguccauuauaugauccaugaaccagaaccucacaucuugcuguuccggcacccacuacccgagaaaacaaagaaaugaagcuggcaagcugcuuuucagccucaagcuuuacacagcuguccuuacuuccuaacaucuuucagauaacauuauuauguugccuucuugcuucucacuuugauauuuaaaagauguucaauacacuguuugaaugugcugguaacugcuuugcuucuugaguagagccaccaccaccauagcccagccagaugagugcucuguggacccacagccucagcugagugugaccccagaagccacgauguguucuguauccagaacacacuuggcagauggaggaagcaucugaguuugagaccauggcuguuacagggaucauguaaacuugcuguuuuuguuuuuuccugccggguguuguauguauggugacuugcggauuuauguuucaguguacuggaaacuuuccauuuuauucaagaaaucuguucauguuaaaagccuugguuaaagaggaaguuuuuauaaucuaaaaaaaaaagaaacauucuuuuuccuuuguuaaaaaaauuaauuuguugcagcuuuuaagaauuccagaagcugggaagauuacuuaguguuaggagacagguaaugcaaagggcugaagugaguaauccaggaggggcugaggacaguaggggcccuccucuaugacugagggacagaaaagcaacaggguuaaacacagguccuggugccagggagagcugcagcacagcccugggucuaccaucacacaugccaugaccuuuggcaaguuacuuaaccuccaucugccuuagucuccuaaucuguaaaaugggaacaauaguaauacugcguggggucguugugaagacuaaagcugcugugaguguaccugcacauagugagcgcucaguaaguguucgguggguggcauacguucuugauuugcucagacucucugccucuugccuuuauuccuuccuguugggacgugagagucugcugaugggguguuuuuuacaagaauccauguauuuaguggcagugauugauccacuagagccaacagaagaccuagaccugcacugugucauugucgcuuacuagcuacguaauguuaaauaaaucucuuaaccucucuagguauguuucauccucuaaaaagggaaucaugagccuugcccuacuugacaggguucaugaggaucaaaagaaauagacaggaauguacuuuaagauuuaaaauauuauucaagugaaaauaugguauuaugagccacuugaaaugcauagauaugaaguaaaaaaauguuugagauauuggcuguuggugggucuucucuguuugggaaugcauuuuaauucugccaugagcagcccuccuccauuuaauguguggucucugugaggaaaguauuucauuucaucucugcuucuuuuuuuuuuuuuuuuuuuuuuuuuuuugagacaggaucucacucugucacccaggcuggagugcaguggcacaaucucagcucacugcaaccuccgccccgggguucaagcaguucuccugccucagccucccaaguagcugggauuacaggcacacaaccccaacuuggcuaauuuuuguacuuuuugguacagacgggguuucaccauguuggccaggcugauugaacuccugaccacaagugauccgcccuccuuggccucccaaaguucugagauuacagguaugaaucaccgugccuggccucaucucugcuucuaauggucaaggaucaguguccacacagcaaagguuaacuaacugcauggguggagaaccugccccaucaacuuucuuuuccauguauucaccaggugucacccacacaucauccggugggcacaggagagcagagacagcaugcgcacacgguccuguccuccccacccagaggcacagucagcuuaagguacgacagcuuaaaaaacuccacacaccucaccacaagggaauuaacuguaaaacagaacagcagagagaacccugagaaaugaucuucuauaaaauuucuccacaauugacaaaacacccuuucuuuuuuucccaugguuuuuaccauccauuaccuauuaaugaagauuuguuguuucgggggguaaugauuuacaauaagguuuuuguuuuuuguuuuuguuuuuguuuuacagaauagguaauggugauuauugggucuauuuggagccauguuguauuaaucucuauauuaaaugaacuauaagauacaauuuuuaaugcagaucaagagugaucuccccagaaguuccuuaaccaaaauacaauaguccccuuuuauccacaguuuuacuuuucugugguuucaguuacccaaagucaauugugguccaaaaauguuaaauggagaauuccagaaauaaaugauucauaaguuuuaaauugcacaccauucugaguagugugaugaaauuucgugccauccagcucaguccugccugcgauguauguuaucccuuuguucaguguaucuacacugucuacacuacucgcccauuagauugacuguaacgaacuguacuuguguucaaguaacccuucuuuuacuuaauaauggacccaaagugcaagaguggugaggcuagaauucagauaugcuaaagacaagcuauaaagugcuuccuuuaagugaaaaggugaaaguuuucaacuuaacaaagaaagaaaaaaauuuuuauacugagauugcgaagaucgacaguaagaaugaaucuucaauccaugaaacuguaaagaaagaaaaagucaugcauaauauauauauaggguuuguacuauuugcaguuugaggcauccacuggaggucuuggaacauauuccccacccuuagcagggacugcuguacuagaaauugagaaugguggaagcauuugaaaguaccuacuuaaaaacuugaaagagcaauguugcucucuacuggcauuucuuguguuuacuuguuuaauucaguuuuaugaagaugcccaaauggacauguccacaaguagacaaauagaagccuaagggauaugguagcaaauuuuaacaguugaguguaguggcugugaaaacaaccagcacauauuagagucugaaccuagagagaagucgcugucucccaggcuggagugcagcgcgaucuuggcucacugcaaacuccaccucccggguucaagugauucuccugccucagccuccugaguagcugggauuacagguacaugccuggcuaauuuuuguguguuuuaaguagagacagaguuucaccauguugacaggcuggucucaaacuccugaccucuggugauccgcccaccucagccucccaaagugcugggauuacaggcaugagccaccauggccagccuuuuuuuuuuuuuuuuccucccucacucuugcaagggauuuuugagcucuccauagaaugcccauugaauuccucccacuaaacuaaccuuccucgucugucuuacaggaagcccaggggagagggcaaaaagugucggaagguguacgggauggagaaccgagacaugugguguaccgccugccgcuggaagaaggccugccagagguuccucgacugagagacccccaggcagaggggcucagggcccugagccgcuccugcccuggccugccacugcagguguuggaaagagcuuuuccuacugaauaaaacacaguugaagccaggaaaagcccuuucaggaaccuuggaggaauaacagcaaaaacacagaaaaauuguuuaagucaccaccuaugacaaaagaaaguugcucuuacugagaacccagcuuggagcagcuauaacuaguuuuuuuuccuucaaaagaaaagucaacuuuuuuugcuguaugucuagacuuaaaacuguggacuucuguagcaauugaaccaacaaagcccauuuuaccuagaaaggaggcauauuuugauaagcuuucugaauuaugccauuuucaagauuuuuuugacacuuaaaaaacaagcuacagguuauucaguagcauuuguacaaagaucaauacuuacuuuuguugugaauaaucuuuuccguaucuuccauuugacuucuuggagcaguauaugucaggauguguugcaagacagcgcagcacucugggcaucuuuucuauggcuuuuuguuuguuuuucuuuuaagaauggccccacacugaaccaugguagagcuauuaguuuguagggccccagauggcauaaacucgagaagggauuguccacggaaaucaccagcagacuucagcccgaagcugaguucaggaaguccagcugucacuguugggaaacaucuaggagucuuccuuggauccauaagaagcucuuccccuaaaggcagcacagcuaacucuacucucuaccugccacaacucagucaagaauuggcaccuguagccaucuggguaagccucgaugcuucuuucagggaugugacacaaauggcaacucggagcuauuuguuacugcuugucugucaagauuguagccagguuaaugggucauuuuccuucucuccagacuccaccacugacugauuucagaagagguagagaacuccaaacugucccagcagguuugcuuuagacaacagagcacagcccacauggcccuaccuguucagaaagucauguuagaucaacaaaccacuuccauucugagugcacuuuuauagguuuuaugcuuuagcauguccgggagaugaguuaauuaacaauauaaacauuaugugaguaaauggaagguccaaacuuuaaguuuuucuuauaaaaauauuggagcuauucauuuaagaauuugcucaaaagggaacauaacgccaaaaggaaaaugcauguagguauaggaauuucucaguuuaguagggccagggcuugcacuauguuccauuuauugggcuucguaacuuacuugcuuguuuguuugggggauagugguguggggagaggggagucgucaagcccuauaaauaagcucauucucuaucuacccgacucucaauugcccugcuaaagaguuauuucuccuauaccuaugcaaaguaggaagagcaccuuauaggaggcacuguauagggacaggggacaugggaucagccauaggaauguuaaaugaaauugcacagaggaaaguuuaauauaugucuagagauuauacauacacuuuuuuaagcguaaaaagaagacaucuaguaaugacagauauucuuuuuauauacaagcaaaagaaaguauaaggagguucuacagugcaacauccacaaucugugcauucacauauuaugggacuuuuauuuuuuaaacucucauauaaauuuuuuaaaauuacuccuuggaagagauccugguuuuuuucuucauuuauuuuuuucuuuaaaaacauuuauuuuaagagaagagaaaaagagcuucaucuaauuuugcaucuugauuaccaaucaguacuagucacagcaccagcaauacuguauguuuuagacugacaaggucagccaggaaauggcauuuuuuuaaacgcagaaauguguuuguuuccucuacucuaacacguccuuucuccuccugguguccugucaccccccaugcagcaccacugaugcgagaugaugcucuggccugguccaggaagcccugagccaugggcagauugcccaguggccuugggcggccagagcuugucaccuguuuaaacaaguucaccauguguuuaaaugacaggguacaguccuggaccagagguuuuucucuucagcaaagcucccuggcccuugaucguuggacuguuacuaauagaaaaagauucaagucaugaaguauaaaauccaucccccaucccagaacuuugaaacacaaggagggagagaucuuugcuauggagcaguccuggagcaaagccccguggcuuccacccccagauauauaccccauaaguagugcugagcuccagcuuagcugagccaagcucaguccuuaucugguguucagccagugcacagguauaagcagaacuacagagcugaauguagcuucccugggaucucuucuccuuucuaaagcauuuuucacacaguucuguaccuccuacccaaguuggggcugcuuucugccugcuagcccacggcucuguguacuuucuuuucuggcuucaggugcagacagacccucaguaccuuccuggacacagacacauauucccuggaccaaggcguggaauaacuaguagaccaccaagccacagguggcuggucuugaagaaaagggauuauacuccuuacaggccacccagaaagcuaugaauuccaauauacaccacugaucgugcaaguuaggguuuuuuuuuuuuaaacguagcauuauuuuguuauauuuuggaacuaaaugaagugccaaauuaaccagacauucguuugaugccaucucuguggaaccaaguucucuguguguguucguuuggcugggaggagggggaggacugggcagacugcucccacagcaggcuggcaguggaacuggagcccuggccaccgcagggagcucagaggccaaucuacgcaaaaggcaugcaaaacaauggauucuggucccaaaauauuucuaaguaaggcaugauguagccuuuugauuuuuuuuuuauccuuugacaccccagccuucagaaaagguuuuucaucucucuccaaagaagucauuucauagugacugacaggacauucuccagagagcgacaaagcagaguggccagcaggcagugguguuaagccuugggccuucccagcagaugugugcugcauuggugggugggaggcagugugacagccuggagaaaacacacagguagcaagggagucaggggggagguacaagagggcuguggacaccuggcucuugcucaucuucuuggugcugaucagcugguggucaccaucccuaaguaccucccagggagcugccauuuucuccucugggagcagcugccugaagcaaggagagaaugaccugaagggaaguaccuccggccaagagugcagggcugcugugccuagccugagcgggccaucucuagcagauauggacuucucuccaccacacuagcugaaaaguuuucucccuugguuggcaaaagccagugucaggaaaaaagcuguggguuucugaccaagaaugugugcgcuuagcugcaaagugccugucagcagcuccaggcaccaacaaggugcccuuuuauuagacaauuccugcccgaacauaaccauauugcagaugaaaauuuucaauagagaaugacacaauucuugaccuuucuaaaaacuuuucaaagagauagucacauguguauauguugcaaaagauuuuugaaacugaaauguccuccauuaaaucucaagagcacucgaguuuuaagucugcuguuucuggugucacacuaagacacacuuuugaaagcagcccuggguucugaauuaguuggcacugcugaauccauguucccccuucaucagacuccaaagugcagcauucacuugcaaagguugagagaaaaguggccagaauuguacauauaacagagaauaccuugagaauaguagcaaaauacuguaaauaauauucauuuccucagggaaaaauaaagggcaugcaaaaauaggucuggagacuccugaaacuaggaagaauuuuguuaucacuaaagucuuuuauagucagaacaauuuuuuuuucaaaugaacaugguaucauuucaagacaaauuuaugugaacugggcaguacugacauuugugaggcauaggggagugcccugggaaaacgguuuggagcugaccuguagccuaaggcuaacauuugaaccacaggugcaaugccugggggugggggagggggacggggugggggugguauuccuagacucacguaaggcuuuuucugaauguaauugugaauacaaagccuugcugguccuuuuuaucauuacccaauggaugacuguuuauuagcuaucagcagaauuccguaggcgaaagcaagccgugaacgauguacauuuugcuuuaauagcauguuagcgaacaaacuuccauggacuuuuguggacaaggugcugcuuuuucucaugacccuguagaauugcuaucgaccacaucuucuguagcacugaccugugugaacucagggaagaauuugugcauacaaaugaguggaaacagagcaggauucaugaauaugaaugagaaugugaaucauuuuggagaaugcccugggcacacgggucaacuggaaauuucauuucucuaagaaaguagcccuaccagcggcacggacuguuccuguuccucauaccuguggggauuccuccauauuggaacuguuucauguaucuuuuuugcauuguaacuagccaaaccugaagucaguaaauaaaaugagauuagcacuuuuuuuagguaccaguuguaucacugaguaaugcacaccaauagagcaagaaaguauaaaauguauuuaagaccaacugguuugcuuauuaugacugacuuugaaaaagcccauauccaaugauauacaugcuuuaaaagguauaucuaucguaggaccaggaaccaaaaugggaauuuuacuucugguccuguuuuguaaauaguuccuuuuuuugaagacaaucucauguuuuauaacuuuuguugugggucugagaaucacaaugguaauaugucuuggcaaaacauaaccuuuaaauacaaaaacaauuauaacuuaauuuuccaaauaaaacaagaaauacacugauuaggcuucuacaguucuaagagacaugacacuuugguaauaagcgucaguacucuacuucucaaguuaacuggaaauauuuuacaagaugcaguguuuuguaaucacaaagaacgcagacauuuugugagaaaugaccuugguuuuauacauuguagcuuauuuuuuaaaauauaguauuuuaccaggcaggaaguauuaauauuauaaguaauucuugcucaccaaacaaagggcuaugucucuuuuaagcaaauguuuugaugcauaucuuuuuaauuaacccucugcagcaaggguagaaauacagaucagauggaauggguauuauaggagaaucaagauagcaacagcuacuccuuuuaccauuacuaguguguuuucaaaguauggaaaaagaugccugaagagucauuuuauauauuuuaaaucuaaaaaguguuaacagguaugcuuauaggccaugggagaaauauucuuauaaauuuuuuaguguaaaaugauaaauucugugucacaaagacaaguuuaccacuugaccuaccagaaucacagauacuugcauuuaacuagcaaguaucauuugguggaaauuucuaaaaucauaguagacaggcccaaagauagaauucuuaggugaucaguaguguuuaaaauaauuuuguccucagcacuaacuauauaacuguaauuucuacauaagaacaagugcuuccaaaauauaguggagggaaaaaauaaaaaaggaaaauaaaaaaacaaaacaaaaagaacaagugcuugauuuuucacugugaagaacuagcaggcacaugagguugugaucagaaagugacugaguucccaagaaccaggaaacagaggggaguugugaagaguuuauuaaaacuguacaaauaauucagagcuuugccaaaaccauuucauaaugcuguacaguuuuuucaagcccacucacuguuaaaacaagaaagcaccuuuucuuucuaagauuuuaguaauccaaaagcuagccuaauuagccaaguaugcagauaacaucaaaagcaaagcugagauagaacagccauacacccguugggcagcucuuaugagguggucagaaggucacucagaccuugguuucaaauaggcuuuagaaucugcacacuugaggacuagaaaugcacagaguuagggaaagccauguacaggcuuggcuccuagucuuugagaugaggcgucuugcaaaucucuguuuucacuccuuggaaugucuccauuguuagcauuaaaguccccaagaaguuuuuauugcuguacgguuuugaacccaaugagucucauuuccaaaagauuccuaauucuauauaggagagguugcaaaugucagugccucagaaggaccaggcaaguucuguaaaugauugauguggauaaggcaaagaggaacacaagaaugguggagaccagguugaacugcagaacacaugcccucuuugaaggggugcccacacucagcucuagacaaucagaaccaugcagaaaucaggcccagggcugcuagaucuucugacguggaaguaugauauuaccugacacguaaguguugacaacuaacucaaacucuuggccaacacugugcagaccaaagagaagcuguacacagacaggugcagccugcagcccccaguuucaacuauugggaaaaguggauuucacauuccacaguugucaggucagguucauccaucagccccacaaacucacaugucggcacuaucugggcaacuaaaauaaaagaggggaaagagaucauuucuccccagauaucauucucauggcagacuugaauauagauacgcugaguuauccagcucucucacucugccuccuuuuggcaugcccaggcugugccccguaaaguguugaaucacuguuauccuaauuuucuuaguguuuucuaccguggccacugugaugaggggcuggcaaagagcagccucgugccuuccgagaaggcugccaggagccucugaagcuugaagcgagcacacauugccuccuugugccaaagcccuuggccagccuccccacacuccuucccucuccauccggccucaugagucuucguuaccaaguaaaauuaccacugcuucaccucugauacagcagaagccuugcuucagaacugguaggcauuuaggcuauuucagaguguccacuaaccucaaaaggagguuuuuccacauacaaaacccuagcaucuuugaggggaaagcaaaaugagaauaaauuaugucaugaaaaaaauuagaaguugcuuccuucauuuagauggacuaaguuauuuuaaacucuaucuuacaucagaguccugaugguguugggauagucacugacccuuucacguauguaauaagauacgucucguucacacacuauuucauuugaucuuuguaagaacccaguguagaauaggaauauuuaaaaucaacauuacccaccuccaaggccaacccagaguagucuugaaccugagucagccucaguauugcuugcaaggaagagggaaggggcucauuaaaggccuggcucaaaccuuagucuuccagacugacuagggacguaagaagacccagggacccaccauguucucaaaccaucuauucaguccaggccuuucagcauagacauaaagagcccacccguuacucagucauguugccaagugcaaacugauuuauccccagaugaaucccuuuacuguagcagaucccuaaucccuaaauuucagccaauuugguaguuaauuauaggaguuuauuagcuaaauguauguucugaguaaaaguuuugacucuuuggggaaaauuuauuuugcugcuagcauacaacauuugcuauguauauaaacuuaagucaaugccagaaauuuuaaaaccagcucaaauuuauaaucuguaaugaucaaaucaaaacauacuguaaacucagaguuggaaacgccugguaauaugguuaagucauguuuaaauaugaaugcaauuuaaaugacauuggcaaugccugagauuucuuucauugugaaugauuaaaaggcaguccaauauaugaauggauuucaucuuaccuuucucccguuaauuuacuagguguaacaucuugaguguaaagucauucacaggcaguuggguuguggagcuagaaggagccucaaaaaaaaacuuuuuggccagacuccuacaucaugaacaggguuuuugaugaauaauauuuauuauuauguuucuaaaguaauacaguguuggagaaugaaacaguuuaguccuuuccucuucugauggaaaagaaucauagcgccguugccaugacaauaacaggauguagaaagacccaugaagaaagaaagaagaaagcuaugguuccgaaagcagguaaccacagauuuugaaaggaggcagagauggugauuaaacuguaguccuuguuuuuuaaaauguucuuucauguuaggcaccaccacauaguuaauaacuaccaacuucuaaagagaagauccccuugauuuauuuauaucaugaaaauacuaaaaaucaauucucaagucuaauuaacuauuacauuaucuugcuagguccuuuucccuaaauuuuuaauucagaaaauuaaccagaauuggccagaugcagugguucacgccuauaaucccagcacuuugggaguccaaggcagauggaucacuugaggucaguaguucaagaccagccuggccaacagaggaagaaagagugaaaacaaaagaagaaagagggaaacccugucuuuacuaaaaauacaaaaauuagucgggcgugguggcgcacaccuguaauuccagcuacuugagaggcugaggcaggagaaucccuugaaacugcaggcagagguugcagugagccaagauuucacugcugcaccuggggugagacuaccauuaaggaaggaaauuuccuuuaaacagaaaaaaacaaaggugcucaucuauuucuucugaauucucucuacauccuugacuuaagaggaaaaccagcacucaagaaacagcuuuaaaagagaacaguccccauucuagcuaccagucuugcuuucccccaucuuggcaagccccagugaauuugccauugaaagauuacccuccccuuugcccucaucugccugagcuagaggccaggcuguuguuaauguuuuuucaguuccaaagccccugaugggacauucuuguuucugugcuacugcuuucucucucuuaaauuaaggugcaaggggauaaauauuacuauaacugggauguaaggcucagucaguguggcuauucccucccuucgggggaaauauuccaucugucugaacgguuuuaggugaucaugaggagagcggcuuagucacacagccagccacgcucaucacaaaagauuuguucagacucacuguaaagaaugacaaggcagauagcuaauccuuucacugugccucaaagcccgccgugcaagucaccaacccuaccgguccucuccacgugcgaggcuaauagagugaucagaaccaggaaugugagcuggguuccaccuuaggaggggacaaugaggacagagcaagagggcuccauguuuaauuacuccaggcucugacuucugcccacaauuacagagcaugaaagcagaauuggccuuuaguaagugaaaaggaaguggcuccugcagcauauaauuguuauaauuucguauuuauggaaagagaaaaggacuucaguccacucauguuguuaagcacuugucccucacuccacuggagcccccuuccuauguuuugggcacagauggcugggaccgagaggaaagaggaagagcggcugccagagugugaauauaccccucagggauauacagcggaguuucaugauaaacuacccauacuuucccaaaaaagguugaggagcaauacauaacuuugcagauuacaaacccuuguuuuacuuuuuaaaccuuuuuuccauacucugcuuauuggaaaucgauggcugugaugugaccaacaccugugaugauagcaaagccccuccuuucacagucuccugacuguucggggaaccuccuuggucauugguagaaagcuuuagaaaagacuuagcuuuuuagggaagaacuaaaaaaucuccaaaacauacuagucccaugacuucgauaacugaaaauguccuggguguaaacuaacccaggaauguggaucauacauguuuuuuuuaaaaaaaaucccugaaucaauauuuuccuacaacacacccuaaaauuccuauuuuuguaauuaaugguuggacagugaucagccauuuaaacauaggcuuucuggaauaaccagacacuagaauaguuuccaaaguguuuugcguaucaaaauccuauauacuuagaagaagaacucaggauaagaaaaaaucgcuaggucccaaaggguucaugacuaucaucagaugcaacugcgaguggccuacggucauuuuuucaaaugagaagacuggagagagagaacaacaguaaucacaaaaccucuguugcccuuaguccaugacaauguuuaaggaaacuuuaaaaaauuaagccaucuucugaauuguuuucuacaccaaaucuaaaauauuaaaaugaaauuauuaaauauuuaaaaugggguauuuaguggaaaugcaaucaguagaaaacauugcuuuuuagugccugcuaaacaaguaaaggagaaagaaugaagagaaaacagcaguccuuccugugugacacucguguggaaaugacaggcauucacaugucauugagugcuaacucaaaagcuagguggcaaugcuguccaauguuuagagaucuuuugaaauauaauuuuaccaccauucagagguaaguacuugcuuaacagaagucuuuaauguuagugaaugaauguauaaaauuauaaacuaugcauuuucaaagaguagcauguauuuuguaucgaauccaaguaaauuuuuuucauagcuaccuaccacaacugcaaauuauucaaaauaaacuuggauacauauccuuauggggauaugggaagcccaucuauauucuccuacuugauguuuuuaaagauugaaacuuuauucugaaacaucaggcucuaaaaaauuccaucauuaagaugaauaaaugggaaaugguuuauuuguuacuucguaagcauaaaugggaaauguuggcuguuagaaaaugugcccaguucuuuaaagguggauguucuaguaacacuggauuaacaagcaaacaaaacugcaugaagugaacgaauauuucauuggauaaaguuagcauagguuuuaucugcuggguuuaauucucaaucccagaaaaaaauauucuucaagggguaucaguuauaguuucaaagaacaaaauaugaaaauauuguccagcaaagcaaaucauugaucuuuuuucaaaauuacuuauauuuuggaaagucuauauagaauauccacaaauuucuucagcccucuuguugauuucauauuuucaugaaacuuuuuccccuaauaauuugucuucgcucuuuaaucagugcuuuacuacauuacucagccugaaaaaauaucuuuuccuucaucugacaauguggaaauaaagaacuccauuucugucauucugguucucuucaguguccauugagaaaguuucucaacuguuuguaaaauacggggggaaaaaaacacgcauuucuaaaccugguacuuaagguuauacuggauuguuugcuaccuaauuagaaguuauuggggaaggggcauugugucuuuuuauaugauuuuuagccaaauccagauguucugauacacauuucugaauaccugucugacuguaaauacagccuguggagguucagguugauaaaccuuucaccugacugcuccacagccaugcuccuugccagcuucuggcacauuguacauagauuuguugaauguuuaaaugauguuguuuuucuaaaugcuguucucuaaaacaauuuuuugaauuucuuuugcuuuccauuguuuuggacuuuguguguucguuuuuuaaaaaaaaaaauguuuccuaaauauuuaacaccaggaaaaauauuuuuaaauacacuggugcuaauugaaacagaaggaaauuuucagaucgaagauguacaauguuaaauguucauaccaguuaaacugcacuuucccaaggggacagcuggcaucuacuugaaaugggcaucaagagaccaccaaauguuuacaguuucuguggcccguuuaaguguaaaaugcagaaguggcucuguccccccagaguuaaggauuugcuacacugguccucuggaagcauuuaaguagaagaaaaggcuuauagucagaaucacuuuaguaaucgucuucugguccuuggacuuuucuguucuguaaugcuuguaacaaugaauaugguguugccaaucuagucugauaucauuguugaccuguacuuacuuuguggaugguucuaccugggguugcacuggcacaaacagagccagaacacuggacuuucaaaagaccauuuugacuucuacaguguccacacacaugaauuuaaaugcacuuguaacugguuaauuaccaugaaguaagucuaacuuccacuuaauaaaaguuuuuguguaucugcuucua

SEQ ID NO: 191289 - RNA, 127401 nt, Homo sapiens
uuaauuuguucaacaaacguuuauuaauggcccaauguacaccagcccuauggugagcacaggaaccaggaagauggaggagaccugcugggugcucuccaucagcucacucccaagugguggucauuccaccuguagaccaugggcucuugggggccuuccagaugacacaagucauuauuagcaaggaacaagcugcuaauucuugcacagaccuguauuacuccguguuucaaauguaugcagaugcuacagugauuaauaugcacauuucuuugaaagcaauacugaauuccuauuagcuauuggucacuguguauuuucucaaucaggagauaccgauugaggggauuuuaaacaacauuuauacauuaaaauauuuauacaugcuugaaaacacuggaaauaccugaugugagaguuuuaagaaaauagaaaguuuaauaaaaaccaagaaagcauuuuggaaaaaaagaucauuuucagaaucuucaaggaauuacuagcaccucuaaucuguaccucagguacaaauauauuuguuugcaaaggacauaaaauaugauuuuuacuuuuauacagaguaucauuaccaaccaucacauuuacagugaguacaaauauugaccaggaaccaauuuuucuuuuuuaaaguuaggacuugucaaaauuuucucuccaaggaccuuuuacuccuagagcagagacucccucagccccugaaauguugagccaagaggcccaaaggguggccaugugugugaaaauuuuuagucucccauguaaaauaaauuuugcauucuguucuguaauauuuacuugcuuuuuaaaaaaguaaucuuuuaaauauuuaacuguuuccuaaaauuuuuuagaaaaaaauauuccaguaauauaggucguauuuaaguggagcuauaggccugaugcagugucucacaccuguaaucccagcacuuugagaggccacgguggcaggacugcuugagcccaagaguucaagaccagccaagccaacaaagagagacccugucucuauaaaaaaguuuuuuuuuuuuuuuugagacagagucuugcucugucaccuaggcuggagugcaguagcacaaucucugcuccuugcaaccuccgccaccuggguucaagcaauucuuccgccucagccucccgaguagcugggauuacaggaaugcgccaccacgcccagcuaauuuuugcauuuuuaguagagaugggguuucaccauguuggccagacuggucucgaacucccgaccucaggugauccacccaccucagccucccaaagugcugggauuacaggugugagccaccaugcccggccacaaaaauguucuuaaaaaauuagcuggccgggcacgguggcucacgccuguaaucccagcacuaugggaggccgaggcgggcggaucacgaggucaggagauugagaccauccuggcuaacauggugaaacccuaacucuacuaauaaaguacaaaaaaauuagcagggccugguggcgggcgccuguagucccagcgaccugggagacugaggcaggagaaugaggagaauggcgugaacccgggaggcggaacuugcagugagccaauaucgcggcacugcacuccagccugggcgacagagcaaggcucugucucaaaaaaaaaaaaaaaaaaaaaaaaaaaaauuagcuggguggugugguggcacucaggaggcugaggugggaggauugcuugagccuaggagguggaggcugcagugaucaugccacugcacuccagccuaguuagcagcgagacccugucucaaaaaaaaaaaaaaacaaaagggcuauagaaggugauucccacauauacauaauaaaacaacuuuucaauggguuuauuauauguguaggcaggaaaugggagccacacccacaguuccccugagaauguggaaauaggaugaucuuuucaguuucaaacuauaagagaaacaauggaucagagcagaagcaaucauguauacaggcagaauggagcccagguaagcucaacugaaacaaggcuugagguaaugacguuauuuaaugcaugugccaaucagaagcugauguagagaagcaacuacuggcagagaaucucuagcaccuuccaggggaagaggguacccugguccacaaacaugaauaucacagaagacaugggucuucugugcacccaaagggacaugggugcacgaggcaacuugcuucccuugcucagaauccaugcucaccagcugcucauaauuuggcuucccaggaagauuugccuaaagggagagaauaauugauaguuacauuucucacuguaaauuaaaauauugauaguguuuuaaaaaaauaguuacugugagcuugguuaauguggguuugccaugauaguuccacucucuauguacugaaacagugggccugaauuuuuaaggaucugaguuaucagacuuucuguacacauuaaauauaggccaagguauggccaucucacgagagugaccagcugaccauauuccucuacuacccucagaccucuauacccacacuguccaauaugguagccacuagccacauguggauauugggugccugagauaugacuaguccaaauugagaugugcuguaaguacacaauauacacuggauuucaaagacuuaguaccccccaaaagaauguaaaaacaucuaauuguuuuuauauugacauuuuaaagugauacaauauuuuggacguauuggaauagauguuacuaaaauuaauuccauguuuucuaaauguggcuacuagaaaaccgaaaauuauguggcuuggauucuguuucuauuggacaucaacacucuucuguacaaauaauauguuaauguguuugauuuagaaguuugcaccauaucccuucuaaugaguuggaccugggaagauauagggaauggcacagugguaccuuguuuacaacugauaucaaucaaguagaguggaguggccuuuucuuaucacuuuaaaaaggccaaugauugauagaaauaaauacaacuaguauuuuaguacuugcaagacuugcugaugucuuaugcaguucaccacuguaggaacaaaaggccuggcucaaagcugaccucuccccuguguuagucaggacuccaacagcccuaacugggcuucugcuuacucacuugcaaggugagucauuaguagauaagcucggacugaguaaacaucugagggaugaauuacaagagccaagaagcuaacuuugauuuccuuguaauuuagcauuguguuuuccaaaagauugaguuauaagguaaaugucaaagauaaaaauaugaaaagauagguuuuuauucaucaaaaguuaacagcaacaggcacauauuaaaaugaguauggcaaagccuuuuacaaauggcuuuacacucaagcuuucucccaagaaaauggcuguugcaacaaacuguaaacaauuaauaaacagucuuuuacaguaacaagggaaauacaaaugaacuaaaagaaagcaccgguuucucuuaaaacuagauuacaguugugcuuacuauacauaaaacaauuuaaaacaaauuacaaaaguggaauguuugaaguuuaaaauuaguccuuauaguuuguccuagaaaacaucuguucacaucaaaaggcccgucaaaggguaacguuucaucaaagggagggacaagaaaacaaugcacuuuuuucaaaucaaaacaagaaguuuggucacuuagcuaugugcauaguuuaaggcaacuggagcaaucuguuacagcuuaccuaccaaccuuccccucccccgaguguggcugcucauuaugucacauucuaaaauaauaaauaaaagcuuacauuucaaaucuuugcccacauggagaaacauaacaugcacagucacacaugcacaaacaugcacgcaaacacacauccguacauucacacacaacauaccucucacucacugcagcgaaagggacuuuaguacccuugaucugaaggacacacucucccaucccacuuuuauuucagauuggcaaauacccugagcugauuaugguguuuuaaacauuccaccuuuuucucgcaugugcaggucaaguguacaguagugaaaacaacaugcaaugucuucacugcagaaucauaauacagcuaggacauugguguucuuccccucccaccccaaauuaaaaacuaauugcuaaaaaaaauugcauugccaaacggcacuggagugaaagcuuggcgguacucuacgauaaaugcucaguuuccagugcaugaaauaaaacuauagcaaaugggaggcuuugguggcauccaaagaagaaaaaggcaaaccagggggaaagagcugcagucuaaaguuugaucuuuaaauuuguuugagugguuccuucacaaucaugcuccaaggcaauuuagaaccaauauuuucagaguugauuuguaaacauugucuugccagaggcagcagaggcugggcacuucacauuuccauuuucucagagagaacuuaguggaagguacaagauacacauuguugcaucagacugguuaaauuccaagagauuguugcugaacaauucaaguuucacguuuugaagauuagaugcuuugaaaaagucguggcacauaucaaaacuuccuuuguuacuccuuucggauucucuccugcugggcuuugcauauucaagguuucacaugaaagccaaauucauauugcuguauguucgggucuugcaauuaacaaguggguucaaaugauccaacagaggaaaucuuggaaauaaauaaugcuggcuggcaucacucacuuggaaaccuuggcagucaagaguuaaguucucucaccucaagaccccauuucacauuucuaaaaaccuccaggaggcaguuugucccacugguucuggggguuaugauaaccgauuuuccugagguaauaacugugaguucaacucaaaugcagcaucaguguccucacugcucgacuguucucucugcagucccuuccagcuggcuuuauucagccccacguguccaagcauugucugggauagccuuguauuggaaaaccuggcccauucuguaaauaaaggcuccacuagguaagucauaaaaccuugagaaaauaggagaaaaaguuauuaacauauaugcugaaacucuaucuuuaaaacaucaucuauacaacauuaaccuuccuacauccuacuccaguauuacccagaucuuauucuucaaaagauuccuguguauguguaggugacagagucuguaauguacauauccacuuugaagaacugauuucuuaaguaacucaauggaaauuugaguaaaagugaacugacaaauauaucuaaccuuuucugguuauccuucucaguggcacaacuacauucuucuacuuaagcaaaaauacacugcccaucuaaacucugaggauacucgggcauagcccaauucgaggcagaguugcagugcaacaacuggaggcuaagaaggggucuccuucaggacugagggugauguggccugaacugaaguggagcuggcaguagucuacugcuuuaccccucagggauggaaucuucaugccuggucaugacuacaauuggucauuuuauuuaacucagaauuuauaaaggcaaaacuuaugauaagagucagucuaaaaauaacaggugggguuagugaaaaaaucauuaaagugaacaacaaauguguaccagagaccuauuuuauaaacaauucauauaaucucccuuaauucagucagaaaaggaaaaugagugauuucaggauuguugcaucuuuagguuauauagcacuccacugcacauuagaucugacuuaauacuaaguaguaucuuaaacaaggucaaaagaagcccucuagaaaauagcuaucaaucaaaucauauuauauauugggaacaaauaacaucuuuaucacauuuugaucuguuaagaauggggaaaauauacauucugauucuaucacgcuuuaaaauuuucuucauauccaagacucucguugcagcaaaagaccauguggaccacagacaacauagguuccauuuauccaacauaagaaucucaccagaauuaaagcaaccagcauccacuacuuuuaaucaggaaaguuauauauggucugauggcugaauuuuuuaaguguauauaauuaugguaucugaaauauuaauuauguacaauaugugcaauaaggcuuucuuucuuucauugauccauucccuccacacguauuuacugagaaccuacuauguccccggcacuaugccacgguggcuggguauacagcagugaauaagacagacaagaucccugcccucaaggagcuuauguucuggugaggagaaagagauaacaaacauagaaaagugucauuauagucaaagcacacagcggcuuucuggcagccaucuucacacuacaguguuauguugagccagccacccaaagcccugucuuuccuacgugccauaaagucauaagccacuggaguuaucuacccacauggcccuuauuauuauagguuucauaccauucaucuuauuucaucccucucacuguuccaacugguugagauccuuggggaucuuaccuccaacagccaacaaauuagcuaucacuucuggcucuacguuaaccuaaaauuucuuuuagguuuuaaauaccugauaaaaaugaacagaccagagccauggaccagccucucucuuggagggcaggacucuguuaauuaguaccucgaacacagcuguucaaccauuugugacuccauuuaauuguacuagccccacaagccucuacuuuaucuucacagauuucacaggacgccuugucaaaugccuuacucuuauccaguacauauuuucuuguucaacaaaauuaguauuccuaucaaagaaagaaacuguauuaguucaacaugacuuguacauacugccccuauguuggggaguaguaaucacugcuuggugaguuguuaagaggcugggauuugauguccgaaagaccuggauuugaagcccaacaccaacagcuguuaacugcaugaagugggcaaaccaucugaaaauaaggaugcucaaagcaccgguccccuaggguuguuguguggagucagcagaugucaacaaucaccaucagaucagugaccuuaucccugacaacccauucuagaucuguacaacacugacaagaucaauagcuugagaugaacagugaaagggaucuagcuucuguuaccuuauaaaaauuacaauguuuuaaaucucauuugcaaguucucccauuaagcaagggaguaguuuacuaggauaaaaagacauuuaauauuaaaaguaacugaguugacuaccgauucaccugucuucgauucaauucucuuuuguccauuuuuuuuuuuuuuuuuuuuugagauggagugauggaguuucauucugucacccaggcuggaaugcaguggcacgauauuggcucacugcaaccucugccucccagguucaagcgauucuccuaucucagccucccaaguggccaucacacccagcuaauuuuuguauuuuuaguagaaacgugaguuucacuauuuuggccaggcuggucucgaacuccugaccucaagcgaucagcccgccucggcuucccaaagugcuggguuacaaguaugagcuaccgcuccuggccacuuuuguccauuucuaauguauucuuuugcauuugaagauuauucuacuugagaaucaagacaaagcauaucugguucuaaauuguuuuacuauccucccaaaagaaaagcaucugcuacucucagcauuccuggccagugugagcucucugggagauucagcaucccucacacuccuaaagucuggccacaguucuacacgcucuucccuucucuaccugucacucugaagucaaaucggccacuacccacuuucuuccaugaguauccauugcaaucacaauguaagaauuacguuucugaauuucuggccccauggcauggucuuccuuucugaguaugaugccacauauugugcuaccuucuuaguuucuggaaacuucaucuuucugaacuuugggcacauauuucacuguguucagucugauucucaaaggcccuauucaacaccagcuaccaaaauuacacuccucccucuauuccuuguugagcuacugcccccguagaaucccccuccuuuauacccaaagcccaacacacucaauccuagucaacuuuccugugaacuccugcaacaagcuacacauacuucagucacaggacauuuucauuaugcuuucuauaauacaguuauuaguucacucaacacacaguucucaagggccucgugcuucugguguggugcuaggcuccaggaauccacaaccaaguggaucaggcacuuuggaaucuagaagaaaagugacugacucugccuaaagcaaguggagagcagcuucuggagaaggugacauuugagcugccucuucaagaaaaauaacucuacgaggcacauggaaagcacuggcgaggcacaaagagcgaaagaacagcguauacuugggaaacacagaagcgucccgagaugcuguaggcaaaugagagggaaguugaggcaagauggcugcacagcauuugaagcaagauuauaagggccugucuaggauguugaagaguuagauuuaaucaacaggcagugguaagagucuggaaaggcaguggcagaagcuggucuucguauuaugaucaggcucagugggucaccaccuauccauuuuuauuuuauuuauuuuauuuuugucauuucuuuguuuaccuauccuuuuuuaaauggcagucccaaaugaugcaaaagaagcuuccacaugagcgaauaauggauucuuauuuacauaagaacagaaacaaguuauugcugcugccuguucugcaaaaauauacuuuuuacauccuaaaauuaaaugagaauuagaagagccauaacaagggaaaacaaggguaaaauuucuuaaauuauuuuuaaaaauagaaaugagcauaauuuuaauauuuuauauuucaaauauauuucccuucuugauaaaaacaguggcauuuuucuaaccagcuauaucuaaauauguauaguuaccaaucuggauguuggcaauagauucagugugacgaucgcaaaguggacucacacccaaaugauauuuuuuuucuauaucuccuauaaauuaaaaaaagagaaguauuaauaugaagaauaucuauugguuaaauauauaauuaaaggcuugaacauaccugugcauuucuuaggaaaaacauacuuaauccucaugagaggacagcuucgcaauuaguucuuuuuaaaauuuuaaguuauuuacacauagaagagauugccaagcugauauuuuuauuuaaaugcaagguguuaccccaagacuguaauuuauaacacauuaauauacaaccugaaaggaagguucaugaaauaaagauuccuggauccggguuuuaaauuacacacacaaaaguuuuacauguucauauggcccuccacacacgacaaggauaaagcaaguucagggaaaucuuucuguacagcaaaauuccaaaccuaaucuaucuauacucauaaaugcauaaauacaucugaucauuccaaaagaggacuucuaauuuucaaaacagaugcucaauuuguauugauuagauguauaucuauugugaauuguuacuaaaaaugucaagacucuacugcuagacccauauaaauuauugaguuauuuuauucuuacgauguuaaaaaaaaaugaacuggauagauuaauuaucacucaauacuguaacuugccuugauggaagaauuccuccguuacuuuuucacuccacugcuugcuuaauucccacguccgacauggguuacaaauaucagcacauuucaaagccaucuagcaaacaaaacauuaauauuguuuuaagauauauacacacuugacaauaauaccaaagaaccaagugcaaggacuggauuaaccauaaauauaaauaaauaagccagaaauauaauucuccuauuuuuagauguaagaauuuaugagaauaaaaugcuauuucuuaauugguacccuaaucuuguaaaaauuguuuucaucagaaaucuugaguaugaaaaacacguaagcaaugaugccuuccuagguagcagauucaccagugaucuccuuuuggaaggagugugcgcuaauugaaggaaauucuuuagcuugcccucaagauuuaaccauucugaaaaacuacacuagaauauucauuuuuuaguuugacagucacauaauuuauccuagaaauagaauguuuccaagccccauuuuaccuguaaaaccaaaugucugugucuggugucuucuaggcauaaaucaccucuauccaaaugggaccuaaacaaagacagauacucauucuggcgacugaugucuguggcuaguaucagagcaccuaucugugucuccauuuguugccuggaaauagagaaauauaaagagaaaauauaagacuuucaauuaacuauuuauugauuuuuuuucuuaaccauaauaaucggaaggcuuuauagaacccuaaaauauccaacuaucauucaauuuaaaauuuaucacacaaaaaaugaguuuuauagaaugcuucaaaaaaagccauuaaaauaaccaaaacuaaaaccaagaguuuguaggaaaauaccaauaugcaaacauuccaaaaggagagccuuuauuuugccagccaaggugguauuauuugcuuuaaaaaaaaaaucaauguaacauugguuguuuuuugagaaaguuccuugcugggauucuuuugcuggaaaauucucaugcugaggguaaacaacuuugguuugcuuuuuagugccugagaucugaaggcagaaggaagauucaaauagaaagaauaauggcccauucaacagcugacuccuacagacauucugacuaagaugccuguugcaauuccccugagcaacuuaauaacuguguuuucaagguuaaacucaagaaccaaucaguuaucuguaaaugaauauccaacuuuucugaaaggaaaaagguaacauguuaauauaaacagcaaauacauacaucauuuauaaaacugccucagaucaauuaacaagauaaacauacuuaaaaaaaauucuugccuuuuguuuuaaugggccauagcaaauacuaucucuguauaaugaucaguaaagagcugucaaauagauaaaaagacucacaauauugaauguuaaaacaaacccuaaaugaagaaaacauuaaauaaugcuauuagguaguauuccuuauuuccauuuuuauuaaaucugagaacucaacaggguuaaucaucaaaugaaaaacaugauuuuuaaaaagggaauaaugaagcaaacauuuuaaucugucuuaauuuuaagaacccauaauuuacauauacaguguguuuaagcaauuuucguauuuguacuacagcaaaaaaugauuuuacuuaccagaaguauugucauacuccaaaugguauccgugaauaaagauuuaaaaaaauaaaaaauaaaguccagcuuuuuucucauggucauuacacaaaacaguuuuuuauacaguuguuuuaaauuaugaaagggaaaccagagaacagcaaguggaacuuaaauuuuaauacucaaacauauuuuuauaccucaccacuuuucuugaaguggaugguuucaauccacuuucaugguuugcugacgugcauuuucccucagugcaacauuacuaaaaagcuuguguguggaccacacuauggcaaugacgugagauuuuauaaaccaucaccaucguguuagccuuauucacauuaauguuuuuuauuagguucuaaaauagcccauuuauuuuuuuuuccuaaaauauuaggguuuuuuccauucauuauuauauccuauagcucuagaagugugacuccaggauuaugcuauugaggacauaaggcacucucuuuacuuucuugucaguuuugaaaacuucugggaacagauuuuaaugaaucuauuuaauguaauagaauguuuacauuccauccaauuuaccuuuauaccuagaccuuaagguuuuauucagcugaguauggaaauguguaauaucuauuuauguaaauaaguaguaaacuauggcugagcaauuguguauuugaguaaauuuuauaguauucaaacccauggaauagucuuugauaaaaauaacuauccauuaaaauguuaccgacuauauaguaggauagcucuaaauuacuaaaauuguauauaauuuauuaaauuugacaaacacugaaaacuguggaacaccugaacauaacaauuuuuaaaacuuuauaaaauuacuuugccaacuuaacuucuauaaccaguaacaaauuaaauuugucuuaauccaaccuaccugcuuucuaauggcagaugugagaauaagccugauucucucaauaagcccacugcagaucuccaguggugauuuuccaguacugagguauucuacaacaaaggacguuucugaguuacuuaaugauacgucucuuucuggacauaucauuacuaacaauacuguuagcaauauuaaucugguuaaaauucuaacauucauugagaauuuauuuucauuacuuucauuucuucaaaauaugaaagauuuucuagaaugcaaaaauaauaaaucuugaugauaaaauugcacuaaccuuguauaaaguugccaaguaaugguuaguuuuaauaaggaaagguugauuaacaccuggaugauccagaucaugaguggcagcugcaauuaagcucagcaagauaucccaaggaguuacagaauuggcaagcugaagugugacaaaagaauaaugaaucacagauauaucuaaaauaagcucuacgccaucacaguaguuuugaauuagcagccaaugguaguggugguaaucuccucccccuucacgucauuccucaggugguuguucauuagguucaccaagcacaucugccagguccugaucucaucaccacacuggcaaagccaugauacaacaguggcccugcccauguggaguuuacagaguucauccuuaggccauuucauuuuuaacaagcuuaauuaaaauggcagcuaaaacauaaaccguucuuuuugagaaauaauggcuuuaaaaugacaaacauaguuuggcacauuuuuauuacuguagccauuacugaacaaaagaucuaaaauuuuaaggguguuuauuuaucaacaaauugguuauuggauuucaauaauguaaucuaagauguaagguuauuccuuuaguccugauguuuaaggaggcuacugaguaaucauguuaaguggaagucuaugucaagucugugauaaaauccuccccuaacggauggcuacauucauaacaaugauacaauguauucaugucagggaaagcaaucuugcacaccagaaauuguaacuuuacucucaauaaucauuaccaaacuuauuuaauaaucacaauaaauaaaaguuuaugauuagcugacaaauguucaaugauaaaaaagaucaccuugacuauaucaucugcuuuucaugaaaugccucucauuuucuggcaaacuuggccagauuuguguucccacagcaccucaugaccugccacaauaccacucaucagagcaugguauuauuuagguuuacguuaggacagugcugacuaaacuguaaugauccugugcucuaacagugaaaauuuuugagcauacaccacuuauauuaaguauauguacuuauggauuauuauacugaacuaacauuuauauguuauacaacaaagauaaaaacugaaaauuuuaaaaaugagauaaaaauaauuuuagauucaaauucuauuguuuucuuucucugcuagaacgaaucaaucaucucuuucuacucccuguguuaaguucaucucagucagagaaaucacugucugagggcuugaaucuccuggaaaacuguaagcuaccuggaagcagagaugcauauuauuuauuuuuguaucgcauauaauuaguacacggagaaggucaaugaauaggagaagaugaagaaaauuauuuccucuuuaggauauacaaaagcauugaaaaaauaaagcauucuaaagcgcugcuuacuaaucaagaugaacagaaugcauaggauauaaagcauacugcauauaaagcaaucuccccuccuugacauauacaugaaugggcaugggugucuaugucuuaugaacauguaauuuauuaggcaguaugcaaagggguuacauucuuauuggcagaagaauagacauccugggagaauacaauaauccaaaauuagacugauuuaaaaaauuaauguaugacugcacaugacaucaaaacauucucagguauauuaaagaguuaaccauuaaaaauaggaacaugacaauaagcaacugaauucucaaaaauucugugaagagaaaguaacuuuaaaaacaaaucacacaugcaaaaaaauauuugauauaaaaauguaacauuucugcuuguaaaaaaaaaccuuucaucagaaacaaaauuuucaauauuauaacaaagacaaggacuucaauaacuuaacuuuuuaagguggauuaaaagacagauguuauuuccauucugugauuacaucuguuaagagcugacaacaaagaaaugucaaaaaagaaacuacagauuauuuaacauaugugaaggucagcuuuuacuuguaucugcaaagccaucauuaggguucuuuuucaauaaaauagaaaacuauuaaguggugaguuuugcuguguucagugaaaagcuuacuguuuucacugccugccagcccuuaucauuucccauuguaaugguuaucacagugaguuucguuggugguagcuuuuuuuuuuuuuuuuuuuuuuuggcuaaauuggcaaaucaaaaauauaguagaaauagcagaaagaagguaccugagauacugguggcuugcugaggguaaagaggagguggcacuaucauggaggagagcaguuuagugacauaaaauguccugaaucaguauuguauuuuuauuuuuccuaaugaugcuaccucugaaaacagauucuauuuuuuugugacagagucuugcugaugcccagccuggagugcaguggugcgaucucggcucacugcagccucugccucccagguucaaucgauucucuuacucaggcuccugagcagcugggauuauaggcgccuaccaccaugccugacuuuuuuuuuuuuuugguacuuuuauagagaugggguuucaccauguuggccaggcuggucucgaauuccuaaucucaggugauccgccugccuuggccucccaaagugcuggaaucacaggcauaagccaccaugcccugccuagugaagacagauucuugacacauuauguccauccugagaaauuacugaaagaaaugaaccucccacacacagaaggcaaaaggacaaggcgguccucgcagggcuccucaauccccaggccauggaccgguacugguccauggccuguuaggaaccugagaggaaccaggugcacagcaggaggugagcugccagccagugagcauuauugccugagcucugccuuggaagcaguagcuucucauaggagcacaaacccuauuguaaacugugcaugugagggauccagguugcgcacuucuuuuuuuuuuuuuuuuuuuuuuuuuugagauggaguuucgcucuuguugcccaggcugcagaguaauggcgcaaucacggcucaccgaaaccuccaccucccggguuuaagugauucuucugccucagccucccaaguagcugguauuacaggcaugcgccaccacaaccagcuaauuuuguauuuuuaguagagacaggguuucuccauguuggucaggcuggucucgaacucccaaccucaggugauccaccugccucagccucccaaagugcugggauuacaggugugagccaccaagcccagccagcacacuucuuauaagaaucuaaugccugaugaucugaaguguaacaguuucauccugaaaccaucccccuccccauccaaggaaauauugucuuccgugaaacuggucccugaugccaaaaagguuggcggccacugcucuagaggucuaaaaacagagaacuaggcugggcaugguggcucaugccuguaauuccagcacuuugcagggccaaggcaggcagaucacuugaagucaggaguucgagacuagccuggccaucauggcaaaaccccaucucuacuaaaaacacaaaaauuaguugggcaugguggcacaugccuaucagcuacuugggaggcugagacaagagaaucgcuugaacccaggagguggagguugcagugagcuaagauugugccacugcacuccagccugggcgacagagugagacuccaucugaaaaacaaaacagaacaaaauaaaaacauaaaaacagagaacaguuagaguaaacccagccaaugauaaagcccauauacaauaucauucauuaacagcucauauugaccaaguaccuaccaugugcuggugcuguuuuaggggacagguaaauauuagggaauagacagacaaaaauuccugcccuggaggccugacauuccugugguuuccaugucagguucccauauguuuuacaaguaagauucugggggccaaaauuccuaucuuacucauauuuuugucacuagcaauuagcaucuacucagagcaugaauaaguguacaucugcaagaaaggcaacucaaccaucagucuugcugacaucaaagggaaggaugcgggggccagggagggacgugcagggccaggcucuuuugucaacugccagggacaaguagagcaagguuuaaagguucagugcuagaguggguuuaucucugggacauguaagcguaauucuuauccagacuuaguuuaaguauaguuauuaaguaaaauagcuaauuuaaacucauuauagaaacaugaaacuaaacauuaaaauaggaaacaaagggaaaaucacaaucucuucagcugacaacuaugaauguuaccagugucaaucaaucaaggagacuuugggcucaacuugaacaaaaugcuuuauaauccacaugaguucagccuugaggacauaaaaaauaaauacucaaguuagugacaaugcauauauagagagaugaguuugucuccaaaauuuccaguaauuucuuuggcuugaaauauuuuuuuuuccacauagacaagaguccaagaauuagcucuuccauauaaauuauaagguauaaaaacugaaaacaaauuucucacaaaauauauauacuuaagucuauuuacuauucccucuguacuuggacuuucuuauggcugacuccuuaguuauguacuguccacuuaagugacuugugaucacccuaucuaaaguuguaaaacucuugccauccaccuggucauucucuauauuauuauuauuauuauuauuguuguuguuguuguuguuguuguuauuuuagacugaguuucacucugucgcccaggcuggaacgcaguggcaugaucucgguucacuggaaccucugccucccagguucaagggauucucaugucucagccucccagguagcugggauuacaggcacccgccaccaugcccagcuaauuuuuguauuuuuaguagagacgggguuucaccauguuggccaggcuggucacaaacuccugaccucaggugauucaccagccucggccucccaaaaugcugggauuacaggcgugagccaccaugcccagccacuaacauauuauuuugaucaaaauucuauuuaucuauuuguuuaaugacugccucccccacuaggauguacacuucaugaagacagggaucauuccugcccugcucaccaccacauuccuugcaccaggauagagccuggcauguggcagaugcucaaagaguauaaaacgugaugcugugcaaaggcucaggaguaaaagagauacaaucuucaggcaucuaucuaaucuaucuaucuaucuaaagauagguugucacccaggcugcagugcaguggcacuaucacuacucucugcuggaccucccaggcucaagugauccuuuugagucagccuccuaaguagcugggaccacagguacacaccaccaugcccaucuaacuuuuuauuuuuuguagagaugggaucuugcuauauugcccagguuguucucaaacuccuggcuucaagugauccucuugcccuggccucccaaaguauugagauuacaggcaugagccaccgcacuuggaccuacuucaaauuuuucagaagucauuuuuaaaacuuugagugacucuguuuuuuuuucuuucuaucuuuuuuugaauaaaagagaugaggucuugcuauguugaccaggcuggucucaaacuccugggcucaagcaagccauccgccucagccucccaaagugcagaacuacaggcaugagucaccgugcccaguccugggugacuccauuuuaaaauguucacuaugauaagggagaagggaaaugccugcauuguagggcuuugugauuuuaucuauauccuuaauugaagccuuggguaaaguguucacugaguauguuaaggaugaaaaguguuuaaguauuaucagaacuccacaggcaaaaaguguucaaaaucauguuuuuauuaauuuuuguccacaugcauccccacccugcucaccuggcaucacccagauuucccugccccuggcuuggguugggugugcccagagggagaugggagugcagaagccuucgcugaccagguuaacccuuuugugugcugcagagaacuuauuaccaucuuuccacuuaccagauuguauggugauuacucaucaaucucucccacaacauucucaaacagaggaugcagucuuggcccagagauuuuuuugaaguuuaauuuaaaaauuggggugggcaauagagugagacccugucucuacaaaaaauuuaaaaaauuagcuggccuccagcuugagcccaggaugucgaggcugcagugagccaugaucacgccacugcacuccagccuggcaacacugugaaacccugucucuuagagaaaaaaaaacaguugggugguugggaguauacauuugucaaaaccguacacauaaaauguaugcacuguauuacugcauguaaguucuaccacaauaaaguugauuuuuuaaaagucaugauauauauacuaaaaaacgggcauuuucacauauucuaugaucucuuaaauaaucagaagacuagcuguguucuuaaguuggcaucaaugggcacaagccaguuuggucauccuguuucccgccuaacaccuuagccagaacuaagaucuagggagagagcaguuuugaaguagagaugggauaggcagacauaauugcagaacugccagggauaggaaauguccaggggcaaacauggcuuucauuaacaccugcagacaaugauucccaaauccauacauuaagucugauuucucuucuauacuucagacucuuuuauguaacucuauacuagaccucuauauuaggaugucaaauacauuuaauaccacggauccaaaauggugcucacugucucuacaagccuuacccccaaaacuuguucugcucuacauuccuccucucauggaagacuuccaccuucuacucaacugcccaaaccagucuucacugacuucuguuucuuuccccgaaaugcauucaccaccacauccuguucauucuaauucccaagagaacuugcaaacuauccacaucccuacuucaccaaggccacucugcucucuuccauggagcacugaaguaacuccuggcagguguucaggcuuuuggucuugauacgauuuaucuucacaucacagccaggauaauuuucuaaagucuccugccuccucucuguagcuccucauucauucacugagucagaccaaggcugucccugcccacauggagcccauguggagcucaguguaaaugccagcagucgagguuucaagugaccuggcccuugcuugggcuucuccagccucucucucaacaaccacccaauucucuagcuguugcacucugaaacacagccagauucagaaacuugauccagcuagaucucauucuugugaaggaagucugugauuuucagucaaagcaguaacuucaggagaaguaugugaaaguaaaucaaaaggaauuuucuuaugauuuucaccugaaaucaaugucaaccucuuaccuuagguuccuuuaaguaacagugcauggccugaguaacauccgcagcguggacugcguuaugguaaggauuuugacugugguaaucuucuugaaucauaacugcaucaaagaaagagaucccgauuuuauuguauaugagcaacauauacaaggacaaaaauugugauaauuaugaguuacccacucauacuuuucauguagcuaucggcuaaaaucgugccgauucgggcagaugauaaucaccucacaacucacauguauaccaaaagaaucaauaucaauuugacucucuaugcuaucauggacgaacagacuaggcuucgggguggagcugugcccccugccaucaaccuacuugacagcccuagcagcauaacacacaaauccaguggucucaaaggaaagcgagccuaccugugauggggaaacacaaucgccgagugagcgggacagaccaucagaauucugcacuugcuuccgucccauccuuuaaaauagccuuucaguacccuugguuaauaguguuuuuuugagacaggaucucacuucguugcccaggcuggagugcagugacaugaucauggcucauugcagcccugaccuccugggcucaaguaauccugccaccucagccucccaaguaguuggaaccacaggugcaugccaccaugucuggcucauuuuuuuguauuuuuuauaaagacaggaucuugccauguugcccaggcugguuucaaaccccugggcucaaggaguccaccugccuuggccucccaaagugcuagcauuacaggugugagccacuaugccccaccuaauaagcuauuuuuguaugugguuauuuuugagauggagucucgcucugucacucaggcuggagugcaacagcaugaucucagcuaacugugcaacgcccaccuccugaguucaagugauccucccgccucagccacccgaguagcugggauuacaggcaccugccaucaugcucggcuaauuuuuguauuuuugucacaaugggguuucaccauguuggccaggcuggucuuuaacuccugaccucaggugauccacccaccucggccucccaaaaugcugggauuacagguaugagccaccaugcccggccguauguguuuuauaauuuauauuuuuaguauaguaguccccucauauucuugggggauauguuccaagacccccaguggaugccugaaaccacagauaguaccaaacccuauuuauacuauguuuuuccuauacaaacacaccuacgauaaugcgcaauuuauaaguuagucacaguaagaaauuaacaauaauuaaaauaaaauagaacgauuauaacaauaagccagcaucacaacucuugugcuuuggggccauuaugaaguaaaauaagggugacgaacacaagcacugugauaccaacauggcugaucugauaaccaacacgguucaggaugcaaugagauuucaucacgcugcucacaauggugugcaauucaaaacuuaugaauuguuuacuucuggaauuuuccauuuaauauuuucagacuacaguugaccauggguaacugaaaccacagaaagcaaaaccagagauaaaggcggacuacuguacaguauuucaggcauacuacuuauaauuaauacacauuaaaaaguuucucaaggccaggugcacugccucacaccuguaauuccagcacuuugggaggcugaggcuggaggauugcuugaggccaggaguuugagaccagccuaggccauuagcaagaccuugucccuacuaaaaauaaaaauguagucuggugugguggugcacaccuauauuccuagcuacucgggaggcugaggugggaggaucgcaugagccgagagguugagggugcagugagccaugaucacgccacugcacucaagccuaggugacagagcaagacucuccaaaagaaaaagcuucucaaaagcccuauguaauaaauuuaucuguuuuuuuuuuuuuuuuugccagaguucuaaguagaagucugaagucugaguuaauauuucuagcucuucauuuggcuguacauucuugguauugaggcuuuuuuuuuuuugagauggagucucgcccugcugcccaggcuggagugcaguagcgugaucuuggcucacugcaaccuccaccucccagguucaagugauucuccugccucagccuggaugaggugggaggcuggcuggagcuugggaaguugagguugcagugagccaugaucaugccacugcauuccagccuuagcaauauagugagacccugucucaaacaaacaaacuaacuaaaaacaccugaguuauuauuuucucaauucucccaaggacaguauagagccaaagccauuccagauaugcugcacaaaagauaauccauugaagccaauggauuccuuauggcuuuaaggcuuaauucucucauaaaccuguucuaguggcuuccacauuagcggcaacaggaugaagggauaaacagccaaguauucauaugaacaaugugcaaaguggggauaugcaucuuuauaauugccaguauagcuacuggggcuacucacacuauauuaauuauaaacuugagaauuuacugcaaaauuguaucuguagagucacacaggcuucuguuuaccuagauaaagcaguugcagauuagcaaaaaugguuauauuaauuauuauuauuauuuuugagacagagucucauucuguugcccaggcuggaguacaguggcgcgaucucggcucacucucucucucucaaucucaccucugccuccuggguucaaguaauucuccugccucagccucccgaguagguaggauuacaggcacaugccuccacacccgacuaauuuuuguauuuuuaguagagacgggguuucaccauguuggccaggaugguuuugaacuccuggccucaagugauccaccugccucagccucccaaagugcugggauuacaggcgugagccaccaugcccagcauguaugaaauauuaaauguccccaccagcaacaucuuaacuuauuuuauaguuccacaguuuuaccauuuuccuacaguaauaaauuacuuccugaauaauuuguaauuucucucuacuuaaaauugaaagauuuuaaaaaggauaucaaaucaaugugauggucucucacuauuaaguauagacauaccagugagauauuuaguguuaaguuccagacuacuaaaauaaagugaauauugcaauauagcaagucaaaauuuuggguuucccagugcauacaaaagcuauguuuacacuauagucuauuaaguguacaauagcauuaugucuuuaaaaaaaaacgauguauacaccuuaauuuaaaagacuuuauugcuauaaaaugcuaaucauuaugugaaccuucauuaaguuguaaucuuuuugcuguauauaagcaaaauuguauauaaccaaauaaauuacaaauuaagcuaucucuugaucugggcacuauaugaaauaucacaaugagggucagaaaaugagaccccaaaauaugcugcuuuggacuucaaacucagagcagcaaaugcaggagaggacuuucucagaaguucuccuauccaccuaaaggacggacaaagacuuuaccaggaaucaugaauuccuuccucagguagaaccaacuaggagaaacuggugccuauuacaagaaggaagacuagaguugauaucuugugccucagccucccgagcagcugggauuacaggcgugcgccaccaugccuggguaauuuuuuuguauuuuuaguagagaugggguauuugccauguuggccaagcuggucuccaacucguggccucacgugauccacccgccucagccucccaaagugcugggauuacaggugugagccaccacaccuggccccaaauaaucuuuaaagccuaccgucaaagagauucuaggggucagaaaaagaagaaaccuaacugcaauauaccugcucuuuuaaaguuuuagccuucaaaaauuuagaaaaguacagaaauugugucaucuuugucagcaaucuguggccaauguaaggaacauugcaaaaugaaaucaaguauccacaauuuccuguaucuguggcucugugacuuugcagccuuugcaccaacagguguagugcaucccuggucugacuugcuguggccacuugcugcaugcagaagugaaggugggccgauucugagcccagggcuccagcggccuggggauaucagcucucucggaaaccugccacuacuguuugaaccagcucggcuaauuguaaaauaaauaauucuuuuuuguuuuuaauguaaaucuauuauggugccaaacuccucugcuucuuuuaaauuuaacagaagacuauguagagccgagaugggucaggccugguauccuagcugaggucucuacaaaaccaacaugcagcccaccuguugcugucugcaggugcacaaaugagcucacccagaccagaccaaaagaagcauuuaacagccccacagaugcaagagcuaaauaacuguguguuguuuuaagccacuaauuuuggcugguuuguuauagagcaauagcuaaccgauauaacugagauaaaacuuaaacagguucuuguauaaauguaaaucuuguuacuguuaauggguuagaaucacuuaccuaaaaaucuacgaaguuucaucauaucuaaauggaaguacucaauuaauccaugaagacuaaauaaaugaaagguuaagcuuacuagacuauuuccuaaaaagaaagaagagacauuacauuaguaggaaauacaagucaacacaauuauauuaugcuuugaaauacagauuuugaauauaaaacauggaaagaguaauaauucccacuuuuugucuaucaaaaauaugcaucuucuuaccaguuaugaacuuuauaugucacaucuuguuucauuauaagaaaaauuuaauuuuuguuguuuuacuuuuccacaaccaaagaacugaaaacuagacauuuucaaauagauuaauuuuuuaaagacaccaaaauaaugagaauagacaauagaaaacuuuaaaaauugucccacauaguaaccuaacucaguguggcugcaccugaccucccuccugacauugccucugccaucuugcuuucacugaaacugacugccccagagcacacuuccuuggcugcagccuuguuagguggagaaugugucuauucucauccauacaggguuaggaggaggcaucaaugaccucaagaucaucaggauuaaaaacucugaacucagccacuugcuuuuccagaguagcugcagaaaaucugagaguugcuuggggggguggggagggggaaucacaaaacuaggcagaauaucgcuacaaacucguagucaacacugcccagcaaucauauugucuuuccagugaaauggcucuuucacguuuuaaaaugccuauuuucaagccuuuuaugcucuucuuaaacuuucaacauacuuaguucccauccacccccucauucuccacagccucauaugucacagaaauaauacaagcccucaaguuuccuuuucuuucuuuuuugagauggaguccagcacugucaccugggcuggaguacaauggugcgaucuuggcucacugcaaccuccaccuccugaguucaagcgauucuccugccucagccucccgaguagcagggaguacaggcacccgccaccaagcccggcuaauuuuuuguauuuuuaguagagacaggguuucacuuuguuggccaggcuggucucgaacuccugaccuugugauccgcccgccucggccucccaaagugcugggauuuacaggcgugagcuaccacgccuggccaaguuucccuuucuuucaaaagccaauccauccacaccuccucagagauauuccuuguucuaucagguacaacuauccccaccccaccccaccaaucucucucucuuuucuauauugucucaacaagcaucagcauucagacauguucuagauucucucaucucugaaacaauaaagaaucacagccucuccuggcccccuccaguuucaccugcuccaucccccuacagagccgaguuuuuggaaagagcugcuacacgcaauggggacuguuuucguccucaacguccacuccuuugucacuaacaaguggagucacaccaagaauagaaauuaaauuuggaaaaacuaccauuuuuaugauguuucguuuucccuuccaugguguaacucuccauuuuuuauaccuccuauuauacuucucaguuuuguaaacuuccauaggacacauauacuauauuauuuuaacaauuaaauagaccacguuuuaaauaggcuacauauuaaaaagucuauuuuaaguagacuacauccuucacauagacucauaaauuacugccaacauucagauaaugcaauaaaauacacgauucuaguauucucucgucuaugaugacucuuacaaaaauguauaaaagacauacuagucccaaauugaaaauuuauaauaauaauauuuaugaaggauaauaaaggacuguuugguuaaccuuguuaucuaaaacugccuaaccaacugccaacaaaagaccacagcugaugaaaaaguacauuaauuggagcauuauuugcauaagcaaugacagaaaagauguggcaggccaaaagagacuauuuuuaaaaacuaccugacguaucaccuucauguggaaagaaaaaagcauuucaaaucuuacauuuuaaauaaauuaaauguuaaaauguguucagguccugauaugcucuauugguacaaacacgaguccaugugguguggagccauuucugaagaagugaacaacgugucuguugcuauugcuguaacaaccaucuucgaguauauaaauauuuuagaauguuuauucauucucuguauauuuagauuaucauaagguucuccaaauuguuuuucaaauguaacaaaacaaauuacccauuucuaggauguagaauaaguuuuaagaaagcuacaaucuaaugggaaaauacccucuuuuggaauucaggcaaagugcagugaagaaacacauguaauguccccaccaaaggaaucugacaagaaucagucucuuaaaguguacuacccauauguaauugaaaagcugcaugcaagauaccaacugaggauuauaauaccagugaguaagaacacaagucaacaaaauauuucaaaacaagagaugcucaguuguguuaaacaaaaaccaggcacagaagaacuuuuuaaaaaauggaaauggaaacacuuucuugaaaaagaaaauuguauuuuuagaaaagcuacccacauaaaaauauaucaaaagauagaacugccuaugaaagagugguccucaaucauuuuuagaaggugaucccagaugggaucugguuggaaggaguaggccacccugacaacgcaggccuggcagcuaguguccucaugaaccagguggcuuuaggagugacaagcuuuugcuaugucgcaucacuuaacucccucaauccuacaaaaggaacuccaaaugcauccuaccagacaauaacuacuucccuccuuguagcagacaagcugggaacgauuugucuuggcacgaaucacugcauuuugcuuccuccucugccuugcuguucuucccccaauaucaacugggaaauuaccagcauaagaaacacaagaaagcacuggaucaauaagcaagaagggaaaacuauacacuuggauaccaugaauguauguuauccagaauucacuucaggugaagcaguuuuaaaaggaaagccauucucauuauauaauauaagcuaaaggaauuuuuuucugcccauuuguuccccaauaacaucucuuuaaguagaaaauuccugagcuuuugaauagcuguaguuaacugaauguauaaaucuccaccucuaaaaucaaagguggguagcuaaccaugagugguuucuacuaaacccuaaugaucuggaaugaacccuaaggggaaacuaguuagccacccuguccacaaaucccauucaaagagugaggugaucaaaaggaaagcgaagugcuuaguuaacuacuguggacugcuggcuauuucuucugcccauccagugcacugcugagcucacgccgcuuucaucaccaugcccccaacuagcagaguauguacuuuuuaaaaauaaaauuuggagaagaacaaucaacuauuucaaugagugacaagugucccaguagacuaauaauaggcuaugagcugugagaguuuauguaaggcuaaaccuugaaaauguuaagaguggcauuguuucaucuauauuugccuugagauaauaccuaaaauaauauuuguguuaaguuaggaaaggggaauuucccugagcaagaagaaggugggccacuugauauuucacuaccuguauuuucaaaaaggagaagggccaagggaaggcuaacuguguaaaugauaucagagccuuuccuguguguacgggccaaggugggggcagggagaagaacagaacacuuaaucaccaagggcaaaggaaaaguagaagagagauagcgaaggggaggaauaaaaaggcagggaggcaggaggguggcucugcugauaaagacaaacuucacugucuucacaauuuugccuaggaucaguccaguuuauuuucugucaacacugcauaagcaaacagaagguauagacaaagguauuuccacuaggcauugccauacagcuuacagagaauaauggagugauacuaaaagacccacauugauucucaagaaaaauaaagguaauuuauuuguucauuuuacauauuuggcauccuuaucaaaggagcuucauuccaaagcaauaagaaaaagcaggugauuucaaaguacagcagugauuucauuauucuaaagucagcacugacuuccucucaguguacuuucagcucuggggcaaaacauuagcugaauugcuuuuuuuuuuuuugagacagucucgcucuauugcccaggcuggagugcaauggcgcgaucucagcucacugcaaccuuugcuucccagauucaagcaauucuccugccucagccucccauguagcuaggauuagagacaugaaccaccacacccagccaauguuuguauuuuuaguagagaugggguuuugccauguuggccaggcuggucuuaaacuccugaccucaugugauccaccagccuuggccugccaaagugcggggauuacaggcaugagccaccacgcccagccuagcugaacugcuuuuaccagugaauaagaacacaaaucaacaaaauauuucaaauaagagaugcuuaguuguguuacaaaacaaaacaaaacaaaacaaaacaacaaaaaaaaacaggcaugaaggaacuuuuuuaaaaauggaaauggaaaugaacacuuucuugauaaaggaaauuguauuucuagaaaagcuacccaaauaaaaauauacuaaaagguagaacugccuaagguuuagugguccucaauuguaccaccaauaauuaugcccacaauuuuauccuaaauaagagugauucccuguuccuuuuccuacagaacauguuucuguccgcaaagagaauaagaaaacaugaccccuccauccagaaccaaacuaaacucaggagugauuagaaucaccugugggcauuuucccccaaaccacccauacucuguagauucugauaagcgcucuuaaagaagcuacagcucuuccccauucccuaucugaaagcaaggaaccacugcuuuggucaggaaacaggcauacaacaucagaugugauuauaaauggccacaaucuaaaagaaaccaaaaaauaaaaauaaaaaacaugagauaauaauguuuacuuuggguuauuaauaauagcagcggcaauugccaaccaaucugccaagucaugaugaugaugauacuaaugaugauuugauuacuuuuaaggacaauaaucaaaacauaaaauuaugagauugauucuguaggcuuuuagaaaagucacuuaaaaagagaaaaaaaugaugcucccugauaugguuuggcuguguccccagccaaaucucaccuugaauuguaguucccauaauucccauguguugugggagggacccggugggagacaauugaaucauggaggugcuuucccccacacuguucuugugguaguggauaagucuaacgagaucugaugauuucauaagggguuuccccuuuugcuuggcucucauuucucucuugccugccaacauguaagaugugccuuucaccuuccaccaugauugugaggccuccccagccacauggaacuaugaguccauuaaaccucuuuuucucaauuacccagucucggguaugucuuuaucagcagugugaaaauggacuaauacacucucuuccagcagagggcuaacaaccuuaguacaguaaaugaaagcaacgcaccagcggcugcaccaucaaugcaguaaucuagacuacauuaacuugagcaagucaaauucuucacuuaccauuuguuagucuaucaaauagaaagauaucaaaauuccaauuuccaacuuuuuccagcauacacugaaaugaaaaccaaacauuucuacuguaauuuaauuucaauaacauugucuuuuggagauauuccauagagaaguuaaagaaaauguaaagugauugauuuacuuuaaaaaauacaaguaucauuuuucuuuuaaucaugacuuuuucaacuggcuccaaaaaaaugccaaagggauaaacuccauuugaaaaaugaaacauuauuuuguuuuucaauuaaugaaugcacaggaagguuauguuucccagcuuauugcuacagucuugcaaaccuuuaagaauucuaguaucacuuaacaucacagaagugugguucaaauguuguaugguuuagaaacuaaauugcaaacaaucuaauaaaaauaagugacacuacugaguauuuacuguauuccagguacuguuauaaguuacucacucuuuuauuacuaagaacaacacuaucagauguuguuuucuuuuuucuuugagacagggucucacacucacugucaccaaggcuggaaugcaguggcacaaacaagacggcucacugcagccaugaccuccugggcucgagcaauccuccugucucagccucccgagaagcugggacuacaagcauguguuaccauaccuggcuaauuuuuuuuuuuuuuuuguagagacaaggucucaccaugcugcccagggcugguuucaaacuccuggacucaagugauucucccaccuuggccuccgaacgugcuaggauuacaggcaugagccacugcacccagcccaggcauuguuuucaauucucauuuuagggacguagaaacaagcaaaaaauaacuaacuugcucagcuauaaagugauagagcugggaucuuaaauuagguagucuguuucuagaaccuaggcaucugacacugauaccacaccaugcuuaaauuauuuguuauucaguuuuuaaaaaaacacuucuaacuuauggauauguauuuauauuaucuaaauaugcuuauaaaauaacacaauuuacuacauuaacuuuuaggauaauguguacuucagccaagcaaauaaaucccacaaaggcccuaaaaaccaaauauuuuuauaccauacauucuuaaccugaaccuuuuguggacuuuuucuagaaaaaaacuuauauuuuauauccaaaaguucacuguuguauacauuuaugaauacacugacaugagcaacacuaagauacuacuaguagaaaucauuaauuauaacaguacuaauaacaacaaaugacauagagaucaauauucucauucuaaaaggcagaacuuguaaacauuuuaacauuuaaagcaggcaugaacgcuuuccacugauuucuuuuacuaaacagggaaguaauuuucuucacuuucauguaauuguaaagaagacaccccagcuuuaccuacacaacuuaaaaacuuaucuacacaaacucaagaaucuggucuguaaauauuaagucaaauauaacuuaaaauacauuggaaauuuaauauuauuuaaaauccucauuugguuaaaaacaagcucauuuaacccugauguucaguaagacauuucuuuuaaauuauauaaagaggaaguaaauaaugcucacaaucaacaaguuuaacuaugauacaucuaaacccucaaaaaucucucucaaugcaagagacuaucaagacucauuugacugaaagucacgagaccuuugugaaaagauguuauuaauacacacacacacacaaaaaagagagagagaccuaacuuucugugcuggguuuaccucuaaccagcugggugggcgcaaacaagucccucgugcucucuuggacucaguuucuuuauugauggaauacggacaugauuagaucagguaaucucuaagucuucccagcauuacaauucugugagaucuuauaguuuaauguuuuauugaucuccuuguuacguaauguuauaauaauaaaugaaaacauugucacuacuuuaguuauuucagaaauuucccuugcucuguaauggcuaauuauaaaacaaacagcugcucuaaagaaaaaaaccuggaaaauaggcucaacugcuuuucauagacagagaaaaagacucuauaaaucauuacuguauggggaauaaaggccuucaguaaacuuaucaaaaaauuaauguuuucuuaaaaaaacuauacacaccuuggcuuguccauuauaaucaucaucuaaaauguuuagggaauuugaaaccgcaguaccacgaaaaaagcgugaagaucuaagauaucgcuggaaacuuaguagccuucugauauuccuugcagagacagacacuucaauuucagauugagcugaaauaaaaagaauaaaagguaaguauagcaaguuaaaauuauacacaugcuaucuuugcaauaccacuuuuaguuauguacaaguauuuuuaaaaauucauuuaaauaauuauaccacauuuccaugaaagaagugauacuuuauuucuauuuuauuuuauuuuuuuaagugaguucucacucuauuacauuucuauuuucaaugaaagaacuaaggaugaaggucaauggccaauuuugacagcauuuagaaagcuaacgaagacuggugggauuaauaaucacgguuuguuuuuuuuuuuaacuuuaaaauacuauaaccucuuacucuuuugcuucaauauaccacauaaacauggagcagaaacauggaaaaaaccuaguuucaaacuacuagaaaagccagguccuaaguuacauaugagauuuuaacaauuacacaaguaaaacauuucauaucccaaugagguaucauuucaaauauuuacuuaagauaauuaagaagaaaaggagguagaagggggagcaaagugguuuauauccuguaaguguucuaaaggauagggauaaaaauuauuaaggugauaugcucuagaaaagaugcaguucuacaguggagacuggaauguucucuuucagugagucuaacauagccauuuuuucccucuaguguuagaauaaaccagaguucccuggauugggcaccagaugaaaugacagaucugggguaaaaucugucuugcagggaacauacguuaucuuuagauucuaaaaucaaaccaaauucaguaaaauguucacaauauaaaacaggaaaaucaagacugaggaucaauaaaucaucucuuaauuuagaaucaccaggugaaauggaagguaaucaaacauauucucucuugcauauccagucacucacuccucuauuaaccucuagcccuguguuuccuuauguguauaauggcaauaauaucuaauuuaaggggugcuggauuaaaugagauaauauauauacaagucagagacacagcagguguuaaauaguagccaugucgagggugguaaaauugaugcugcucccacugcuugcagguaugcuacuaguaauuaucagaaauucugaaucugcucaucuugcucuaaauaaaagcauuucauggcucuucaucaucuuaauaugaacuucauuuccuuagccuggaagagaaggcuucacgcuccaagucuggcucuuuguagacuugacucagcugucaccuucccugggaagcacauucaguacacugccccuaucuugaagaggcgggaagcacccgcucuggcuucccaaagcucccugugcauucaucuauaauaguacuucugauauuauaauuaguuuuuugucuccuugaacaaaugaugacuuucagaacaggcaugaacuaucuuuuuuaccucuguauuccaaagccuaauaguaaugcaaagcauauaguaaguaauuguaaaauauauuaaauaaaugcauacuauuuuuaaaauaucugaugaacucugagguucccauacacacaaauaaacagaaguaaaauaaugcacacuguuaugugauuuacuucucccauuuuucauuccagugaguaaaaugcaaguaucuaaaacaauuaugaaucuuaaauuucugaucuuuaccaauguaacuuacuuuaaaaaaaggacuagaaccaaaauaguaaaaacuauuaauaucaagugaugauuauguuuaaacuagaauuggucuguuugaagaaauuuggguagauuaaauucuaugaaagcaauguuccaagugcuuuguaaaaagaaucucauuuagccaucaacagcuucaaaagauaaauaguaugccccacuuuacacaugagaacacugugccuacaagaaauuaaauaacuuuccuaaggucacauacccaauauagggugacaccuggauuaaaaaacacagaucuguuuauaaagccuguuuacucacaaggguuuuuaaauuauauuucuacaguauuguuuauuuacuguccauuacaaaauucuguguacauccuuauucaaaauagucuuuauuucagaugaagauauggacagaaaaagaaacagaaggaaaauagcuaaugcaaaggaauguuaaguauauaacggacucuucuaacuuuauuacuagaaaaaaguggaucugcaagggacauaauagcauggcaugaauaugugggggaggagauaagaucuaauuaauguaacacuagcaccaccaucucuguauuuguaaagcacuuuacaguuuuaccagaguauguucacauccacuaucccauuuaguaaucauuaccauccugugaagaaggcaaagauuaucaucuccauuuuacaaauauauccuuagaaaccaagguaaaaaugcaauacaaugaaugcauuagagccgacacacuuagaaaacuuuuagaaaauguugcagaauacuuguacuguauuuauuaugaaaaaauaaccuaaagcagaguucaaggucaugagugccacuucaugagcauucccucugauuuaccuuaaauuacacacaaaagguaacaauuuuauuacuggcaauuaggauugcuguguguguguauuaggaucacacuguauguauauauguaaauuagaaucacugugugugugugugugugugugugugugucugugugugucugugugugugugagacagagagagaauuugagaaucucuuugcaaggacaacugcauaagguccaaaacaugaauuagccucauuugagagggaaacuccaacaauucaauccacugugcucugucaccaugguaggauacauacugucaaugguuaagucaauugguacugucugggagccaaggccccaaccaugaaaucaugguuguauccuccccugccuaacucuuauuuucugggcaacuucugacaagucauaaccuucugauaucucauuuuccuuaacuguaaaaaaaaaaucauguuuccuguuucacagagcccugaaguuaagauucauuaucaagaguucuauuuugaccaaguuaagcugcaaaugaguauuagauauugacucacaaggaaaugaucacucaucauggaagcccaaugccuucuaagauuaaucucauaaagaaaccuacauaacaggauaagaaauggaccuucacuuaaugauauaggaccacccuuaucaauuacugauuaugucacagacaaauuaagaaaggacauggagccugucuagaugaaauggaagaucauucaaggaaaaguguuuucuucaccuacagggucugagggccucauacaggaagccuacacguaacaagauuauauucugguaaagaaugaaaaucccacgagacuuugcagagaugccaacuaaaacuaccucaaaguuuugucuaagauuuaauagaggaccagaacuuucgggggaugucugguuugauuuuuuucauuaaucuaaucuuugaauauguaaugcauucacguuucaaaaacaagaagggagggaagaaagaaaauaacagugaaugauucaacccucuauguguccccuuauacaaccacucucaagcccuaccccaaaaugguaacuuuuaucuuaaaguuucuauuguauccuuccugagguuuuuuuuuuucuuuucucgaguuucaucucuuguugcccauucuuguuguucauucuuguugcuagagugcaauggugcgauaucggcucaccgcaaccuccgccuccgggguucaagcaauucuccugccucagccucucaaguagcuaggauuacaggcaugggccaccacacccagcuaauuuuguauuuuuaguagagacgggguuucuccauguuggucaggcuggucucgaacucccgaccucaggugaucugccugccgcggccucccaaaaugcugggauuacaggcgugagccacugcgcccagcccuuccugaguuuuaaaaaauuaaauauauagaaacauauuauuuuucuacuuauuuuacauaaaugguagcauauuuuacaaccuguucugcaucuugcuuuuuaauuuauuguggaucacucucccugucagugcauagacaccuucccuguucuuuuauaaggcuguaaaguauucuaucauacagaugaaucauaaucuauuuagccaguccucuacugaagggcacugcuacaguuuuacaguuugcaagaauaccuuuguuuuguuaaauaugcuuauauuucuacuacuugauuugucagcuugagauaucauccucuaauuuucaguuauugcacgaggaagucacucuauaugccaucuucuuuccccuuuccucuuccaguauuguuaguuaccagagcauauuuuuuuccuuucacucuuaucucuacuuucauuuuaggcuuagcuguagaaacugaauauacucaauaacgcaagaccuuuuaucuuaauuuccccaguuaucuauuugcuuguguucauacucuaguaguauccuuaagugcucaugaaaacaaaauuaucucacagcaauauauuucacucauaauauauuauugaauguucaaauuuuuuuucaguagucuuuugucuuucuugguucuccuuuuccuuucuugaauuucuuugaagguacugguucauuaucucuggcauugaaacuugcaaaaucugaggcaaaccuguuauuuuugcccuuguaagugacuagguauuuuuguauggccgcccacagaauucuuucuuucucuuuaaaggccaauuacuuuacuaagauauaucucauuguuaaccauucugggucauuuuugccugguauguucuuucaauauacaaauuuaaaucuucuguuauuccuggaaaguuuucuugaauuauaucucuaaauaucuacuuugcuccacuauuuuagcuuuuuaaaaucagacacucuaaacugucuauguugaaacaccuuuauguguuuucuaucucacuuucucuccaauucuuuuuaacuauuuguuugcuuuucucauuucuauccacuauaaccauuacuguguucaguauaaauucuaucuugucgccuuccaaaucugucuuccuuuccaugauauauuuaaauuuuacuucuacuauuuucugauucugaauguacaugucuaaugcaacugaacuccuuuuguugucuuaucucuucacugaguucuuaaauuugugcuuuaugguaaagcuauuguuuaauuuaauuuuuugagugguaggaaauuuagucacaauuuucaucaguucuauggcagcacuauuccauuaagugcucuccagucauuaaauucugcugcugucuuccacuguuuuacuuaaauuaucugcugugccaguuuccuuuuuuaaaagucauuauugaaugagcugaauuuuccuggaccaacucuuuguaccaaguucuuaauggggauaaaagggaggucuugggagagagcagaggaaaucccucugagcucuacuacccaaauggcucucuccuucucugccaaagaaauaaacugcuucuuaggaucaugccucugcuauuucucuaaaccauacugggcccagagagacugcacuggacccugcuuaacccagauccuagaccagauguggaaagugaaauaauuagcuuuguacuucagggugagcuccccacccucacccaccccuaagcuuuaaaaaagaaaaauuaagacuucuuuguguccuaacauauggucuauucaaugugcacucgagaagaauuuguguucugcuguugaguacucugugucuguuaccucuaacuggauuauaguguugcucaggugcucgauuuccuuauuacucuucugauuguccuauccauuauugaaagugggguauucaagucuucauuauuguagaauugucucucucuuaaauucugucaaauuuugcuucauauauuguggaaauccauuguuagauauacguauguguuuaucauuauuauaucuuccugcuggauugaaacuuuuaucaacauacaaugccuuuuaucucauaaccuuuuuuuucaaaacuuaaaguguauacugucugccaauaauaauauagucaccccagaucucuuuugguuauuaucugcaugguauguuauauuaggguucucuagauuaguucugucccucuaaaggggaguuaaguauuaacucacacgaucacaaggucccacaauagggcaucugcaagcugaggagcaaggaaagcaagucugagucccagaacugaagaacuugggagucugauguuugagggauccagcacaggagaaagaugugggcuaggaagcuaggccagucuagucuuuccauguuuuucugcuugcuuuauagucuagccacgcuggcagcugauuagauggugcccccccgccccaagauugagggugcgucugccuuucccagcccacucgcucaaauguuaaucucuuuugguaacacccucacagacacacccaggaucaauacuuugcauccuucaauccaaucaaguugacacucacuauuaaccaucauauaccuccuuucccauucuuuuacuuucaaccucuuuguucaaaccauucuccugccucaggcucccgaguagcugggauuacaggugcccaccaccaugcccaacuaauuuuuguauuuuuaguagagaugggguuucaccauguuggccaggcuggucucgaacuccugaccuugugauccgcccgccucggccucccaaagugcugggauuacaggcugagccaccaugcccagccguuauuugucuucuauaugccuuguuuuuuguucuuuaauucuuccauuaggcugggcacaguggcucacgccuguaaucccagcacuuugggaggcugaggcgaguggaucacgaggucaagagauugaguccauccuggccaagaagaugaagccccgucucuacuaaaaauacaaaaauaagcugggcaugguggcaugcaccuguagucccaucuacucgggaggcugaggcaggagaaucgccugaacccgggaggcggagguugcagugagccgagaucgcgccacugcacuccagccuggcgacagagcgagacucccucaaaaaaauaaaaauaaaaauaaaaauucuuccaucauugccuguuuauuuuuuuuuucacuuauuuuuuuuuuuuuugagacagagucucacucuguugcccaggcuggagcgcaguggugugguuucggcucacuguaacgucugccucccagguucaagugauucuccugccucagccucccaaguagcugggacuauaggugcaugccaccacgcccggcuaauuuuuauaucuuuaguagagauggguuuuccucaaguuggcccagcuggucuugaacuccugaacucaggggauccacccgccucagccucccaaagugcugggauuacaggcaugagccaucaugcccggcccauuauugccuuuuuaaaauuuagguuuuuguuuuguuuuguuuuguuugugcaucauuuugauucccuccuuuccuguuuuguguauuuuuaaauuuacuuagugguuacuuugggguuuacaauuaacaccuuaaacuuauaaagaccuaguuugaauaauaccaauuuaauuucaauaguauacaaacacugcucguaugcaucuccaauccuccuccuuccuauuguuauuaucacaaguuacaucuuuauaugugugugcccauuaccacagacauaauuauuguuacaugcauuugccuuuuaaaucauauaaguaaaagagguguuauaaaccaaaaauauaacacugguuuauauauuuacuuguguaguaaccuuuaccaguguucuuuauuuccucuuauggcuuuagguaacuguuaauacccuuuuaugucaucauaaagaacucccuuuagcauuucuuucuuauucucuuugaaauggagaucucacuaugucgccuaggcuggccuugaacuccugagcucaagagaucuucuugcccuagccuccugaguagcuaggauuacaggcaugugccacuguguugaaucuaccauuucuuguaggacaggucuacugguaaugaacucccucaacuuuuguuugucuggaaauauguuaaacuccccuucauucuucaaggauaguuuugccaaauauggaauucgugguugacaguuuuuuguuuuuguuuucaggacugacaauauguuaguuuauucccuucuggccaccaagguucuuaaugagaaaucagcuauuaaucuuauugagaaucccuuguacaagacaaguugcuucucucuugcugauuucaaaauucuuacucuuuggguuucaacaauuugacuauagugugucucaguguggauuucugaguuuguccugauuggaauuuaccgagcuucuuggaugugcauauucaugucuucaucagauuugggaaguuuauuuuuucaaauauuuuuuucugccccuuuuucuuucugggacuccagugauucauguauugguacacuugauggugccaccagucucucaggcucuguucauuucucuuuuuuuucucucucucuuucuacuccucagaauggacaguuugaauuaucuugccuucaaguuugcugauccuuacuucccccugcucaaagguuucaacagcagauuuuucauuucaguuauucuacuuuucaauucuagaauuucuguuugguuccuuuuuacaauuucuuucucuuuacugagauucucauuuuguuuguacauuguuuuccuuauuuguuuuuaguuauuuguccauguuuucuuuuaguucaguaaacauuuaagauaguucauuuaacaucuuugacuaguaauuccaaugugugggcuuccuccggggugguuuauaucaaauucuuuuuuuuuccugugggcuauauuuuccuguauguuuuguauuuuuuuguuggaaacugaacauuccaaguuuuacacuggggaagcucuggaaacugaauuauuuuacuccuccaggauuguuuauuuuuaaaauuuugcuggcuuaugauaaaggguauuucaaggaaacagauaaagggauguauagggcaagguaugggggaaggggugcagagcuuccaugcccuccguaggugcaccacucuccaggaaccugcagguguucagcuauguggaggcucccugaaugcgguccucuuggguuuuuauggaagcuucauaaugucagcauuccuucccccaagguauagggcaagacucucucuggggaaggucuuaggacccacaaucagaaaagugggcagacauuagaguccugccuuggggcaggugaaaggagggcaggagaaggucagagaaauuguuuuucuugaggccugcuccugaggccugacacacucaacauuacaacaaaagacuguaacaagggcuauggaaguuacaagccaggaauugugggcaaaaacauaauaccacaggucauccccugguuuucauacauggauccuuuaaaucaaaagaauauacauaauuauuaauaacuaguccaguccaucauagugcaugacugucucccagggugaggcuacucagguuuguaggguuuuuuuagaucuugucagguuccaaaaguggcaguaguuuggcaaacauacaguguuauucuuuccggcaucuggaauaauugagcuaagagauaauguugucucuugcuccaagacuuuguuuuuguuuuguuuuguuuuguuuuguuuguuuuuuaagacugagucucgcucugucgcccaggcugaagugcaguggcaugaucugggcucacugcaaccucugcuucccggguccaagugauucuucugccucagccuccugaguagcugggacuacagacgugugccaccacgcccggcuaacuuuugcauuuuuaguagagaugggguuucaccauauuggccaggcuggucucgaucuccugaccucgugauccgaccgccuuggccucccaaagugcugggauuacaggugugagccaccacacccagccaacuccaagacuuuuaauguaauauuugauuucccucaauuuauaacccacuuacucauuuauuuacccucaguuauuaguccuccuuuucuccacuugucauuuauuuuuacucaaauguuuccacauuuggaaggagcauuaaguuuggucucugugcuaguccagauugcugguuguaauacuagucuagcaagugccuuuuccuguguccauucccauucauagaggguaggguuacaaagguucugaacuagugaaccauuuuuaccacuaggcaauaacagccguauucacucucagccccaauuuugccagauggggugaaggcacaacccacccccaucaggcccucaggaauucuggcauaaggcuuaaaaauacaguuauacuuucuugcuuagaaauaauccuuguuuccagcacuuguaguccuaggacuacuguaucagguaagggggaaaaaauguuuuuaggugauuuggggaagaaagaaaaaaacuacaguuguuauacuagugcacuucucccuuggcaagaauuuauagucauaucagcauccuccacaaccccuauucaccagauccaccagaaaaagacacaaaucuuguggggacacuccuuuagucccacucaugcugaaugugagcacacacuugugacggugaguaagccagcccuuugugcuuucaucucccucuguuauggacaguguuucaauugccauuucuacuuaucuuucaaacuauacucugaagagguuaucucucugcccagugcuggacauuaugggcuguacaguauguuccuuugucugacaacuguuggccaccgaaauccaugcaguaccuucuguucuaguucuuuaauggcacucuaagcauuugcaucuuccacaaguaagcaaagcccaauccagaaucaggucuaucccaucuguagccccccagggcuaccagcaucagucucacuugccagcuauguucagggcguuccuaccauggaaucugucccauaaccauaggcagccucugucucucuugcggagaaacaggacuguucuuaccgucauuaugugucugagagggggcaaaaggaacaugucuugacucagcccaucucuacacugcugcaguacccccagauccacucauuccauggaccucagggaggcacacggggauacuugcuugcauuuuacgucuuuuccaaacuauuuuucccuuugcuugucuguuugccuuuuucuauuccuuguauguaaucacugaaguuucuguuccaguaucucugcagucagccagugauguggcacagauuuccuuaagugucuggcuccaaaaugggggugaggggcucaggacaguacuaucuccuuaaaucuccugacagaugccacugggggaaaccccugaggccaagagggccaaaucuugugaaaacaucugcaucagucccucagggauccgccagaaugacgagaacaccaagguccccacuucccacccuggcuucagccagauacugcaggcauaugggccauauccccacaggccacagggcugaggaaugggggauggcuacugguucacccaagcuguccugccaaaaaacaguggccucucccuucaacaaguacucucuuggugacucuaaguguccaaucagggcccagaaugcugaaauaguugauucuggucauuuuuucuacuuggguaguuguuucaguggagagaucaaccccuggagguucuuacucugucauuuugaauggcauucaccccuuucuuuuaaaggggguuuuuccuaaagguccuuucuggaaugagacaucccaaacccucucuuuugcucagccuagguuugagaauggggaaagguugcaugugagagcuuaacuguccagaaacaaccauuguuaacaccccacccugguacucuagauuuuuuuuuuaagaauuauuuucuauauguauauauacguauaauuuuucuuucaucuaagaaaguuaauacuauuuuuuucacaucagaauuuaucagcugagcacgguggcucacaccuauaauccuagcacuuugggagcccgaggcaggcagaucacuugaggucaggaguucaagacuagccuggcuaauauggugaaaccccaucucuacuaaaaaugcaaaaauuaucuggguguggugguggucgccuguaauaccagcuacuugagaggcugaaacaggagaaucauuugaaccugggaaguagagguugcagugagcuaagaucgugcuacugcacuccagccugggcaagagugagacuccucaaaacaaaacaaaacaaaaauguaucuauuaucuuuucaugccaauaaauauauguaacaucacuuuuacuagccauguauuagucuaauguaugaaauuaucaucacuuaauauuuuugcuauaaaacuguuucaaacuuuuauuuugcuuacaaacaauucugcaguaaagauccuuauaacuaaauuuuuguacacaaccuaauagauucccuuagaauaaguauucagaaguagaacaaggaauaggagugcacuucaauagugucuaaaacccaugccaaacuggagacuaaguacuaaaagaaaauuagagagauuuccagaacuguccuagaauugcuuccaaaauaugaucuaagaaaagggaucaagaacuauaaaucaaggauaaaacaugaugagaucacuuuaagacuguuggaaauuuuuaguuucuucauguuuacuccacacccccacuccccucaucacacagacacuguuuuccuggaguaaugacauguaaaauucuuacuuuggaaaagccuagacuccuauuauggggaaaggaaggaggguagugcugggaagguuacacccagguguucugucagcagguuagcgaaaccugagugaaaaaagcaaauagaggccacuacagagaggaaaggauaucaagcugaauaauuaacaucauuuaggaauacaggagagaggauacaugaggaacugggaacaagagugacuaugagaauuuaacuaguacuuucauccgaacaauuacuaaaaagcucacccucuggcuguauuacacaauaucugaccuucuuaccaauauuguuuuuucuuuuuuuuuuuuuuagacggagucucgcccuguggcguaggcuagagugcaguggcgcaaucucagcucacugcaaccuccgccucccagguccugauucaagcaauucuccugccucagccucccgaguagcugggauuacaggcacgcaccaccaugcccagcuaauguuuguauuuuuaguagagaugggguuucaccauguuggccaggcuggucuugaacuccugaccucgugauccaccugccuuggccucccaaagugcuaggauuacaggcaugagccaccacgccuggcccucuuaccaauauucucaugagcucacugugacaugagacaaauuauuuauuucacagcauaaugcacaacagauuaaacuugccuuuauuaaagcuccacuuccaucaagccuggacuauuuauuuuaagucccaggcuugugcuaguuuacaugguuaccuacauuccaauccagcuuagaaagccaacagggcucagugaauuaaucaaguuacuauuaaagagcaguuggcuuugcuggcucuuuucuaaaauaucacauuacuucacuaugugaccaagaacaaacuaccagccuccaccaaaccuaaaugaacacugugacuuagugaucacggguauuacuuccaguuaaugauucuuagcuucucuaagccaaaucacaaaaagugggauagcagacgaauguaaaagacauguuuuucuguugcuuuccccuccucauauuagaaaguagacaggaaauacaagccccaggucaaggaaacaagcgcugaagaaccaacacaacuggagcaguauuacucuaacucuuccacagauucuuuucuaucacccaaaucgcauguuuucccacaaccgaugucacaaaagaggccuuuaacagaaaagccucuggcucuugagacccgaccacuacuugcuuuaacaguccacgagagggagcccugcagccacuguaucugccaccuuaacaaucaugaagauacuaaucaugaauuacccuuggagauuauuguuuaaaauuuuuuuaauucaguccuauaagguuuuaacucuaaucuagggcaaggucauguugaauggcgcugguauuaaaacaaaccugaagauguucuauauccuaaccuucccuuucuuucucuugauuucccucaaaaagaacaggagugguaucuaaaagccuauuguuaacaucggguaauuacacuuacccuacaucuacgggacacauuuucuuagaaaaaaauuuuacauuuagcaugcaugaaugaauaggggaaaaucagcuaggugucugcagcaauggucauuaguagagcagcacgugcugacauggagaggcagagcagcaaaguacaugagaacacaggggcuuaggaauuagacacaucugaguuugaaucccaauucugccacuuuuacuaguucugugacauuaaacagguuaguuaaggucucuaauccucaguucuucaucuguaaaauaggccccacaagacuguuaaagauuaaaugagauaauauaugcaguaugucuuugcacauuuuuggcaaagaaaaagcacuuaaaauuaauagacauggucauuauuaugaauaucaaauauuuuuaaauaugucauaccauuuuuuuuaacaaaaccagauuuauuuuucaugacaguauaacuucauccugaaaacuaaugugcuagagaaauaauuggaaacauuuaaaauauuucagaauaagcauacaaucucauuaccauaaaacaaguauauuggccaaguaugguggcucaaaccuauaaucccagcauuaugggaagcugaggugggaggauugcuugagcccaggaguucgagaccagccugggcaacauagugagccuccaucucuuuauauuuauauaaaaacaauguguguguguguguguguguguguguguguguguguguguguguguauaaaaugaauauacagcuuaaacuucaguaugaaccaaagaaauaaauuagccacucguaaucuaaaaauuagauuaauguuauguguacaaccaauauucccucccaaaagaauugcuuaagggagggaauauuuguuauacauauaacauugaucuaaguuuuagauuaugcagaauucaauguucacuuugaaaaaauuuaauaaaauagggauaugggagacauaaaacccuauaaaaagguuacauacgguggcucacgccuguuaaucccagcacuuugggaggcugaggcggguggaucaccugaggucagaaguucgagaccagccugaccaacauggugaaacccugucucuacuaaaaauacaaaauuagcugggcgugguggcgcaggucuguaaucccagcuacuuaggaggcugaggcaggagaaucacuugaacccaggaggcgaagguugaggugagccgagaucaugccauugcacuacaaccugggcaacaagagugaaacuccgucucaaaaaaaaaaagauugauuacucuuauuguuauggguuaggcauauuuuuacucuucagagcugggaugugggauaugcuggaucccucuuaugcugaaacucagacgcugaacauagcauagcuccucagucauuaaauucuuaauucccuuauuaaaguaagcugagaaagaaagaugaaaagcaaaguacacaaagucuuaaugcaguuccuucaaaacuuaacauacaaaauaaagcugaauuuccaaugucaccaacuugccaaagcacaaguaaaauuaaacuaccauuaaacuguauuaagauuaagguccaauacguaucggucaauuuccuaauuuaugcuaucgaguuaaggaagauauuuagaagacagaacauucuguucuuucaacuuuaggacaaacaagaaacaaagauuagugguucuuaaauguaggcacuuaugaaucaccuggaaacuaggugaaaguuuuuuuaaaaacugcacauacauggggcagaaugcucuguguccuaaugcaauucaguacagcagugcuaaucucuacaagcaccacuuuguaaggaauuacaauagaaaagagauaggagcaugggugauagaaaagacaggaaaaagggacaugggauuauuguuuccugggauaucgccauaaacuauuaaagaaauguuugcucugaaacaaccugauaugacuucaagagaaaugaacgacugggaagaaauuaaaauuuaauagacacuccagacaaauaagaucuuagucuacaauaccauaacuacaagcacaggcuggcaaacucgagucugaaugagagacuaaauuacaaaugauggauagcugcuuucgcagaccaaacagauaaugguuggaaaaaaguaugcuugugaauaggaaacuaaugaccaugcaguacaguaugaaaguuagauaagagaaaaauacuauaaugaagaaagcugcauggcugagggaaaugcugagcaaacuauuuguacaccuaaagaaaaggggaaaagcacuaaaagcuuccaaauauaacagaaucuacccuuguaugggaguuacuagauauuaaagacugagauaaacuaagacaauauaaucaguacgauaugagcuuuuaagaaacaucuucuuucaugucauaauacaacuaaguaugaaacaaauaaucaaagucuaacacagucuuaucagaaaaacaggaaacaacuccaaaucaaauacacaugaggaacuaagcgaaauuuagggaaaauucuguaugcuuucauacagucauuguaauaaagacaauaugagacacaugauucaacagaaaggcagcaaccagccugaacuugguuaacaguuaauacagauuauauggagagaacuacaaacaggccccuguaaaaucuaacuguaggagauacacagccauagucaauucaaugcaauaaaaauauacucagucucuacuaugagccagaagcugccagagaccagaaauaaaaagaugaauaaaacuaaaagccuaaagugaagagcuuauaggcuacaauguaaauauccugaaaggucccccugcugcccuagcaugggaugaaguuaacuguuaaaaugaauacagagcucaagauaaugggcgagccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacucgggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaaaaagauaaugggcgaaacaugcuuacauggacuggaacaugacugugucccaagaguaaaaagaaaauggaaaaaacugcauuuguguugacaugagaaacacugaaagaaaacauauuccuuguauuacaucuugcuggauguuggcagagagaccaggcccuccagucuggaugacgucaaugagcuuuggcaaauuccaugaaaagaacugucaagcugacaacuuccauuacuauuuaauaaucaugccagaauuguucaaaagaacacaucagacuagaaauucuaaugggcaugcauaaugggauuauaauaauucuuuaauguuuaagacauuaguaucucuuauacguuaaaaauaauguguaacuaaagaaugauuuauuaaguuuagagacaaauuuagagcagaaaagagaugaaauuuuauuuauuuauuuuuugagauggagugucacucugucacccaggcuggagugcaguggcacuaucucaacucacugcaaccuccgccucuuggguucaugccauucuccugccucagccucccgagcagcugggauuacaggcgcccgccaccacgcccagcuaauuuuuguauuuuuaguagagaugggguuucgccauguuggccaggcuggucuugaacuccugaccucaggugauccacccgccuuggccucccaaagugcugggauuacaggcgugagccaccaugcccagccgagaugaauuuuugacaaaaaaaucaauauggaauuuauuucguguucacuuaauuuaggacucaaaauaucuuauuucaagagaccaaguauauggcuaauugaacagaggaaaaucucuguaggaauauuugcgacucuuacuuuagcugacugaaguuacuuacucaaaagagugaaacuaaacaaggagccuccugguuaucuuuauggaguugaaugaaagcaggaacuugagaagccuaguaaggagacgcugccauaguaaaaaaugaugcuuaggagcaagggagccuguuagaacacguagaaagcucugggcaccuuucaguguaaaccacucuauggucagcccagcauugacgucagucucuuccucucucccaugcaucacccucucucuauuucucccucucuccucuuccuccauuaucuuuuccucccaauuuguuggggcuacccauugcucauuguuauuaagugccucaaacuuaaauuuucccagcaucagucaggagaccaaacagguuaacguuagcugaaugaaagggcaucaagaaucaguuaauuaaaugcaggaggaccacaaaucuguaccuuaauggguguaauacuuagauauagggcaggucugaggauuaggaaucuuuuuaaaaugggaugagaguugaggaaguuucucaaugggucuuggaaaaguauuaaugccaacauuuucaguuuaaauauuugucagaaauaagucugcucauucaaaacaacaacaacaacaacaacaacaacaacaacaacgccuggaccacuacauccaacugaaucuuguuuuuuaaaaaagguauauauuaaauacgucauacacuuagaagaauuagauccuuuauuuguggcuaaucuuguagcccucaacaccaacacaggauugcaugcacagcuuugggggacagacacagggcaaagagguuaaacaugaagcaugaaccucagauuuuuguuacguaaauaaaucaucaaugaccagcauaguaugaacguuuauggauuaguugucaugauacauuuccaacugcaugaccagagacugugcuuucuguuguauaagcaaccacaguccuucuaucagguugaauaaaaguuuuuaacuaaugggaguguaguauuaugauguauauauugguuuucauccacagucccaggcuaacuccuauaucccuuguuacagucuuuuauuaaaacguuggguguguuaggccuaaggaaacaaucucuccaauauucuccuauccuccuuucaccuguuucaaucuucccuggccuuucugacugugagucuuaagacucuccccagagagggucuugccccauacccugggggaaucugggggaaggaaugcugaccucaagaagcuuucauaaaaacccaagaggacuggguucugggugcuuccacauagcuuaacauguagaguuucuuggaggguggcgucccagggaaggcauggaaguucugcaccccuucccccauaccucacccuacacaucucuucaucuggauccuuugcaauauccuugauaauaaacugguaaauauaaguguuucccugaauucugugagcugcuccagcaaauuaauccaacccaaaaagaggguccugggaaccgcaaccugaagcuggucggucagaaguuccagaggccaggacuugugacuggugucuggguuuugggggcugggaggcagguuuaggaacugagcccuuaaccuguggggucugacacucccuccagguagacaguguuggaacugaauuagaggacacccaguugguguccaccgcuugguguguugggagaaaccccuccacacauuuggucacagaagucuucuguguugaugacugccaugguggugugagagcagagggaaaacacaguuugaggguuuuuccuacacagugagcauccacaaauuuaaacaguaucuuuaaugagcuaaaauauuccaaaucucuuaacacaagccacuaguauaauucugauaugguuuggcugugcccccacccaaaucucaucuugaauuguaacucccacaauucccauguguugugggagggaccugguaggagguaguugaaucaugggggugcuaauucucaugauagugaauaagucucaggagaucucaugguuuuaaaaaggggaguuucccugcacaaccucucuugccuugucugcugccaugugagaugugccuuucaccuucggccguaauugugaggccuccccagccagguggagcuauaagucuaauaaaccucuuucuuuuguagauugcccaaucuuggaaugucuuuaucagcagcguaaaaacagacuaauacaaauucuuacugauacuuguauucucuuuuaaucacaaaauagaacauuucccagagaagaaaauacuauuucaagaaaauacuccaagaauguuucuggucauccuaaagugauguuaacaaugacuucuuuauguaaaaaaucccuuucucaaacucauaaacuauguaaauauguaugauaaauauuaccuucugugcuagaauaauagauaauaaaagauauaaucaaaaauaauacaaaaaggucaagaaugcaucagaaaacuucuuuagugacagaugcuaucugaggaaauuuuuuuauucuggcaugaagagcccacuaaaaguaacagacauggccaggcgagguggcucacaccuguaaucccagcacuuuggaaggcugagguaggcagaucacuugaggucaggaguucaagaccagccuggccaacauggugaaaccccgucucuacuaaaaauacaaaaauuagccgggcgugauggcaggcgccuguaaucccagcuacuugggaggcugaggcaugagaauugcuugaaccagggaguuggugguugcagugugcuaagaucacgccacugcacuccagccuaggugacagagcaagacucagucucaaaaaaaaaaaaaaaaaaaaaaguaacagaugcaugcacauauuuuuuuuaaaaaauuguuaugaaagucugcaugauacggccaucugagaaaugacuuaacuuaaaaauuacagaauuuauugauuaaaucagaaucauugcaacaaagcugccaaacuaacccugagagcauauuuguaccagaucuuugagaaacuacuucuuggcuagaagaauucguaaucaucaaaaucccucuaucuuguguaaccacgaauacaaguuaguuucaaaaugucuucccaaagcuugaacucucucggcucuuuauaaauaacuacagaacuggccuaaauuucaguuaauuaacaaauaugugaucuagacugggugcgguagcucauaccuguaaucccagcacuuugggaggcugacgcaggcagaugacuugaggucaggaguuugacaccagccuggccaacauagugaaaccccgucucuacugaaaauacaaauauuagccgggcaugguagugauugcccguaauccuugcuacucaggagguugaggcaggagaauugcuugaacccaggaaguggagauugcaaugagccaagauugugccauugcacuccagccugggugacaagagugaaacucugucucaaaaaaacaaaaacaaaacagaaaaaccccacaaauaugugaucugaguauaaacccgugauuuuuaauuaggugaauaauuucauaauaccauacucuuaaaaauuuuuguccagagauaauuucaaaacacauacaaaaaguuacaaaaauaaauaguauaaagaacacucuauucucagauaugcauuguuaacauuugucuuauuacuugcaguauacuucugugugugugugugugugugugugugugugugugugugugugccacaccuaauucuuuuuucugaacauuugaggguagguuauaagcacucuaguccuucaccucuguauuagucuguuuucaacgcugcugauaaagacauaccugagacuggguaauuuauaaagaaaaagagguuugauggacucacaguuccauguggcuggggaggccucauaaucagggcagaaggcaaaagccacgucuuaccuggcagcaggcaagggugaaugagagccaagcaaaagggaaaccucuuauaaaaucaucagauuucgugagacuuauucacuaccacgagaacaguaugggggagaacugcccugaugauucaauuaccucccacugggccccucccagaacacaugggaauuauggaagcuacaauucaagaugagauuugggaggggacacagccaaaccauaucaaccucuaaacacuucagugaauaacaccauaacuuaauacauguuccuauuauaaacaaggugaaagugaaugucuuugcacauacauuaacauuuauauaugaugacuccauuugcauacauuucuaguggugaaaucaaagagaaaaaaaguuuaaaggugauacauauuaccaaacugcccuccagaaagccuguaacaauuugaacuucuuccaccagcuccuuagcugauugccuaaguuucuaaauuugauaggaauuuguuuagaugugagguuuagcauuguuucuuguguuuaauguguuucugugcucaacugauuuucuucuuuugccucuucauacccuuucagaaaagacucguuaaagucagaaccugcuggacaagaaggccuauggcaaauccuacugaagauaaauuuauaagccuuaagagaauaaggacuaugacaaaaacaauccaaaccacaauaauucaugguaggaaauauuguggcaucuacauaauaaaaugguugagguccuucuuuuguuaauuuugaggccuauaauugcuccuuaacuggucagguaucuuagauaucagcuggcucacaggagaauguaucuucauaauauaaacccaaacguugcuuauaauaaacuguacauauaaaaaaucuuaaaagaaaaguucaauauugcaauauagaugucuaauuucuagguaaauuuaguaaacagaauauguucaacauggagaaaaucacacuccagaaauaaguuaaaaauauuucaacaucuaaaaaaaaauucagcagcacccacagauacagcacauagaagaaauuaaaaaauuaugaauaguuuuaauaaauaacacuaauaucauaugucuuuaaccuguugauaucgaucucccucuauauuuuaagcucucucucucuuuaaaaagaccugacccuggguaaaggguagaggauggaucaaagaacagauaauccuggcugggcgcacgcaguggcucacgcgguggcucacgcauguaaucccagcacuuugggaggccagggcgggcggaucaccugagguaagaguucgagaccagccuggccaacauggugaaaccccaucucuacuaaaaauacaaagguuagccaggcgugguggugggugccuguaaucccagcuacuugggaggcugaggcaggagaaucgcuugaaccuggaagguggaggcugcagugagccacgauugagccacugcacuccagccugggcaacagaucgagacuccgagacuccaucucucaaaaaaaaaaaaaaaaaaaaaaagaagaagaagaaagaaggaaauauccugaaagcagggauaacgguuaguuaggagaauaccagaacaaccucagacaguggugauaaaugacugguucaaggagaauaagagauaacgaggcagaaaagagaugaauagaauaggcuauguaagcauacaaaaacccaaaggauuuaaugagacuggauuuaagcaaugaaagaacagaaagagacaacaauuuuacaacagggaaauuaacagugaguuuaggauaaaaguaaacaggugcagaaaauaaguggguugaggagcuguaagcagagaacauucuagcuuuaaugaauuuaauacacauauccagaauuuugcaaucagaacaccuagaaacuauuuuuauuucagcaugcauguaaauuuuuguaucauuagggaaaauagucuuauuuuuaauucuauacaagguagagggcacauuauagucuuucaaagcuucaguaccucugaagguuuaaacacauccugcaagguugcuuuaguguuuguaucuuugccaagucugagauuauaggaagugaauggguuuguggcauaaaucacaaauuccuaauccaaggaacuucacagggaagaagagggguaaaaaaggacaacuuugccuccagguaaauaaacuacugauaucuucaacuagugcaagggagaaaggaaauaccccacaaggaagaaaccuuaagauucauaacuggaaauaaaagaaggauaauccuccuggucauuaaguccaaggcagcucaacuuuacugugcauaaacucaagccuaggguuaaacuggccaggugcggugguucaugccuguaaucccagcacuuugggaggccaaggcaggcagaucacuugaggucaggaguucaagaccagucugaccaauauggugaaacccuaucuuuaauaaaaauacaaaaaaaaauuagccaggugugguggcacacaccuguaaucccagcuacuugggaggcugaggugggagaaucacuugaaccugggagacggaggcugcagugagcugagaucgugccacugcacuccagccugggcgacagauugagacucugucucaaaaaaaaaaauuaagaaaaaguuuuguaagcuaacuccugcagagaacaaguucaggcuaauguuuaggacaaucagaggagucaguggaagaagggaaggccugaagaugacuaacagauuuuagucauagcaggagcacgugcucauuucucugauuagaucacauuucacaaaacacacuagauuacaauuucaaaaagaauuccaagcugugugauaagcagaaccuauuauaagcagcaaagaauaaugcauuuuucucuauuaaaaaaaacuccucuaaauuauauuaccaugguggcuuaaagagacauauucuuguuuuguaauaacuauaggaccaagucuauagcaagaguccauuuucaacuacaacuuacacauuugucaccuuuuaugaacagcaugaugagaucgagaggauaaucugcugcucuuaacacugagcugccuccaguguucuaaauaccauacuacaaagcuuccacaucacuggaucaggauauaaguauagauaccaaaaccucaagcccgguucugcuucauauuaauuugaaccauuuuuuugucauuaaguuucauuuauuauccaauuugaccuucuuuaucucuuaaaaggaauauuuaacccauuuaucuuuauuacuaacauugauauguuuggucuuccuucucuugucuuuuagauuuauuuuauuugcuccugguuuccuagugauuuagauaguacauauccuauuuuaauuucauuagagauacuucuaacaaucuaaucauuuuuaaugucccucucccacuaaaacgucccauuaugcccccuauuuaaaacuucuaacaguuauauuuuucgaauucucuuauuuuacuaaauucagugaauguuaggggguaggcuggagacuccaaauacaauuguacauuucuuuauacaaauaucaauauuuagacuuaacucuuuuacugauuuccuuacccacagccaauccuuauuuauugcaauaccaaaacauacuuuuacuuaaacuuuccaaugagcaauacguucacaugagucaaaauucaaaaggucuacaacuaaguuucuuuccccucccaucuccucaagccacccaguuucuauccuggaagcaaccaauguuaucaguuucugcuacguuauugcagaaaaacuauguauugaaucauccuugcuuccuuuucuaaaacaaccccacuaucgcugaaguauuacucuuucgugcuguuggaaauccucaugcuaauaaauauuuuuaaaagauuuuuuguacugacauuuauagugagaauauuauaaaaaguuauauuugcuuuauaaaauuacucugaaugguucccucuuuauaaucagaaaguuuaaagagcuuugaaacuaaucaucaaucuuuuaaagaucuuaaauaauuugccuauaaaauucucuggcccucaggcuuuuagagagauaacucuuacacaacuuucucuaacauauugguucucaggagucuuucgcacucuuaaaaauuauugacaacccaaauaacuuuaacuuuauauggguuauagcuaucaauauuuaccacagaaauuaaguauuuaccauagaaauuaaauuuuuaauauuuaaauauuuaguuaauuuaaaaauauauaaaacaaaauuuauuugaaaauaucuaauggcuaaauauuguuuaaauuuauuuaaaaaauuuauuacuauaaacccauaacauguaacauaaauaacauuuuuauuaaaaauaacuauauuuuccaaaacaaagaaaaauuuaaugagaaacguccggcuguuucucauaucugcuaauacacugaauuuacugagacaucacacaucaugcagccuuggaaaacuccacuguauccuugagagagaauaaaagcaaaaaaggcaaauaacaucuuaguauuacgaugaaaauaguuuuaaccucacagaccgcacuuuaaguacugcuggauuaauuuauguuuucuacauucaguucugauaaacuguaauuuuuaagaaaauuuucuggaucauacaaguguucaaauauauuuuuggggucaagcaaaauaguccauuucgauucuuauauuuucucuuuaucugugguguuuuccccucuuaguuuuugaguaugcacguuagcuccauucaaucuuuaaguuagcuagcaacuuaucucuuuuauugcaaacaaccagcucuuaguuacagaguucuacuuuuauuuuaguuuacuaguucauugauugcuguuuuuuaucuuuaacaacuacuuuaucuuuucuuaguguauuuugauauuauuuuucuaauuucuugaguuggacuacuuaguugacuuauuucauucuuucucauuuaugaauauaaguauuuuuuaaggcuaugaauuuuccugcaagcacugcauuagcugaauuucauagauuuucccaucuagucuuuaauuaucacguuuuuauggucuaccucuuugacccaagaaguacuuauuucagaauuugaaaaauuuccagguggccaggccuuuuuguuuucuagcuuugcuauuaauuucuaguaucagugauccuacguccucugucaguugccucucuuauuucuucccuuuucuuugagacgaagucucgcucuguagccaaggcuugagugaaguggugugaucuuggcuaacugcaaccuccgccucccagguucgagugauucuccugccucagccuccugaguggcugggauuacaggcacgcaccacugcaccuggcuaauuuuuacuauuuuuaguagagauggaguuucaccauguuggccaggcuggucuuaaacuccugaccucaggugauccaccugccucggcuuuccaaagugcuagauuacgggcgugagccaccaugcccggccucuucccuuuucuuuguagcaaaagucucuaaaagaguuguuuauacuugcuauaucuaauucccaucuuucuguucucucuuaaauucacuuuaauuucaggcuuccccuacaccauauccacauugcuaaaucaauguuauugauuuagcauuccucaucuuaccugaauuaucagcauaauuuggcaaaguuaaucaaccaaaauuugauuuuuuuuaaugcauggugugaacaggguccaagauucacuugauuuagugaaauugcuauuucuacccauugcauuauuuaucuucuaccuacuucauuaccacacuugucacaaaucaaauauccauauauguguggguuauuucuggauucuauaguaugccuuuauucuauugucaguccuugaauuaacaucaccuugacuuaauuauuauuguuuauaauaaguuugauaucuaugagauguaaacuccauaauuucauucuucuuccuaauugucuuggcuauucuuggagcugggauuuuuucacugugauuucacuaaaccuauacagaucaauuuaggaaagaagaaaaacuggcaucuuuaaauacugaauccuccaauccauaaauaacaguauauauauuucuauuuaaguuaucuuuaauuuuucuauguaaucacuuacaguuuucuauguagaguuauacauaucuuuaguuagauuuaucccuacauauuugauguuucuugauacaaauucaaauuauauauuauguuaauuuugucacuguuacuuuacagaacucccacuacguacugacuuuguauccaggaaaacugcuaacuucacuuauuaauccuaacaauuuucuaaguacauaacuaugucauccauaaaaaugauacuuuuucuuuucuaguccuuauacuuuucauuucuuuuucuugcauuacuauacuggccagaaccucugaaacaauacugaauaggaaagaugaugaaagauauucuugauuucucaucgcagaaagaauguuuuaauauugcgcauuaaauaugauguuugcuauggguuuuguagcuaauguuucagacuguuuaaguuuuucucuguuccuagcuugcucagaauuauaagaaagaacaaauacucaauuuuaucaaaugcuuuuuuuuuuuuuuuuuuuuuugagacagaguuuuguucuuguugcccagacuggagugcaaugcaauccuggcuaaccgcaaccucugccuccuggguucaagcgauucuccugccucggccucccaaguagcugggauuacaggcaugcaccaccacgccuggcuaauuuuguauuuuuaguagagacgggguuucucuauguuggucaggcuggucucgaacucccgaccucagaugauccgcccgccucagccucccaaagugcugggauuacaagcgugagccacaacuuuucuccuuuauuuuauuaauauagugaauuacacugauugauuuuucacuguuaaaccaaucuuauauuccuggaaaaauacuaauuaggucaaaauauauuaauucucccuuuguguuauagauauaauuugauaauauguuauuuaggauguuuccucuauauucaugagcgauuuggcuguuauuuuuuguucuuuccacaaccuugucauguuguaguaucaagauuacaugcuagccuuacguaacaaauugugaaguguauccuuuucagaguuuguggaugauauuuuuaguuugacaguuuauuuuuuucuagcacaucagagcuauuuuuccuuugucuucuaccuuuuuaguuucuguggaaaaugaaaccaucuguuucuggcaaucucauaauugcuccuuugaaaguaauacuccacuaccccucauuacuuuuaauucuuugucuuugauuuugguuuucauaguuauacucugguacacuuaggugugauuuucuuuuaauguuacucugcuugagauuuauaauacuuccugaaucugucccuuaaugucuuuuaccaacuucuagagauuucucagccauugcuucuuuaaagacugcuccugcuacauuuuucccucuccucuccuucuaggaccuuaauuacuuuuucaaaacauuuugugccagauuacagaugggagauuaaaaagguuuugaccuugcaucccuuugacaaccaggguugggagagggcugugucuucccuccaugacccugagcaagcugugugacacagcucaucaacagaauauggaaaugcgauguuaugccagggucugggcccagaucuucagacacuaugaguccucacacuuccucuuucuugaaaugcuugcucugggagaaaguagcugccauguaauuaguccaacuacccuaagacuucccugagacugccauuuauggagagagaaaaauguuggcaccacaccuaagagugcagaagccaucuuggagguuccagcccuggaagaugacaugagauggaccaaggcccuggacauaaggcuccagugucaccaucccagccauuuuuaagcugucugaaccauuccaaucaaagaccaagacacuguagagcacaagcaagccaaacuugauauauacccugacugaauuccugauucucggaaucaugagcauuaaaaauagugguuauuuuaugccaauaaguuuuggggucauuuguuacugggagagguaauccuccuccgaggccccgagugucccuacacauucuuacugaugucucaagaauacaaagcccugacuacucucugccuaggacaugucccagggcucuguuugcagcuagcaaacuuaagggaugaguaacaucucuguccugcagguggcaagaaacaugagucacagaucacauuaauguauucggugagugagauauuucaaaguugggauuuauuucuaagacauagcacuuuaggauuccaaccgaagccugaaugguuuaccagcaccaaccuuccagccuugcugggcucuaaacaccuguuuuuguuucucuaucccuaaguguccauaaaaagcucugcccaucuucuaauccaccuuucccagaaucaguacaugcuauuaagaagaaaaguggccugaaguucuggacuuaucucucugccucaauagcauucagauacauuugaauacauacaugucuuuuacauuuugaauaguuuucucauuuuuuagagcaucaauccaaauuacuuuagcuaacauuacugaaaguggaacuccuccagaaacagauuuaauauguuuaauauuuaagguguuuagaaguucuguuuuuuccccuuucccuccacuauaggccaaauccacaaagaaugcuuguuuuugaaauaggcauucuaccaagcaucuuuaaaggugauauacauuuucaaauaaaccuaaaagauaaguuaaacuacugaaauaccuuuauaaaauaucauuugcacaaaaacauuucaguugaaguagugaagacuaaccauuuggaauaaaacaacuuaaaaaaaucuuuuuaaagaaaaaaaaguaauaaauuagaggagaagagaaaagcuauaucaacuuucauauuuuaguaucuuccucuucuaauugucucuaaguauuuacuaagauuaccuagaaauagugucauuuacaugaccuagguuuuaaaaacauuccaaacauaauagaguuuuuuuucugguauucuuuuucccuuggaaaacuguguaauuuuauuaaaauuuguagugaaaauccgagaaacuucaugucuaccaacacuuacaguggaaaauacgaaaaucaauauaugggugagaaccucuucuuucugauucaaauccugcucggcuccuuacacguacaucuccuggacagaaucaagaauaaaacauaaguuuagaagguugucauucgggaagaagcuuccauaugcaacaaagguccgugugguaucauauucauaaguaacagcccacugaucauauauguggaacagguaguuaagagcugauuuauucaaaaggguucacaaaaucucaguaauuaauuguaaggcugaaugaggaggauuuuuuuuaaaucuaccccuauaauaauuauuauaaucuauauuuuaauaaguuagccuucugaaagaggauucaaguguaugauaagaugaccuaauauauuauucacaugggcaacauuuuuuuuuuuuuaaaaaaaggccauugggaagcaauaucuguuuuacaggagguugaaaauccucagcacaaaacuuuagaaagcugcagaaagaagcaacauauuuauuaagagccgacucugugccuagcacuauacuaugggcuaaaagggauaugaaaaauggaaaauacauuacuuauuuuuaagcaguuuacaauuucauagauguguaaaaacuuaaaauguuaaagacuuuguuuuaaagucaaucugauuaaucacucuuuucucauugacaguggguacauccaaggccuuuagcugagucuuaaacuuuggucuuuggaagcucagugucguuccuacaugugcccacauuacuuccagauuuauuuuucuauacagcaacauaaccauagcaaccauguucuagacacucuuuuucguguuuuacaggcauuauuuuauuuucuucucucaucgacccucagagauaggaaucuuaauccucauuuuacagauucaaaaacuugacuuugagaaguuaaauagcaugcuccaugccacaaagcuaguacaaaggguaagucaggauuuaaacccagcuccauggguuccaaagacaguacuguucucacuacacuuuuacagccuccaaguucauaaccuuuaaaucuucagccucuaucccuuugcucuugcaauuuggcuugccuagagggcacuccugcuuacucuguuucucugaguaggaccaugacuuccuccaaggcucacuucaucgacuauaauuccaucccacaaugacuagucaccuguccuguggccauuccuucaugcugcaacaaauguuaacaugucaagcacuggaaauaaagcagugagcaaaauacauaaagucccugucacuguccucaugaagcuuaucuuuuugugugaugacacaaauaauaaauaccaaauuucagucuauggaagaugaugaguuacauggagaaaacuaaagguaagaggaauggcgagagaggagcaggggagggugacucauuagugcagucagagaaggccucacugaaaaggaggcaucugggcagggaccuacaggaagugaggcagugagccagggaggaagagccaguguaaaacuccccaagacagaagcaugcuuggcacagucaauggcaaggcaagaggcuggcguggcaggagcaaggugagugaggggaacuggugggggugggguggagaggcaguggagucagaucaugcuggaccuuuguggccaucagagacuucugaauagaggagucagaugauuaugucugaaaagguucacucuaggugugaugagaacagagucagggaacacagguagacacagggccuccaguuaaggaguaaguaauaaauguggugguaacagcauugguguggugagauuuggguguauuuaaagguaucaaccaguaggaucugcugaugaauucaauauggaguguguaagaaauaggaaguaaaaaaaugacucugagguuucugaccugaugacaggaagaguggaguuauauuuacugagauggcaaaagacugcagaacacagacauggggaacacaaauguuuugcuuuagacauguuaaguuugagguauccauaacauuuacauggagauguucuacagaguuaaagaaaauaugaauccaaagcucugucuuaaggacagcggaauccugaacauguuuguuagagaaagauggagacagcaaggagaaaaaggcugcacauuugugggggaaaaauauguacuggaguagaaaagaacugaggcagguaagacacacaagauaaaauaaagaggacaaaaaggaauaggaguuacaauagaacucuggggaacacuucagcuuaaaaguaugaaaaggaauuagugaagguggcaaagaagaaaacaaaaguaggugaagaauaaggauggaucaguaucauaaaguugagggaggaauucugagcugaggaggagucgugggagagacuucuaacaaaaaaugaauaaauuugccuguuggaaucuuaauaugcauguuuaauaauaugaguuaaagugcaaggaugaaggagacauggaugaagacagaaaucuggcacagagaaaaagagaaaaagaaaauuagacauauauacgcacauaucuaaauucauuuuaccuugcggaauugacuaauauauaaaaaauuuaagcaccagaacuagaagaagucaaauggucuuccuuaccagccaacugagaacaaaauacaucuagugacaggacuaucugagcagguguuucacagccucaccuuuguccaugcuggcauucaucuauuugguauuuagccacucuacaaaucuaagacuauuuucuaugaagaauguucaagaugcaauucgaaacuguguacuaaugacagugucccaguuauuaggccaaagauuucucaauuaccuauaacucuaaaaugccucucuuuauucacaucacauucaauauugguuuccagacucuaaacuccaugaauagguuauuucuacuacaaacagugaugaaaagcuaucuaaugaaagauaccucaaacucaaauaacaacagguaauaacaaaauuaacugauauugguauaaaauaaauaaugcuuaccuagcauacgaauguauaaugcagucugaucagaacugucauaggaaauagcuccacgccucuagaaaaaaaaauacacauuauaauacaugacaauuaaauaugauacaaaauucaacucaacaaacauguauucaucauuuauuauuugugaagcacugugcaagagaaguuggauacacaaaaugaaauuagcuaugguaccuguucuugaaaucucugggguacggggacgacaaauaauuguaauacaguaugguuaagaacuaccauaaaaauggauacaaagagagacacaugcagccucucuuuggaaauuuaaucuguuugaguaagucaguaaagguuuuggggugacaucuguguugacucaaaagggaucgauaggaguugccaaauauuaauagaaaagaaaggaaaggacaauccacuggcuuuccugcugcaucucuuugguccccauuccaugcuucacauaaaagcaaaaguaagcacuucagcuccugcucaaaauccuccaaaggcucuccaucacacuuggggcuccccaaacguuacuuucgagagucaucugugaccugccugcccucuuguacuguggccucccccacugcuaggagacagccaagccggucuccuggcuuuuccucaucuacaccaaauauacagccuuuccaagugcuguucccucauccuggaucacugcuucacuguucccuucuuaccaugcagcuucuagacaaagcaucaucucuucagaaagggauucccugacuaccaaaucuacagccaccuagaagccauccccuuccacagcucccuaccucaguccucuguguagcuacagcugaaguugucuugucugcguguuacuaaaagcuccacaagagcagaaacuuugucuaucuuagucaucacugcaucccuggucucuaaaacaggaccuauuauuuaguuaaguucuaaauaaaaauuugguaaauaaaugacuaaauggacuuauugcaaauuaauaauaacugauaaauaaauugaugaauaaauuagucacuaacagaauggauauaaauaaggauagauuuaaaaaugaggaagauaaaauugaucaaaccagagcuuagacauaaaaucuaagcucuguggaggcaggguuuucagucacugcuauauucccagaucuaggauagaucccaacauuuagaacagugccuagcaugucaaaagugaucaguaaaaucaguugaauuaacaagcaaaaaaaaaaguuuaaguaguaauaggccaggcaugguggcacacaccuguaaucccagauacuugggaggcugaggcaggaggaucccuugagccuaggaguuggaggcugcagugagcuaggauggcaccacugcacuucagcuugagagacaaagugagacugucucaaaaaaaggggcgaggggaauggacuagcaccaugggauauuaacaaaguagugugacauugcaaagaaauagagaaaauaaucaauagagacucuagaagcaaauccaagagugauucuguauaugauaaauacaggacuuagaaucuguggaggaaauacugauuuuuaauaaauaauguuagauuaaguggugcuaucuagaaaaacauaaagcuauauuauuaccuuccugcuccaaaauauauuacacauggaacaaugauucauauguuaaaaauuaaagcaugaaaauauuaaaagaaaacaggacuguauuuuaaaaagucuuagauaggaaggccuuucuaacuguccuauaaaaaucccuaagucaugaaacacugacaaauuuggccacuuaaaaguuaaauuaugaugguaaaaguuaucacaaacaaaguaaaggauaaacuucaaacccagaaaagugaguucaacugauaugacaaagggcuaauuuuccucuacuauccucccaccaaaaaaaaaaauuuuaacugucuuacaaaucaauuagaaaaagacuaaaaagcuguagaaaaacagguaggacauaaauauacuauucacaagguuaaaaaaaauauaaaaaaaugcuugacuucauuaacuaaagaaauacauauuaaagcaaugagauuguauuuuuacauaucagauuaaugaucaucuucccucacaaaacucuggcaugggauuuacaacuccucaacauauaccuacaaaucuccaaaaaaaaaaucacauuuuuuacaauuauuauauugaaaauuuacugaaagcccucacuuggauuuagugugcaaaagaacuacccaaaacauuaaguuauuauauccuuaaugcuuaucuuuuaagagaaaaauaucaacuaaaaucuuacaugauuucacaaguucuuaaaaaaacacaguucaugaaauauaagaggaacaaaaauuucaaacaaagauaaaauucuaacuaucaccacugggugucuccaaggaggcugagggauacagagguaggagaggggcuuuucaauguuuaucuuugcacuuuuugagucuugcaguguguguaauuaucauauauucacaaaauaaauaaaauuaaaauugaaaaguaaaauaaaaaucuacuacaaagaaaagcaugaucuuaaaucccaagggaccaaaucauauagacuacacuucuggcaucaugcuuaaagugucuuccacuaauagaauauccuaaggaagccuccugcaguguuucaugguauuuacucuggagcaaacagccacuguaaaaaggcaccacucacagcuacugugcaaauccccuccccaacauauuuagcuuacuagauuacaggucucuccucaauaccaccaaucuagggguaaaccuaguagccuaggaagggcauauguggcaauaaauauuccuaucagcuaaagcaaauuaaugaaacugcagauacuauguaauaacuugucaugaccuaucaauuugaugguguccaguaacaacucagauaaauaacuuguuaaaauaaauuuuaagguguuaucucuaacaguucucuuuaggaggggaguugacauuauuauuaugauuuuuuuuuaauguaggaagggcauuuacuauaacaguugcuauuuagaaagguaaaauauuuaucacuucacacauuaaggauugugaaagacugaccaauauuagcucucuguuaaauaucacaaaauaauauuaagucaaaaacuggguaaugcgcauagucuagauaacaccauggcauacuaaacuuaacuaagguaaucauuuuagccucauuuauagaagcacuaauuuagauauuaaaaugguagggucuguauuaaucuuaauuucuuaagcaaaaaaggcagaguuuaauuuuaaaauagauacaaauuacauaggucugugcaaaauauccaaguuauucuauucauuauaagguacuaauuuaaguaaggcuagucuacaaauacuuagcuuaaaugcuauacugaaccacaagacauagcuuuuaugaaauaaauccaaaugagaccaaaacuguuuuuaaagaauggacuuuaaaauaaauaucugaacccaucaacaaauacauccugagugauaauucauucaccuacccacuuaagaauuaaaauuaaaaugaauauuaaguucucucacuagguagaauaaucuaaaguaggaagguagaauaaucuacaguaacucauuuuggaaaaaacacuauaaauuaugaguucuaacaauaaaaauuugaccuccguguuagaaucauguuguuuuaaaaauaauuauaucuacuuuuauauaagacugcugcaaauguaaaaaagauuucuuuaaagauuaucauuuuaaaaaccauauacuacuagaauuuucuuuuuaauaacaguaaaacaaauuucaucaaaauccugugucacacugucagucauaaaacucucagagcuaucacccacauucccaccucacuucaccagugaauggaaauaacugagaggcuucuacucgugacuuuucuaauuuagccauccugggaacagcuuguaaagcgaacuaguauaggucaaaacaugggcgaggcugagcuaaucagaaacugucagcaguagcacaaacaaguuaaacuguaaagcaccaaaggacccacugccucacuaacaggaguucugagugcccugguaagacucaccuugaauuagggugaaucauucuuccacaaaagauuugacuugaagguaaaugauaaaagguguaaaaguuguucccaauauuaguuaauacauaacuuuuaaagacagacauguuuuaaaacccagcaaagauauuuuaagugucauuguuuuuauuuuguuccaaguuuuccacuaaaugauuuauuagcaaaagcaagugccauuuccauuacacgguaagagugauaauauauuaacuaacacuugcugugcuccuugugccaaaaaaauguuccaaguguuuucgcacaaaaucucauucaacccacacaagaucucuauaagguaggcuuuauuaguuccauuuugcagauucauaaacugaugguuaaagggcuuaaacacgggagcacugaacaaaauuuuuggcaacauuaccgaaaaaauaauaauauagcaaaagaugaagcccagccaaaguugugaagucaauuuccucugacauagcaaaaugagcuuuuucagaguagucaucuuacauaugcuagaaaaacaugcuuguacuugagugccuaaaguauucaaauauugcacugaucuaccaaacaguauccuucccauucuucuuccuuuuuucaacaguuuuuuuaaaaauaaaauauuagcauuguuuuuguuuaaaaacaauuuaauuuuuugguggcaauuaaaagaguaaagucuagaggccaggugcauugucucacaucucaguucuuuggaaaguugagguaggaggauugcuugagcccaggaguuugagaccagccugggcaacauaguaagaccucaucucuacaggggggggaaaaaaaaaaaguaaagucucugaaaacacccacaagacaacuaaugcauuauuaacauuaacuugaccuucauucaauaacuuggcaagccaauccuuuaaaaacaagaaaauagcugucacugcaacaaaauuaauucuuaacuuuuaaaacacaaagauuuuaaaauuuaaauacauuauuuuucuuuaagagauuucuucaaucauauucacuaagaaaagaagaccaagagauaauuaugcuuaaaacauuauguuuaaacguggaaaauuacauagcagguauuaaaaucuugcuugagaaagaaaauuaacuuuauagaagcuuuguuucuaagugauagccuuaaaaauucaguuucucaaucuagaaagaaaaaaagcugugugguggaugaaagauauaaucauuuuuauagaagaauagaaaaaaauaauuucaaagaguauaauuuuaaauauguuuuacuuuaguuuuagacccuucuccagauggcaaauggcuagcuagcauucuaucaagaauuucucaagccugacauuuagaauucaacuucaaaaacaacauauauguaauccuacauuuaugucauuauauuauagcuaaggcacguauuuuagcaguagcaagaccuuaggagaaaacaugauagacggugguuuuucguuuuuaaaaaguuuauaauuguuuagaaauccucaacauuauacuuuaaauacacaaguguuauuacauuuucuccgagagaauguuuaaaauauauacaccaaaaguauaacuuaauuuuauaaucuuaaaaguuaaacuucuuuagucauaaaaacuucuuuaaggcagugauacugaggaaugcugcuuugauacugaggaaagauauuauaaaaagcccuuaagaagaaauaaugugggauaagaacaaaaacuacaaauaguaaauuuaagcccuuuggucgacagaugaaacucacagcucuuuuaaucagagaauaaaaacugaggcaaaaggaggagaaaaucgagcuauuuaauuccuaucaaauauguaaacuaaugaugaaugucaccauccuaaaaauaaagauggccuaccuuagaggugauccacuugauaagaaccaaggccagacaccagaucaauguaauucccauuggaucaaucaaaagcccgcugcauaaucucucucuucuacuagggagcaaggaaaacuucuuaggagucugauaaauaccagcugucccgaggcaaaagagaggggacacugacugccuuggaccucaagcagcugccuuccaacagugaucaccugacuccucugggaaugcacuacccagccagccuucuuacccagcgcaugcuucaugccacaaccgcaggguugggguagaacugccuaaguaauguuggaagaggggagggaaaagacuuuagugagcgcugaccuaacagucuaacaaaauguaggcaaaggaggccucaggccagccccaaacacuucuacaaucuuaguacuaacagagugccuuaaaacaacuuucaaaaaauguguggcaguacuaaaaauuucuucauucuuuucacauagaacuguuucacaagcacaguguccugugacauuuuaaaauauuaaugcauuuuauuccaucuuuucaauuuuuaauugaaauuuguucaacuuuuuauuucuuuuagggauagaacuacuuuaugaauauuagaggcugucauauuaucuaugcuucuuaacauuauaauucacucauuuuggacuuacugaaaaaaagccagucuaauagugcauuuucaaauaauuaaggacauauuauuuucaagcacuaacugcaaucuaacuuauauuuuugguacagaucuuguucucgcggcuguaagugagcuuucuaauaacaaaguaugcuucuauucauccaucuucauaaccgagaggcugcagauaauacugcugagaaaaugccuuuugugaaacuuucauucaaguauucagcaaauauuuauuaagcugcuaauauguaccaggcucugcaccagauggcagggauauaagcaucaaguaaaagcagacaagguuccugcccuuguggugcuugcaauuuaguuggaguguacauuaaucaaauuauguaaauaaacacaaaauugcaacuguaacaaaugcgaugaagcagacguaggaaacgccaacaaaccugaaucugaccuaguuaagaggugaaggacuucuuccagaaucucugaaaugacccugagauaaagugugauggugcaagaauugugaagacagaagacagauugugcagacgaagaacaggcgugagggccaaagggugagacaaaaccaagccaagcaagucugagagacagaaagaccagggcggcucaagggcagggaggaggagccagaugacgcugcagcccuggggagcagaggccaggcccuacgagggccaugugggggugucuugucugaauuucaaucuacugaaguacuguaguagauuuugcuuuuuaaaaagaccacuuuggucaaguauagggaggugggguaggggcuggaugggcagucaggccaccacugcagaggucccagagaaaggugaagauggcaugggcugacugaagaacacucaggaggugacugcaguccaugacaagacaacgucaucugauuaucaauguacacaaaugaugauccuaaaauauuugaaaagaaccaaaauaguucaaauaauaauauuauuuucauuaucuaauccucaguacaaagagcuuauuuaaaagagaagucaguucuaggcuugucaaaaugaagugcaaauuaaauuuauagguguaaauccaaauuuuccuaaccugaaaccauucuuaacacauggccauaaaauuuucacuucuugcuacagaacuaacaaguuauaauacucaucuuugcauaaauccagauaacauuuuaauuuuugccaugagacuagcuuuaauaugagaccgucaaggucucugauuacucugucuuccaguaagguucuagcaacuaaacuugaaggaugccuaggcaugagacagagcagcagaguguaucuuaggccaaugcuccagggaaacacuggcggucaucuguaagaggcugugcagccugggccccuggcuucgaggucauucucugccacucuggccugggcuauacacuccaaaccagccuauaaccucgaugcuuggcccagggaugcuacccuucccaccuucacauuucucuuccaaucaacugcucaaaaagagucaaguuuuggaaagcgaauacaagauggcuauuuuugguacaauacuugaaaaaucauaauugagaugaagauuuaaaaagaggaaguaagaaaggcaguucuaaaaguugucucacugaaaugaauuucuaucuagauuauuucuaccaucucaaaacucuacugugcuugaaguucagagccuagauuuauuucccagcuuuacugccaugggcaaaucaccacuucucugugccuuaauuuuucuccccuucaugggagguaagugguaucuauaaacgaacagcuagcucguaguggacucucaacaaauuuuugcuaaaucagaauuaaauucuacuguauuuaaaaccuagaaaugagaaugcccuaaacacuccagcuucaccuuaacucuagaccuaacugcaaucacaaugguccaugaagggaacuugcacuguguuugcaagugcccugagaaaccuccgauucucagcaggauuaggcucuuggcuuucauuucucacgcuaguuaauagguuggcucccuaaaaugcuucccccagcauccacuuccuaauuuccacuaaugucugacacgguaauacagagauaaucaagacacaauucucccccagaucagaaaauuuccuauuagaacagaaacagcuacugaguuuaugccugaagucguaaagcuuucauugcuaaugacacauuuacaucacucaaaucuuacaaaaaucucaggcaacacaguuuuucuuaaaguaguaaucucaacuuucucaaugucauaaaccuaauggcuguaagacuuuuucuuauuuugagauacacuuaguacuacuuaucuuggugauuuauaauuaaauuuuaauaauaauaaaauuucaauaagaugaaauaaaaacaaaugcuguuucaaauuacuauaaaaucucuuuuaccauaaauauuaugcuuauaacuuagauaauucuccuaaaaguuuauuuuuccagaguuggaucauguaguuuauuauucuauaaaguuaccucuuuuacacuaacaacaaauguauucuuuuacauuaacuguuuucguaguugucucauauccuuagugaaacauggcaaaguaauaaaucaggugacuauucuagaaaaauuaaugcauaggauacacuuaaaauuuucaaaaacagaauuugauacuauaagaagaaaguauaaaacuuuuuaccuuucugggguuuauaaggcuaauaucagaaaagcugaguuaaaagcagaccucacuauuuuaugagugugaucaauaggaaaaaaauaugacuuuguucauuguuucuuagagaaguaauccaagagaaaauuuuaucccuggggcucucugccacucacaggacaccugucaaucuuggcaauagccuuuagcuauccauacagagacucggcaugucccucucuugcccaaauuaggcuaaccucaucugcauugacaucagugucuauaauuuuggaaucccauggacagaaauagucuaucacagaguucuuuauacaaauguagugucuguagaaaacuauaaccaaauuugcgacagaaaaaaugugaacacuauaguaaaaacccuccaacugugcucucauuguuuugaauuccagcccacuuuaauaacaaguaauaaaucagaguaagguuuugguuuauuucuuuuacuaaaaaccaaggcuuauuauucuucaaaugguaugaauuuuaagugacaugaaacuaagaaaaaagcuuccauaacaaaaaauuauuuaaaagcuaugguacuaugagaguuuugccauucaauuaagaccuuucuguaauacugacuuagagcucugaauuuuuugucauguaguauccgaauauuugaugaaaaugucaugugauuucuccuaguauaaagaaguaaaaaaaaaaaucuugacacuuuaccaacaauucaagucuucagguccagaaaacaucaccuuaugauacuaaaagcacuuagaaagucucuggugacauucuuaagaaccaaacagagccccaugcuacaauuaggcacacuccuaguugaacaaacacacccagagauaaaguauuugggcggaaauacuuucccacccaauucuucaaacuaguggaagaauucuagaaguagccaacaagacucuucauuagaucuugucuuguuccacaguuuauuuacuggcauguagaucagaaaaacauauagcaaaucugcauauaaaacacaauagguauaucagcaugcugaauuacaaaauuaaaaaaauuaaagguaugucaguaugcugaauuucaaaaauuuaaaaaaaauugucugcauuuugauauacaauaaauugcauaccuauaaaacaaugaaaauaaguuuuuaaaguuuccuaaaaaaaaaaaaaaaggcaaauaugguuaaauucuaaaugagagauaauaagugaagacaaucuuaggaggcaaugagaucagguacguuuccaaaucaaggaugcuccacuaucuucaauacgggccacauaagaaugaauucaguucugaauaccacugcagaugaugcaugauuacaugcauauuuuaaugucgacagggauacaauauaaggaauaguuuuaaaacugaagcuuuaggcaaagaaacaaaaagaaagacagaauagguguuaaacugcuguaacauaaaauaaccuaagaagaagucuaccuuuauuuugggaaauuacauaaggcagaaguaggaccaggagcacaaguuuguuaaaaacagaauuugacucuuauuuccuaagaacuuucuacagcuucuuacaacuuucuacaauuaaaaucauguaaggaucugccucaaacuagccucuguucaggggcuuuucggguaggcuagaacaaaugacuuucaaggucucugccaauucuaaggcucuacaguaauguaacugacagcucauaagugcuuauaggcuaacaauuuuaauuuuaaacuuuaaacugauggcaaacuugaaccaaaucaugacaaauuuuuguacuaguaaucugaaaaugcuaucacucacaacucugugaaaugaaaaauggaaacauucuuuuuccauacacaaaagauaaauaagauuagcauggcaugaaugcaccuucuucaauuuaauaaugaaagaagucuuucuaagaaagcuacuguuaucaaaggcuccucaaugggacagugcacccaccaccacaccccacaagaccaagccacaugaacuuccucaaaacuacuauggcaacuaagugguuacaguguuuaucuugaaagauacuuuuuuuaaugagaccgauuuguaggugagggaaaaaaaaaaaacuucaccuauaaguaguauuauaaacagaccaauacuuguaggcaaauauaaauuauaacauagacauuaaggagaaaaacaccaaucuuggcagaaauaggauaaauuuuaaaagaagacuucugaauaagaaugguaacuguccauaauugccugucucuccaaaccaguguagaaguccaaaaauuuucugaaguauacuugaggcacuuugaauugaauaguacuauuucaucuccacauauaacauugcaaaagagagagacacacacacagagauugagaucuucacuguguuaggcacaagggaaauaaugugaaugagacacaguccuugccuuuacacagcuuaaguuuuugugggggcuacaaacaaucagcauaacaacaaguaauuacaauuacauguaaauccagagugcuauaaguaccaaguaugacaauuaacccaggauuuguuaacaucaaagaagacuaccaggaaaaaugcgacaauguaaucucauccuuaaaaaugaugaauaagagcuugucagguacaggcaguggggaaaagagccccaggcagaaagagcaauauguacaaauuaucagaggugagcuaaaucuucgccagcaaaaaacauaaacaagauucaauaaauuauaagguaacugguacuggacuagcucucccauuauauaaacaacuaaaaaguuaagcuuucaauaugagauacaugaaacauuguuuucagauguuagacagcaaguacugcaggacuuugauccuugagagaauggaaaaaaccaagguaagcccuaacauugcccaggcuccuuccuauaggcagucgccaaaccugaaagcaaggcacaauccugcagagcacagcggucucacaaagcuaaggacacagagacugcagcucagggaggcugagguaccuggaauuugcagggcugaaugccagagaggagggagcugugaggacaaggagcuccagaagucugaugguggauccccuugaaucuuuggcugaauacuaagcugaguauguguaggauuagacuccaugaggccagaaaaauaauaacuaccagggaaagaacaacuacaggagaguucagaguuccaaccaaccacagagaagagaccucagggaauaccugggacauuccauagagauuccagaaaugccauaccguuaggagguacuaguccaucagcguagaaagcccuaucagaaacacuaacaaaacuuacaauaagcguaaagggaucagguggaucugcaagucacuaaacugccuaccagaacagaauuuaacauucuuuaaaagaugacaaaucaaaaauuacaaauuaguagggaaaauaaaaaagucaccucaaaacugggguggaggggaguguucaauaaaaacaaacccaaaaaugauuaagauaauagaauugguagacaaagacuucuuaaauguuauuguaaauauguacaaagauuuaaaggaaaacauguacacaaugaaaaaaaagaaacuaaaaaaauggaucaucuauagcugaaaaauacaguaucuaugcuaagaaauucacaguugggcuuaauagcaaacaaaacacaauauaagaaaagaucaauagaaauuaccuaaccugaugcacacagagaaacaaaagccaaaaaauaaauaaauaaauaaauaaaaacuaaaaaaaaaaacaugaaucugaaccugugagccugcgggacaacaucaagcaguggaguaauuagacuccaaaaaggaauguaaaagauagcaaacauacuugaagcaauaaugaugaaauauuuuucucaucugauaacaacuaucaauccauaugucaaagcagguuaaacgaacuccaaacauaaaaaaacacaaagaaaacuauaccuagauacauagcaaucaaaugcugaaaauccaaaagcagacaaugacauuacaagaaaauaaaaccauagacuaauauccccuauaaacacagauaaaacaaucauuuagaaaacauuaguaaaucaaauccauuagcauauaaaaaggaaauacauuaugagaaguggcaauuauccuaggaaucuaaagcugauuuagcauucaaaaaacaauaaauguaauucaacauuaacagaauuaagaaaaaucauacaaucaguucaauugguaagaaaaaugcauuugacaaaauucaauagucauuaugauaaacaaucuuaauaaacuaagaauaaaagaaaacuucuucaccauauaaaggacaucuauuaaaaaaauccauagccaucauuguacuuaacaauaagacuaaauauuuuugcccuaagaucacaagcaaaguugcucuaccacuucaacaugguacugaaagucaaagccaauaaauacauuaaggccacaaaaagaaaaagcauaaggcauauaaauuagaaacaaagaaaaaacugucuuuugugcagacaacaugacuguccauguagaaaauccuaaagacccuacaaaagagcuacuggaacuaauaaaaauuaguacggucaauagacacaaguuugauauuaaaaaaaucaacuguauuucuauauauuaguaaaaaaugauuggaaaaugaaauuuuaaaaauaccauuugcaaucauaaccauaaacauaaaauacuuauggauaaaaucaauaggauauaugcaugauccauacaaugaaaacuacaaaacauaguaugggguugaauuguguccccccaaaagauaugucaaaguccuaacccccaggugccuguaaaugugaccucauuuggaaacagguuuuugcaaauguaaucaaguuaagaugagggcauacuggguuagugugggcucuaaauccaaugacuagugucccucuaagaacagggaaauuuggacagaccacacaaaugcacaggggagaagcccaugugaagauagaggcagagauuguagugauuuauuuauaagccaaagaacaccaaggauugcuaucaaccacuaaaaagaagcuagaagaggcaacugccuccggggggcaaggccuuggcugacaacuugauuucagacuuccagccuccagaagugugagacagauaauuucuguuguuuuaagccaccgagguuuugauacuuuguuuuaacagcccuaguuacuaauacauauguuuacggacuggaagacucaauacugucaauuuucccuuaauuguuccauaaauucaaugcagucucaaaaucccagcagacuuuuuuuuagaaauuugaugcccaacaaagguaccaaaguaauucaggggaaaguauagucuuuucaauacaugacacuggaaaaacuauauaaauauuuuuuaaaugaauaaaauaaauuuuaaaaugagucuaacaaucucaugccauacaaaaaaauuaaaaaugaauuauauauuuaaacauaaagacuaaaauaauaaaauuucuaagaaaauguaugagaauauauccauaaucuaggguuaaguaaagauuucuagacacaagaacaccaaucacaaaaggaaaaaaaaaauguguuaauuggacuucacuaaaacuaaaaaccucuguucuucaaaacacaguguuaagauauaaaaaggcacagacucagagaaaauuaucuguaguauguaagucugauaaagaacuuguaccaaaaaaaggcagaauaaaagaauuaguauccagaaauauauacaugugugugugugugcauauauauauauauauauauauauauauuuuuuuuuuuuugagauggagucucgcucugucacccaggcugcuggagugcagugcaguggcguaaucuuggcucacugcaaccucuaccucucggguucaagcaauucuccugccucagccucccaaguagcuaggacuaaagacaugcaccaccauccccagcuaauuuuuguauuuuuacuagagaugggguuucaccauguuggccaggcuggucucgaacuccugaguucaggugauccacccgccucggccuuccaaagugcugggauuacaggugugagccaccuuguugccuggccauauuuaaaaacucauaacuuaauaagacaacccaauuuaaaaauacaagcuaaagauuuaaacagacgagucacaauagaagauauacgaauagccaauaugcauauggaugcucaacauguuuaaucaucagauaaaugcaaaccaauguaacuacaagauacuauuaaccacaagaauggcuaaaauugaaaacugacaauaucucguguuaucaaggauguggagcaauuagaacgcucaugcuaauuaaaauguauauaugaaaaauaacuugaacacaaauauucauaccaguuuuauuccuaaaagucaaagcugguaacaacauaagcauucaucaacugaugaauggauaaauuguggcauauccauacaacagaauacuacucagcaauaagauagggcaaacuacuaauacaugcaaugaaauaaauaaauaucagaaacacugagcuaagugaaagaagccagggaaagagaaaguauacucuaugauuccauuuauaugaaguucuaacaggcaaaacuaaucaauagugauagaagucagaucagugguugucuggggcaggggcuggggggaaccuauggcaaagggccccaaaagaacuuuuuggagugacuaaagaguacaauaucuugauuggaguacuaguugcaugaguguaccugcuuguuaaaauuaaucaaacuguaugucaauuaucccucaaaaaacugaauuucagaaagaggagcaaaauccaccccacccccaacccccagaggaaauuuagcauaauuacuaauagaauuuaaaguuaaauugggagcaacaagaggguugagaccacaggaguaaucaaaacugucaaccauaauagggagucugaauugcaugcaaagacaaaaggaagucacugagagguuucauccaggagacuaauacacauuuuggaaaaaauacucuaggucccagaguggaauggauuaacacagcggaagacuucacucuucagggagaucuguaagaaagcuauugccuuaauccagaagagaagauggucuagacuaggguaguaaacaggagaauagagaaaugugacgggauuuaagagguugauuugcuuuaauguuaggagagguuaagugucuggauacuaaggacaacugaguggaaauauucacucauggcugggcaugggucucacggccuggaaagagagcugggcuggagagagggaccuggaguaauccucugccaaucaagacugcuaaguaggauuacccaaggagagaagugaagacagcuaaaaucaaaaccuuuaggcucacagacagaaaaggacugggagggccaaaggccaaaacucacaauugguaacuauucaaacuaaauagcagccccugaagauagcuguuuuuugagacagagcagggacucccuuuuuuagggacucacaaaggaaaauccuuaaguuccuucaagggaaauuccaggcaucuagcuagccccagagguaacuacuaacuagaacaagaagguaauaguagccuaaaacaacagccaaagaaguuaaagcuccagagauguuugcuuuccuuauagaaacuaaaaauaacaucugaacauaugucccugaauugucuuucagaggcucggaccccccaccuaacagauccacuggcaccuggaguccagauaaggagacagugaaaacuaaacuuuauaacugcuuuuuguucuaaguuucuuccugcagugcuuggagaaagucacacccccuagccaguuaacauuuuucuacugacccuaaauuuuuaaacaaagcugcucuuccuuaacuaauggcaaaucugaagaucuuugaaucuaccugcaacauguaagccccugcuucaagauaucucaaccuuuuaaacuuaaaccaauguguaaucucccuguauugaaguaugauuuugccuguagcuucugcuuuccugaaacucaccccuguguuuaaaaauccuugccugcaagucacuggggaggccaggauuugagcauuuagcugccuguccucccugcuuagcacucugcaguaaacaccuauugcuguguuccucuguguggguauuugguuuuacugugccaggugaguaggcccuaguuugguucuauaacauucucucucacacacauacauaccaguaacauuccucucccucucacaccucaguaagguuaaaaccagaaagacgccacuuugaauacaauauaaaaauaaagugacaagaaggcccuugcucaacgaacaucaaacagaaacuccuuuuagggcuuaaaguuucguccagugcuaggcuagaaaaagaacauuagguucaaacccucuccauccccucaucugcuccuuuagugccuucagaagaugaaagcaagcuauugcagcuaacaucaaaaauucuuucauucgagucuaaaacagacacgaacagacacugacuuaguagucaaaaauacacaguggcagaaucagauagagucgugcaccccuuuugucccaucaacucaggagguugaggcagaaauucaggccuaugaucacaacuuugacuagugacuccaauccagccugggcaacacagugagacccccaaaggcgacaaaaaauaaaaacaaaaaacacaccaaaacaaaaucuguguuccuauuauuacuguuaacuggguggagugaaugaaacuauuuagcaaagucucuaagaauacuuccauuuccaacaauggacuaguuuagaaacacaacucuaccacugaaaacaacuaaaaaugcuggaagauauugaaaauauauucugaaaugaauccaugagcaguuaagaaaauaauuauucugacaaaaacaguaaaagaaggaaugcaacaaguaaaguaaugaagcuggcuuucaacucaaggucaaauuaaagugggugaaccugaguuuuaggauuuucacaaccucaugggucaauggaacaaaaacugacaaagccaaggaccugaccaaaguauagagcaccccccaguaacucuuacuaacggaauacaaugagcaauaaucauuauauucuacacucauuuaaaaaaaaaacagcuugaaucaaaaauaaguaaauaaauaaauagaaguaauagcuugagucaaauuaugugcaauuugauaaccaucagcuaggagaacaugauacaaauuuaugcaggcuggcaaaaagaucucuuggauuuguuacccauuuugaugagcuuaauugcaaaggcaauuaagacuaacagcaauguaacuuaaggaacucuaacuagaacaguguauaaaaagcaguuuaguaagguucaggaaaaaacuauuuucucuuaacaccauuuguuuacauuuaauaaaguaagaggacaugaagccuucuguauuuagcauauguaauuauaacacuuuguuuaaaauagaagagacaaaaaauuaagaagucaaaaauaacuuaauuugcauugaaguacaugguacuucuuguucgaaagaaauucauuuaugaucaacacucuacaaagaaauuuaaaaguuaagccacaugaucuaacaucaacaaaacuuucucauuaagaaaauacuuuguucacaaacacagaaaguagaauagagguugccagaggcuggggagagcagggaauagcaaguuauuguuuaagggguacagaauuucuguuugggaugaugaaaaaguucagaaaacagauaauggugaucacugcacaacacugugaauguacuuaaugcuaccaaaguucugcacuucaaaaucauuaaaauggcaaguuuuauguuaggcauauuuuaccacaauaaaaaaaugcaaaagaaaaaaguauuuucauguuaauucauuaaaguuaggaauucucucuagucugaaauucaugcaaacaaauaugcucuuaaaauuggaccaggggagcacuggcuuugggucaucugaucacugauucaaauccaguguuuacucuuccuaacuacggagucuucauacaaguuauauucuaaaccucaguuuucuccaccaggauaaugggaagguacuuggacaguuguuacaaggauuaaaauagauacugaugguauucauaaaaauaauccaggaagauaaccaaguuguuuuuauccaauucucucgcaaguccaaauaaagucaucaauuaaaacuugcaaaccugaaaaaucaucucucuuuaacuaguaugauauaguucggauauuugucccugcccaaucucauguugaaauggaauccccaauguuggaagugcagccuggugggagguguuuggaucauggggguggaucccugaugaaaggguccgggccauccccuuguugauaagugagcauucuggguucacucaucuggucguuuuaaaaguguguggcaccucccccuccccacacucucacuugcuccugcuuuugccacauaaugugccuguuccugcuuugccuucugccaugauugaaagcucccugaggcuucaccagaagccaaacagaugccagcaccaugcuuccuauaaagcuugcugaaccgugagccaaguacaccucuuuucuuuauaaauuacucagacucagguauuucuuuguagcaaagcaagaacagccuaauacacagugcucugauaauauauucaggcauaucgaugacuugauucaauucuuuaaaaugauuucugccucucuacagagcagacauuacucaaccuuguucccauugcucccauuuaaauggccagcuucucuaaguuacagcaacagacagacaugguacuuuaaaaagaaauaaacugaagauucauuaucaaguaaaaguuugaccauagugcuccccuuuucaaguucuggcuagccagcacucuugguacucaacguaauagucaauuuucagucagcugcaucaguaaucaggugugcauuuaacaauguuaaaccagucagaaauuuucccaaguguuugacagucuaaaucacaaauuuacuuucaggagacaagacauggcuggaauaggugguguuuaaucuuuugaagaaugacaaaccccuuuuaauggcaaaauaguuugcacacacccacaagauaggccuuuuucuucugguauccacugagaaaaguacaaaauagcauaacauuauugugaauuuauguuuaaauggauuuaauucaucacaacaguauuuauauuugaaauaugcuuauauauauguaugagaguuuuuaaguuuacuuucugaaauauacaugaauucaugaagcuccugucaauucccaaauucucuugggauuugccaccagcaguugggaaccauaggacagaggauacgauugggagaacaaaccagcagaggcaagguguguguauaugcaucucuccuugcaccucuccuacacacagacacacauacacauucuagaaaaaauaugcaucauucaguauaccaacauaucucuuuuaauaugcugauauaauucaaacuaauaugguaagaaaaaucuauaugacaaagguuuaaaaggggacacagcaaagaacauacaauauguaacccucuuaucaaacugcauacaccagcacuuuaucacacauccuucucuagccaacagcaugauauuuuguauuacaaagacagaauaucauuuuuaaagucucucucauggcacaaauuuaauucuaauauuucauuuuuuaacccuauaccuacccuaauucaagccaaauaguuacucaugauuuccugaacauggcuggggcauuaccacugucauacuuuuacccaauuuauuuccucauuuuagaaugaauucccuccaucccaagaaagucgugucaacuuuaacaucucuaaaacauagguauaaagagaaaaaugaaauucagucauauuuggacaccagaauugcuuauuucaagauuuacuggagaagcuuuaaaaaccccaaaauaaguaauuugagaaagcugaaaguuucauuuuguugcuuuuuuuuuuuuuuuuuuugaagacaguguuuccauugcccagcuggagugcaguggcgcaacaucagcucacugcaaccucugccucccggauucaagcuauuauccugccucagccucccaaguagccaggauuacaggcaugugccaccacaccaagcuagcuuuuucuauuuuuaguagagacaggguuucaccauguuggccaggcugguuucaaacuccugaccucaagugaucuacccgccucggccucccacagugcugggauuauaggcauaagccaccgugcccagccaaguuuucuuuuauuuugagaugggaucuugcucugucacccaagcuggaguacaguagugugaucaaggcucacugcagccaugaccuccuaggcucaagugauccuccugucucucauccucucaaguagcugaggucacaccuguguaccaccaugcccagcuaauuuuugaaaaaauuuuugguagagauggacucucccuauauugcccaggcugauuuggaacuccuggacucaagcaauccuccugccucagccucccaaaguguugggauuacagguauaacacugugcccagccaaagcugaaaguuuuaauucauuguaugaacaguuaagaaucaguuggauauaguacaagcaguuuaugggugaugacuaauauauauuuaaagagccccuuauuuagaaccugggauacaaacugguaccacaguagcuuugcuuauuugagguaaugcuucaaguacauuugauuuuaaaauuaugacucauguucacugaaaaguuucuaaaguguugagcagaaaacaauuuucaaaaguagucaaguaaacauuuaauugagcagcagagauuacccuauauaaagaaaauaaaauauggugcuguagaggcuaaggcaacuccaucuugguugcuaaucuaccauguugacuucuaauuaaccuguucugggaaggccucuaagauuuccaguuuaucuauuuccuguguaacagcauggacuuaccaucaaucuugcucuugggucaaaacaaccuucauguuaucguuuuucaguugucccacacauuccuucugaaucacguacaccccuucccuaugguguauaagcccugguuugagggauaaugguacuguggauucacccucgugucuugcugcugccuaagacacaggcauggcuucuguucguaagucccuauuaaaugcuucuuucugagaaacuggauauguuagccgccuucucagcucucucaaacuuuggggguagguuugcacagaccugcccaccacagaacagucacuuacuguauuauuauacuuuaaaacuuauaugagucuuucuuacaucacuguuugagcaaaaauuggugcaaacuucuggaagguaauuuggccauguuuaucaaagacuuaaagcugcaccuagcacuguaacuaguuacacuacuucuaggaaucuuaagaaaacaaucauggauaagcaugaagauuuagcaacaaagauuuucauuacagcauuguuuauaauagugaaaaacuguaaacacucuaaauauccaacaauaaggaaugacugguugacuaacuguaaaaguagaaguacgaaauauuuacaaucauuugaaguaaaugcugcaaaacauaaauuuucaaacuaucucccaaaugauaauaacuuaauucuuggacacuuuuaacuauuuuaaauuuguaguaaaaaaaaaaguacauauucacuuuguaaauucauagagacagaaaguagauuauuaauugccacagguugagggaggagggaguggggagugcuauugaguauagaguuuauuuuugaggugauaaaaaagugcuggaauuagaguaguaaagguugcacaacuuugugaauaaacuaaaaaccacugaaucauacacuuaaaagcgugaauuuaugguaugcaaauucuuucuuuaaaaaugcacauauucaaacacuuuagaauuuuaacuuggugggacuccuaccacaauauuaacuuauguugccagauaaauguguuuauaugaaucuuaaauuaggcugucccuuggcaccucugugcauguaagugaauguuccauacacguguuacugauucacaaaguuugggcucugcgcuggccuucauccaaguuggagcacaugucagaaaugcauuccuuuuccauguggcuguccaguuguuuagcacaauuuguugaaaagacuauucuuuccccauuggauggccuugguacccuugucaaaaaucagcugaccacagacacauuaguuuauucuucuacucucaauucuauuccauugaucuaugugucuaagcuuaugccagcaccccacugucuugauuaccauugcucuguacuaaguucugaaaucaggaagugugaguccuacuuuguucuuuguuucaagauuguuuguguuauuuugggucccuugcaauuccauauauuuuuucaaaucacuuugucaauuucuacagcaaucagcugggauucugaaagggacuauacugaaucuguagaucaauuuggggaguacugccauuuuaacaauauuaaguuuuccaauccaugaacaugggacauucuuccauuuauuuagaucuucaauuucuuucaacauuguuuuguaguuuucagacaauacacuuugcacucccuuuguuaaauuuauuccuaaguauuuuaugcuuuuucaugcuauuaaaaauugaguuguuuccauuucauuuucagguuauucacuuuaaggguacagaaauacaagugauuucuguauguugaucuugcauccugcaacuuugcuaaacucauuuauuagugcuaaaauuucuuuaguagauuccuuaguaucuucuauguagauaaucauaucaucuaugacuagagauaguuuuacuuuuuccuuuccaaucuggauguuuuuuuuauuuuucuugccuaacugacuuggcuagaaccuuuaguucaaugcugaauacaaguaacacaagcagacaugcuuaccuuguuccugguccuacagggaaaacacccagucuuuaccaguaagcacaauauuagcuguggguuucuuguagaugcccuuuaucagguugaggaaguucccuucuauuccuaguuuucuggaugguuuuaucauaaaaugguguuagauucuguuaaaugcuuuuccugcaucuacugggaugagcacauggcuuuuuuuauucuacugacauguuguauuacaucaguagcaaaagagacagaacaugggucagugaugaugauucugagcugcugaauuaaccauaucuggagccacuaaacccugggucuucuagguaaaucuuauuguauacaagaauuuggaacaaguuuuuuguuacuugccacuaaagaaauucuggcugauacaacgagugucauacuggagccugcucacacuguuucaggaaagccaguucuguacaugucuuccccacccccauucagugauacugcacugacagcuucaaaucagccaugguaacaggauguacacuauuuaaucucuauugaaguauagagaagacuggaauaggaacauucagugcuaguaguuaaaaugagcagaaauuggcaagcaccauuuuucuuucagagauccaguugcuacacauuuagcagcauaccacuggauacaacucuguuucaaaguuuucuuuucaucaaaucuaccuucuuauucccauaauaaaguuaauaauaaugaauaaguuacuacaauaagaauuuuaccaacaaaauacuguauauaucuggguuucuaauaagacuuuacuagaaaaaagucuccaguauuuauuucuauaaaagaauauuucagaauauggaaaaucaccgacauuauaaguuuuuuuuuaaaaacaaacugauuauaaaacauuacacacaguaggagaaagaaucuauuucaaugaacagauacuaggacugucgagcuaaacaccaauguguucacaauguuauuaucucuggguaguaacauuacagaugauucuuauuauuuuugcauguucuuucccuugauuuuuaaugaugaacauguauuaacuuacuaagaguaauaaagaaaaauacaauuuauauuuucaagaggaagaaacguaaaguauaguaauuuuuguccgugagcacaagaagacacuuuuuuuccuuccauuuuaucuaggaagaaccuauacaauuccuugcagguaggaagguagcacuaguucuuaaacugggugauucuuuguugcuauuuauaauacaaaguuauaaacuuguucucuaccucaagacaauguagucauaacuuacaauaugcauuauaagaaaagugcuguauucuucacacauaaucgcuuugaaaaaaaugugaucugauucaugaaauugcauaaccucuacuccuaaagaggauauaguaaagugaaguagcacuggaccaagaguuagaagauuugguuucugguucuagaguuaaaccuuauuagccaugugaccucuggcaaggagcaaucucucugaaccuaaaucuucucauuuguuaaauggagcuaauaacacccauuccucuucacaggaugagauaaaguauaugaagacuaucaaaugaaagaugguaucauaugccacugcuucauuacauaaacauuaaaagucuuauaacaaccguauuuuguuccacuuugauacagaaaaacagcuuuauaaucaggaaguuaugaugccaguuuuucugguaacagguuaauuugcucagugcuuugaagaucuuuguaucaaaaaaaaguuuuaaaaauauuuucuuuacugcauuacucuuuuuaaguuaccucaaaaaauccaaggaugucaacagauuagcauuaccacaacaugacacuagaaaagccaagaaagcuauagauugauuuccguaagaaauauugcuguaaaagaaacuaccaucagagugaacaggcaaucuacagaaugggagaaaauuuuugcaaucuacccaucugacaaaaggcuaauauccagaaucuacaaagaacuuaaacaaauuuacaagaaaaaaucaaaccccaucacaaagugggcaaaggauaugaacagacacuuuucaaaagaagacauuuaugcagccaacagacacaugaaaaaaugcucaucaucacuggucagagaaauacuaaucaaaaccacaaugagauaccaucucacacuaguuagaauggugaucauuaaaaagucaggaaacaacaggugcuggagaggauguggagaaauaggaacacuuuuacacuguuggugggaguguaaauuaguucaaccauuguggaagacaguguggcgauuccucaaggaucuagaacuagaauuaccauuugacccagcgauaucauuacuggguauauaccccaaggauuauaagucacgcuacuauaaagacacaugcacacauauguuuacugcagcacuauugacaauagcaaagacuuggaaccaacccaaauguccaucaaugauagacuagauuaagaaaauguggcacauauacaccauggaauacuaugcagccacaaaaaaggaugaguuccuguccuuuguagcgacauggaugaagcuggaaaccaucauucugaguaaacuaucgcaaggacagaaaaccaaacaccgcauguucucacucauaggugggaauugaacaaugagaacacuuggacacaggguggggaacgugacacaccagggccugucaugggguggggggaugggggagggauagcauuagaagaaauaccuaauguaaaugaugaguuaaugggugcagcaaaccaacacagcacauguauacauauguaacaaaccugcauguugugcacauauacccuagaacuuaaaguguaauaaaaaaaguauugcuguaaaagcccuaaauaaaauauuagcaaguagucaucaauagaauaauacauuuuuuuuuguuuuaaaagaacaauauauuuuaaccaaguaaaaaucauccuauuuuuuaaggauaaauuaauauuagaauauccacuaagguaauuuacuauauuagagcaaaggugaaaaacuuaaaguaucucaauaaaugacccaaaaucaugugaauaaacaaucacucccauauaaauacuccuaauauucaaacauauuuuaagaaacaaucauucccaauaaauauuuccuaauaaaguaagaaaaagguaaaacuguuauuugcaggugauuaugaaacagacaagaaaagggacugaaaaacuauuagaaacaauaaacuuaauauacaacugauuuacaaaauuaauucaaaaauuauuauaguuugcccacauacaaccaauuagguagaaaacauaaugagggaaaaaauuuauaucugcaaccaaauaaaaguaaaucuggguguaaacaacaaaaauuguaaaggccucuaugaagaaaauuuaaaucucuauugaaggauagagaagacuggaauaggaacauucagugcuagcgguuaaaaugaacaggaggaggaaguggagaaaaaaaggaggaagaugagagcaacuuuaccagucagguucccagcagaaaacugaugacaaacucaaggagguaacuaaagagaacuucaugaagggacuguuuacugaggucuggccagggugcagcacccaggggcuagcaauagugggaagauguuacuacugaacccuagugaagacucucacugugggagagaagacaagaaauguggccuuaggugaacaaacacagcccuccagggggaaaagcugggaaauguacccuaaacucucucuccucccacccgcccaucuccugcuaggccucccauuggccaacccaacgagaagccagacggcaugagaggcuggaugauuccacagagguuagccucuuucagcagagagcaagaugaagaguagagaauauauuugaaggauaaaaggaauauccagcacagcagcuauucuccuuugacuguuuaugccaggcacugcucuaggcacuuuauuuggauuaauccuuuuaacucucacauggucuaauaaugccaauuaacccuaaacuacaaauucaaacaauuccaguaaaaauacuugguguguaguuagagggaagaagggaguuuucgacaaaugauagauucuucuagaaugauaaacauacacgcaaggucagggagggggaaaagagaaaaauaauccuaucaaauacaaaaauuaauuauuaaacuauuaguuuaaaugguuugauacuggaacaugaauagacagaucaauggaaaagaauagaaaguccaggccaggcgagguggcucacaccuguaaucccagcacuuugggaggccaaggcaaguggaucaguugagcccaggaguuggagaccagccugggcaacauggcaaaaccccaucucuacaaaaaauacaaaaaauuagccaggagaguggcaugugucuguggucccggcuacucaggagucugaggugggaggaucauuugaacucaggagguggaggcugcagugagccaagaaugcaccacugcacuccagccugggugacagcgcgagaccguuucaaaaacagaaaaaaaaaaaaaaaaguccaggaauagaacaaaauacaugcacaagaauuucacaugugauagaggugguguuucaaauaaauggagaaaagaugcaguauuuaauaaaugauuucggagaaacuggcuaguaaauagaggaggaaaggcuaaauuccugccuuauuccuuauaccacaauaaauuccagauggagcaaagaucaaaacaugaaaaacaaacuguggaagcagaaccauaaagaauaauguaaaagaacuguauaagaacacaacaauggaaguauuaucuugaaguaguaaggagaauauucuaagcaugauauagcaccagaagccuuaaaaguggaaaaaaaaugacacauuuaauuaaauaaaaccaccacacacaaaaaaacuaccauaaaaagucaaaagacaagacauuagauaaaauauugguaauauuguaauaaaaccuuauuuuucuuauauuacucuuacaaugcaacaagauaauggccagauacguauuuuugaaaaauacaaaugcuauuaacauaaaaacaugcauagcaccacuuuuaauagaagcaaaacaaaccuaaugagauaccuuuuuauuuuaaccuaucacacuggcaaggauucgaaagacugauaacaccucacugccaguaaggguauggagauaacgagaaagaaacaacagauacccgcacuguucaaaaaggcucacuagccaacucaggaaccaaacacauuagaauaaauuuucaaaugaacccucauuaucuggacugucccuacacuugcucaggaacuaaacagauuuggauaacaccauaucccucaccauuugaacucacugugcuaauucaagaaaaggaaaagauuuggacacaguaggcacugugaaaaacacaaauaaaaauacaaaacauacaguuuuguagugagaauguaaguuagcauaacccuuucagagauaucaaaguuguaaaugcacauagcuucugacccaaguucuaccacuucuagaaaugaaugucacagauauauuagcauaggaauguaaauauauaugcacagaauauuuacugcagcacuguuugaaaguacuauuaaaaaaaaauacaagaaacccaacaaccaaaaaacuguuaacagccuaagcaucuugauuaguagggaccugauuaaauuacaguccauucauagaaaguuaugaaauccuaguuuuucaaagaugauugguaugaacugggaaaagaccauuuagugaaucuucuuagaccaggaaccaaaauguaauuguaaauauugaaaaugauagcugauuuucaaauuuugacuugaaaaauaagacaaaaauauaaaaacaaguuuauuuuauauuugacaaaauuaaguuauaauuucaacugcaaaauucuuagacuaaaagaaugaaucaagcauugacuuuauuuuuuaauguaaucuuuuugacaaaacuguauaauagcacgauuggauauccuucauguuuuucucuuaugggacaauuacaaagaagauauucuugcaaaaauucugaaggguuccauccauuuuccuaagguccucucuuuaaucgucugguagucaaaucaggcucccuuacagcaucuauuauaucaucaaccuugauaauuuucucuucuucaacugucaauagcuuugaguucuuuaauaucacacccaugaacuucauaaacaccugcauauuuugcaaguugagcaauuucaguuugcaaaugauuuuauucucuuuuauuaaaauugcuaauaaauggucaggagcaacauuugagugcaaacuaauuuuaaaagugguauuuucauuacugaauuuuuuuuuucugaagaccuuggcuuacauaaccaaugcaguaacacagaugcuaagcagaugauuaaaugaaaaugaccuauuauacugauauaaagaugugcaagauacauuuauuuauagaacaauauguaguaugauuccauuugcuuaaaaaggacuuucggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaggacuuucauauguguauauauauaauacguacacauauaauacauacgaagaugucuaucuuuauaugugaacaaauuuucagaaaaagcauucaggaaacuauaaacauugcuuaacucuggggaauugcuaagaagaaguuaccuuuaaguguauuuuauauccuucuaaauuauuuaauuuuggccaggugugguggcucaugccuauaaucccagcacuuuugggaggccaaggaggacagaucaccugaggucaggagaucgagaccagccugaccaacauguaaucccagcacuuuugggaggcugaggaggauggaucaccugaggucaggaguucaagaccagccuggccaacauggugaaaccccguuucuacuaaaauacaaaaauuagcugggcaugguggugggcaccuguaaucccagcuacucgggaggcugaggcaggagaauugcuugaaaccaggaggcagagguugcagugagcugagauugcgccacuguacuucaggcugugugacagagugagacuccaucucaaaaaaaaaaaaaauuaauuuugccacaaagaauaauacacauuuacaauaauguugacaauauuuauaauguauucacaguaauggugauguugauauaacuagguuuuaaauuaaauacauaguaaugauagauaaucuaugaucccagcuuucgagaguuuaaacuaagcccuaacuuauaagagccauuaaauuuagaaaucucaaauacuaauuaaaccauuuaaauaacauucuaaugcaaggcucaauuacccuagcaguuuuuuucaaaucuaauuacuucagacagaaaaccuuuguuuaccuuuuuacacuuuagagacaggaucuggucucugauuaccaaguugugaaacaaaauuugagauuuaagaacuaggcaaaagauaagcaaaacuaacucccagucaugacacaaaaaauaucugugcucacugaagcaacuuuaacuguuuuaaaacuuuuccuaagaaaaaagagagauguguucauuuuauacuaaaauuccaauaaauguuaaaaaugaaagaauagucagaugauucucaaagugugcuacauacagggagacccaauaccuuuucaaagggucuuagagauagaauuauacauugcuaagauccauugauagaauaauggauuuuaauguaacaguacaaaaaaauucguugauaugguuucagauccuauguuguaacuaacuuuuacaaaacuaucacuucuugaguuuuacugucauaucacagaauuuucaccauuauaugaaagggcuuuuaaaauauaccuccgacuacaucuuaguggggccagauuuucuucacuuacuucagccaaagcaacacacuauaacaaauucagugcaaagccuaaagugaaauccaguugucuucuauuaagguagacguuaaugagauuugagaauguaaagcaaugccacucuccuacuucauuuuggaaaauaucuauuuucauuuaacacauguuauuuauguuaacauguaauugguauuucuuguaaaugaauaauauuuagcucuuuucucaguuuuaauuucuaauacaauaaauaucaguacauaaaacccacauaaacaaaagcucuuuagaguucucagaauaauaaaaguggaaaagaauccugaaacaaaaaauuuugaguaucauuaucacagucuauucuaugaaucaaaaggcaaagaggugaaagcaauuugcuuacaacuaggacgaaugugcagaagguaauguuagauacuaaauuuguuuuuuagauagaauucaaugcuuuuuaaagaagagaugagaaaaaauauauuuauagucuucuauauuaaccuacauauugacauuuccagugcucuucauuucuuccuguggauuugaguuuccaucuggugucauuuccuaucaaccuaaagaacuuaaucuuuuaguauuucuuauaagguaggucugauagcuacaaauucugucuuucuguaggaauguauuuauuucaccuucauuuuuaaagguuaguuuugcuaaauauagacuucuucacagacaguuuucuucuuccagcacuuugaauaugucaccccacugccuugggccuccaccaauacugaugagaaagcagcccuuagucauugcugaugcuucccucuuguguagugaguugauuuucucuugcugcuuucaagauacucucuuuaucuuucaggaguuugacuaugucuaggcaugggucucuuuguauuaauccuagucacauucacugaccuucuggauguguaguuuaauguuuuucaucaaauaugagaaguuguccaaaaggucauuuuucugacccuuucuccuuuugagauucucauuacacaucuguaguacacuuaauguuuuucacagauuucugagcucuguucaauuuucuuccauccuuuuucaaauguuuucaagaucgaauaauuucuacuggucuguuguucauggauucauuuucuugccaucucaaaucugcuacgagccccucuagugaauuuuuaguuucagauauuguauucuucaacucuagaauuuccauuugauuuuuaaaacuuuuaacuuugcaauaaauuauuuacagaaaaguugcaaagauaguagaguguuccuauauaugccucccuaaugucaaaauuuucuccuaaugcuaauuaauaucuuacauaacuguguuauacuuacauaccauauacauaaacacacaucuacaaauacacaaacaugucuauauauaacacauuuacauuaacagacauaauaauggaaaugucuuacauaaccaugguacguuuaucagaaauaacaaauuuccauuggugcaacaaaacaaaaauauagacuuuauuugucaccaguuuuucuacuguuauuuuccugcccaugauucaauacacgaugccacauugcauuuagucaucaugucucuuugaucuccucugcccuguaauaauuucucaguuuuuccuuguguuccaugaccuugacagguuugaugaguacuagucaggugcucuuauggaauaagccugaguuuggcuuuaucuguuguuuucucaugaucggacucagguuauagguuuuaggggagaacacuacagaggugaagucccucucauuauaucucaucauaucaaggaguguuuuuuuuuuuuuuuuucgagauggagucucacucugucgcccaggcuggagugcagcggcgcuaucucugcucacugcaagcuccgccucccggguucacgccauucuccugccucagccuccugaguagcugggauuacaggcgccugccacugcgcccagcuaauuuuuuguauuuuuaguagagaugggguuucaccguguuagccaagauggucucaaucuccugaccucgugauccgcccgccucggccucccaaggugcuaggauuacaggcaugagccaccacacccagccagcuuuuuuguuauuuaaaaaaauaauuucuauauucuuguugagaaucucaauuuguugacacuguuauacuuuaaauuuccuuuaguucuuuucacauauuuauaguaauuuaagucuuuacuaaauccaguauuuagggacauucagagacaauuucuacugaccuuuuuuuccucguguaugcgucacccucuguuucuuuacgucuuauaauuuuuuuuguuguuaaaccuagggauuuuagauaauguagugacucagaauucuguuuuccccauuaaagguaguguugccauuuuguuuuuuuguuuagcaucaugaucaagacaaauauguggaaucugucuccucuguuguacacaaucacugauaucucugcucauuuuuuuaauauauucucauuuuguauuuuuaagccugccuuccuaguugucccuuugcacaauuuaguaguuacugugacacucaacagagacuguguucaaauaccucaagauagcaaggcuuccaucuuuguugaugggcaugugugugggcagggaagugcauucaaaguucagccuguuuucaaguuugcucugaguugaacuucccaaagagagaaauuucaagucuccuaugugcaagcauguaccuuuggaaccagccaaaaguaugugaauaccuuaggcuuucuaaggucucuguugagcacaugcacagccucauccaggaauauucuugccccaaacacuacugaaucuucaggcuauuugagcugagccccuggucuucccuuguaccucuggaaauucauauccacaacauuacccaccacuccaaagaacuaagcccccuucaaacugagguccuuauguccugcuucucacuggcaguaccuucaugccaaccaagcuggggcagaauugggggaaugugaguagccucaagcuagaauggccacugacucccacuguucucacuccaaauucaagagcauaacauuuuucaaaguuuuauacaauuggccuuuagucaaccuccagagcacugaaauggcugcuuuacaaaaguaauguaaggguggguguaagggcucaugucuguuaugcaggcacuuugggaggccaaggugaaaggacuggaggccaggaguucaagaccagccugggcaacauagugagacacugucucuacaaaaaaauauauguuaaguuagcugggugugguggcacaugccugugaucccagcugcucugaggcugaggagggaggaucacuuaagcacggacguucaggguugcagugagcccggaccacaccacugcacuccagccugggugacauagcgagacccugucucaaagaaaagaaaacuuguuuaagaaauaaaaauucuauuaaaauguucaaauuguuuggaccaauaauuccacuucuauaaaaaccauccuuaaagaaauaacaccaaaauauggagaaagcuguaauuagcauguccuuacaaaguuauuguuaacagcaaaaaaauuaaagcaauguaaguauuuagcagagcuagauauuaauaaaaccaugguacacacaacugauacauuacauaauccuuaaaaguuaaaauuacaaaaauuauuccauuguaaacuucuuaauucuucccauugacaaaaguuaguaagauuaauuuuauucaaauuguggcacacuacuaguugucucccaaaacaucuauucucauguucuuccugagcauacaaucagucacauaggcuccauuucccagccucccuuauagguaggcauagccgugucacuaaguucucaccaaugaugcaaugugaguaaaagaaauagcagaacuuccugcucaccuccucaauggcaaacuguccugaauuuccuccuucuccuccccacagacugaagugugaaauuguacaaccaugacaaguggaucccuguauuacuucauggagcagaauagaauaucuccaaccuacuacaugacagcaaaauaaaauguuaucuuauuaugaagacuaaguaacuguaaaaauccacauuuuaaaaaguauuacauggccaggugugauggcucacgccugucaucccaacacguugggaggccgaggcagguggaucacuugaggucaggaguucaagaccagccuagccaacauggcaaaauccugucucuacuaaaaauacaauaauuagcgggacaugguggcacaugccaguaguuccagcuacucaagaggcuggggugggaggacugcuugaguccaggaugcggagguugcugugagcugagaucaugccacuucauuacagccugggugacagagugagacccuguuucaaaaaaaagaaaaggaauuauaucccccaaagcuauaaaauuaaauguaccaaaugaucaaaacuaccuuaaaauauguauauaaacauaggaaauacauaaaaauaauauuuggugguugaacuauuaauuauucuuuaucaaacuuucaguaauguuguuuaaauuacuuugacaauuuuaagaguugaaauuguuuuugucugucuuuugagauggagucucgcucuguuacccaggcuggagugcaguggcgcaaucuugacucacuguaaccucugccuccuggguucaagcgauccucgugccucagccucucaaguagcugggacuacagacgcacaccacuaugccaggcuaauuuuuguauuuuuaguaaagacaggguuucaccacguuggccaggcuggucucgaacuccugaccuuagaugauccacccgccucagccucccaaagugcugggauuacaggcgugagccaccaugccuggcugaaauuguugauuuaaacaacugaggauauaaauaauaaaacagugaaaagcaguuccaaaauagauuuaagaaauuuuuauccuauugacuuucauauuauaaaacauggguccucuggccaauauuccaaauccaaggugcuuggucugcaaaucagugucaucugcauucuuuaauaagaauuaucuacucauacuucucaagggcacuagcuaguagccuuaaccaguaagacuaccuccauauaacugaauaggccuuuuugacuuuuuaaaaaaacaaaacaaaacaaaaaaaaacccuuuuuucauauuuguauuuuuuuuaagagaaaauaaugccucaaugcaaggagauaugagaaccagaccuaaaaagcuuuaugaagcuuccauuaaccuaaaaaucugucuaaagaaggaugagcacuguucccgcugugaaaagcauagcuucucauaaaauagcaauuuaagguuaaaauucccuccccccuaaaccaagauacagcccaacccaaagaaagcaaaauaaauguaaaaacuuugccauccucucauauuugaaacuauauaaucccucuaaaaauauagccaauuuauacaguaucuugauauuccccaacgauuaaacuuaaguuuugaagaggaagaaauguguauaacccuguaauauauugcuacugcaaaucuauagaagugguaccccgacucccaagcaauauguaccauaaauguucauuuuuagagcuaugcuguccaaugagaaucacuagccaucuguagcuauagaauacuugaaauggugauagucagaaucaacaugugcuaccaguagacaauacacacugaauucugaagacuuauuaucuaaaaacuauaaaauauaucaguaucuuucuaauuuugauuacauguuaaauugauaaaguuuuacauacagugaguuaaauaaaauuauuuucgucuguuucauuuuacuuuuuaaaauauggcuacaacaaaauuuaaaauuacacauguggcucacaguauauuucuacuggacaccaauggugucauaacugaacaagcugauccaguuccuaacaggcagaauuuuauaaccacugccuuuuggcuuaguacucucuagucccauacuuuuaugcugaaacaaagaggguauguugaccugggguuaugucccacagauuaccaaagguaagggcugccuauagucauccugcuacucaacagggacccaucuauuaaagaaagaaguccccaggagaaauccagagaccuuuguaaagucuuuaaggggcuggaaaccugcccccucauucugaccuugccguccaucagcuuuauaugagagacugugaaugcuauaccacuucaagaagugcuccagaaauccuccgucauucuaagaaaaaacaguagccaccuugagauggcauaugguauuuuagaacagaaaugacugaaugccaccgcagagaaagggauggcauugugggaaggagaaaaaggaggaaguguggguagagcagacagcuggacucuccguaggacugggucacugacaggacuugauaaugguuugauucacuuucuauauuugcuaauaucuacuuggugugaagcacugggcuuacaaaagugaaauaaacaguauccacucuuaagaagcacauauucuaaccaaacauacugaagucggaacagaucaguggacaaggucagcugugcuaagaguuaauccuaggcuguaaccuuaagaacugaaaccagaguugguuaauaaagucaaauaaaucaguagagaaaaagcugagggcaacuggacucaggaagcaaagaaaguuauagauacaugguauccuagggguaugaugagugaacuucaagaacccccaaauguuugaaguguuacaaacauuucuauacaggcucccccacucccauuuuuggaggagguggaaauaaugcauaguaauuuaacagauuaucugaggcagcagucuccaaaauuuuaaagcacuuauuaucuuaucuauuaacuuuaucuaucuaucuaucuaucuauauacacaaacacucuauggaaaauaaauaaaacuaggaucaaaaaaauuaaaguuaaaaauaaauacaaguaaaaucuucaaguuuuauuuuucuauuuccagugguucuucuugcacagcccacuugaauccugcucuaagguguccuaacauuaaaauaaagacauuuaaaaauaccacugauggggagaagaggguggaaaaccucuaaaaaguuugaaaaaccacaccucaaauagaaaugagcugaggccaaccaccaaaauccuuaaagucacuuccacaaaguuuuucuccaaaaaugaauuuggagaauuuucauugugagacaaagaaaacauuaaacugaauaaugauguuucuacagauugcagguaaucuauguucugcuuuuaccuucaaauuguccucuuguauguuauuauuauuuaaaaaucccuuuaaauguuugcaagauauaaauucuccuuaaaaacuuaaaaguuucagaaaacuaaucugucuaaaugggucuuauuuucuauuuuucuuacuauaacaucacaaaauuaaaaauacuugauuuagggggagauuauguguggcaauuucuuuaacacugagugcuucuguaguacauucaguuacacgcauaaaaauuuuucccucccauuccacauucucaggucuagaaaaauauuuaucuugucaccuuuaccauauauuaaaaacaugaagagauaacuagucauuaauuacugacaauuagccaaugcaauauauuaaaaucuuuaucaaacuaguauauugaagacaaaaaguuuacaugugcgagauuuauaaaauacuaaaaacuuuuauuaauaauaaacguacugcuauuauuacaucauuacagcaacuaaagacuuacuaguuaagaucuggcaguacaaguaggacauuaaaaauaaggcaaaaaaagggaaaguuucccacaaauaugacaaaauguucuuucucaauacaaaauaauucaaaaauugauauaaaaauacuaaguugacaacaaaaacaagagccaauagaaacaacucacagaagauacaggaaugccuugcuuuauugugcuuuucagacacugcauuuuuuuuacaaaaugaaggucuguggcaacugcaccuagcaagucuacuggcaccauuuucccaacugcaucugcucacuucuuaucucuaugucacauuuugauaacugucacaauauuucaaacuuuuuaauuauuguauuuguuauggugaucugugauagugaucuuuaaugauacuauuguaauugucuggggcgccaugaaacuuguccacauaacacucaaauuuaaucaggaauuccuucuuacugaugagcaaagaaagugguuuccggaguugaaauuuacuccuggugaagaugcugugaacacugcugaaaugacaacaaagaauucaggauguuacauaaacuugguugauaaagcaggguuugagaggacugacuucaauuuuggaaguucugccuguggauaaaaaugcuauuaaacacuaucacaugccacagaaaaaucuuucaugaaagggaaaguccaucaaugcagcaaaugucauuguuauccuauuuuaagaaauugccacagccacccaaccuucagcaacccccacccugaucagucagcagccaucaacugaggcaagacccucgaccagcagaaagauuacaacuugaugaaggcucagaagacuguuagccuuuuucagcaauaaaguauuuuuaaauuaaaguguguacauuguuuuuauuagacauaaugcuacuguacacuuaauagacuacaguacagcgcaaacauaacuuuuauaugcauggggaaaccaaaagauucacgugacuugcuuuauugugauauuagcuuuacugugauagucugaacccacaauaucugagguaugccuauagauagagcagguaauuaauaacaaacauauauuacaaguuuaauauuuaaaaaauuccagaaauggaaacuaaauauauuggaaauauaaauuggcaucaucuuucuggaaacaaauuugacaguaugcuuugaucuaguaauuacauuaggaaaugauuucaaaauucaagauuuaugcacaaaaaucaucacaauauuuuuacauaaaaaauacuugauuaaaauauucuaaaauguuaauagugguuaucucucaguggaagaacuauggauggucuuuacuucuuuacauuuuuucauauauuccauguauuuuauaacaagcauacauuaacuuuaguccaaaaaaaauucagguuacuuuuuaaagguucuguuagcaaauaucacccaguucuucuuauagaaacaaacaaugaauguuugcuauuucuauuccaauggacagggcuccuauucuaauucuggauuuauaccucccacuuaccaagaacaucagccuccacaccagcauagcagaggagcuuuaguuagagagagaucuaaguuuaaauccuagaaauaccacuuauagcuguguuacuuugggcaccuuacuuuucuaaacuucaacgcauucuuaaauaagacuugcauauauuauauuuauauauuuagaguuaagauaguuccaauauuacaaagggcaauucagaaaggguauaaagaugaagguggaaucuuggaggagguaggugggaagaauacaauuugggauucauccaaaggaaaguuauggugacauaugcucugacaugguaugcaugagauuaaaugaguaaguuuuucuuuauucuuuuguaaagaacacuuacuaugugauguacacuagggacacaguagugaauaggguaaacaggacuccuguuggcugaccacauauucaauggcggugaagguggggggugaggcggagaugaaugccagguagagacauacaaaucaaauuagugaggugugucauaaauaaaacgaaguguaacagguaaugggauagaugggggaugggugcuauuuugaagaggauggucaaggaaggcuccucugcaaagacugggcugacacuugaaugacauggagccaugggaagagccugagucugacaaaacagccaaugcaaagacaaagaccagaacaaagcuggcauauucacaaacagcaggaagaccacugugaaaggccaagagauugaagagguagcaggaaccagaucacauggggccauaucaugaaaaggaguuugaauuguguuuuacugugaugagaacacacugauguuuucaauagacugacacaaucuuacugcaucuuaaaaauuacuucaaccaaauuguggagguagaauucuagugacaggaggcuauugcagccggcuaaauaugcuuugaacuagguaggacugauagcacugcaguggcagaauaaaacagaauuccuauggaggcugguuucaacucuaucuuugaaaccaaacacaaagaucucacuucguaaaacaucccagguucuccuagcuucaggugccaucacuuaacuucauauaacauucuagugaaaacauguaucaaaauguauugcaacugucuauuuacaaagcugcuuuuucuacugagucaaaccccaagaaugaaggcaggaacaaugucuuauuuaucucuguaauaccuagcagagugccuggcauguaagugcucaguaaauuugauugaaagaaugaacaaauaaauuugaaauaaucaaaaccaucuguaauaguuuccuagggcuauuaacacaguaccacaaaucggguggcuuaaaacaacagaaauauauucucucauaguucuggaggcugaagguccaaaaucaaggagucagcaggaccaugcucccuuugaaggcuuuagaggagaaucguccuugccccuuucuaguuucugaugucucccagcaauccuugguguucuuggcugguggcugcaucacuccaaucucugccuccaucuucacaugauuuucuuccuugagugugucugaguuucugggacuccagagauaccacucauugaaucgagggucugucuuaaucccauauauucucaucuuaacuacauuugcaaagacccuuacuccaaauaaggucacauucugagauuccuggugaacaagaauuguugguaaacacuauucaaccccacuacaccauuaaacaccacaaugcauugccuuaccaagugguaaccuucccgcuccaaaaguguuccauaaggcugaauagucaaaaucagaaacauucaacagaagagauuucuguauugccuuuguguguccuuuaaccucucuuguuucagccuacugaucuguauguuaugagaaguuuacaggcucuucuaaugguaauauucuaugaucuuaagccguaauuuuucuugacaacuuuuuagauuuuacgaacguauuaggcauauagagacccucaaauauuuuaguaaauuuaaauauaacagaaaguuuauuuucucagcuuugaaguagguagaauguuuuuuguaaacuagccaccauaacacucacuuuaauuuucuucauuuuucauuaagaaugcagcauauuccuccaaacauuauaacacuauacagucaugugccaaauaaccacauuuuauucaauaaugaauagcauguauaacaguggacccauaacauuauaacacuguauuuuuaguguaucuuuucuauguuuaaaugcacaaauaccauuguguuacaacuuccuacauauuuaguacaguaacaugcaguacagguuugcagccuagaagcaauaggcuauaccacacagccuaggugugugguaggcuaugcuaucuagauuuguguaaauaugauguucacacaacgacgaaaucgccuaaugaugcauuuaucaguauguauccucauuguuaagcgacacaugacucuacuuucauuuuaacagacuauaccucugaacaccuucuaugugccaggcacacagggcuauggcagugaauaacccacuuccaacucacauacuuguaacucauuagauuauuaacuaacuagaccucagucucuucauaacuuaaaaauuccacuuauaugauacucuaacagacauguuacuuuuuuaaagggacuauuucaaaaaauagcuuugucgauuucugaaauagauauauuuucauuguuuaaaaaaaaaaaucagaaaaguaggaagaugguaaaaauuaccagaaaucucacuacccaaagauaggcacuguuaacauuauacugaauaaccuuccagauuuggauguuuucacacauugauauauaauaucuuccaugauuuuauccaaaaauacagauguagaaagcagcauuaaauggcuguuaaauugacaggcaugccauuuugcaacuaguuuuuuucccccaaaguuguuauguguaucuuucuaugacaaauauggcuauuuggcaucauuuuauuggauacagaguuuucuguugaauuaaaauacccauaauuuauccaaucccccacugauaaacacugaaaugaauuaaaauaucuaucauuaccaauguugcaaauuguuaccaaaaaccuguauacauauaucuuagcaaaguuuugcaauugccccuuuggacaaauuccaggacugcagaaaugguaguaucuacauuuaaaauuuucaucuguauagcauagaccuucuguccucucaaaagguugacucaaaugauacuccaacuccacauauaagauuacucauuuucuuauauccuucccaacaguggauuuugucagucuucaccaauaugaaaguacucuucugccaaaacaaaacaaagccaaaccaccuuuuauuugcauuuccuuuauuacuagauaagcuauacauguuuugcuacauuuauauuucuucuuggaacugcuugagacuuuugcuaauuuucuaccgaguagucuuauauucgaguauuuugcuaauuuucuacugaguagucuuuacauucuuggguauuugauuguauuauccuuguuaaaaguaaagaaucuuuucauuuuacuuuuuagaauaacuucauuguuuuucuuaaaauauauauucacuaugaagaauuuacacaaaaaguaaaauuuuaaaaaaauuuaaauuacuaaaaaauuccacuacucaccauuucauacauaacagugcuagagagugagcucgcuguauguuaugauauuaacuuuuguuccccaaggugaaaauggcuucauucauaaguuaauuuuuaaaggcaaguaagauaugucuuucuuuauaaaagguuaaguugcacauaaaucacauuucaacaaaucaaaugcuaucuucccaaaugacccauuauacuucugauaauggcuuugcuuuaucucugauuauauguuaauuaaaaguaacucagauauuuucagaacugaguguguuuguacucuuaacuuuuucaaacgauuacugggccauaaacagauggcuucaauguauuaaagaagauaugccacccaaauaauguccauuaaagaaagacggcaacugaaagaauuccuacagcucaauccuuuuauaaggaagcagggaauauagugagaaaagcaacagauuaaaaguuggaagaacuaaauuuaaagccguaacuucuccacuuucuuacugugugaucugggacaaaucacucaaucuucugagccucagcugcuaaauuucuaaaauguugggaauggaauuauuuauaaagucccuuucaagcauugauauucugauuccacagagugaugaaguauggaaacccagaacuaguaacaaucaaaaaccuagaaaaaaaaugacagaugaauaagguauuauuucuguauagcuauggagagcagcaaaauacagcaacaaggcagcaacaaguaacaaagggaauauaguaaaccagcaguccacaaauugggucauguauaccccuggaagcauaucagcauggagaguaaagagaauugaugauuagguucucacuuuccaucuguacaguuuucuagaaccauuguguugacacagcaugucuguuuuccuuuacuuccacuuccucuuucccuuuaccucauuccccucugccacuucauaaaagaaaaccguaacucucacauuuucugaaacuugcugucgaguacugucuuugggcuaaaaauauccagguggacaaaaggacacuucaauauauucauguugagaaaguuaauuacucuaaaaacacugaaaccuuuuucuuucuuuuuuuuuuaacauuuauuuuaaguucaggguucuuuuucaaaucaaggugucaccacuuccaugaaaaugaaaggagaaucaaauccaguugcuaccugacaaagcauuaagaauaauuuugauuauggauuauuuuguuguuuuaugcauacaaccuagaagaaugggugcuacugcuaauauaaagcacuuuuuaaugaccaucuacuaaauucguaagugagguuucucaacacuuucaaauauuaaaguaaaaaaggaacagaaucaagcagaaccccaucuuuucuaauauuuagaaauggauaaaauaauugaaauaaaucagccccaucuaucccacugaaaacgcauuucugacaaaauuuuacuuuaauacuuauuaaaauuuguaauuaacauauguuguuuugauugucuacuggacaugacugaacugauaacucaguccaaaauaaaucugacacagagcauuauggacauacacaauuuucguauuuuuguauuauaacuguccauagaacucagaacugagugaccauuaaaauaaagcacuuuuuauucccaucuacuaaauucaugaaugaauuuccuuuuguugcagaaaaauauaacaugauugauaaaaaugcuuuccagcauaaaagaauacauuaggauaauauguagagaaaguaaaacaaaaauaacaguucaaagaaaaaaaaagacuauaaaaaauucuguuaaaauuaacuuuguucacauauuuuuuaaugaaugaacuguuaaaaauccccucauauacauuuaaaauugugauuugaacaacacuaccagaaauuacaucauuuauauauauuaaaacuuagaugaaaaacucaagaugugggagaagguacacaguuuuuuuguuguucaaguucuuugaaaggcuguaugagcaaaauguuugaaaacccuuauacuaaaggucagaauauaucauuagugcuaaccuuucuacuggacauccucaucuggauguucagacacuugaacucuacauauucgaaguaaacuuaucuaccccccucuacaaaugcacacauuuguuuuugaaagaagaaagaaaaacaaaccugccucuucuuccuauuugcauuuuuguuccuagcuucacaaucuaccuggucuuuccaaacuaaaacaguaggaauacuuuuuaccucccaaagcaaaucacuuccuaggaccuaacuccuaacuuucucucuuccuuccaccacugccauuguugaagaucucuucaccagcugucaucaaauagcucuucuucaaaacaauaacuauacuuaauuuuaccucccaggaucucucauggaaaguaaaauuacuuuacaauaaucagagcuaugcagguguaccugucaugcauauauaugacuuaccaaaaaaaaaaaaaucacagaaucacgaagguggaagaaaucagucaaacccuuggagacuauccuuaucuaaauaccuuucaagcugcugucucaacagucacugguugagaauuuauaaacucaugagcugcccacccuuuacgaacagcuuugccaaagaucuggguccaaauacaacucacuugacuuauuauuccuaaauuaauuugguuaaaaaagagauucauguuaauacaagaauaucaauaaaguuacauacaauuauaaagaaguuaaaaauaacuuauaauuucaccacccagcaauagcuucaguuagcauuuugggauacaucuagcuuucucuuuauuuuuuggcacgcaugcaugguauauagauauguauguauucuguuauuuguuuuuuaaacacaauuaagauaaucuguagauacucugggguuuuucuucacuuaauuauguugcuagcauuucuuccaugugauuaaagauuccucaaauucuucaaaucauuuuaguggauauacaauauagaaauaauacuagaauccauugagccauuuguaaacuauauuuuuauauauccuuuaaauuuuucaaggcauuuaagugcuaacauaauacagaaacaaugaaaaauacuauacuacauaauacuauaaucuacuucaucauuuguaaauuauguuuucaauuuuucacagugauaaauaaugggaugaauaaacuugaagauuaaccuuuaucuacauuuuuagucauguccucagaauagauucccaaaagcgaauuaucaaaaauacuaauuuaaguauuaauuuuuaaaaucuuacuagcauuguguacauguaaccuucaagcuauaaacucacuuuggcugcaguguaguagcacgaucacaauucacugcagccaugaccuccugggcucaagagauccucccaccacagccuccagcuuagcugggacuacaagcacgugucaccaugccuggcuaauuuuuaaaauuuuuuuugcagagacaggaucucucuguguugccuaggcuggucucaaauuccugaauucaagcaacccucccaccuaagccucacaaguguugggauuacaggcaugaaccaccaugcccagccaguaucacauuuuuuaguaugcauuucuuugauuaccagcaugguuaaacaccagaucuccuuauuuccuacuguuccuagcuauugguacuuauuuuacccucugagguaacguccuuuucccauguggcaaaaggaaguagaagagaguacacaggcuuuagagucagcaugaccuagaguuuaacccauuuccacuacuuaauuguguuaccuuggacaaaugacagcuuuaaacuuauaucuucuccaaauuagagacgcuuaacacaaaguaggaagagugcacagcaaucaacaacacacaaccaaucgaaaucuauaacauauuaacccucuuuuuccuuuuauucacauggcaguccuuuaaauccuggaagacagcaaugcucuguccccucucaccaacucuccaucuccaucucuaucccugcuggcuaaaaucugagacuuuuuuucuccagagaagugguuucaaaucaccuuaccaaccugcucauuaucuucagagaacaauuuagcugaguuauacccuccuagaacauggcauuuagaacaaaauacuccagauaggauuugaaaagaucagaaugaaaguuauuacuucaaauaacuacaucaaauaaucagucaaauguguuuuccuaauccacauccauaagacaacaagauuuauaauuuguaaacucaaaauucuaacugcaguccacucaucuucccugauuaggcaggccagauuaaaagugaaggucuuggagcacaacaggccuuucuggaaguucauauaauaccuugagcaacuuaaugucuggaaacucaguuuauucuuugguaaaaaugagaguaauacuacuuaaucucacggaguuuuuguaaagaucaaaaacaccaacugggccaggcacgguggcucaugcuuguaaucccagcacuuugggaggccaaggugggcggaucacuugaguccuggaguuccagaccagcaugggcaacauggcaaaaccccaucucuacaaaaacuagaaaaauuagccaggcaugguggggcaugccuguagucccaguuacucaggagggucauuuaaggccgggaugcagagguugcaaugagccgagauacugccauugcacucuagccugggagacagaacaagacccugucucaaacaaaaacaaaacaaaacaaaaaaacaccacacuaauuaaaaguaucugccauauaggaguuacuccaaaaacagaaacaaauacaguugacaauucaauauggguuugaccugcaaagguccccuuacaagcagauuuuuuucaauaaauauacuaagaaauuuugugaagauuuaugaaaauuuaagaaaacuugcaaagcaucaccccugagacagaccaaucccuccucuuccuccucagccuacucaacaugaagaugaugagguucaugaagaccuuuacaacgauccaccuccccuuaaugaauagcaaacucuuacuucugauauucuuaauaacauuuucuuuucucuagcuugcuuuauuguaagacagaauauaauacauacacaaaauuugugcuaaucaacuguuuauguuaucaguaaggcuucucaccaagaguaggcuauuaguaguuaaguuuuugaggagucaaaaguuauauguggauuuuugacugcacggggaguugcagccugcauuguucaagggucagcuguaauuauaauuguuacuaaagcaaaacuacugcaucuuuauuaagaaccacuugccaaguacuuuauaugguccugaacuacacuuuguucuacucaaaauucugauaaguaaagcagacuuugcugaaauuuaguuacccaguuaacaacuaauuuucucccccaaauucuacccugacuugccuuggucuucuccaucucccucuagccaucacuuucugaaaaugaagagccaucccuaccagcagguggaggcauggagcaguguuccaaaauugcuacucaaagaaaauuauaagcaggagaugcuucagugucaaccauacaaucauuggcacagucccuucccuuauaaaaggaaccuaccagcagccaaaauaaagcccugcaaguuuagaaggcucaucuacaaaucuaguuuuuguuccucuccucauaugcugauccuaugaacacuaccugaaugcaaauauaccugaaugcaaauaugcaaaaguaucacuuauuugugaauaaccuuuugaaaagcauguuuggcaacaauauaaaaaaaucaacaaagucuauguuacuuuuaggcaagaauaagccauuuaaauguggaagagaauaaauucaaaauugucucucaauucaaauuaaccauaaaagauaagcaacuucacagccagaauuuaaguuuugaauuauuuuuaaauuagaagauucaaaaugaauuggaguuuuuuguagugaacacagggaauuuaagaaugucuagaucugaaaagaucuuuagucaagagacuucuaacaaaaucagaaauagauuuuacauaaacacauaaaugugauccauaaagucaaacaaagaaaauuaagaaaacaaagaaaaguaaauuccuuaagagggccugcaugcaauaaggcuucuucaucaucuaaauuuacuaggucuuuaauccaguuaaaugacuguuaacgaucuuagacaaaaaugagacagaaccuaaguuuuguccacucccccuuucuucagcucuucuuuucccaaacuugccccuacauucauccucagaaaacaacacaauucucuauaacugcucuggucaauagugaaggaagaggagggaagagaaaagaagagaagaguugaaaauugccucaaagagaaugaagggcaccucucccucuuuccacccaaagugagcucccucucuuccuaacuucugugaagggcuuaauauuuuaccucuugcagacuuugguguuuaagaaggaauuccuggguagacagcauguacagcugauggaacucuaggcauagcaacaaagcaguaaaaucucggcauauaaaucacaucuccuagacugaauguguuccugacaaccuauaaacuagcaauuugaacacccuguuagaacuacacucccacuccaaauacacuauggauuuacauuaauauuauguuugagcauguaucugaaauauaaacauauauuagcucagaagugaaagcuaaaguaugguaguauuaaauuuaaaucaaaguaugaagcauuucugaaaacagaaaugaagccaaggucccaacaaaacagguguuuugagaauacacagguaggaaggucucauaaauauaaccacuucccuugggguaucccacucacuggccacacuagucccuguaucagcuucuguaucuaaguuugcaaagaggcaacuauuaugcuaacaguaauuuggaauaaugcacauuuauauacugauguuggguacacaagagcccuuauaaacaagcacgggauaugcaaauaaaauuucacaaaagagcaaauacaaauagcacaagcaauacuucagaaagcacacucuugcuuacugcaauuuaaaacaaacucaguguaccacacugcaucuacuauaguagcaaaauguuuauaaaaugucuaauaauauaugauuggagaugaaacagacaggaucaccuauuuugguaauaucaaaggauagauccuuuugugaauuucaaaagauguucuuaccuuuugacccaaccuagugauuuuaaagacuuuaucaagcaugcaugaagguauuuauuaaaugaaguuuugcauacaucaacgaaaaccuaaaaacaaaaauguucaacauucagagaauguguugcucauagauuaacaugacuucacucuaguuuauugacaauaccucugcucugccaauugaaaagcugcuagccauauguagcuauuuaaauaaaacugaaguaaaaauucauuuccucagucauacuagccacauuucaagugcccacuagccacauaaggcuagugacuaucaucagauagugcaaaaacauuuccaucaucacagaaaguucuacuggacaucucugaucauauccacgugggccauccuccuuccuccucccccuacauucacccauuugucuagaaacaacugcuucaccuucaguccuuggccuaagaaagccucaacgauuacauaaggcuaauccugauuuaaaccagaaauuuaggcauacaugccuuaucaucucauaacacuuugauaacuccaguauaauaauuacaccacauauaaucauaccauuuucucuaucacaauucuguaagcuuccugaaggaggaaccaacuuuuauccaaggggcuuugaacuauucucgcacucacaggaccuggauaauuugucauauacuaagaacacugcuaaagagagaauggaaauaaugacuguaguugaaaaacgguuguguauaaggaaggguaugcauacaaaggaaaacuugguuaggguggcaguguuacaaacgauuaaaacaacagcagcaacaaaaaauuacuacaggcugaguaucacuauccaaaaugcuugggaucaggaguguuuuggauaucaaucagacuuuuuuggauuuuggaguauuuguguauacgucaugagauaccuuggagaugggacccaagucuaaacacaaaguucauuuagauuuuguauacaccuuauaaacauagccugaacauaauuuuacacacucuuuuaaauaauuuugugcaugaaacaagguuuguguacacugacccaccagaaagcaaaggcgucucaucacucauguggacgaucuuaacacccaugugguugaucuguacuuguuuggcaucaccaucauuucugacucugaauuuauaugcuagugauaagcaaucauuucucacacuuacacaaauguacuuaacaguaaacaguacaacauaccauuaauacagugagaaaauaauguguuuaggguaacuaggcagcagagcagcagccccagaauaccugcaucagcugcucaacaacagcaacaaauaauagcaggcugucuccgugucggcacucagaaaguuucccuuugagggcauuuuggauuuucagacuagggcugcucagccuguaauucuuuacauuuucucaacgcauaacacaaggagccucacucacaagaagcuauucuaugaguauauauuugugaaauauuucuuaaaaaaaaaaaaagacaaaugauaacuuagcaacaauauaaauuaacaauagauuucuaaaaauuaaaacucaaauuucuaacccauauaagauuugcuuccagugcauagaaaaucugacugaauaauucuaacugcagugcuuuggcauacccaucaauguacucacucaacuuucacaucuaccaagaaccuaccuaugcaaaguaccacagauaugauggugaauaagacacaauuucugccuucacaauauuuuuuuuccaaauaugaaugcuauucugaaagacaaaucuuuaaacucagcuaucaacaauagauauccaaaaacgacaaagaacaggcuucaucuacuuuaucauucacuaauucaaaaaacucacauuaaccauuugaaauaguauacauccuaguuuaaaacaaaaaauuaaugccucauuuacuuggcauccuuggaagagcugguguuccauccacauaaaugaauuuuccagguaacucaagcuuguccauuucaguucagcaucaauacuuaaaacucuuuggcauggaaaucuuuuuaaaaacaaaaaaacaguacgaaucuuucaacuuuuaaaaacaggcucuauuaacauuauucugacuaaaaauuauuguguuauacaacacucaagccccucaacuaaaugucccagggugcuuguaaaaguugcuggcuucuaagaguuuuucuucugaucccuggcuuuuggugugucugcugucaaccuuugcugcugucagugugaacugacucuggcagccucccaccccacuucaaauuugcugcuacuugaaaacaaguugugucagaacuuugccuaaaacacaccggcuuuaagacgaucuccaaaucaauuuuggucacucggucuuuucuguguauuccuggaaucguuauggucugcaguuacaaguuccaaaccaaguuuuggauaaaugaauuugugcuguaccuucaugcuccauauuguuuucauauuuaaaacugaugcucagucagagauaauuucauuaccuauucauucauucaacaaauauuuauuaaguaccuacuaugagcugggcuccaauacuauggugacaauaaggaaaugaaaaggaagguugccaguuuuaagcauauuuuaaaguacaaaaacuguaacuauuuuacuuaaugucuuuuuuuuaaaaaaaaaaggguuuuuuuuccuaaguaucuuaaaauuacaaaaccaguuaaacuuuuuauaacuucuguaccuucaggcuuacgaacuaaaaauuuaaggguaaagaaagcauuugauuaaccaaauguuuauuuuacaaguucugagcaggauuccaagguuuucugucuccuuuuuuuuuuuccuauuacaaauucacaucuaggccuaaagaaaucaauaucaacauaugcuuuauuauuaaaugauaugcaaagucuugauaaugauaaguauguccaucucugcauccacuaaguuuacauuuaccacaauguuaauagaaaaaaaaggguuaauugaggaaaauuucuguccaaaguuuaagaaguuccuguauacuucacuuugggguucagaaauuuuuuuaaaaguuguaaggguuagcaaaauaugguguaauucuacaauauuugcuucaucugccacaaucauauuuuuaaaauuccauuacccauuuaaaccuaaggcuggaaaaaugaaucaagaaguggagcuuaaaauuggucucuguggauuaauuaagacaucaggaaaaaccccuggcaucagccucauuuuaaucccuuggaaucuuccuucucauucauuuucuucucagagagcacaagaacuuuauucauguuuuauaauuguauaaauaaucagugauugccuuuauuauucagacauaacuggaaaugaguugcuagucaugugccugcugaucugaggaaguaaaauaauauuuagaaguaaaaaaaguuacuaccauuaaaaaccuuuaacuacuacuauuaaaaaccuucuucagcagugcauuaagauuuccucaacauuaauucuggaaucugaacaugcuuuaagugguacuaaaaaggcagaucacaggucuaaccuucaaaauaaauaaccauguaauauuauucuaaaugacacauuauaguaauuuucacaagucugcucugaccucauuagcauacuaccuugugcugugaaauaaguuuuaguuuaaauaaaaaggauucagagagagacccaaauauaggcucuugcuccuucuacaaacacuuuaggcaaagaaguaaaugacaaauauuuacuagacacuuauuacacgcaaaauuucuaccaggugcuguccacacuaccugcacacacacacacacacacacacacacacacaccuugcucaagauacaauauaacuggagagagaaaauauacucccauaaaagauaguauuagccaauaggaaaaauauauuugauuaauaaaagugaucauuagccauaacuucuggcagcagaaagugagggcacucaguucagauguaaacaaaauucuuuucaccucucuguuuuaagucugacaaucaaaauuagccaaaccuaaggaauugggccaacggcaucaccacaggaaaaaaacagaaaugcucaggagcaacugguauuggaccacucaaagucuucccaugaguguacaucaguaguuucucuccuaaaaucuccuuaucaaauuaaaaacaaaacugauuccuggcuaugaacuuugcagacuuguuccucugauacccaguacagcccagccacagaaacgaaggagucggggagacuacagcaacggggcaucuaggccuauuguucagagggaaccgcaggaccaggcgagcgccgcggggcgcgcgggagcugggggaggagaggcgcgaaccccguacaguuguguguaugggaagggggacagguauguugcaaggcgggggagcacagguguacccuggggccacgacuaaggaauaaagacucaacuuccagaccgaaaaagacaagggcggucauuccugaggcuuaaacugcugggcacagagggugacgagccuggggagggucugaugagaggaucccggaacccaccagggugggguuuuggggaggcuggagaacugaggggggacagccaggaauauucaaagaaaaggcucugcaaucgaaaggccagccuagaaauccccagacaauggacaaugcgcgggcuggggguuguagaggaggugaagcugggugggcagagggaaacaaaagagagaagcccucaagugugggcccggcggcggcgauuaccugagagagcugccggggauuggggcagccgaagagagcggagcuggagcugaagcugauggcuccucggcggcugaggacgugcugggggaccggccuguccaggggcaguaccggcagcugguaacacacuuccauugaauacgcccgcccugccuccgcgcggcgcccgcccugccgcggccgccggccccugcagugggagggggccgcggcucgggggcuccgggccgagacgggggcagggcgggcggggaccgaccccgggcugggaagccgcgcucacgccuccccaaccccagcccuccgcucgggccgccggcgggaaggcuccgcggcggccgcggcgccaauuaccaggacc

SEQ ID NO: 191290 - RNA, 66966 nt, Homo sapiens
gcugauuuagaagaauacaaaucauggcugaaaauaguguauuaacauccacuacugggaggacuagcuuggcagacucuuccauuuuugauucuaaaguuacugagauuuccaaggaaaacuuacuuauuggaucuacuucauauguagaagguaaaccuguuaccugcuuuaaaacaaucaauuucuauuuuaauucuaaacuuauuagugacuuucuuaagauuuaauuuuaauaccaacuguaaugcuagagcacagguauuaaguaaauauuuguuuacagaauccuuuuacacuaugucauuuuucugauuauuauuuggguuauuuguaugcuuugcagcuuugaaaagggaggcaucuuaauuuggauauuccuuuuucuguaugugagggcggucuagcuacagcauuauuagcuagaaguuauacagucaugacugguuaggugaaagcuacuuuuuccuuuaccacuuuauaaauggguuuuuccuaaaauuauaugcacuguugaggaggaugacuauguaagauagcgcauucucuggcuaggaggaaugcugauguuuguauacccugcuacaauaugguuucucuuucucuaaagugauauauagccagauauuuuuguaauaaguugggaguugaguccuauuaaauuuagagaaaguuaugauucccucaaagauguaauacauacuagauauagccaaaagagcgauaaggaccuacugauugugauguuaauacaugauaaacauugaaacauuuuacauuuuaacagaagagaugccucagauugaaacaagagugauauugguucaagaagcuggaaaacaagaagaacuuauaaaagccuuaaagguacggaguuuuagguuuuaguuuuuuuuguaaugcaauuuuucuuccaucaguguguaaauaguuucauagcuuucuuaaccucauacuuaagucucuuuuccacagacuauuaaaauaauggaagucccuguuauaaagauaaaagaaaguuguccuggaaaaucggaugaaaaauuaauaaaaaguguuauuaauaugguaggucaaaguaacucauugcauguggcaugcugcacuucccuugauuguauuauucuacuuucuggugauuggaauuaggcacaagguguauugugugcaaucugaagcuuaaugaauagaaacuguuuuauacuuuuuaacuccuuagcuucuuuuuucucauucauuuuauauuuagucuaaauucuugcuguauuuccaaaauuauaaaucacgguaauuuauaaucagggaauuugccucagcauacgaaauaaucuaauucuggaauccagcuguuuuaguuugcuagggcugccauaacaaaauaccacauaguuaauugcuuaaacaguagaaauuucuuuucucacaguucuggaggcuagaaguccaagauuaagguguguguagguuuaguuucucuugaggccucucgccuuggcuugcaguguccuuuugcuguccucacauggccuuucuucuguguguccuugcaucccugguguuuccucuuauugggacaccagguuggauuagggcccaccccuauuaucucauuuaaccuuaauuaccucuuuaaaguccuuaucgccaaauauagucacacucuaaggacuucauucuucauucuagguuagggcuucaacaugaauuuuggggguacauaauuuagcacaucacacuagccuugcaaauaaaauucaaauaauuuacugacccauuuugaguuaaaaaaaaauuuuuuuuuuaauuuaacacgaguuacaagaguuauauagguacuuuaguaucuucauuauuuuucguggauguauaaaguguuuacuguaaguaacuugccuuuuuauauccuacauuugccaugcugcaacugcuacauauugcacaucuuucucauauaucuuacauaucugcuaaaaugauuaugcugauuuuccuuucuguaaguauuaagugcuauaguauuauuuuccuauuuuucugaagauaguuaauuuguacaauaagaacuuuauguaugguaucauuuucuuggucaguaguggauaucuuucuaaugcaucuugauaucaaaaugcauguacuuaaaaacuuuagcauucuaauuuuauggaacuuaugcauacuugaugauuuaugacuaauaaguaauaagucagaauuaugccuuuauaauacugaucuuuaaaauuuaagaacuuaauuugaauggagauauguauauguaaaaauguaaguacguaaagaaauaugguuguucauuaaguguaaugcugauuauugugugauagaaacuuauuuucuacaaauauaaacauguuaaaguugauauugaauugauuguuaagccuuauuuagagagacagauggauuauuugauauauaaauaauuuuuauuucugcuaacuauaugaugaaaaggacauuaaagugggcuuuguaaagauggagucaguggaagaauuugaagguuuggauucuccggaauuugaaaauguauuuguagucacggacuuucaggauucugucuuuaaugaccucuacaaggcugauuguagaguuauuggaccaccaguuguauuaaauuguucacaaaaaggagagguaagcauauacauuuauuaugacuuuucaaguuaaaauuuuuauuaaugaauuuuaauuagcaaaaaauuuauuuggaaaaaucucauugauugcugagagcaaaauauuuagaauaggaauaauaguggcuauucuaaugugguccuuuaauuccuccauuuuaaacuuaguggugaaaagcuaaggccuuugaaaguuaaauaaugauaacuguacauaugcauauacacagacaaauacauaguccuuuuuuuuuuuuuuuuuuugagacggagucuugcucugugcccaggcuggagugcaguggcacgaucucagcucacugcaagcuccgccuccuggguucacgccauucuccugccucagccuccccaguagcugggacuacaggugcccgccaccaugcucagcuacuuuguuguauuuuuaguagagauggcguuucaccauguuagccaggauggucuugaucuccugaccucgugauccacccgcuucggacucucaaaguucugggauuacaggcgugagccacugcgccuggcguauacacuaucaauaccacaaugucuuagagaagauuacuugcuuaaacuuggguuccagaaauucauacauauacauaaacuuuuauuuuucucaacacagaacagauaccacgguuccauuuuuaucaguuacuguauaacuuaaaauucaaaaauuauuuuagcuuuuuguauuuauuuauuuauuuaauaaauaaauacacgaucucugcucacugcaaccucugcuuucccggguucaagcgauucuacugccucagccucucaaguagcugggacugcaggugcaugccaccacgccuggcuaaguuuuuucuauuuuuaguagagacaggauuucaccauguuggccaggcuggucucgaacucuugaccucacguuaucuuccugccucugccucccaaaguguugagauuacaggcaugagccaccgugccccgcuucuuuuuguuuuuaaacagcauuucaauaugagucguaugagaguuagucccuauuugguuuuguugcugucuuggcauucuuaagcuugccuuguuuacuuaaaauugcuuaggucuuuguacuucuauuguuacacauguuaguaauaauaagcacauguuaaccuuuaauucucuuacauuuugauuuggagugguugguuucaaaacccaaauaaacuuuaaaaggccaaauuuugaaaaauaaucuuauauaaugaugaaaaucaaauuuauucuuuuauuauuuuuaaaccguucucuuuuauacacacacacacacacagacacacacacacacaaccguuggguaaauuauuuacugaauaucaccauuuauuagcuuaaagauuagaauuauauuugguuuaaguguguguauuauauuuacucaguguuuauuauaaaaugccucugaccuguuuuaaugacauuaauuagaaucaucuauaguaguguauggagucugaaaacuuugcuuauagucaguacuucaugucugucagagugcauuuaauauuuguuuaauuugcugagaguaaaguguguuuagauuauguauauugcauaugauuaaggaaucgggaaauauuuuuauugggaaacuugcaaucugucguuuugcuguuuuuuuguugcauauugaaaaaaugccaguaaaucuuuggauugggaaaguugaauggcaagaggggaaaugaaauauauuuagcuugagaaaguuguguuguauuuucuacuaaagagaaagcucacauuuaaaauuguuguauccuucagccuuugccauuuucaugucgcccguuguauuguacaaguaugaugaaucuaguacuaugcuuuacuggauuuaggaaaaaagaagaacuaguaaguauuacgaaacaaauucaaagcguauuuuuuacagcaaaauaaauuaaaauuggcuuuuuuuucuuuuuaguauuaugguuuuauuuuuaaaauauugaaggauaacuuauuauggcuauaccagauuuuaaauuuucugaagaaacaaauccugaagagccuuauaaagagaccaguguuuugucuaggcuggcugaugugaauuaauagaaagauuucauagcaauucuguuugacugucuuguuaccauauuggcuacguugguuauuuaaaguuuuuguuuauacauugcaauuucuuauuaugcaaguucagccugaaaguauucuguugcccuauagaauucauagaaaguuccuuuuuuauuuuuauuuuauuuuuuuugagacaagucuugcucugucacccaggcuggagugcaguggcgcaaucucggcucacugcaaacuccgcuucccagguucacaccauucucuugccucagccucccgaggagcugggacuacaggcgcccgccaccacgccuggcuaauuuuuuuuuguauuuuuaguagagaugggguuucaccguguuagccaggauggucuugaucuccugaccucgugauccgcuugccucggccucccaaagugcugggauuacaugcgugagccaccgcgcccggccagaaaguucuuucuuugguucacaauacuuuguuguuggaacugauggguauuacucugauuuugugggaacagucuugaugugauaaaacuugguauuuuuuuaaaaaaaccaauauauuuacacaguaugguauuaaaaagcaauauauuuaggccauaggaaaggcgguuguuuaacuuacauuugugugaaaucuuuacuaaucccaccucuauaauuuugccuguguuaauaggcaaacuaaucuuuuuuauacuuacuuugacauaaaauuuaauagcuuuauaaaaaucccguauguauuuuauaaauagaaaguauuuagcaaaugcuaaaugugggguaaacauaguuuaaaauuuuguucaaauuaaccauaaagucaguguugcuuaauuuuucuuuugaggucagguuggugacauugguccaucacauggguggaguuauucgaaaagacuuuaauucaaaaguuacacauuugguggcaaauuguacacaaggagaaaaauucaggguauguaaacuuggguauuuuuguguauuucaauacagcauuauuuuggcauggguuuaauaauagcagucuuuuaucuauuucuuucacaauuaaagaagagaaacucaauuuuugcuaugaauauauuuaguaaaaaauuuuaaaucauaagagugguuaaauuuucuuucuuuucuuuucuuuucuuuuuuuuuaaauagagaugggguguugcucuguuacccaggcugcuuucgaacuccugggcuuaagugauccuccugccuuggccucccaaaguguugagauuacauacgugagccaccaggccuggccgagugguuaaguuuuaaguaggcaauggaacuugagugagguguugaaagaugacuaggaucguggggguugguagaugaauaacauuguaggaauugugaaaguagggaauuuacucuugucuaagugccuuuuuuuuuuuuuuuuuuuuuuuuuugagacugagucucucucugucacccaggcuggagugcaguggugccaucucggcucacugcaagcuccgccuccuggguucacgccauucuccugccucagccucccgaguagcugggacuacaggugcgcaccaccaugcccggcuaauuuuuguaguuuucauagagacaggguuucaccauauuggccaggguggucucaaacucccgaccucaggugaucugccugccucggacucccaaaguggugggauuacaggcaugagccacugugccuggcugucuaagugcccuucauaagaacagagcucugcucuuauaaagugguucuaagauuuaacuugugaauauuauaauaggagaaaauacucucacuaggauugaaucuuaguuuaagauuauaguugaaugucuuagcaagaguuuaucauuuuuucuuagucucccuuaguguauuuguguagcaaaugguaauuuuaguguacucuucaauuuacccuaaauauuucaacucauaucuaagguuuuagugacuuagucggaugucuucuucuguagugccaucuugagggucauacuuucaaggaaguaaacgugaagaaaggagaaauagaaauuuaauaaagaugaacuucagagauauauuuauuuaaaauaaggaaacaguucggacaccauggaacuuguuuugaaguuauuuuacccuaacuuguaugauuggaagauaguuugucuguuaauuuuuaaauuauuuuguuacaaagcagauagugaucuaaaacugcaaaaaauuaaguauguuaacuguuuagaacuuccuugaaugcaguuauuuaaggagaaaauucacuguaauguuuauauuuuuagguugcugugagucuagguacuccaauuaugaagccagaauggauuuauaaagcuugggaaaggcggaaugaacaguaaguguuuagaaacucaguaguucauuauguaaauuaaacauucugguuuaaagauaaauccaugugcugaaaaaaguaauuucauagauauaaaaacugaauucagucugaguagcuugaggaauaaaaucuagggagaacaaguuauaaaaaauuauaaaaaauuaaaaauugaaagauaucuuugauaucuuuggauuuuaccuugugaaguaauuuuggcuauuauaaacauucugaaauuauuagauaauagcuaaauaauucuguguauuuggauuuuguuacauauuuuuaaaauuuuguguuaucugguuacauuuuaauuggugcuugaaauuuauugccuuguuuugcuuaguuuuccaagcgcaugauuucuugcuguggcacuucaugaauuaagauuucaugaaaguuaucauuauuuuagauuucaugaaagccuuggaacacaguacauauaaaucuucaaauaauagagaaaaaauuugaaucucuuguaaagcuuaucugugaucacauuuugucagaaguuacuuuugggaugacaggacacaucauuuuuuuaaacugaaguuuuugugagcauuucaggaccaaauauuaaauaguuucaauagauagauuaugccaagaccuugaaaauuacuguagguuuguaaauugauauaccuaacacuugaauuuaaguuaaacugguuuuggaagaguguauuuuguuuuuagggauuucuaugcagcaguugaugacuuuagaaaugaauuuaaaguuccuccauuucaagauuguauuuuaaguuuccugggauuuucagaugaagagaaaaccaauauggaagaaaugacugaaaugcaagguaaaauuuagcauaauguaaaaguuauaucuauuuuagucccuaggccugcuuaaucacuuccuggucaauauaccucuuaaaaaauuugaguuuggaaauaaguagcuuggcuuauuuaugcuuaugugcauuccuuuuuaggagguaaauauuuaccgcuuggagaugaaagaugcacucaccuuguaguugaagagaauauaguaaaagaucuucccuuugaaccuucaaagaaacuuuauguugucaagcaagaggcaaguaauucuagaaugagguugguuuuuaaaaacacuauuaauagcuucucugauaaaauaaauguaaacuguuuauuaaaauguuuuuucucucaccuagugguucuggggaagcauucaaauggaugcccgagcuggagaaacuauguauuuauaugaaaagguaugcuuuuaaccccuuacuuauuuguucugugagcuugauuguuugaaaauaacacuuuucuguccagaagguuuagaagcauguuuaggaauuucagaaugauuaaaacaauugggauaucaaguuaucuuagucuauguagauuuaaguggaacuauucaauguaauguguauuauuuuaaccuaauauauguuguucugugcgaauucuuggugauaacauuacgaacaagaacaucucuaucuucagaaacuuagacuuuuaauggaaagauagauuuguacguaguuaacgauggggaaugaugugugccacaacugaguaauguauuuuagguagccucgcucugagagacucaggagggaauaaaaaggugaaauaaauguugacccaacuuacuaggccaacuagguaaggacauucguuagaaccccaauugggagaggguaugaaagcuuugagaguacauuaaaauaacaaguaguuuaguauggcuuuacagugugggaaggaaggccaacagauaaaacuuaauggauagauagaaucaagaaguuuuuaauacauuaaugagcuuggauauuauccuauaacuauugggagccauugaagaagaguaaggggagagacgucauuaaaaagaugaguuugauaguagaauaucguuaaggaaaaucuaguguuuauggugaaucuuggugaagaguaguaucacucaccaaaaugacaaaguuauggaaguagucuuuaagggaagauuuacuucaguuuaggauuuaauaacuuuguguggaauauugaagaugaguuguuucuguaaaaucuauauaguaccauauuguguucucuucagagucuuugaaaugugaaguucuuaaaguuuaaaaagugugcuuuagauuuagggagagaacucuuaaaaaucaaguguuacucagcacauauuggaaagcauuguguccaggcacugugcuagggauacagcgaacagacugugaauggccccugccuucuuggaguugaugagcuaaugaaggagcagguaguaaacaaguuuacagaugaaaauauaauagugauaguggcuaugaagaaaaaugaggugcuugagguuagacaauuacagucgucucuugacuauuauguuuuaugaaacuuuugaauugccugguagaguguaggguuauaaaauuauugugcaaaauccagauucugucagacuuguaaauauauuuuucucuuguuccugucucaguaaagaaccauggaaguaaauugagcuugugugcuuuugauuacaggcaaauacuccugagcucaagaaaucagugucaaugcuuucucuaaauaccccuaacagcaaucgcaaacgacgucguuuaaaagaaacacuugcucagcuuucaagagagacagacgugucaccauuuccaccccguaagcgcccaucagcugagcauucccuuuccauagggucacuccuagauaucuccaacacaccagagucuagcauuaacuauggagguaauucacauucuuaaaaacuugucuuuaaaguuuaguggaauggaauaauuguuagaauuuagauaaaucccugauauagugaauauggaagucuuugccuuuaauuaccuuuguucuagcuguagagaaaagacacaugaauaguuaagcuuaauaauguugcaauuuaaugacugcuuacuacaugcuaaaugcuuuauacguuuuguguguuuauaauagauuuuauuauuccuguuuuacagaugacuaaacugagauacagagaaguuaaguaauuucuccagggucauauaacuagagagugauagugcuguucaaaaagcaaacaaagucacaggggaggucacauaaauuauggagaaaauagguagaaugaagucagaggagggugaguucacuuugugcugaacugauacagaaaggcuccuauaauucuuccuugguuaucaguauuucccuuucuuuuugauuuuuagucuguaaacaaauguguuuucuagauuuaagaaacaaaaaaaaucaaaaucuccuccggaccucaugacacuuuucacuuauugucccauuuuucuguuugcuuucacaucagcauacuuaaaagaauuacuuugaucuauugucucauuuccuugauucucguuguccuuucaacgcauuccaacugaucugcaguccuuguuggggagacaguuuuuaugcauucaacacaugaauagcuacuccuuuauggacacaauuuuuuuucuuugcuucugugauauuacuuacucauuucucauucuccuuggccuaacuucuuuuuuucaauucuaaauguuguauguuccuccugagucauuguuucuucucuauuguacucucccuaaauuaucguaguaaaaucuaugguuuugaaaagcauuuguaugcugaugacucccaaauuuguccucuucccugucaagcuaccuacuuuguacuuccuuguccaugucuaauagauaucuuaaaccuaagauaaccaaauuagaccuuuggauucugccacucuuaauuccucuguuccuuugcuccucuucaucagucuuuucuguaaaaaggaucucucuuagaugauugcaguagucuccuaaauagucucucccuuuuaauuugugccuuucuauaugcaacacuuagaaaaaucuuuaaaaauauauaaauuagaugaugccacuccucugcuuuaaaaucacuuaauggcuuucuauuacuguagcuuuuaagucccuauguaaucuugcccucaucugccuaaucucaugugguauuaugcucucuaauaaugccuguacucucuaagcuucagucauaccaucuuuguuauucuucaaauauuuuuaguacauccauaccucaggacuuuguuacuuucucugccucaaggaaaucugcguggauugucuguaaaguuaaaucccuccacuccuuucugccaauccugugaccugguaguuguuuuuaguaguaguucuuacgauagaaauuacaguacuuguuuacuucuuuauuauuugauuugcuucaaauaaguaaucuuuaagagaaaaugaaccuugucugucuuauucuguguuuauccucagacccuaguauaaaguggguauucacuaaauacuuaagggaagaacugaaagugaauucaagguuggcccagaaauuugaaaugaauuugagaauauaaagaggagcaaauauacagauaauagcauacaaacugaguuuuuagagaauaauggauagaucaguuugcuuggaauguggaggaauaaaaguuaaaaauguuaauugaggccuaauauuaggucacuuucaaauaagacuguaauaucugaacuguauauugucaucaacaaggaauuuuagaaacuccuugagcagcagagaaauugauugaauagauaauucauagagaguuguucugaagaaugauuagaaggaaggcaguuuggagacagucagaccaugauguaaucuauuacaaucgcuucggccaugaaauaauaaggugcugaaccagaguauguggugguuggaaagaaaaguaagaagcacuggagaaauauugguagaauaaagcaauagggaggaaauaaaaagagaugaaggcaaauuacuaauuuaaaugaaagaaauguugccuuggcauggauaggaaauuuauauuuuggagggagguagugaaguuuuagagaaauccaaguuacauuaaggcagaacuauccaguaagcauuuggaaaaguugaaccagcuugagagggagaucaugauuagaucugagaauguacuaguuuuauaaucauaauggacaauagcaugggaugguaagaggagaacauaaaggacugaaacuugaauaugcauuuuaggagacaagagaacaaaaugaaccaccgaaguaaacagaugugacaacuauacugauauuuuaggugcucuguaaaauagauuccccaguuuguaggucauugucuagacacagaauaauuaaauuagaucagugcaucucaauuuuuucccacugaaguauauucuguaauggcagaggcuucugggucuggugaguguagccuaaaauaauguuugacaagugggaaauuuuuugagauucuguuuuuuuuaaaaagcacucaggggcugggcgcgguggcccacgccuguaaucccagcacuuugggagguugaggagggcagaucacgaguucaggaguucgagaccagccugaccaacauggugaaaccccaucucuacuaaaaauacaaaaaucagcagggugugguggugugcgccuguaaucccagcuacucaggagacugaggcaggagaaucacuugaacccgggaaguggacguugcagugagccgagauggcaccacugcacuccagccugggggacagagugagucuccaucuccaaaaaaaagcacucagaacuccauaguacauaauuguuuucauauaaaagcauuuaaaauuguuuaucauugaguaaaauugaugugcuggaaauauauauuaugguucuuugucaccuauuucuauuuuaugucauacauuccuuuuccuguugaaaaacuugcuauuaggugcuucuauauauaauguuaaaguauucuaaccauauuaacaguaagaaaacagauuuuaagcuuuuauacauuaaaaagauguauauauaucuauagauauguguauagauuuuuuuuuugagacggagucuugcuuggucgccaggcuggagugugguggcgugggagugugguggcaggaucuaggcucacugcaaccuccaccuccuggguucaagagauucuccugccucagccuccugaguagcugggauuacaggcauguaccaccacgccuagcuaauuuuuguauuuuuaguagagaugagguuucaccauguuggccaggcuggccucgaacuccugaccucaagugaucuguccgccuuggccucccaaagcguugggauuacaggagugagccaccgugccuggccgcaaauuuuuuucuuucaugaaauguauaugaaauacacuguugcauccuccuuccacucuguacugguuguuuuauauuacguuaagacaguuugaacuaccaaagaauuuucaguuaauauuggguuuuuugugggggggcuucuuuuugacauaaguauaugacaaguuuucguuauuguaauuguguaaucacaacaaccuuuuccucuuuacauguaaguauuuuuacaucucccuuucuguuuuuuuauuuuagcuguacaaagauuccuauaccuuuuacccagauuucccaaagggacauauucugccauguuugcuuuagcauucauucagucaaaaucucucuuuuucuaaacacagauauaauacacacgugcacauguauuuuuaauaucuauacuguuugagaguaagcugcagacaugaugugccuuuagcuuuaaguacuuaaaugucuauuuccuaugauagagacauauuucuuaaauaacuacauuacuuacuacauuauuauaguaaggaaauuaacauuaauacugugaacuguuuuguagacuucagauuucaucaguuauccuaaaaagucuuaauguccuuuuuagcaaaaggaaaaaguguuuuucuuuuugaucuaugauccaauccaggauacacauuuguuagguugucucucucuagucuucucuaaccuggaacaguuccuuagucuuucuuuguuuuuaauaaccuugacguuuuugaagaguacaggcuguuuaguggaaugccuaccaacuggagucagugauauuuuugaccguuauuuuuuucuggccuuagccuaugagaaaaaaauuuuuuauuggaaaucuguauggugguacauuuauaagaguagguuuucucuccuuuuuaucuuguuaagucuacauaauguuugguauuuauauuuggcuuccauuaaaucuuuccaccuuuuaacguuucagacaccccaaagucuuguacuaagucuucuaaaagcuccacuccaguuccuucaaagcagucagcaagguggcaaguugcaaaagagcuuuaucaaacugaaaguaauuauguuaauauauuggcaacaauuauucagguaaguaugaguuugauugaaaaaugauuucuguuccaguguuccuaaguaaaaaaaucuaggugauauuguuucuuacgagaaaauuauauaaacauaguauuugaacauggauguuaaaaauggaauugugugacaaaaacugcuguuagggaaaugucauaacuguaguauuaccuuuuauuuauccagaaauaggaccauuuuuaauaauuacuuuaaagagaacagaacucaguagaugaucucaggaguaucaaguuuaauucagaauuuugcagguuccuugucaagauacugcauuuauauuuggaagugauagauaacuuuuucugaaaguauggguucugagagucauugcuuuguuuuuaguacuguauauaugugaaaaacaucgccuauacaauagcaaugaagcauaacaguguugauauaaguaauuuuuuucaguaaucauuucaugugacacaugaaauaugcagugguuagucauaaauagauguuaacucauugcuuaccaauauuaaaauguacuauaaaguuauuucugaagaaaacagcucuaaugaauccuuguaggaugagauuauagaagauauuaaggaauaaacugaaauuuaagauuccaaaagacaauaauaggccauuauguugguaucuguagaaagaaggaagaaaucuguuuuagguaauaaaagagauagguugacauacuguuaagaaaaugaaguugguaacaccaagcuuaucuuucaauagaaaacaauagggaguuucugauuuggguuuaguuuuuaauugacuuuuauuugaauucauaaaauaacucauuaagggccaauuuaauagccuuuaaguugcuuguaccauugauaaaauacauggauaagacauggaaagacuucuuacuugauggucauagagaaguuauuuuucaugguuaauuauuuguuuaggagcagucaggguuuuaugagguucuuugcuguauuagcuuuauuuuaagucaccuuugcucuuccuucucaagggaaaucacucuagauagaugaguuucuuguugaaguuuuuauaaugauucaaaaugugguugaguagcaaaaaaucccuuuggcauauacuauucauguacuuuaguagcauuuauugcuuagaaauguaaauucuuucaagccaugguaaaaugcauugaaguuucagaauucuaauuugcauaucaauuaaauucacuaaaacuccuuuuaaaaaaucucacgaaauuauuagacuggagaaaguuucauaccacuuugcuuaguauaaacucaucaaagguuuguuuaaaagauuguggccuaaauucaugauaguauucucuccuuaaaaaaauuuuuuuuuauacagauggggucuugcuauguugcccaggcuggucucaaacuucugugcucaagugauucuccugccucagccucccaaaguguuguaauuacaggccugagccacugcacccagcccaugauaauauucucauuaaagagcuuuguuuuaggacugauauuuuccuuuuuggggggauaggauuuggaauaacuuaauuauagcuuauccucaaaauuaaaugaauauccagaggcuucuuuauuccacauacuacuuggaugccuaauuaauauaaaguacugugcuaaguguuaaagauuuuuuuuuuuaaagaacuuuauacuagaagaggagauaaaacauacacaauuauaauuaccaaauggaagguaucagcauaauaaaggaguuaagguauuagauuuguaaagugagaguuuuacuacucguuuaguuuagggaagguauuggccuggaauuuucuguguguugugcaucagaaaaagcuucauacagaagguaaugaucgaagugaacuuuuuuuucuagaaaaauacaguaauuucacaguuuauuuaauagcagcugguacacaugaaauuuccuuccuuugguaaugccuuuuuuugacagaaguuuccaaauuagcacugauuauuugcaaaaguuauuagauuagcuguacuaucauuuuccuuaaagaugacuaaagguaacauagaaucacagcccuuagauggucauacaaaaugaucauauaagucagagcugguuuaucaccagcauuuauaaaaacagaccuagggaaagguaagucugagacacacgcguggucuuaauauagugaauguuuagcuugucguuacuauuauaaaaucaaaacggugaguauauucauaaugaagugaauuuuaaaguaugaauaugauugguacaaguagaggauauagaugagaagugucuuugagaccgaguaaacaauacaagugaucauucuguauuaucaauagcaaggguguaguaggcauauggauacagugacaguugagaugagauggccuauaccaaucuagagaaggccuuugaguggugugcuauauuaucuaagcuauagaauaauuuuuuuaugagacgagagaucaauaauaucugacuugcauuucagaaagauaacuugguucacuuugaaggaggaauucaagaggggaaauuggggaaucaaugauaauuuagaggcuauuucagcaguugggagagauuuugaagaucugaacuuuuuaggauaguaucaguguugauaagaggauagauuugagaaauauuggaaaaauagaaucuuucauugugguuucaguuuucauuuucguaaugacuaaugauguugaacauauugucuucauuugacaucuguauaucuuuuuuguugaaauaacuguucguguuuuuugcccacuuuuaaauuggguuguuuccuucugaguuuugagaauucuuucuuuaaaauuuuugagauagggucucacucuguugcccaggcuggagugcaguggugcaaucuugauuuggcucacugcagccucugccuucuggguucaagugauucucccaccucagccucccgagcacuugggacuacaggcaugugccaccacacccagcucauuuuuguaucuuuugguagagaugggguuucaccauguuggccaggcugggagaauuauuauuuuuuuugagacugagucuugcucugucgcccaggcuggagugcagagcgccucccaaguucaccccauucucccaccucagccucccgaguagcugggacuacaggcacccgccaccacgccuggcuaauuuuguuuuuguaauuuuaguagagaugggguuucaccaucuuaggcagaaugaucuugaucuccugaccucgcgauccgcccaccucggccucucacagugcugggauuacaugcaugagccacugugcccggccgagaauucuuuauauauuguggauacuaguccuuugucaaacaugacuugcaaaugcuuuuuugucauucauagcguauuuuuuaaauucucucgugucuuuugcugaagaaaaguaaauuuuuauucaagucuaauuuaacaguuuuuuucauucauagauugugauaucauauaugagaacucuuuaccuaaguuuaagucaugaagauuuucucuucuguuuucuucuaaaaguuuuauaguuuuaaguuuuuuguuuauguccgugacccauuuugaguuaauuuuuguauaaaguguuauauuuaggcugugauucauuuuuugcuuauggcagaugguauuguaauaccguuuguugaaagacuauccuucugcauugaauugcuuuuggaccuuugccuaaaauuacuugaccauauuugcaugaguuuguuucugaauuaucuguuuuauugaucuauguauguuucuccccucaugaauacccauacagucuagaacaccacagcuuuguaguaagaagcuucuuugccuuuccauauaaauuuuuagaaucagguuuucuauaucugccagaagcccuggaacuuugauuggcacuaaauuuauaaaucaauuugagggagaauugacauucuuacuguguugauucuuucaauccaugaccauaugucuacauuuauuuagguugucuuugauuucuuucaucaguauacuguaguuuuuagcaucaugaacauauauuuauacuuaaguauuuuauuuuuuuauugugauacuauuuacauuauauuuuccauuuguaaauuacugguauauagaaguaaaauugacuugugucugugcaugcauaugcaugcacugaccuugugucuuauggccuugccaaacucauuguuaguucuuaguuuuuuucuuuuacuuuuuagauugauacaagcagaaacauagauacaaacagaucuucuagcuucaaauccagucuuucccccaagccaagcuucuacacuaacaauuuuaaaacauuuagcacauauauuagauaugucuggaggcagcagauugcuuguugcuuucauccuuaguaacuugaauacaaaaguagaaauuacucuuguaucauacuaacaauuuuaaugauugauugcagaacugugugaaguuuuauuugcuucuaaugacauuucaugacgagcauauguauauacauauacacagguauauaaauggaguacauaaaauagaauagaaaauauggggaaaaugucucaaauuuagggagaguauuuuuuauuauuacuuccuucucuauuaauaucuugugucuccuuuaucacugucuaucuuuuagcucuuuucuuuuucccacaaucuacuuaaacuagucuuuuuucucauuuaguuauuucaaguaccauuggaagaggaaggacaacgugguggaccuauccuugcaccagaggagauuaagacuauuuuugguagcaucccagauaucuuugauguacacacuaagauaaagguaaauuuguauauguuagauugguaguaauuuuuuucagauuguacauauuuauuaugaucuuugagguacuucugguuagcuaaauaaguuuuguaccuaaaacuucuuauucccuuauuaguuccuuugaaucauuugucucuuuguuccagugccucauaauguuuguuguuugcuuuuguuuuguuuuuugagacagucucacucugucacccagguuuuagugcauugaugugaucugggcucacaguaaccucugccaccugggcucaagcaauucucccgcugccuaaguccugaguagcugggaccccaggcaugugccaccaucccagcuaauuuuuguauuuuuuuuguagagauggguuuugucaugcugcccaggcugguuucgaacuccugaccucaagugguccacccgucucggccucccaaaguguggggaucuuagguaugagacaccaugcccugccuuuuuuuuucgagauggagaauacucucucacccaggcuagcgugcaguggccugaucaugacuuacugcaaccuugaccuccugggcucaagugauucucccaccucagccucucccgaaguaacugggauuacaguugcaugcaaccaugccuggcuaauuuuuuuaaaaaaguuuuuuguagagacagggcagggucuugcuguguugcccaggcuggucucaaacuccuggacucaacugauccuccugccuuagccucucaaagugcuaggauuacagccaugagccauugcaccuaaccuuuguuugcuguuuuuuauuuucaguuaauccuacaaacaaguaauuaaggcuuuaugaaaucuauucuguagaaacaugugacucccaguacuauuuuucuuauguuccuauuguuuuugcucuugggguguauauuuuuguuuugcuuuggcuuguuuugaaaacucuaaaccucuaauggacuuagaguucauuuaagucccuucuccauuuauagguagguaaaugccaaaaguaugugagacaaugcuguccucuuuggugaagggccugugaauuccaggugucaaucucuuacacuaaaauaauuccugaacagauuuagcugaacucuuaaacuacuuuuuaaguaaguaguuuaguuuuauuuccucuuauuuuaccuauguaguacuugagcaaaguugaucaguuuucuuuucaaaauaacucacauuaauauuuaugucacauuccaguaaaagaaccaaucggaauuacaggauguuuucaaauauauaagauuguuuuuuauuuuaguauacauuauaaacaaaaaauagaagaucuauaaauuauuuaaaaugauauuuaccaauugcuuguauuuuguguuuuaucaguauugcugaucauauuucaguuaauuucuagaucuaaagagaacucugaaggaaucuauuuguuuaaaaagcuuagaaagcuagagaguuucaggcuaguuaauccuauuccaauuaggauucugaauuuuugaagaggaaaguacucuuggaauauuuuuuguuuuguaagaauuacuggguggcacaaaagcagaauggaaggucaaguagguuuuguggguuuuuuucuuuuuuuuuuuuugagguggagucucacacugucacccaggcuggagugcaguggugcgaucuuggcucacugcaaccucugccucccggguucaagugauucuccugccucagccuccugaguagcugggacuacaggcaugcaccaccacgccuggcuaauuuuuguauauuuaguggaucugggauucugccaugcugaccaggcuggucuugaacuccugaccucaagugauccgcccgccucgaccucccaaggugcugggauuacaggcauaagucacuguccugucaaguagguuuuuaucuugguguuuugccgcuaacuuuguggaucaauuugaauuugugucaguuauuuagcuagucuggacacccuucuuugacaaaauguguuauuuuauguuugcagagucauaaucuuaauuuagaaaaucauauucuuugauucagugaagcuuugaaaauuugucacccuuuaguuuucucaaguguaacuuaauucuuuaagcuucuuuuuuguaaaaugguacuucaacuauuaguuuuucaguuuuuucuuuuuuuuuuuuuuuuuuuuuuugucaucuaggcuggagugcaguggccugaucugagcucacugcaacuauuuguuuuuuuuagcugauugcagguuugucaaauauuuaaaaauuuuaaagcuuauguucuuuucuaccgugaaaccaguacgugccgugaaacauuuguaaaacucaagagaaaaggaaaaagggagagaaauacccauaauuccauuauccaaaaaugucuaaaauuuuggguuuuuuucuuuauccucguaacacauagcaguuuuuuuuccuguuuuaaaugaagccaaccaucuauugagcauuaccacaucuauugagcaagaaguugguauuguacacauuuuagaaaugugaaaccgguacacacagagaauaacuuuacagaggcagucaucuaauaaaugcuggauccaagacuugaaccuuuauuuguauaacuucaaagucuguucuccuaacuauuaaugcuauuuugcuucuuuaaaaucaugcugagauacauucuuuugguauguagaugaauacaccauguaaaugugucuuaaauuuguacaguuuuucguaucaucucaauaacagcauuccugaaaacauuggugucuguauuuuauaauaucacauagugguuaagaauauguaguggaaaaaacggguuuguuuuuuuuuuuuucuuuuugcgacaaagucucgcucuguugcucaggcuggagugcaguggugcagucuuggcucacugcaaccuccaucucccagguucaaaugauucuccugccuuagccucccuaguagcugggacaggugugcgccaccacaccuggcuaauuuuuguauuuuuaguggaggugggguuucaccacauuggccaggcaggucucaaacuccugaccucagguaaucugccugccucugccucucacagugcuuagauuacaccacugugcuuggccugaacaaagcagauuugauugaguuugaagucaggugacuuuaagugcuucaguuuuccuguuuauaaaauggggauaauaauaacugacucaugaaguugggcaaacuaaucuuaaguuuuuuguaguguuaaaacuuuuuuuuacccauuguguuuacacccacugucuagcauuuagauuacuuucgguaaauguuuacuaaaugaugguuguguuaccuuuaacuuucaaaauuaagacuagcacucacuguauuuucuuaucuagguauuauguauacaacuuuagaagccucauccuuacuuugcuuccaaggucuagugagcugauguuuugaguaagaugaaaauuuuugagguuguuauauacaucucucucuuuuccucaguaugaauuuuucuuuuucaagauuaaacaucauuaauccuugauguacaauuuucugcucuuagcuuggcacaguggcugaugucuguaauuucugcacuuugggaggccgaggcaaguggauugccugagcccaggaguuugagaccagccugggcaacaaggcaaaaccccaucgcuacaaaaaaugcaaaaauuagcugggugugguggcgcaugccuguaguuccaacucuucgggaggcugagguguuaggaucgcuugaacccaggaggcagagguugcagugagucaagaucaugccacuacacuccagccugagcaacagagugagacccugucucaaaacuaugcaacuaugaugaaacaagagacagagauugauaggaguucuuuuucuuuuuauauauaucuguuguuauuuuagcguaagccucaaaagaauuguguacuuguuucaggaacccauguauguuggcuuacugugcaaugagcucagcaaaagagaaacccugguuaagauuaauucugcgcuguuucuaccuacuuaacagugcagaauaaaucuuaacaaggaagaaaagaaguaaguagcuuagcuuucuuaagccccaucuguuuaugacuuccccacuuaucuaauauucuugcccaggcuuuggaaucugcucugucucagaacuguagaauuguccguucuuuuagaggaaaaguuaagagaauccuaugagaauuucugauguauuauagacaaggaggaggaaauacaucucagucucuguccuaaauuguaucgggcauuuucccucagaaauguuguaagaaguagugguauuaugaauaaagcuacuggggacucgccugccaaacugagucccccuuucuaauggggaggaacuguggaauaacauggaaucugagucagacaauacugaguuucaauacugguucacagcugugugauuugaggaaaguuacuuaaucucucuaagccuuaguuucuuuauuacuuaguuccugagcuauuagcuaucuuuuuuuuuuuuuuuuuuuuuuuuugagauggagucucgcucugucgcccaggcuggagugcaauugcacaaucucagcucacugcaaccuccaccugccggguucaagcaauucuccugcccuagccuccugaguagcugggacuacaggcacgcgccaccaugccuggcuaguuuuuuguauuuuuaguagagacggaguuucaucaugcuggccaggcuagucucgaacuccugaccuugugaucugcccgccucggccucccaaagugcugggauuacaggcaugagccacggcacccggccuaagacagcaaucuuuauucaacaagcauuaggaauuaaaaguuaaccagaaacagagcagacuauauuucagagugccuaaagaugauuuugcuuucuuagagcaauguucuuauguaaguauuuauuuuacagguuuaugaauuaauacuuguaaagcauuuagaggaaucccuaacagauaguuaugcucauaaaauccucuaugauguaggaauaauuacauuccuuauuuuucagaauaggaaauugaggaacauauagcuuaaauaacuuguccaagggcacagaaguaacaagcccaagagccaguauuuaaaccucaguagucagugccagaauucacugcauuauauugccccaagauuagacuuauuuauaauauuuuucuuucuuuuuuuucuuucaagugcauuucugaacaguucaaucuucccaguucuugaugugugugggcuguuaaaauauucuugcuuugaguuuacuuuuaugcuauugaaaguaguuuuucucgcuuuugaacuuuacuguaauucuuaaauuuuuugucuucaggaucccuuuucauucuuaaagauugaagaaguuuuaccuauguggauuuuauauauugguaguugcuguauucaaaauuuuaaaauauuauuuaacauguauuauuuuuuaacagcuuuacugagguacaucuuacguguuuuuaaauucaccuauuuaaaauaacacaauucaggccaggccugguggcuccugccuguaaucccagcacuuuggaaggcugaggcaggaauaucgcuugaaucuaggaguuugagaccagccuggucaacauagugagaacccauuuuugcaaaaaauaaaacagcuggcugugguggcacaugccaguagucccagcuacuugggaagcuuaggugggaggauugcuugagcuugggugguugaggcuacagugaguugugccacugcacuccagccugagcaaaagagugagacccugucucaaaaaaaaaaaaaagaaagaaaauaugauacaauucaguuauuuuaauaacuuaaccaagugguacaaccaucacuauaaauccacucuaggagauuuucacuacccaccccaaauaagaugucuacuuaaaauuaaucuuuauuucuacacccagccauaggcaaccacuaauguacuuucuguaucuaugauuuugccuuuucuggacauuuuauauauuuaauauguuauacauugauacuauguauauauacauagcauauagauauacuauuugauacacuauauaguauuguaaauauguuuauauaguauguggucuuuuauauaugguuuccucuuagcaugugauuuuuaguucaucuaaauguagcguguuagaaguucuuuuuuucuggucaaauaauauuccauuauauggcuauacuaacuuuaaauugucuguucaccaguugauagacauuuagauuguuuccauuuuuggcuauuaugaauaaugcugcugugagaguguggugugcagauccauguggacauguuuucauuucucuugaguagauaccuaggaguagcauugaugagcuauaugguaguuuuguauuuaaaaauuuuaagaaaaugccaggguuuucccauuauuuuaaaguuaauuaguuaauuuauuuagagauguggucaugccagauuacccaggccggccucaaacucuggucucaagugguccucccacgucagccuccugagaagcucagacccaucaguuguuauuuucaccaguaaugaaugagaguuccaauuucuccacauucuuuaaaaacacuuaucuuuuuuuuucuuaaauuauaaccauccuagugggugaggagacaucucuuguggcuuuaauuguauuucccugaugauuaaugauaagugucuuuucacaugguuauuggccauuuguauauuauuuuuggugaaauggcuacugucuguugccuguuuuuugauuggauugucuucuugaguuguaaggguucucuguaaauucuagauacaaguuuucuugaaauacaaaaguuuuaaauuuugaugaaguucaauguauucauuuuuucugugauuucaguucauaucuaaaaauuuuuuuucuaacucaagauuuugaagauuguuuucuauguuuucuucaaaaauuguuuugcuuguggugaggguuuaaguucaucuuuuugcaugugggauaucuaauuuuauauuaauucacuuaaaauaauagcucauuacaugguaacacaaguaacauucuuuaagaaaaauaauuucccaaacaaaaauaauuaguaaggggagugguaguauuguaguuuuuuuacugucuggcuuaauagaagacugauuaucauaucugcuucugcauucagucuguugcauaucacauaucauguagcuuccagaaaacaacuguauacuugugagagaaugagugaaaaagucaaauaaugcuuuagcaguauuacaaaaauaauuuuaaucucagggaucccacugaaagggugucccagcagucuuuguugaaacuuuagagagucuuuaguauaagagcuuguugauugaugucuacuuuaaaaucacuuagaauuucaauuagggccugucauuucuuggcaucucauuuuaucaucugauuuguuuguuuauuauaaagcuuuuaaauguucuucuaaguuuuuacaaagaaguaauauuuuagaaugaccaugaagaauuaacaaacuaugguucaugggccaaauccagcccauugcguguuucgguuaaaagaaguuuuauuggaacacagccacacucauuuauucacacuuuuaaauuuacugacccccuguuagagauuacaguuuuuaaugacugauguuaaauaaauuaaaaaaaccucauuuuuagaguuucuuagauuucagcagcaggauugaaaguaguuuucuauaauuaauaacaccaaucagcuuuauaguuaauaaaaaauauugaguuaucacaucauauuggaaaguuaggcuuaucgacuuuacauuuuauauuuuaaaaauguuuuucaaaggauguuuucuuuguaguaaaaguuaauuccuuguugaagagaaagaaugggauguucauuauuuuacacaucaaauuaagacacuuuguaaagugcuucuuuccaaugaguaucucagaaauaauaaaaguuguauaaggagcugucagguuuaauuuuaaauauuucaauucgugcuauuucaggaugaucuugaagaccuuauaguuaauugggaugagagcaaaagcauuggugacauuuuucugaaauauguaaguauuguauuucuuuuuuaaguuuucagauuaaaauaugaucucaucaaggacuggcaaggaguguaauuugccuauuuaaaugugagagguuuuaaaacuuugauaugauuguguuuauaaaauacauuggaaauguucuuugucuucugaaacaugccuucuguaugcaauuuaacacuuuaguagcccaagauuauuggaagaaugccaauuaucaugcugugguauaauuguuuuaguauguaucaaguuauuugccuuucauaaauggccacagauuguauuuuuauuuuauauauuauuuaauuuucauuuuaaguucaggaguacauguacggguuuauuauauagguaaaauugugucauagggguuaauuguacagauuguuucgucacccaggcguuaagccugguaccuauuaguuauuuuuccuguuccucuccuuccuccuacccuccaccuuccaguaggccccagguauguguuguuccccucuaugugucuaugucuucuuaucauuuugcucccacuuauaagugagaacaugugauguuugguuuucuguuccuguguuaguuuguuaaggaugaugcccuccaguuccaucuauguuccugcaaagggcaugaucucgcauuuuuuuuuuaauggcugcauagcauuccauaguguauauguaccacauuuucuuuaucaagucuaucauugaugggcgcuuagguugacuccaugucuugcuauugugaauauugcugaauucuaccagauguacaaaguuuuuauuuuucucccuucuuaguugauaacacuuuuugcugucaugucuguuucuauuuaaaggcuucuaaugaacugccucuuacuaggauaagaaccacacaacuuaaguuuuauaaauucauuuuggcaagguucugugaauagaauuuagaaguuucuuugaaucucuuuaaauaggauuuguaaguuucagugccuugaguacuggcauuuauacuuuuauuuuuugagguuucuaacuucuuuccuuacaaaauaaucucuuagguguuuuuucaguuugguugagaauuaaaaauuuacaaauuauuuucucauuuuuuugauaaccuuuuaauuuucucagucagccaacauuguuuuccuuuucuuguuugcauuuuuggguaauuuaacugaucuuuuaauggcgguuuggauuuuugaauaaauaccaugcuuuuggaaucuacauagaucagcuguaauugauauuuuuuaaagucauagacauuuucuuugucauguuuguaucaauacaaucagcuuuaacauaucuuuuguuuuuuuucugagucuuccuguuuuagacuauguauaccaauugauguauuuuguuuagcaauuaacucuuuacugagaaauuuauaaaauaaguuuguucucaaacauagaaauuuacuuuaaacuuuugcauccacuaugucagauugugacuacuaauuauuugacuuuaaguuacauugucucuaagggugacaaaugcauaauaaauaauguuuuuuucccuuuucuuccuagucaaaagauuugguaaaaaccuacccucccuuuguaaacuucuuugaaaugagcaaggaaacaauuauuaaaugugaaaaacagaaaccaagauuucaugcuuuucucaagguaauguguguuucuuucaaauaaaaauuugagaauuauuucugaaguaauucaccacaauuaugacaaaaaugaaguaaauuuuaacuuuaguaaaauguauccauuaauaucuguuaauuuuaguuguacuuaugggugaccaugauauuuagcuuuggaagcuuugauauauucaguguuaggugccaggaggcagcugagugaauaagaauguuauauguggucauuuuuuuuuuuuuuaaauuguggccgggugcaccggccaaugucagccuauaaucuuagcacuuugagagacugaugagggaggauugcuugaggcuaggaguuugagaucauccugagccacauagugagacucccaucucuacaaaaaguuuuuuuuaaaguuuuauguauuuuaguucucaaaacaccuaaugauuuuccagugacauuuguuuugcuuuuaaugauuuuuuuucuuaccaguuccuuauuaugguauuagcauaauuaauauuaaaugugcuuuuucuugugaauaauguagacuuaagaaaaauuuaaggugggauauauaggaguguguagaggaacucacuuuuuauguaagauguuaaccacuggcuggccaagaggacauuucaggcccugaaaaauuauucagccaaguaaucagccacggagaaauuccacuucuucucuauuaguuuguaucacagacacuaaugauaagguguacuccaguaaaaguagggcauauaaucuuuucagaaaaccuuuuuugaaauuguugaauaaauuguuuucagauaaaccaagcaaaaccagaauguggacggcagagccuuguugaacuucuuauccgaccaguacagagguuacccaguguugcauuacuuuuaaaugguacuugucugaucuguuucaaacuacaucagauauuuuaauggaauuguuuuuuccaaaaaagaugaauuucuucucauuuuuagaguuucuuagauuucagcauuaaaguuuauauauguuuugcuuuauggauuaucuuaaaaaauaguuacuggugcuacuaaaauucagccuggccugaaauauuuuauuuguugauuaguaguauauauuuugucuuuucauuuaaaauuuuucuuaauauuucauggugugucacuaauucaaaaucauuuuauauccaaguacauacaaaauuugcccacaaaaucacaaggagaagauaauuuguaugucccgacuuuuuuguagcccuuuuuugaauuuuaguaaaguucuauauacuuggcuuuaugcuuacuguuuuugaccuuagauuguucagaauacucuugaaacauaucuauuuauucuagaacugaacuauagguaucaauagaguuuuacagcagauaauuuuuaugaauaaauuuugccugugguaaaaaauguguauguauauuuuguuacauuuagcuggcuaaggacaguaucaguuuuuauuuuauucuuaauuaaguaugaaaacaaaauuauagccgguaaucccagcacuuuggaagaccgaggguaagcccaggaguuggagaccagccugggcaacauucagggacccugucucuaaaaauaauuaaaaaaaaaaaaagaaggauaacuaaauuauaaacaggaaaaagucuauaauaaaagauauaauuccuaagcuaaaucuacacuaauauauacagcagacaaggaggcaaauuuugugacuguuuaaucuguuauuuucuguaaaaaucuugguuaguauaugaauuauaguacuaacuaaaaaucugacaauuuuuuuguuuuuuagaguuaucuaauacaguugagaauuacuggcuuauaaaaugauuuguccacuauuuaaaacuguucuguuuugcaaauuauaaggagaauauaugaacaaacuuuagguuuccaaaacauugugguuuucuucugauuugcauaccuucauuauuguuuaaguacuuguagaaauucguaaauguuacaaauaaaaugauuucuaggcuuuauuacuauuauuccacaugagagauuagguggacagugguacuagauuaaaccuagauuugauaagaauaugccaaggauggcauagggaacacaaauaaccuggauuagaagagucaacguguuaaguauaaaucucuaagguaacaaaaucugugcuuaaagauaccagaugcucucugugauguagccaugggccccaguaugaaauacaaaauacauuaugauuucugagcuuauugaggaucauguguuuucauuuagcacuauggagagacuuugaggaauuuaggaguccccaagcauuacuugaagggauuggaauagcaguguaagaaaaucaggauuacauauucugaaaauuuagucaguaaaaauggaaaccuuaacagauguguaauaagagagcuuuuuagggaacagugcuuaaaacuuuuuaaaaaauaaggauugaauauuaucuuuaaaaauuagcuguaucaagauggacagcauuuuagucuuagaugagaaaucacugaauuuuuuaugcauggaaaaaacauuguauuauuacagaucuuaagaagcauacagcugaugaaaauccagacaaaagcacuuuagaaaaagcuauuggaucacugaaggaaguaaugacguaagugcauuauuuucaauuuuugauugugccuuagauuucgaauggaauugauagaaaacuagaaucauaaauaggaaaauaucaauagcaaauuuuuguaaaaugucuagauuauuuuucuaauaguguaguuacacauuaaaaugaaguauuguaagaauacauucauuaaucaaaacauuuauuucuaagcuauuaaacuauugugcacagagaauaauaguuuagaaacuugaaaauguuacaaauucccuaauaggcauuuucuucauauaacucuagucauagcuuguuucugucuucauauuaauguguauugcccaaauguaacuugagaaugugaccacagugaaacgaaaagguuuauaauacuuuuucacuuuaauuuuuaaacuuuuuguuuucuaccuagaguucuguggaauuaaauuggcgggauugguuggaaauguauuaaaaguauaaauucaaugaaauugaucuggggaguuuggucauaaacuuaggcugcuuacuauaggucuaacuuggaaagaggacugaucagaaaugaucuucugacuguuaggaucagaguggaaaacucucuuaccauuaacuguuucugguuugccucagagaaggcacuuuaaguggacuguauauaucaguauauuuaauagguuuaauugauuucugagaugccagggugcuucuguaugagaguuucuugaaagacuuccagaagggcucuuaaggagaaacuucguuagcucuagagaggggauucagcggagaccucucucauucucuugagacaguaaugcucaaauuaguuauuaccagcuuuuguugcugcugaauggguuauguaaauaggugucccaagacucccucagauaccaaaaucuguaggugcucaaguccccuacagucagcaucugcagauauggagggccaaguguauauacuuuuuuguuuuguuuucuuuuuugcuuauguauuuuguauguucaccaaccagccaucaugcuuuugcuuuuuuuccccuaggaccaggauaacgguauugagacuauuaugaugauaauucucuguaauuuuucaacaccuuaugguuuaaaauacucuugacacacauuauuuaccuugaucuuuucaacaaacuuuaugaaguaggcagucauuguuuucauauuuuuauaaaagaaacugagagguuguuaccugcucaauuuaucuguuuggaguguagaauacucuacaaguggcuuaugcuauuuguuauuuauguacaauauauuuugguaagcaaagauuauaaaguaaguaaggaaaaguagcaaauagauuagucauuugaccuguugccuuauuuagaauagugucaagcuggcugcuguagggauaaugagcugaaucaguaagacauuaaguuucuugagaacuucuauuuuuaguauaucccuacccuaagugccuuucucauagauuuucaauaaauguuaaauuauaggaccugauauuuuaaugucgaauugugaugcugauuaauaagccuuauagaauuuuaccagaucuaaauucucgagauucuugaacauuuagccuagagauuuaaugcuuauuaugguugauuaaaaccacuguuaccuaucagauauaggaaauaaugacacagcaccaguucacuaguccuugccauuuaagcaaacuaaaaaagccuccuaaaauugaauucuaacaacaucaguuauacaugcuuagauuuucaauauuaauuuguuauagauauguuuuuaguucaaauauggcuuuuuucuuaaacuacacauauuuaaaauauaguuugauuaauuucagcacacauaugcucccaugaaaccaucaccacaaucaagaugaagaacauuucugucacccccaaaauuuacucaugccccuugguaaucucuuuuucuggcccauccuguuuuacccuucccaaggcaaccgucuaucacuguaauuuaggaaugccccagauacuguggguuagguugcaaaccaugacaguaaaggaaauaucccaguaaagcaagucauguaaauuuuuucauuucucagggcauauaaaaguuacguuuacacuauacuauagccugugaauugugcaguagcauuauguuuaaaaauuaauguacauaucuuaaugaaaaauuauuguuaaaaaaugcuaacaggcaggacgcuguggcucacgccuguaaucccaacacuuugggaggcugaggcggguggaucacgaggucaggaguucgagaccagccuggccaagauggugaaaccucgucucuacuaaaaauacaaaaauuagcugggcaugguugugggugccuguaaucccagcuacuugggaggcugaggcaugagaaucgcuggaacccgggauguggagguugcagugagcugagauugcgccauugcacucuauccuggaugacagagcaagacucugucucaaaaaaaaaaaaaaaaaagcuaacaauuaucugagccuucaguaaguuauagucuuuuugcuagugggggaucuugccuugauguugauggcugcuuaccagggucgugguugcugaaggcugggauggcugugguaauugcuucucucucucucuuuuuuuguuuuuuuuuuuuuuuugagacaggaucucacucugguugcccaggccggagugcaguggcacagucucaacucacugaagccuccaccuccucccaccucauccucuugaguagccgggauuacagaugugcaccaccacaccuggcuaacuuuuauauuuucuguagagaugggguuuugccauguagcccaggcuggucaaaaacuccugaacucaagcgaucugcucaccucggcuacccaaaguauugggauuacaggcaugagccaccacagccggccggcacuuuguuaaaauaagacagcaaugaaguuggccauaucaguugacuuuuccuuucaugaaugauuucucuguagcaugcgaugcuguuggauagaauuuaacccauauuaaacugcaaaguuggggucacuucucuuagauuuugacaccacguuaucaacuaagugucuguaguauucuaaauccuuucuugucauuucaacaguguucacaggaucuucaccaggaguagauuccaucucaggaaaccacuuucuuugcuuauauguaagaagcagcuuuuuuaucuguuuggguuuguucaugagauugcagcaauucagucccaucuuuagucuccacuucuaauuguaguccacuugccauuucugccacaucugcaauuccuucugcaauugaaaucuugaaccccucaaagucauccauaaggauuggaaucaacuucuuccaaacuauuaaugucgauguuuugaccucccacgauucacaaauuuuuuuuuuucuucauuuuuauuugugccuucuucuuggccugagcucuggcuuuugguuuuuucucccucgccucucugcugcugaccacugcaggcucucugaaccuugagaguuaccuccccugaggucuccgcuuaugccuccaaccucucaugcucagcuucaccugcccgacauauggucuuaaauggcaacccagauggugaauccuuuccaguagguuuucuuuuucuuucuuuuuuugucaguucaaguuuaauagaaacugcaaaagauaauuggcugaugcccucuaaugauacagcauacaaaucaguggccugccccacaacacagcucaggccauuccuaccaagggaagaaaggcuggccucuguaaccccuguaggaaaggccugcuuuguaacacaccacaucucagcugaaucuaaagucuaguguuuuaccuaugaaaagaaaagaaaagagagguuuuguuauggcuguccacugcagccuggcacugaaaugucccauugcuuacuucuacuuggaaaaauauucuuuguucuuuuggacaucauccaguauguuuucaauugacuuagugauucuugugauucuucugauggaucuguucuaucuguggcagcuauagccuuaugaaauauguuucuuagauaauaagacuugaaaauugaaauuacuccuugauucaugggcugcagaauuggauguugagcuagcaggcaugaaagcaaaauuagucuccuuguacaucuccaucagagcucuuggaugaccagguauauugucaauaagcaguaaucuuuugaaaggaacauuuuucugagcaguaggucucaagagugggcuuaaaagauuuagcagggccggaugcaguggcucaugccaguaaucccagcacuuugggaggccaaggugggcagaucacuugaggccaggaguuuuagaccagccugaccaacauggcaaaaccccaucuguacuaaaaguacaaaaauuagcugggugugaugaugcacaccuguaaucccagcuacuuagugggauuucaacgagaguugcuugaauccaguagcuggauguugcagugaaccaaaauugcaccacuguacuccagccuggaugacagaacaagacucuugucucaagaaaaaaauuaguaaaccauggugaugugcugucauccaugcuuuguuguuucauuuauagagcacaggcagagucgauuuagcauaauucguaagggcccuaggauuuugagaauggucagugaucauuggcuucaacauagucagucaccagcugcauuagccccuaacgaaagagucagccuguccuuugaagcucugaaaccagguauugacuucucucuagcugugaaaguccuagaaagcaccuucuucuacuggaaggcuguuuugucuacacugaaaaucuguuguuuauuauagccaccuucuucaauuaucuuauuuagauuuucuggauaacuugcuguagcuucuccauuagcaguugcugcuucaccuuguacuuuuauguuacagaaauggcuucuuaaacuuccaugaaccaacugugcuaacuucagacuuuucuucugcagcuuucuuaccucucucagcuuuugcagaauugaagagaguuaagaacuuggucugaauuagauaguggcuuguucuggauuguuaaggcuggucugaucuucugucuggaccacucagacauucuucauaucaguauuaagguuguuuuacuuauuauucaugucacuggaguaacacuuuucauuuuucuucaagaacuuuucuuuugcauucacaguuuggcugcuuggugcaagaggcuuagcuuuaggacuaucucuguuuucaacuugcuucucuuacuaaacucaaucauuucuagcuuuugauuugaagugagaaaugugugacuccuccuuucacuuaaauacaggacuuuguaggguugguuauuaauuucaauauuguuguaucucagggaauggagaagcaagaggagagagagcgauaggggaauggcuaguugguggagcacucagaacacacacacacuuaucaauuagguuuguugucucauaugggcauuguuaguggugucccgaaacaauuacaauaguaacaucaaagaucacugaucacagcucaccauaacagauaaaauaauaaugagaaaguuugaaguauugagagaaauagcaaaaugugauagagacacgaaguaagcauguacuguuagaaaaaugacaugauagaccuacuugacacaggguugcuuacaaacguucaaucugugaaacaacaacagcaacaacaaagaaaacacuauaugugaagcacaauaaaguaaagcacaauaaagcgagggaugccuauaugcacuuucuaugauuuuauguacguggagucuuuuaucuggcuuuuuuuuuuuuuuauacucagcauaauuacuuugagauuaguccuuauuguugcuuauuucaauaguuacuuuuauuuuccauuguauggcuauaucacaguucauccauuuucauguugauggcauuuugguuguuuccaguucuuggcucuuccaaguaaagcugcugugaaaauuugugaacaagcuuguauagacauaugccuucauuucucuugaauaaauuccuaggaauaggaaugguaggucagauaguagguuuuuccuuuuuuuuugguggagggggugguaucuuauucugugauccaggcuggaauguggugguguaauguuggcucacuauaaccuccaccucccaggcucaagugaucaucccaccuuagccuuuugaguagcugggacuacaggugcaguccuaccaugccuggcuacuuuuuuguauuuuuuguggagacaggguuucacucuguuguccaggcuggucucaaacuccuggagucaagcaaucugccugccucggccucccagagugcuggaauuacagguggagcuacugcacccagcaagguauaugcauuucuaagaaacugccaaacuguuggcaagacgguuguauuauuuugcauucccaucaacagugugugguguuccagagcuuccacauccuuaccaacaauugguauggucagugauuucauuuuuuauuuauuuuuauuuauuuauuuauuuuugagauggagucucacucugucuccaggcuacagugcaguagugcgaucucggcucacugcaaccuccgacucccugguucaagcgauucuccugccucagccuccgaguagcugggauuacaggcacgugccaccacucccagcuaauuuuuguauuuuuaguagagacgggguuuccccauguuggccaaguuggccucgaucuccugaccucguaauccaccugccaaagugcugggauuacaggcgugagcccccgcgcccagccuauuuuuuacuuuuuuauucuuacuuuuuaagauggagucuuacucuguugcccagacuggagugcaguggcgcgaucucugcucacugcaaccuccaccucccagguucaagcaauucucccgccucagccucccgaguaauugagauuacaggcaccugccaccaugcccagcuaauuuuaguauuuuuaguagagacggaguuucaccauguuggccagucuggucucgaucuccugaccucaagcaauccacccacaucagccuuccaaagugcugggauuacaggcaugagccaccacaccuggccuggccagucauuuuaauuugugacauucuaauagauguuugguugucuuuccuggugguuuugauuugcauuugcaugacaaaugauguuaaaugucuuuucaugugauuauuugcugucauauuacuuucuuugaugauaugccuguucaaaucuuuuguuuauuugaaaaaaaaauuguguuuuuuuuguaauugaauuuugagaguucuuuauauauucgaguuaaaaggcuuuuuuuaaaaaaagauauaugauuugcaaauauuuucuccuaguuucuggcuuguuuuuuucuuuugacaauuucuugaaaaaauaagaguucuagauuuuuaagucuaauuuagcaaauuuuauuuuaauggauugugauuuuauaguuuuaucuaagaaauauuugucuaacccaaggucacaaggauuuuuuucuuauuuucuuuaagaauguuugugguauuagucuuuagguaaaaaucauuuagguguaugauccauuuugaguuaauuuuuguauauggggcaugguauagauugaaguucauuuuuuaaaauauggaaaucuauucuagcaguauuuguugcaaagaguauccuuucuccacugaauugcuuuuguaccauugcugaaaaucaguugaccauaaauguaaugguuuauuucuuuacuuucaauucugcuucauugaucuguaugucugugcuuaugccaguaccacacugccuugauuacuguacuuuaaguuuugaaauugggaaguaugugucuuccaacuuuguucuuuuucaaaauugguuucacuauucugaguuccauaaauuuggcauguggcuuuuaggagcaucuugucaguuuccaaacaacaacaacaacaacaacaaaacuguggggaauguguauaggaauuuuauugaauuuguacaucaauuuuaggaguauuaucuuagcaauauuauuauuauuauuuuuugaaacggagucucagugucacccaggcuggagugcaguggcacggucucggcucacugcaaucuccgccucccggguucaagugauuccccagcgucagccucccgaguagcugggacuacaggugcgcaccaucacaccuggcuaauuuuuuuuuaaguagagaugggguuuuagcauguuggccaggcuggucucgaacuccugaccucagaugauccacccaccuuggccucccaaaguucuucgauuacaggcaugagccaccgcacuuggccuauguuagcaauauuaaaucuucugauuuaugaauauuuccauuuauuuacuuuuaauuucuuucaacuauauuucgugguuuucagaggauaagcuuuggguuucuuguuaaacuuauucuuaaguauucuauucuuuuugaugcuauuguaacacaaaaauuagccaggcauggugguguggugugcgccuguaguuccagcuacucagaggcugaggcaggagaaucgcuugaaccaggagguggagguugcagugagccaagauugcaccacugcacuccagccugggugacagagugagacgcuaucaaaaaaaaaaaaaaaaaaaaauuuucaaaauugucaaaauacauuuuugcuuggaauuagugguuagacaguuuuauguuuguugcugcuaaauguuuuaaagucauggagcuuuaaguccagccuaaaaugaaaugaucuucauguaauucuuugauuuaaacuaacauuauuauugauuuaauaaaaacagcuguaucuuuugaguuauuuacaacauacccauguauuucacuuuagguucuuacuuagguaaauaucugauauuaacagguuauaauuuugauuaauaaaaauaacaaaauaaugacuagcucuaauaccucaauuuucauaaugaaucuaggcauaauugcuaaaaaauuuauguaacuguaaaugggauaaacauuuauaacuaaacuuugcaaguaauuugaaaucuuuaaguuauguuacauuaaauuaaguaauagagagcucauuaaaugccugagucauauccaaauaagagaaaaaacaaaaacgaauugcugaauaaauagguuuguucuuggcuucuuaaauuuuauaaaaagacuaaauauacuuagaucuguuaauacacauaaaauuauaagaggacaauguguuuuuuaauuaaaaaacaaugauuuugucaaauucacagguuauuuaaaguuuguuucaaaauauaaauuuaagaagaaaaaauuggaggaaaaaccagugugggagagagagagagaugcaaagauaguuauggauauaaagauguauuuuuaguuaaauaauaauuuuaaaaugucugugauaaauuuuuguccuaaggcaaaaugguuguuccaguaucaaaaaauuauaggacuaagacuagguguuugagaaaaugaugaaagaucuaaacaagucaaagaggguuuaugaaggcugggcuuuauaaaggaagguuuaugugugaucagguugaugggguuggaaaggauuucuuuguaaguuuuuucuaaaaauuaaacauuggugucaggagugcauugauugauauaggaccaaagucugaaucucuauguuuacaacgaguuuuacuugaaguauugaucagcuuuuaauaaaauugcaguagguuuuaauuuuuaauuccagaaucuguuucuuuaucagccaucuucuaaacugcaggcauuuucuuuuucaauuagcaguaaucgcuccucggauagaccucauuggcuacgauacugccacugcgcaaagcuaaacugcaggcauuuucuguuucgucuuacauuucuuccugauaucuguuuaauuuccucaauucagguuaaaaaugcugucuucuuuauuuaaaauuauuuuaauuaauuaauucauuuauuuauuggagauagucucacccggucgcccaggcuauagugcauuggugugaucucagcucacugcaaccucugccucucagguuccagcgauucuccugccucugccuccugaguagcugggauuucaggcacaugccaccacgcccugcuaauuuuuaguagauaugagguuucgcuauguuggccaggcuggucuugaacucuuggccucaagugauccucucaccucagccucccacagugcuggaauuggaggcaugagccaucacgcccagccuuauuucuuaagguagcauuuuccuuuugaaguuucucagauucauauaucagguucaacugugugugugugugugugugugugugugugugugucagggucucauucugucacaggcuggagugcaguggcacaaucuugacucacugcaaccuccacuucccaggcucaagugauccuccuaccucagccuccugaguagaugggccuacaggugugcaccaccgugccuagcuaauuuuuguauuuuuuuuuuuuuagagaugugcuuuugccauuuugcccaagcuggucucaaacuccaggguucaagcaauccaccggccuaggucucccaaagugcugggauuacaaauguaagccaccaugcccugcgggagguucagcuuuugcugugucucacagcacaugauuuucaggucauacauuguuaccuuuugcuuuuuccccuuuugagaaggcauggguugauaacucuuugcuucagcuuuuuucugucagcuuucauaacuguuuucugugguucuaacucugcuguuauauccugacacuaaaauguucaucuugaaggccuuaauucuuuacuuguggcuuuucaugaugugucugaguuguugcaguuacuguguaacauuguuccuuugucuaauugaauucaagugcucuuuucaucuggcucaacuuccagguuaucuaaaugagcuucccccaagaaggaacaaucguacugcagaaaguuuuucuuugccuuuuugauaacuggccuaagaaacagguuuuauguuuuaucaagaaaauguccuguguugccuuuauuagguuuuugauuacuuaaaauaaaacccauaugcauaauacacaaaagaaacaacagauuuuuaaagguuaaggcuuuuuuguuuguuuuuauccauguagcucuguauuccuucuaaagccuugugauuaucacucugguuacauaaaugacuauuauuucacaaaugaccugugauccuguuuugaucaaaugucuugagacuuucaacaucuuuggcaaacuucccccaaaucaaaucguuuuagucuuuuuaaccuaaacuaacugagauuuuugaggugaaccccugggaagccucaaaagauuucucucaucuugagagauauuaaauuauuaggcuuauuugauaaguuguguaaaagacauugacaaaugauaagugauacuagaucuuuuaguugcauuuguggguauuuguugauauguuucacaaauuguguaaguuacagaaaucuguuauuauaauuuugguuguuaucuuaaugccauguuuaauagagauaacuaaauuuuguugucaguugcaaacuuucaccagcuuuuuaaacuauggcuagucuaaguuuuugucauccgguuaggguuuugaauucuucccuaaaaacauaaucaugaaaaugauucuauccaacaagugcccuaaagucaaguuucugauaacuuuaagaucaauggaauugauaaaaauuuccaaaacucuaauuuaaaaaacuguuggauucacgaaacuacuaaucgagaucaagcagaauaaaaaugaauuauacaagauugaauaacugaugaagauaauguuuuaaugacuuuuauuuaaaauauuguugguucuuuaugcaaauguuuuguuuuccagacuuaagaaaaucucucucaagcuaucuauaauuuacaacaguuugauauaguaugcuuuuguaaauauagauagaacauuuauuuuuucuauuugauuccuccacaauuugaaaacuuuuugagcauucuuuuagcaauauaguuauuuacauaagucuaauagaaaucugcucucucuuuauagcagaauacaauugaaaacauugguuauauuaccaaggcuuugacugaaaugucauauuugacaauaugcauaaaaugccugacuucaaagguuccuagccuuacagugaguaaauuaaaaacugccacuucuuggcagacccaggaaccuuaagacuguaaguaaaauauaaagucugccuugguuugguuuccuagccucaagagguuuuaaaaucugaaauuuuuaugugaucaguguagaaaaaaaguuauauuucuaauaaaaagcuguaauacaccuguuguuagauuguagcucuguugguuguuuuugaguucuuguuaucuaccuauagucuagauccuaaauucuuccagauuucuccaauccagcugucuuccauaaaauugcuaaaaaugggaacuguacuguuucuaaagcccuaucaacggaaacuagauaaauuuuaagaaacaagucuugugccugaugcaugggccacauaaaaaguucaccaaaauaucuuaugcuuuaaucagagacauucaaacugcaaaccagggcaagaagugacauuuuuuuaaugcuguagacagccuuucccaagacaaugaggcaagacuccauaugaugacacuccuaccccucuugaugccuaucuuuuuggcuugacaaaauaaugcuguaauuaaauuucacaaucaguaacugcuauaaguaacuugacaaaaccugaccuaagaaauccuuuuauuccacuaguaacuuuagcaauaucuguaacacaacuuuuuguucaaaauguacuggugguccuuucuguagaguuggcauucuuugcuuuaauucaacccaguucuaaaauacuacucaauggcuacaauuagucucauccaguacccacaauggucuuuugauuuguuuaguugccaucaggcuuguguucuguuucaaaacgauuguacacacuaaauuuauuauauuaauuauuuuuuguguuaugauuuuuaagccuuguuuuuauugcuugucuaaucuuuguaaagccaacucucuuaacacuuugacauggcugcuaauaccuauggaauuaacaagauggaacucagugcuggacuucaggcaaaccugcccugagaaaauuuuccuuucuguccucuuuguuacucaaauguggcccagcucccugacauagacccucuauaucuuccccacaaugugggauagagacaaccaggacagguuuguccaggccuugagggacaauuaagccuaccuucaagaugauugauuagcuuugcugucagagaaagaucuugaucaaaggggggaaaugugagcauugauuauacaaaauuggaucauucuuguuauacccaauuaaaucagaguugagggacagaggggaaaaacacuuggggcgcgugguagcuguucuaauaauuaaauuuuccauaagcccagcugcuuaaaauggccuaguguaauccuaagacugguuuuacuuaauaguugcuaaagcaaccugcuaugacucugacuaguuuuacucaccacuaucacucaccacucagcuugccaguuccccaaaacuuuacuagugucaaugagcuuucuuuaaaaacaauacauaauaacauuuuuuucuaauaaaacucccaaccuucucuuuauuauuagaacagacuuuauuauuugaagaccacuuggucaguauguaugcccugaauuauaauucuuucuuccccaauaaaaaguaaaaugagaaauuuaucguuauauuuuauuuuugacuuugacauuauugcuaucuucaauuuuacuaagcuuuucuuuuguaguguuuacucugauguuauucucauccaguguauuuuucauauaaaacauuguagcuuccaucucuguaugacugauuugggucaucagaaaugaugaccacugcuuccuuuuucuuuaaagucuuauaugcuuuccuuuuguacuuuccuacuucugccaaaguguugccgccuuauauaucacauacauuauuauuuaugguaugauuacaagaaaaucuugaagaacaguucaugugcagaacaguuacagauacaaucaaaucucaccaaaaauucacuuguguuaaaugcagaauuuuguuguuaugaggcuaacaaaaaaugauaacuuuuauuuggucaguaaauaagaucuuucaaaaauaucuuucauguuuuugcuuaaaauguucaaucuuucuugcaguuuuuagaauuuaugacgugaauauaauaacuuuaaauuguuuacuaauucacuuaucucuguuucaauuuuuuuuuucucauuagucuuauuuuccugucauugcaugccugguauuauuuuauugaauucuagacauugucaguuuuacuuuuuugagagcuagauauuuuuguauucuuaaaaauguuuuugaguuuuuccuggcaugcaguuaaguagcuugcaaacaguuugauauuuucaugucuuacucuuaaacuuuguuaggcagaaucagaacaguauuuagucuaagguuaauuuuccccacuguugaggaaagaucuuaguacucuacccugaugucacauuaaucuugaaguuuuccacucugauugauaucacuguuccaugccauaugagcacugagcacuguuaacucugauuuuuuaacgugucuucccuaaccucggauaguuuucuuacacgcauacagugaucagguugagaacuguguacauaaggaagccuucugaaaacaggaguucucucuguacagcuguuuuccaguaauuugcccugcggacuaggcaucugaucacacuggacucccacauuugcuucuucucuuagggauauagcuaggcacuaucugugcuuucuuugcagggaagaaacuuucuuuaggcuauaagccaggacaguuguagggcuuagcuuguuucuguuucacagaaauggauguuaagugucuugagaacccuuguuucuuuguauuuugaccaauuuuuuuaguuguuucagucagaaaaguaaauucauucccuguuauucagucuugucugaagcaguagccuuaguuuuuguuucagugaaaugauuagccuaugacuugguaagacuuacauaaaaccuuauuugaacuuauauugagaacuucaaaauuuuauuagucuuaauuuuguacagguuuaguguauuuuagaaagugcauagggaguauaguaaagaauauagaaaggaauaauaguaaaacauacuuuucugaaggagucuauggauguuuuguuuuuguuuuuguuuuuguuuuuguuuuuuuugagauggaguuucacucuuguugccuagacuggaguggaauggugugaucuugacucacugcaaccuccuccuccuggguucaagugauucuccugccucagccgccgaguagcugggauuacaggugccugccaccauacccagcuaauuuuuguauuuuuaguagaaacagaguuucaccauguuggucaggcuggucucgaacuccugacuucagugauccacccaccuuggccucccaaagugcugggauuacaggcgcaagucaccgcaccuggccggaaguugcuuguuuguuuuccucauccugggcuccauaggcauggaaaccuuuuuaauguaaugggauacuuuuaaggaauauuuuaacugauucacuuaucaaaauaagacauucacaucaaacacaacuugugacaugaguuguguuuguuguaguuuucauguucuauuuuaaaaguuuuaaaaauaacuauuuuucaggcauauuaaugaggauaagagaaaaacagaagcucaaaagcaaauuuuugauguuguuuaugaaguagauggaugcccaguaaguauucuucuuuaacaauuauuaauuuauuuucuucuuguuaaugagguuucugugguuuuaauauaaauaauaucuuggcacuacuuucuuuuaaauuacaacuucuuaaaaauuacuugauaccaagugaucucuuuuguuauauuuucaaccuauacaggcuaaucuuuuaucuucucaccgaagcuuaguacagcggguugaaacaauuucucuaggugagcaccccugugacagaggagaacaaguaacucucuuccucuucaaugauugccuagagguaaagauguacuucacauaguauaauaacacuacugauuuuuguaaguucccugaauauuuaaaaccaagcuuuaauugaagaguaauguagaauuuuaaauaaacucaaguaaucuuuuuuuaaaaaaaucgaggacaauuuaugauuuaauacuguuaauagaaugcuuuuagaggaaggucuaauaagaaguguaaguuuucaugacuucaaaucuaaguuaaaaugaaaauuuauuuccaugcaaauaaaugcuuaggucaagaaaucugauaacuucuuguuucuauguauauuuauucaagauuuguaaaauaauucugaguuuuuugaaauuucaguagauuuuuuccaauaaugaugugguuguauuuuguugaagagggagauaacuugauaauuuacuauuauaaauucuuuaugauuccuugauucuucuuaaaucagcagguuuuagagugaaugaggggucaggugggguauaaugaaucuaauucuaaaauucuuauucaaguuagauuuucuuuuuguauuaccccugcaagcaaauugaauuacauguguguguuuuaacuuguucaucccucuaauauguauuuuuaaacaacaguagugagggauaaaaagaagugcgguuuuccuucaucucagaagagaaaaauguucauuuugauaaaacagacauuaauaagaugacucauuugacuuuucugucacuggaaacuuucuguuaccuucaucaaaaugauuaaggaguuuccuuuucuuuucuuuucuuuuucuuuucuuucucuuucucuguuucuguuucuguuucuuuucguuuuucuuuuuuuuuucgacagggucuuacucucauugcccagcuuggagugcaguggcaagaucacagcucacugcagccuugacuuccugggcucuggugauuuucuuaucccaacaucgcaaguagcugagacuauagacacucgccaccacaccagucuaauuauuuuuaguagagacugguuuugcauguugcgcaggcuggucucaaacuccuggacucaaacaauuuacccaccucagccucccaaaguguugagauuaccauugggauuacaggcgugagccacugcaccugccuccuuuuucuuuaaagucuuauaugcuuuccuuuuguccuuuccuacuucuaucaaaguauugccuucuuauauaucauauacauuauuauuuauaguauagaauacaagggaaucuuaaagagcgguucaugugcagaacaguuacagguauaauaaaaucucaccagaaauucacuuguguuaaaugcagaguuuuguuguuaugaggcuaaaugaaaaauacuuuuuuuuggucaaucauguugcaaaaagcacaaaaguaaagacagucaaacuacuguacacaauugacugucuccugaagugagaaagucaaaaaaucaugagacagauaauucucaacuaccuguuucccucauaaaaaggacuuuagccugcccugauugagaacagaugcuaggcagagucaauuuucaauuauauuuuaucuggauucgcaucaucaugggguuuuacuguauauaguuucucuguacuuuauuuguuuguuuccauuaaagcuuuuauagguuuuuccuguuggagucccuaggucagcuugcuccauucaucuaauagguuagauuaucuuuauuucuuugcuaauccauucugguuuuuaucccuuauuccugagagcuauggcuuacuuuaaauuuuugaucuuauauccccuccagauuccucgcagucuucuguaauugguucauugacuugccauucacuuuaauuucugguauuggucuccuguagcucccaagucccuggcuucucauuuucccuaccuucuugaaucuauugauuuuuuuuuuguucuaucccuuuuagccucccugucuuagaaucacuucaacaaaaacugcuuuauuuauaacauuaaauuuggacuucagaauucauaauaaauauaaaauaaaaacuuauaaucuuaaauaaacuuauucuuuagcuuguuuguuuaggaaaaauaaacaaaacucuuaguaaauuggcaauggaaauuaugguacauucuuaaccugauaaaaaccuauagccaucauccuauuuaauaauaaaugguagaaacauucaaaauggguaaaaucuauguuuucuuaaugacagauuauguuauacugaaacuaauuugggauuuaaggauauauuuaacuuuuaaauguuuuaucuguauuuuaaggguuuuuuuuaaacucuguacuagcauuugucaucaaauuaacacuuguuauuguuuuuccuuucuaaaaauuaagcuuaaaaucauuuaauuguuuugcuuagccaacuguuccucuucuccugaauucuaggaguuucauuuaagauucugucauuccuugauccugucgcuucucaucaugcuucuaguucuuucauaccucugggaccuuuugcaaaauaucccuuggccuuuuuuccugacuuuugaacucuucuuauauaaacaugaacauuucugcuauacaauuacauguuugacuuuuguuacauaguaacucugcuuauaacaacuuuguaacgaauaauaacuaaauaaguuauauauagauuuaugugauuagugcuauuuuauuuuuuaaguauuugguccuuuuucuucauuuuauugacugauacuuuuuuauuuucuauaaucagauagcaagaaaacggcacaagguuauuggcacuuuuaggaguccucauggccaaacccgacccccagcuucucuuaagcauauucaccuaaugccucuuucucagauuaagaagguauuggacauaagagagacagaagguaugccggucggauacauucuugguuauauaaaaauaguuuauauucauuguagguuuaauuuacuccauuuuggcuuuuuuaaauugguaaauuaucuuuaaauauaguuggucagacugcuaaaguaauuguucuugcaccucuaucccaucuccaucucuaggaacagaacugacuuuuuguuuucucaaaugaaaguacuaucucaaccuauaggauacccucaucuguuaaaggucaaagagcuuuuaaauggcuauguauuaaaauagcacccuagccuagccuauugccacaccaaaauuuauuuuuuugguuccuucagaauacaaaauaaccagucuguuaccugcaccccucaucuuaacacuuucacuguuggccaacaguugcauuuuuagggcuauguuuaagguacgggucaggaauagaugugggugcaauaaauaaacucagaguaacugguagacuugauauggagucauauguguauuaaggaauguuuuacucuaaacuuugguaguguuacagagcagguucucugaaggccugaaauugcugaaaauuuauaccuaccuacaacagugucaucuguuuaauugacacccagugguguaugugcauggccauauuuuggauguuaggcauauguuuuuacaauauuuagcucuuuccauuacugauuccucuaauaaugaaagguuucaguuugugagaaauuauucuuuuuuuuuuuuuuuuccuuuauaagaaaugauucuuucuuuguuuuuuguggguuuuuuuuuuuuuuuuuuugagaugacgucuuagucugucacccaagcuggagugcaguggcgcaaacuugguucacugcagcucccgccaggauucuccugccucagccuccugaguagcugggauuacaggcguguguugucaugccuggcuaauuuuuuuguauuuuuaguagagacgggguuucaccauguuggccgggcuggucuugaacuccugaccucaagugauccacccacuucggccucccaaagugcugggauuacagguaugagccacugcaccccgccaagaaaugauucuuaaagaaaacuugaacagcaacuuccugcucuuuucacuuaguugacaaauucuggauuuauuaaagguuacauaguauaguugucccuugguauccacgggggacgguuccuggaccucccuugguuaccaaaaucugggaugcucaaguccuggauguaaaauugcauaguguuugcauguaaccuauacacaucuuccuauguacuguaagucauuucuagguuacuuauaguaccuacacaguguaaaugcuguguaaacaguuguuauacuauauuguuuagggaaugaugacaagaauaaaaagucuguacauuuucaauacagauacaaucuguuuucuacuguuuuuuucuacuauuuucggucagcaguugauugaauccacagaugcagacccacagauacggaaggcugacuauauauuuguuuuaaaaaucuucauuuuuggauuuuaauuauggcagacuuuguuuaaaauagguuguauuuuagcaucuugaucgugcaacuuuuguaacacuuaauauuuuuaucauagaaaauauuaaaugacauggauaauacuguuuacuuaaugucauuaacuuaucaucaucauuaguuccuuacgugguauacuauauuguguuuucaguacuucaacuuaauauggugauguucuuugucuuauuaaaaauaggacaaggaaaguggagaagugauaguucauuucauuggaauuucauugcucugagggaacuaaacuugcauacaucugucauuuuccaaggagugacacuuaauguuuaugguuauucuggaacccuagauugccauaaugcuuuugccuugcuugugaggccaccaacagagcaggcaaaugugcuacucaguuuccagaugacaucagaugaacuuccaaaagaaaacuggcuaaagaugcugugucgacauguagcuaacaccauuuguaaagcagaugcuguaaguucuuaaaacaguauuauaaugaaaguuuaaauuucaugacagugcauucagacuaaaccuguacauuuuuaaugacuuguuuauuaugaauggagaguuuuaguuuuguguauauuaaaaaaacugauguaauaaguuguuuuagaaaauauuuuauauaguguagguacacaaaauauuauuugaguucuuggcuuacauaagguaggcccucauagucuuauagccccuguggcucugauucagugaagauuuugggacuucuuguaauguacccugugauuuuucauugauacucuuagacauggcuaaaaauuagagaguauuuagagaugggguuucacuguguugcccaggcuggucuugaacucuugagcucaggcagucugcccaccuuggccucccaaaaugcuaggauuacaggcgugagccaccgugccuggccaaaaaaaaaaaaaaaucuuauugaaagcaaguugaaaaugaaaguugccaaucuauuuuucucaugugaaccucuuaaaaaugaaaugcuaucauaaauauauaauuaucauuauacuauacagauuaaagugaaaauagaugagagaaucaaaauagggaaguuaaaugacuugccugaaaucagguaucccuggaugaaauccaggucccuaaaagauaauuugauuucuuccucucuauauaugagagagacacaugugauagacagauauagaccucuuacucuuugcacaaaugacauagauugaagagaauauauggauauaauagaugacccuuuucgguacaaugguacuguaacugagauugcauuggguguuucugugggaaugaaacauguaauuacaguuaagugugaaaccuuggaagacauuuagguuuaaugugguuuauaaaguaaguauucauugaugaaaaccuccuuccaaaguauuuagaacaauaaucagacuuuuuguuuguguguguguguguuuagauuucuauggaccaauaauauguucuuauaaauaaaaaauuguugcacaaaagauucagagagggaaauacaaugcuaacaaauacaauagaaugcuagcuagaaaaaugauggagaccacuuuuguuauaaaucuuucaaaacugcucauuguaagguuuuuuuuuguagguauccauccacuuuuucuagguauccauauauaaaaugguuuuaucuguagaaguuccuuaaugcagaaauuacuccugcucuuaucagaaugucagacuagauaguuuauagaguccuuuccaaacuuauaacccuaauacugaaaugaaacauuaacagaaaauuuuucuuauaaucuauugaauuacuagccacaugauggcuaauaguacuagaacugaaauauaauaacauauggaagaaauucauaaguaaaauuagccacaagauggcagcaaacguuuaacuauguucugacuuauccuuacacuacaaaauucuuucaaucuauugaaauuuuguucuuaagaaauacguuuguaaauucagguacucggugacuuugguugagcccuuuccugcguuuaaaguucuacauauaguaaauguuuauaaagcccugagaauuuuuccugugaagauaauguguguguauaucuacacacacacacacacacacacacacacacgcacacacacacgugaaagauguaaaaagauauaaaaaucucugauucuuugaauuaguaauuuuuguuuuugguacccuguauauauauaauuuuuugguacccuaaguaaccugagcuuucuuaauuaaaagaguaaaauaagcacaacuaauaagcacaacuauuuuauucuauacuauuucauuugucguguccgcucauuaaugauguaagaguuaaaauuaucaggcugaaagaaaaguuaaucugauaccauuaaguuugaaccuaaggccaagagcaugacugacugauucuuggucgaagcaucuuaaucgacuuucuccccauggaugucaugucccauauuuuguuauuucagaaucuaaggauuaaaguuuaaaucuauugaagaucuuaugucucagaauccuuauguauguauuuuuggucucuugccaacauguaaccuuuaauugcauggucuguacucuaacauucauauauugccuaagauaagcugguagcuuuguggaggccauuaugauuucugaccucuaaugucagaaguauaauuuuauuaauaaguaaauuuaagcaacgauaaccuuucccgaaguuugguuaguuuaaaaguaacuugauaauuaaaugccaugugcuacaauuuaguacuuuugccgcuaccuuuauauuucuuuugaaauuuuucaaaacuuuucaaaacuuauccuacaaugguuaaauaaaucaccauuggcuacuuaagaguugcaaucuucauucugaguuuuuaaacuuguaaguagaauuucuaacugcaugagaaauagaccaacgauuggacauauauuaaaaguuugugcuuguaugccaauaauauuuauaaugaaguuaguaugauuuguauuuaaaacuauaauuauucuuccauuuauuaggcauaccuaguaaguuguuaguauaaaugucuguuauugauaccacuuuaauuuggccaaaucagaagcucuaaguuauagaguuugaggaaaacacugaggcacaggcuaaagggaggggacacgugauaguagauaggaucuggggguuugaagacuaggguaagaggagagcuuagggaaaggggagaagugucucauaacucacgaguaaacagguuaauuggcuuaagaugucaaaugcuagaaaauuuccugggaauuaacacccaugaauaggauuucaaaaucuauagcugaggcucaguuucuccugaaauuaauauuauauaucucagugggaaagauugacuacuacuuuuuaaucuugaacucagcaggucugucuucagguacaugugaauuuggaguugauugaaaaacuccugcccuuccaaagcuucuuuaaugcuugacauacuuugaauaagucagaaaauguuuuuggaauuauaguaaguaucuauuaaaaauguguguucucaaguccagcagaacuuaaaaguaaauaaaaauaaaaaugaguuuuggcuaaucuaucaauuuuacuuuuauuuuauuuuauuuuuucguccuuguccugguacauauuauauuuuagaaauuuagggaaauagacuaaaaagcagaaaguuuuuugucuucguuguuuguuuuuaaagagagaaugagaauuauugagaaagaaugaauaacaaauaaaccuaggacuacugaagauaaguuuccccgacuuugcacuuuugccugugauuuacccuaucuaccuuccucugugcggagagcacuaaaggaaguacuucauauuuguaucuuagcaaaaauaauauauuuuauuauauucuuagccacuagugaacuagcaauauguucacccuuucagucauucugaacucagaaucuucuagaaagguaaaaaaucuuguaucuaucuuucccuccccuaagucagaagcaguuuguuaguucauugagagaaagcaugaagccccugguuccauuuuuaguucauugaugguuauuaauacuuagucauaguuaagauaacaauagaaaaaaaugagaagcuccuuuauuagcauuugcuaaggauuuaaauuucaggggccuucauuaaaagagcauuucagcaaaauuaaacacacuuggaguuuaguuucauuacauauaaaaauggauacauuuuacaucaaagaguaacuuaccaauguuuaguuuaauagucaugcuaugauuuuuacugucuauuaaauugaaggauaauauuugcacauaagaaaaaagaucaaauauacaacaguauacugcaguaaaauaugucucauaccccugucuggcuaaucugucuuucuagggguaugacuuuugauacuuucuagaaauauaagcauagacauauguacauucuucaaaaauguauuucuuuuuuuuuuuuuuuugggagacaaagucuugcuucuguuacgcaggcuggagugcaguggcacaaucuuggcucacuacaaccucuaccucuggguucaagugauucucgugccucagccucuugaguagcugggauugcagacgugcacgaccaugcccggcuaauuuuuguauuuuuaguagagacgggguuucaccguguuggccagccacgcuggucuugaauuuguggcuucaagugaucugccccccugggggccuaucacagugcugggauuacaggugugagccaccaugucuggccaaaaauguauuuauuagauuuauuccuaaguaauuuucucuuuagaaugcagucauaaauggauauuuuaccuguuucuaagcuguuuuguaaauaggugacucuuugguauauguguguuauuuuguaaucagucacaguuaauaaauuaucacuguuuuuaauuauuuuccagcuaauuuuacuggaucuuucagcuuucaguugaaaaaaaaagucauaaguuuaccaauugaaaggagcauugauaaguuacuuuauaguuuaaaaauaaaacauaacagaagaauauacuuuugauuuuuaauucauuuuauuuauaaugacauaauuguacauguuuugggguaaaguguuauguuuuguugcauguauacaucguauaaugaccaaaucaggguaauuaccauaucacuguuuucuuuaaggaaaauauauuuaaaugucaaaacauucuuuucugaauuugccucuauaucuuauggacauaagaaauucuaucaaauaguagguuuuuaguauauaucuguugauugaaugagauaaaaauugaaauaaaaauggaaugaaaucaaagcacaauuaaguucauaaaaguaaggauacaacugagcuuauccauauauacaguaguauaggaaaugugaucccucuacuaugagauauaggaaauccuaguaguguaaaaccuugcagauauguguggcagagcuugaaucacauuccucagugcuuuguuucuuacagauugacauaagguaucaaauauucaguuguuuuacaaacgauuaccuagauaguucacaagaaccaaccaaaaacuauuagaauuaguaacagagcuuaguaaggcagccaaauaaaauauaaaugcauaaguaucaagaguuuuccuuuaugcuggcaguaaccaguuagaaaguguaggaaaugaagaccucuuuuccaauaaaauuugauauaaaauaucuguaaaacaugaaaaaaauauauacccaacuaauaguuuaaagcaauacagauaaagauagcauuauaucaauuguuuuuacaaaucacauuguaaaaaaaaauugaaggagaccauugagggcuagugaggcaggauagauucuuuccuguucugacagaguauagguugaagcaguauacccuuuuuccaucaggaacuuuucauauucugcuuuucuaccgcuaguguucuaguauagaaaauuaccaacaugugguuuaauauuuucguauacaaagacauauacuuucauuuauuucuuuuuauugugguagaauauacauaacauaaaauuuaccaguuuuaaccauuuuuaaguauauaguucauuggcauuaaguauauucauacuguugugcaauaucaccaccaucuguuuuucgagcuuuuucaucuuccuaaacuggaacuguguacccauuccacaguaauuccccauuacugcacucuaaaugcucaaaaauaguggaaugauuaaauuaauugugguauaaucagagauuugucagcucuucauuaagacuaaauccuuugagacaaaaaauuacagcuaauugaaaaacauaagauacaaaacugaauaauauuccaguuuuguuaugaagaacauuuuauacguguagaaauauaucucuuaagaaauauaccaaaguguagauaguaauugauuaggagaguuauggguaauucguguuuucugaauuuuucuuaacucaaaaaguaacauuaaauugaaacaauauugacauuuacaaguacuauuaacugauuuguacaggauaagcaaccuagaguuauuuagcaaauugaucaaguggaaagagagguucuauagcaggcagaggggaugugguuguucaaaugacaaaauuagggaagcuuuagaauaacaaaagcugucuaucuaucagugguggagagcugaagcaagcauuauaauuguugaguauaauauuuaacacuuuguaaagaggcuuaacauuucauuucaaaguacuucuaugcauuauuuucuuuuagccuuaugauuacuauggguuagguauacuagauauauucuacauuuuuaaaauagaaaaaauuuucagaagaaacaacuuucacaagguuguuuuuucucugucaccacagaaugaauagucuuauagugccagcauaacaaggcaauuuggcuauucauagccuagauuuauaaauuuaaagugcaaauugcuuauaggacuauacaaaaucauuuugucuaacuugcuuucuucugaaaauccaaccauaauuugggcaaguaauauuuuuaauuacuuagaaauuaauugucuuguuuaagugguucagugguucuuggccuauaugagguauuuuuaaaaauuuauuuuuaauugacacauaacuacauauuuauggggcauaaugugauguuuugauacauguauacauuguguguugaucaaaucaggguauuuagcauauccaucaccuaauauacucauuccuuuguggugugaaccuucaaaauccacuauucugguuauuuugaaauauacaaugcaauaauguauugucaacuauagucaccacugugcaauagaacaacagaacuuauuucuccuuucuaacuguaacuuugugccuguugaccaaucucacuccagcucccacccuauccuguccuccccagcaugucagcaguggcugaccucacagaaguacacaguagacuugugguuauaugaggucuuugauuccuuugggaaugugauacaagcugugaacccacucuucaggaauaugcccuuugcacguguauacacaaaauuuugcacccaauuucuguucauugucacccuaccggcucuugaucacagguuuagaaccucugauuuagaauccuuacaaaugcugauugaggacaaaaggguaaaguaggagaaagucuaaaucuuaauuugaguuuaugucaagaacaguguuugugguauugguuuuguagccaacuuuauacuucagcauuaaguuuaagucugcuaaauuucuaacuuguuucagaguuguuagauuuuauuuugaggucuauuuccaauugcuuugguauccaugacccuuacaacaaauuacacauuuacugaaugcuuauuuuucacuauccuuaagucaguacauuucaggguagaaguuauaucaagcacaugaaaagucuugaguagcuucauuuauaaauacucccauauauaaauaugcuuaaaaguuugauuuuuagaaacaguuguguguuuuuaagauaacaaaaaguauuauuuuucaauaggagaaucuuauuuauacugcugauccagaauccuuugaaguaaauacaaaagauauggacaguacauugaguagagcaucaagagcaauaaaaaagacuucaaaaaaggugaguuuuagugaaaguauuauuuagcacaucucuaacauauuuuccagacuauauucaaauaauauugcugcaaacaccaguauaaagauaguuuauaaaacaaagcuguucuucgguucuaggaaaugacccacagaaacaauaguuuuacuucagugacuuccuugccacaguaacuauaacuuguuaucccucccguuacuguaauaaugaugcuucugugaacuauccugcaguagaaauguacuguugguguuuuagauuuaaauaugugugcacucaucuuaaauauaucgccacaguuauuuucagcaaagggcacacgguagucaggggaccugacuaucuauuccugacucuagaagucuauuuuagucuucucgugaugaagauaacuuacuuaccuuaucagaguuguugaggauuacauaaguauguugauaauaggcuuuuuuaaaguagcacuagaauuuuaguguucuaagagagauuuacagccauauucucuacugcuagauuuacaaguuuuguuuucuuucccuuggugggggggcuuuguauuuuaauaauuuuuguaucuccuaucauuuaacauuuaugauguauaagagaaaaacauguuagauuauuauucaagugaauuccuucacucuuucaauaaagaaauggagguugaggggauuuuuggauuagaaaucucacaacuagacuggcugaaucagagaagaacuuaggucucuucucucccaggcuagauuucuuuucuccuccuccuuccauuggacugcagugcucucuaaaugaaaguuuaaauagucuacaaauuuccucacuguuuugugccaaagagauucuaauccugccacauaguacaguagaaaaacuuuugccauauauuuggcuuuuuuauguuuaaauauucucaucagcuguauugaauuugucuagguuuaacuaauuguaacuuaaacucuagguuacaagagcauucucuuucuccaaaacuccaaaaagagcucuucgaagggcucuuaugacaucccacggcucaguggagggaagaaguccuuccagcaaugauaagcauguaaugagucgucuuucuagcacaucaucauuagcaguaaguuauuuugauuuaaugggguaaaugacuuauuuaugaaguuguuauggaauuuguuaacuucuaaaaauuggaaauauuucuuccauuuuaaaaaaauuuuaauaauuuuauuuaacccaguaugcuaaaauauuaucauuugaaugcgaaucaauguaaaauuaucagugagauauuuucauucuuucuuauguacuaagucuuaaaaauguggggugcaccuuauacuuacaaagcuggcugcauuucagacuggcuguguuucagggguuucauagccacaaguggcuaguggcuccuggaaggacagcacagcucuguacacuagcacugaagaaucagcauggaaagcaugaugcuaggggagaggaguucuccccuagugcacuuuaaaccuuggcauccuaucauacgucauuuuuuaaauauuuauauccaaaccucuaaccucuuuauuggguaaaggcaacugagaaaacccuacuaugaaugaacuagagacauacuuaauguguaguuuauuugauaggaaauuuuacugggauugaaauauguucuaaaaucucugagaaaagaaacgcguuucaaucuggccugucacuuuacuaauguaaauagcuaugauucuguuuauacagaucgguuccaaugacauagcagagaccgaguuuuauuccuuuuacuauuuuugugaugaguagaauauaaucucugaaacuguauuucagaggaugauacgaguucuaaauucauguauauuguauauauauguauguauauuuaaaguguuuccugaacaauccaaauuuccaacaguuucagaauuauuauuagauauuuaauacuacuauuacuaaguauuugagugaaauaucuguucuuuauaaaauuauuaaccuacugaaguuaagaaaagcaagugacugucauuucuuagcuguguguccuguagcaaguuucuuauucucucaacugcauuuuugcagaugauguuauauacugaggggcaauuuggguggugauuaagagcauggacucuggaacccuaguguucaaauccuugcucugcuauuuacuagcuguauguguuuuggcaaguuauuaacaaucuguuucaauuucguugucuguaaagugagucuuaaguaguuauaaggauuaagcgaguuauuauauguaaagugcuuagaacaguaccuggcacauugugagugcucuugaguuuuauaagugauuucuuuuuauuuauaaaauuuccgcagguaagacacauaaauaauacucauuaaauauauauuuuaaaguugcuuaaagucuucaguuaacacaucaaagaguuauggcuaaaucuauuaguguauuuauacagguuuuucaucaacauuaaucuuaaccaaugggagagaagcugcauuuaguugauaaaaugaauauaugcaaaguaguuuggccaauuaaaauugacaaaugcagauaaacauuaauuugugaaaauuagauuauagcuuucucgaagccaccuguagcaacuauuguaaacauuuucaucuuucaaaugaaaauaaaugaauuuuauagaaaauuuuagaaaauuaauuuauuuaugguuaugucacuuuuaauagacagcauauguaagaagcagcuaaaauaccuucaagacauuaaugucaucuucucaauugcuuguuucuguucuaacagauuacccauucuguuuccacaagcaauguaauuggauuuacuaagcauguuuauguucagcgccuaaacucuacuggugggcgcucucaguacuccugguuucaaucuguacgucauucugcuuuccgagcuaguuuuucagagauacuagaaggaaauacugauuuuucaaauuucaaaaaaguucuuuccaagucaucuuugacauuugugaagaauuaggagauuugccaaccacuaauggaaacaagccucaugaaguuuaaugugagcuuauuagcuauuuaaaauuuguauuugcgggaaaaaaaaaaggaacauauuuuuucuccaaggaaucacuuauuuggugggugggaacuuuggaauucacaauguuaugacugcuuugaauuaauaacaauuuagguuuaauagaguuucuuaaguccagaaaaaauaaguuccauuagaaauuuucuuauuuaggaaaauuaucauuuuaaagaauaguaauugucaugaguaguggauuuauauuccaaaucugauucuuaauguuagauuuauagcauuuauagaaaauuaugcuuuuaauaugccaaaucauaaaaguuccaugugaggaaaguguaaacuuuuauauuauacauucauaucaucauuuuguugauacuugaaugguuauacuucaucaacccagcuuuuuaaaugcuucauuuuacaaccuuguugaugagaacuuaagccaauuaccuuacuagcucuuacaguuagccauuuauauauguuaaaacaguagccuuauaauuuauuuugauuuacaguuauucuugagucuuugcauguuauuuguuagaguuguuuuauuuuaaaauuuuuaagacuucucagggauguaaaacuuagcaauuuaauaaucacuguuauccagaaggauugcuguuucacucaauuuuuauacggaacgaaauuuuaaaaauuauuuaaaaauauuuuuuagagaugggggucuugcuaaguugcccagucuggucucgaacucuuggccuuaagcaauccucccacaucagccuccugaguagcugagauuacaguggaacaaaauuauauauacauauauacacucugacacucacauauguacaucugaguuguacauauauuacaaacacucuuugagaguguaugacuuaauuuuagaaaauuauuucccaugaagugauuucauuccuuuuaauucugcuuuaugaacuaagaagaaaccuuguuugccaauuuauaauuuuuucuuuuauaaccugaaacacugaaucauuaauauuucauaaaacaaaguuagguaucacuacuagcaauaggccaauaucuguucaguugaguuaauaucuaguuaacuagucuagcuauuuggcuuuguucucagaaugcuauaauaguuuucuuuuuucucccuuuuccauuccccuaacuuuaaagaguuuagaauugucagaugucuuguacuuaauuguuacaguaauuuguaaaauguaaaaauaauaggcaugauacugaacuguauuuuacaauuuuuuuaaaggaaaauuuaaaauaugaaauguuuguuuugucuuaacaggguaucccuucucccucccuugucagccuuccuuccuucuuugaaaggagaagucauacguuaaguagaucuacaacucauuugauaugaagcguuaccaaaaucuuaaauuauagaaauguauagacaccucauacucaaauaagaaacugacuuaaaugguacuuguaauuagcacuuggugaaagcuggaaggaagauaaauaacacuaaacuaugcuauuugauuuuucuucuugaaagaguaagguuuaccuguuacauuuucaaguuaauucauguaaaaaaugauagugauuuugauguaauuuaucucuuguuugaaucugucauucaaaggccaauaauuuaaguugcuaucagcugauauuaguagcuuugcaacccugauagaguaaauaaauuuuaugggcgggugccaaauacugcugugaaucuauuuguauaguauccaugaaugaauuuauggaaauagauauuugugcagcucaauuuaugcagagauuaaaugacaucauaauacuggaugaaaacuugcauagaauucugauuaaauagugggucuguuucacaugugcaguuugaaguauuuaaauaaccacuccuuucacaguuuauuuucuucucaagcguuuucaagaucuagcauguggauuuuaaaagauuugcccucauuaacaagaauaacauuuaaaggagauuguuucaaaauauuuuugcaaauugagauaaggacagaaagauugagaaacauuguauauuuugcaaaaacaagauguuuguagcuguuucagagagaguacgguauauuuaugguaauuuuauccacuagcaaaucuugauuuaguuugauaguguguggaauuuuauuuugaaggauaagaccaugggaaaauugugguaaagacuguuuguacccuucaugaaauaauucugaaguugccaucaguuuuacuaaucuucugugaaaugcauagauaugcgcauguucaacuuuuuauuguggucuuauaauuaaauguaaaauugaaaauucauuugcuguuucaaagugugauaucuuucacaauagccuuuuuauagucaguaauucagaauaaucaaguucauauggauaaaugcauuuuuauuuccuauuucuuuagggagugcuacaaauguuugucacuuaaauuucaaguuucuguuuuaauaguuaacugacuauagauuguuuucuaugccauguaugugccacuucugagaguaguaaaugacucuuugcuacauuuuaaaagcaauuguauuaguaagaacuuuguaaauaaauaccuaaaacccaagugu

SEQ ID NO: 191291 - RNA, 5381 nt, Homo sapiens
cgcucucagcgcgugacgcagcacgcuuugauauaaaugcagaccgcgcggccguagcuuccucucugcucucgcggccgacucgcaagauggcgccggugagugagcgaugucuuggugggaguguuguguggcaauuuaaugauuuccgcuguaacgauuuuugcaucugucgaguggagacgucucagucaagauaaagggaggggaguagugaagucugggucagaaacacaaccaagacgcgaggauccugaacuguuuuucgagacucccuggcagcugccaugaggucuaguggaguuggagcugggcccggaauugguuuaggaugggugguuuuggacacgcgggaaagagggaggcacaacuguaaaugggccggugguacugcaaucugagccauuucuuuacuaucucgcgccugauaaugcuuuugccacucagcacuggguaggggaaugguggguaaucgggccggucugacgaccuuugccaggccagagggagcuccuaggcgcucagcucccgcgauggccgacaucacaaguuuuugagaacuuucaguuggggaagaaguuucucggugaaguaauuuuuagaaaaguauaagucuagauuccagcaaugugaaauaaacgugcuucagauguuuuacuuaagucauuaguaagggaaccaguaagauguuaaaauguuccuaagaauaucugaaaagcuagauauacaugcgcaauuuacaaauaaaguuaggauaaaauugcugggcuagcuacaaaacuggguaaugcccagcauggccauaaacccuauaggguuaucuguuccauuagacagaaguuguuugugucucccaaauuaacuucugcgccaacuggguaauuaucuuuuggcacauguuaccaugcuaccugagaaagcaaacuaauguguaauacuugguagccacuugggugaaucuaaauuggagguuauagucugauaaauacagauuuguuuguucauauugcagugaauguacaugguugcuggccacaguaacauuuugcuuauguagccauauuauauggucuugguauaaaagguuuggauauggaaaauuuaaguuccacgguguugguuuuuagguuuuuuuuuuuuuuugagacagagucuguugcccaggugggaguauaguggcaugaucaggcucacuacaaccuccgccucccggguucaagcaauccucccgacucagccuccugaauagcuaggauuauaagcaugcaccaccacaccuggcuaauuuuuguauuuuuacuagagaugggguuucaccauguuggccaggcuggccuugaacuccugaccucacgugauccuccugccucagccucccaaagugcugggacggcaccuugccuuuuuuauuuuuauuuuuucuuuuucuuuucuuuucuuuuuuuuuuuuuuuaccaaaguccccuucccuugccuauaauaacguaagaauugaauuuucuagacauagguggguggaauccuagcucuggcacuuaccugagcuugggcuaggcaguauacuaaccuauucccaucugcagugggguggcagaaaagcacgauaauuuaaaauugaucauugguaguauagaaaacaaugaaaguccguaacuuuuugacaacuugaacauauuaggacuugguuagagguucaaaucaaccccggcguggguaguggugguguuuuuuuauuuauuguuacauuucuguauauguaaccuaacaguacauuguacagauugcauugguacaaacuuuaaaauuguuuauauaaauugaauaaguuguuuuauauagcuacauaauuauuucucauuuauguagcagaaagacaggaagcccaagaggucaaccuggagguuuaauuuggaccuuacucauccaguagaagauggaauuuuugauucuggaaauuuuguaaguaucauucuacucggcuuauuuuuguaaucagaguuauugauaaugguuuaaauauauaguauuugauaauaaccuaagcucuauuccuaggguaccuucccuagugaauaucuaggguucucuucccuaguuuugcauuuuuucuguuuuaaaauaggagcaauuucuacgggagaagguuaaagucaauggcaaaacuggaaaucucgggaauguuguucacauugaacgcuucaagaauaaaaucacaguuguuucugagaaacaguucucuaaaagguugguacuuuugcaaauuuuaauaaaacuauaguaguuuuggaauauuucauagaauauguaguuauuacauguauucuguuuauaugcaagaauaaauaugaacuuuagacuaaaggccuacauaaaugggaaauucaguaaaugagugccaauugcugagucuaguuguaagugucauuuauugcuagaauaugagccaguuguguccacagucccaguccaguaaauuauaggcccuguaaauccaaauuguauauaaccuuuaaugcugaguacuuuaguauuugaguauguugcaagaaacaugucugauguguacauaggagaauugucucaaguuauuuauucaguagagguagccaguuaaagucaaagucuuaacaucuugcugccaguuuuuauuuguugaauuuauucaccaaauauuaaauacuacaugggcagcacaggacuggguaacccaacagugaaccaagcaggcaguuuacccaccaccaagaaacuucuaguggagaagagagagugaaauggaauuaaucaagcagugauaagugcuguaagggcauaaaacuaguugcagaguuuuuggguacguugguaaguuggucaggaaaugaaaugcagaagugagccuugcaguuguuacaggcaggaugaaccagaagccuggcagauuaaaguaauaguaacaaagccagugugucugggguauaguguucugggaggaaugcaugagauuggagggugucuggggagcagaucuugaaagccaugggauguguaaugggaagcaauuguuuauuguggcugaaaaagacuagggugauacaucugguggaaacugaagauguaagagcuaauuucagugagagacaaugauggcuuggacuaaagugguugcaguacauguuaacugagauuauaaucacuaaggauucagagauaaaaauguaguagcuguaguagcuguaaaucaaguaucuuacagauaaucagauaauuauuguaaaauacaacucuaguuacauuagauguagagagagcccaagaauuuucagagaaguugagacuuaaugagcauaguauggguuuaacccuauuauuaauagguugccuguugagccggggugggauugggagcuagggggcuugauaguggugaaggagguguuaacguuuucacauauauauacacagauaauauauuugaagagugaaaucauauugcuuaaauaauuuggcuguagcaguuugacaagagaaugcuacccuaacaaucuugaacaauauauaguguggcaguaugacaagaggaugcuacccuaacagucuuacacaauacauccugugaauggaaggaugaaauauuuuggaggaagcuagguacagaaaagaugaauaugaugauguauauuuuucguauaguaaaccuuuacauaguaggaauuguauuucuuaaugaaauuuauguuuuuauuuuaaaagguauuugaaauaccuuaccaagaaauaccuuaagaagaacaaucuucgugauuggcuucgagugguugcaucugacaaggagaccuacgaacuucguuacuuccagauuagucaagaugaagaugaaucagagucggaggacuaggcaaaggcuccccuuacagggcuuugcuuauuaauaaaauaaaugaaguauacaugagaaauaccaagaaauuggcuuuuaguuuaucagugaauaaaaaauauuauacucuugaacuuuugucucauuuuuuugaguaugcuguuuauaugauuuugauuucccucugauaacuaucaacaguauuuaaauagcuuauagcugguauaauuuuuucccacgauuuccaaaaucuuuuauguacucagguaaaaguagcguuauauaggaaaucuuuuuuuuagacacucucguucugucacccaggcuggagugcagugacucagcuuccuaaauagcuggaauuacaggugugagccaccaugcccggcuaauuuuuuguacuuuuaguagaguaggguuuggccauguuggccaggcugguuucaaacuccugaccucaagugaucuacccaccucggcuucccaaagugcugauuauagcugugaaccaccaugcccggccaggaaaucuuacuguagaacaauuuuuuauauagcuguauaaaauguauaugauugucuugacagucucaaauacuguuuuuaauagcuuguaaauguaaucucaagugcuuagaacaguucuuacauauaaguugcucuguaguuugcucuuauaguuagcccaaagacucugggugugaggccugcuguaaaccaauguuaaacugcuuauuagaaagcccuaaccaccugcuuuguaggcaccagaaacucaaaaccaaaucucaacucagcuacagaaucuacugugguccuugucugaaaaaauuaguucacucgguuggaaucuugucucagagcauccucaucucuuucucaaaagccccuaccccaacaccggcguguugguugucuauugaaacuuacaaguggauggacccuuucucccgaauaaacuggccuuugaaagcucuaaucgaaaugguuuggcaaaauccauacugcaggagauuagggaggacaagaaugaugugccuuuuuguacugcugagccugaugguggugccacuacuucagguacuuagaugagucuugaugcuaauagaauugugucgccaaacauaucuggacaguuacaaccuaaucuaugcauuaauugguuugggaauugcuugaaauuauuguuuaauucaauguuuuaauucguuuuccuaaaaauuuaagugcccccaucaucgugcaauaccucagugcagcaacuccuugauucuuggaugacugaacuuccuaacuuggcucugccccauuguucccauuuuucauguuuuucacaaauaguuaaccagguaccuacuacugugcaccgcugcagagcauugaggauguaugugaugaguaaaaacacccagccugcucugcuguguuaguauuaugacggaaacugaucaaaucacaugugaacaaauuuacugcuacaaaagggagggcuuaauaaaaggaauuucaucugggaaggcaa

SEQ ID NO: 191292 - RNA, 83551 nt, Homo sapiens
aggugucuugggcccgggcggcuguagaggcggcggcgccuacgggcagugggaggagccgcgcgguuccggcugcuccggcgaggcgacccuugggucggcgcugcgggcgaggugggcagguaggugggcggacggccgcgguucuccggcaagcgcaggcggcggagucccccacggcgcccgaagcgcccccccgcacccccggccuccagcguugaggcgggggagugaggagaugccgacccagagggacagcagcaccaugucccacacggucgcaggcggcggcagcggggaccauucccaccagguccgggugaaagccuacuaccgcgggugaguguccugggacagggcggugggcgggaggggacaggccggcuccacucggccuggaggaggggagggugaggggcuggagguguugugggcggauugggcugggcgggcgggcggcuccggugacucagggugagugacgaagugauaggggugggggcgaagcaaggggaugcaguacugggggcgcccccagguauggcggugcggggagccgaggggccagaguaggguccgagaaggaagcuaggguuagaguaggugcaccugguguggacgagagacucgccuccugagagcuuuguaggggccuugcauccuuaagucuggguguauuugggguugcgaguugaggauuccaagugaugccuuaguuaacucaguuugcuguggggauagaaaacgggacuucuucaguuagcuguccguuuugauuaccagcaggccuaacgccucugguucucugagauauaccuccauccccguuguguucacguaguguaucugcacugccaguauauuagacauagggguuguauuuaagaaucaagucgaugcguuuucagggacgugcaguggguacuuacgugucgucaagauuaaguugcauguguguaaaucaaaauuuugugagccuuucuuucucaguguuguuucaacgacuacccgauagggugagauacugcaaggugaggagacuagccuaguuacaguuuuaaauucucugaucuucacucccuuacuaugguuacaagaaaaaacccaguucuaaguucauuguguuaaaucauuuucuaucagugacgcaaagugccccccuuccuuuaaauucaguugugguuugaauuuuuuuuugagauaauuauguuuaggagcauuagaaacgugaaauguuagugugaccauaaagguuggagacugagaagucacagaaaacccagcuacuuuggcuugccuuacugcuuguccagguagaaguaaauugcuuuaaaaaacucaagcagugcuagguugaaauuuuaaugcauacuuuuacauuccugagaggaucagugaagauagcaaacucucaaacuaccucucuuguuuugauuucaaagaaaaucugagccccuaaauguuguauugauuugauguaaggacuuuuuuuuuuauuauuauacuuuaaguuuuaggguacaugugcacaaugugcagguuaguuacauguguauacaugugccauacuggugugcugcacccauuaacucgucauuuacauuagguauaucuccuaaugguaucccuccccccuccccccaccccacaacaguccccagggugugauguuccccuuccuguguccauguguucucauuguucaauucccaucugugagugagaacaugcgguguuugguuuuuuguccuugauguaaggacuuuuaaauuugcugccaugaagccucuggccucuguuuauuauuagcuugacuguaugcaggaguaguuuauuggaguuauauuggacaguaugauaacuuuguguuuaagcagguaaaacugauuaaggagguuuuuauuuuaaaucaguaccaagaaacguguggauauuuuuuaaaguuuguaguugucacaagagcuguuuugacuugaggauggucagccaugaacuuugcaaggugagaaaaaagcuuccuuugcuuuuuuuuuuuuaaacccuuaccuguaauuugaugaaugagauguuucacuuuauucuuuuauuuuauuuuuguuuguuuguuuuugagacagggucuuacucuguuacccaugcuggagugcaguggcacaaucucggcucacugcauucuccgccucccggguucaagcaauucgccugccucagccuucugaguagcugggauuacaggcaugugccaccacacccggcuaauuuuuguauuuuuaguagagacgggguuucaccauauuggccaggcaugucuugaacuccuggccucaaaugaugcgcucgucuuggcuucccaaauugcugggauuacaggcaugagccacugcgccuggcccuaaggcuuucaauaaauucuuauuaauugagaucaucuucuccaaugagucuaugaaagguaagaaauuagugcuucuauuuucccauuuguauuaguuugacacauguaaauaggcccaguuaguaaaugaaaaucauuguaaacuccuuugagaagaaaucaaagucuugcuguacuucaugaauuuagauagcaaauuaucuuggcuuauugcuccaguuauuaaaaagaagagaauaaggacauacagcuucuuuaguguuugacugcaauuuuuccaagacauucaagguaacauugucuuuuaaaaucugugaaauuuugcugcggcgcaaauaaccucuugcccauuguauacuggucuuugcucaaugaaagcuuucuaaugguaccuucauuucaagccucauuuaaagacaauaucagcacucuaaauuguaccaaauuccuguccucugaaauuagauguuaagauuauguguuuguauagucuaaacugaugauugugguauuacauagucagcugcucauuaauauagaugaagcuaaaaugagucacggacaaggauaguuaauaaacagguuggcuaacuagaacaccuaccugauuuuaaaauagaaaauccuuccuuuauaccaagaaaugugagaacauucugcauuugaaaaaguuuucuuuucucuccaaucuucugaagggccauuauuacauagcauuuccucuaucccucuacacuuuucuuuucuuuuuuuuuuuuuuaaauagagacaaggucucaccguguugcccaggcuaaucccaaacuccugggcucaagugauccuccugccucagccucucaaagugcugggauuacaggugugagccacuguaccuggcuccacuacccuuuucuaacaauauuucuuuccagugaauguugacucauuuaauagccagcauuuuuuuuagugaaaaaauugcccucucuuuucaaagauguguauaguguuauuauucuguuaagcuugaucucagugaaaacguguaaucucucuagaucuaauaacauuuaauuuuuuucuaauuuuuauuuuauuuuauuuuauuuauuuauuuuuuuggagauggagucucgcucugucaccugggcuggagugcaguggcgugaucucggcucauugcaaccuccgccucccagguucaagggauucuccugcggcugccucccgaguaggugggacuacaggcgcccaccaccacgcccagcuaauuuuuguauuuuaguagagacggguuuucaccauguuggccagguuggucucccaacuucugaccucaagugauccacccaccucggucucccaaaguguugggauuacaggaaugagccaucuugcccagccaauuuacaucuaguuuuuaagcaagagauuaauagcacugaaaauucaauuuuauuggacaccacaucuuacuuagaugccuuucucauggccugcacccgucuuuuccuagcaaggaagcuuuucagugaggggccuucaguuauuaccuagugcuaguaguuuggaggaagagaaacagguuucauuaauuagugauaaacugucaauguaugugcuuauccuuauauaaaauuacuugcuauuaugggauagacuuuaacaaggcaacaucuggacugcucauuucuuuacauuauauauguauggaaauuuuugcagaaagcuugugaaaguucuuuuuaaaccgcugcugucaaguaguaauaacaauacagaggauuccuucugugcacaucuagaaauaaaagauuaacucuuugcauauuuggaauagcugcuucagugaagaaguauguaggauuuuucuuacugugaacaagucuuggcaagacuuguuuuugaaagaaaugcaagauuauuuuagcaauauacuuuaguaaugguucugaggaaauacaagugguaucuugaggguuggggggauguuagcuaauuggucuuagagcuucagccauggcaccuaauccuagggcagcugauccauagcuuggccaaagagagaaaaaaauagagcaugcuagccuggugccaaaaaacccaaaccaaacacaaaaaacccucagaaauuugaaugagaaaauauggagauaaaauuggucagcacugggaacugaagcuggaguuggagggagagucuggcgaggccagaacugacaaugugcaaaugaaagaugugaagaagcagaaacugaggaagcaaaggagaaaggagcaacucugcacagaaaaauucuccccacagguccuuaguucaugauggcuuucuaaugcaacugcagcccuccuuuuacaacuuuagugucuguuuuuuuuaugauugaaaugagccuaauuuaaacauagauuuuaaaaauuccagucuugcuuaagauuucaaauauaaccagagaucauucaaacugaguuuaguaaauauuguugaacguccguaauccaggcacaugaugcugucguaggcacagagaauguagagguagguaaggcucugccuuuaaggaauuaagagacuuguggagggaaggacauauaagaguuacaauagaaacaauuuaauuugaaguaccuauguaagguauuugcaggaauagacguuggggaggaguuuggggugauggaagccuuccuagaggaaaugucugaggcuuuuaaaggauaacuaggaguuugccuggugaauaaugauguuagguggguguuauaggcauuaaacaaccacaugguaaguuugcagaauuaagaucacuuuggcuguuagucucauauucauuccuuauuaggauauaaaguaugaagugggcacugaugagaaaugaggcuaagaaaguucacaggggcuagauuguaaagacccuugaaugucauacugcagaguuuagacuuuuucucauugaugaaaauucuaaguaagagaaauacaugaucagauuugcauuuuagaaagauaacacuugaaauuaguaugggagauggauuggugauggaugaaacuaauuuggaggcuuuugaaguaguccagaugagauauuuuaaggagagagaaaagaguguauggauucgguggaaauuuuaagggguaguaucaguagaauuaaagauagucuuguaggggugacgggaguuggacaacucauagguuucucguuuaagagagacuggggaauguggaagagauuugugggagaaguuaauuaauuggcuggaacaauucacugaauuuugaguucuagguguuuaugaggcauucaggaggaaaugucagaaagaauggagcaauuauuuauugucugucuacucuguguugcaagcacugugcuugacagcuaaccuauguaggaauguggcugagaacgauaauagaaacaaaaaugacaccaguggccaaauacagaucacaaaggcaaggcacuaaaacuaaauuuuaaaaauauagaaauacagaaagaggcuggguauggugguucaugccuguaaucccagcacuuugggaggucagggcaggugaaucacuugagcccaggaauuggagaccagccugggcugaauguggugaaacccuaucucuacaaaaaaauuagccuguaguccuagcuacuaggagggcgaggugggagaaucaccugaggccaggaagucaaggcugcagugagcugugauugcaccacugcacuccagccugggcaacagagugagacccugucucacacacacacagacauacacacacacaaauauauauauauauacacacacacacacacacacacacauauacauacacacacauauaaaguuccccuguagucucucacucccaccuuauuuuauuuuauuaguuuauuuuuauauauuuaaaggguacaagugcagauuucuuucuuucuuacauguuuguaucauguagccaugaagucuggucacuuaguguacccaucaccggaacaguaaacaguaaaacccagaaaauuaccuguacccgauagguauuuuucaacccucaccccccucccaccuuuuguagucuccaaugucuacuauucccucuuuauguccauguguacccuuuguuuagcucucacuuauaagugagaauaugugguaucuggcuuuuuguuucugauuuuuuugacuagggauaauggccuucaguuccauccaugcugguguagaagacgugauuucauuauuuuuuauggcugucucacucccacuuucuagagauagccauuguuaacaguuagggauauucuauaucauaucgguauauuuauaaguauagauauguaugugcauacacacacacagacauacccuuuuauuuuuccaauaaaugaguucauauuuccacacaugcaucugcaacuugauuuuaaaaaucguggucaucuuuucauuccaggguagacagaccucuuuauaguugguaauacaguguucuacaguuguuguuguuguuuuaagagacagagucugauucuguugccuacgcuggagugcaguggcaugaucuaggcccucugcagccucaaccacucuggguucaagcaguccucccaccucagccuccugaguagcuaggauuagcucacgccacuaggcucagcuaauuuuuuuuaauauguuuuguagggacggggcuggucucaagcuccugugcucaagugauucuccugccucggccucucaaaguguagaaauuacaggcaugagccauugcgcccagccaccauaauauguuuaaucuuuuuucggauugaugaacauuuaaaguugucuucaucaacucacuauuucaaauaauguugaaggaaccuccuuauauuuaauacauauucuuguaaauauggucaaagauaugccuaucuugaaauaugauauuguuucccaaaagagcuuaauuuacauucuuaacaacaggacuagugaagcuucugccuuauauucccauugcauguuaucugucuuuuaaauuuuugacugucagauuggcaaaaaaugguaauuuauuuuuacaaguaucuuuuauauauuaaugaucauuuguauuucuucuggauuguuccuauuuuacccauuuucuauuguauuauuuuucuuauuaauuuguugacaggacauugacauuuuguuaaaguugccagcauuuccccaaucuguugcuagucuggaguuuuucguuuuuaugucaucaaaccuguccuuuuuaaaaauuuccuugauaguuucuggauuuacugucuuagguaaaaguguuuuucaucuaaaaauauucuauuuuucuucuauuaugcaacuuuuuuuuuuuuuuuuuugagacagagucuugcuuuguugcccaggguagaacccaguggcgugaucucgucuuacugcaaccuuugccuccuggguucuaacaauccuccugccucagccuccuaaguagcugggauuauaggcgcacgccacaacacccggcuaauuuuuguuuguuuuuugagacaaggucuugcucagucgcccaggcuggagugcaguggcacgauccuggcucacugcagccucugccuccuggguugaagugauucuccugccucagccucccaaguagcugggauuacaggcaugcgccaccauguccggcuaauuuuuuauuuuuaguagagacaggguuuugccauguuggccaggcuggucccaaacucgugaccucaagugauucacccgcuguggccucccgaagugcugggauuuuaggcgugagccacugcgccuggcuuauuaugaaacuuuuaaagugauuaucuuuucagugaaucugguauuuugggguuuagucauuuauaggguacugacacaacuuuuuuuuucuccaaaauuuauucuaauaccauuauugggcagauuguccuuucaccacugauuugaaaugguaacucuguuauguacuaaauuucccacaaugugcguagguacuuucuauuguuucauugauuuuaggggagagaucuauuuuugcacauaccacuauugguuuaauuauuguaauauuauaguuaacuuugauauauguuauggaauggcuugauucauuauuuaauuuuuuuuuuuuguuuuuuuuuuuuuugagauggagccuugcacugucacccaggcuggagcgcaguggcgugaucuuggcucacugcaaccuccgccucccagguucaagcgauucuccagucucagucucucaaguagcugggauuacaggcaaggcgcuaccaugccuggcuaauuuuuguauuuuuagugaaaaugggguuucaccauguuggccaggcuggucuggaacuccuuaccucaggugauccaucugccucggccucccggaguguugagauuacaggcuugagccaccgugcccggccuauuccuauauauuuuauaaucaugugcuuuugugaauggggucuucuuguagaccuauuacauacuguuuucuuuuuguauguuuaaauuaaacuuuccaccuuacuaauaauuuaacugucuuagaauuuuuaagcuagauaaugucaucugcaaguagcaauuuugccucuucuuuucuauaucuuauuuauuuauuuauuauuuauuuuauguuuuuugagacagagucucacucugucgcccaggcuggaguguaguggcgugaucucggcucacugcaaccuccgcgucccaaguucaagugauucuccugccucagccuccugaguagcuaggauuacaggcgugcaccaccacaccuggcuaauuuuuguaguuuuaguagagauggggauucgccauguuggccagacuggucucgaacgccugaccucagguaauccacccaccuuggccucccaaagugcuaggauuacaggugugagccacugcgcccagccuuauuuauuuuuagccauaggcuagaauuuucuagacaguauugaauuauaguaauaaucucuuaucuuagugaaauauaauagaaaaauuucugucaauuaaagaaaaaagcuuuuaaagaauuaaaguuaguguuauucagaaauguuacugaggccgagugugguggcucacgccuguaauugugccacugcacuucaaccugggugacagagcgagacucugucucaaaaaaaacucaacugaaaaaaguggaacaaaagaaaaagaaccaugauaaguauuuugcacuuuuuuuuuuuuugaggcacauuucuacucugucacccaggcugaguacagugguguaaucacagcucacugcagccuuaacugcccaggcucacgcaguccuccuaccucagccucccaaguaguugggacuguaggcacacaccacuaugucuggcuaauuuuuaauuuuuuuguagagacaaggucucccuguguugcccaggcaggccucgaacuccuguaccgaagcgauccucccacauuggccuuucaaagugcugggauuauggcaugagccaccuugccuggcugcacucauuuauuuucauuuauuuuucauuuuuugagucagugucuuccuccaucacccaggcuagagugcaaugacauagucacagcucacugcagccucaacuuccugggcucaagcugcacuuauuuagucuucaugauaauacucagaggcagauaugauuaucuccauuuuucagauaacauugagacuuacuaacccacaauacaaagcuggguguguuuuuuuuuuuagagacagagucuugcucugucgcccaagcugaaguccaauggcucgaucauggcucacugcagccuugaacuccugggcucaaaugauucucgugaguagcugggacuacgcuaugcuuggcuaauuacaaaaaaauuuuuuuuagagacagggucuuguucugucacugaggcuggccuugaacuccugaggugauccucccgccucagcauccugaguaggugggauuacaggcacgagccaccuugcccagccaaaacuggaccuugaacuucaaagagauuucucuuuuccccuuacuacauugacagggcuuuauaacauugcuuuuuuacuuuauuguuacauucauauuucacaauuguuauuuuugaauucacuaucuucuucauuauuaaaagguggaaauugcuuuaugaccuuuuuuauaauuaauaauuuggggggugauacuuugagauuauaugaauacucuagucccccaaaacauuuugcccaauggucuuaccauucauggauaauccugccuaaaccaauuauuauaaugguuauugcaaauaaaaguauuuuuucgaauagccuaauuuagaagaaaagcuuacacugagguagcagaaggacugaaugugauucuuuuggggguuuauuuuuaaaagcaauuaguccuaaggaaaaacuuuauaauagauucuauauuuuagaauauaggcacauugaaagcaguuugucuucugaagcucaauagcaaaauaaaaaaugcuuaaaaaaauucagcuaaaaccauaucuaaauuugccauuuugggaaucuuugugauaaagcagauuauauucuguugaggaucagugguaaaauaauuuaugcuagugcugaaguuaaacuggaaaaaacaucauacgugcauaauuuguuuuauaccuuuagaauguaauaucuuuauuuugcaguucauuuuuagcuuugguacuguaacaaggaucuggugauuguggaauguuaugaacauagugguuucgcaauuacugagagcuaaguguuuauauaaaacucccuugaauguuuuaguuccuggaacuuaaggagugguaguugauaaagcauaacuccuucauugagucucugauggguaucuauacuuaaacuuuuuuuuuuuuaaacagaaucucacuuuaucauccaggcuggagugcagugacgcaaucacggcucacugcagccuccgccuccuggguucaagcgguuauccugccucagccucccagguagcugggauuauaggcacccaccaccaugccuggcuaauuuuuguauuuuuaguagagacggaguuucacuguguuugccgggcugauuucgaacuccugaccucuagugauccgcccaccucagccucccaaaguacugggauuacaggugugagccaccacacccagccuauacuuacacuuuuuuuuuuuuuuuuuuugagauggaguuucgcucuuguugcccaggcuggagugcaauggugugauugguucacugcaaucuccgccucccggguucaagcgauucuucugccccagccuccugaguagcugggauuacaggcaugugccaccacacccagcaaauuuuuuauuuuuaguagagucaggguuucuccauauuggucaggcuggucucgaacucccaaccucaggugauccaucugccucaggcucccaaagugcugggguuacaggugugagccaccacgcccagccuuauacuuauacuuuuuaaguauuacacagaugucuuaaaaguauuuguauguucugauaaguguuuuuuagcuuuugaaaaguaaaauuuaugaaaaagccuuguuguuuacaaauauguuuaccuuucuguuaauuuuaaauguggacuuugauaaggaaguuauauuucgaugauauccaguguaacuaauuuuuucccucuuauucaagaaagauaauuuuacacuuauucuuugacagagaaauuucauagaauuuucuucuucuaauuuaauuccagaauacauucucucaacccuaugcccucauacuaguaaccuugaggguucuuugaaagaaaaauugcuuuaaaucaagcaauucucuuuugucauuaaaauaagcuauuuucuauuuuuauuuuuaaaaacuauuuaaaacaauauaauuaugcaaguguguauauauguauuugauuuuuuuguuuucuuuuguuuuuauuuauuuuuuugacacagucuccucuguugcccaggcuggagugcagugaugugaucucagcucacuguaaccuacaccucccauguucccccccugagaaggauccucccaccucagccucuggcuaauuuuuuuuuuguauuuuuaguagagacgggguuucaccauguugcccaggcuggucuugagcuccugggcuaaagugaucugcccagcucagccucccaaagugcaugagccaccgugcccagcuugauauuuuaauuuuuacuugaaugaaaucauuuacugaaagcaauacauguugaugcacacacaaaauuacugaaguucaucaaauugucaagcauucaguaauauauacagcauuauuauuuuuaaucauuuucaaacugaaaacuccuuuucuuuuucagggauaucaugauaacacauuuugaaccuuccaucuccuuugagggccuuugcaaugagguucgagacauguguucuuuugacaacgaacagcucuucaccaugaaauggauagaugaggaaggugagugguaaagacagggcugccuguguaagcauuuuaagaucuuauucuaucauuuguuguaaaaauauaaugaguccuaaaaaguuuaagaggaaagacuauuagaaauuugaugccauucuuguuuuuucuuuaaguauuuaaaagaauacugaagagcacaaucuuuuuuuugccccuuuuacgccaaaaugaugugaaauuaacuugacuuuuuuuuuuuuuuuuugagacggagucucgcucuaucgcccaggcuagagugcaguggccuaaucuuggcucaccaaaaccuccaccucccggguucaagcgauucuccugccucagccucccaaguagcugggacuacaagugugcaccaccaugcccggcuaauuuuuguauuuuuaguagagacggggguuucgcuauguuggccaagcuggucucaaacuccugaccuuaugaucugcccaccucggccucccaaagugcuggcauugcaggcgugagccacugugcccagccuaacuugacuuuuuuaagcauaagguaagcaucucaucaaauagugugauguuuuacuuuaauuuuguuuuuucuuugaauuaaauuuuuuuuuuuuauuuuuuaaagacagggucuugcuaaguuguccaggcuggucuccaacuccuggccucaagugaucuucccaucaugaccucccaaaguacugggauugcaagcaggagccacugcauucagcuucacuuuauuuuuuaauuuaaauuuuuuuuuuuugagacagagucuggcucugucgcccaggcuggaguguaguggcaugauaucagcucacuguaaccuccgccuccaagguucaagcaauucuugugccucagccucccaaguagcugggauacaggggugcaccaccacacccagauaauuuuuguauuuguaguagagacgggguuuugccguguugcccaggcuggucuugaacuccuggccucaagugaucugcccaccuaggccucccaaagugcugggauuacagguaugggccaccacaccuggcccccagcuucacuuuaauuuugaauauguguugucuuauauuuuaauuuaagagauuaccuauuuuuaagcugaauauuaccuuaaagaaaauauuguggaaugaaagugauuuugacaaucauuauuucaaaguaguggcagaaaccugauaccucagugacuuguacucagaaaacauuuaucauauauguaggcuuacgccuguaaucccagcacuuuagagucugaggugggaggauugcuugaggccaggaguuugagaacagccugggcaacauugugagacccugucucuacaaaaaguuuuuaaaacuuaucuggugguagcgugcaccuguggucccagcuacuugggaggcugaggugggaagauugcucgagccuggaaggucaaggcugaagaugggcccugauugugccacugcacuccagcaacaaagcaagcaaagcaagacccugucucaaaaaaaaaaaaaaaagaaagaaaaagggaaaaagaagcaaauaucugugugcugaggacagacauuuccuauccucaaacccauagucugauagggagauggacacauguguaacaaaugugauaaauucuggaacauaaacgcauaggggccuugaggaauacaaaggaagacacaucuauaauacaucugcaauguuugacauaaaccuguaacagaguagaaguuuuugagguagaggaggugaggagaaaaccauauaggcugaagaagaauauguagaaaggcacagaaaugugaagaacaugaugagugaaaagcaguaauucacuguaucugaaguaugaaguggugaaguaugaauuggccuacaguuuaacaggcuccacgggugaguuguaugaauacagaaauuuguuugagaagcaugagacuagauccccaagagcuuugcagaucacauuaaauuuuauuuuacaugacuauuauggaagucuaguuaaaagguacccuaaagaaaggguggguugggggugagggauaaaggccuacauauuggguacaguguacacugcucaggugauaggugcagcaaaaucucagaagucaccacuaaaagaacuuacucauguaaccaaacaccaccugcuccuugaaaaccuguggaaauaaaaaaagagagaagauacccuaaauauacuacuuuuuuuacaauaguuuucuguuaauuguuauacaaauagaauuucauuuuaaggaaugucauaauauuuagcucaauauuugggaucauuucuaucuucccugauauaaagaacucuggaaagucauuauugaagcuccaagcuauagguaaacauaaacacauucucauuuuuuaaaacaguguuccugaaguaauucauguucacuguucaggaaaaaaaguagugcaaaaauuuaugaaauguaaaaagaagccuccuguuuuuccuuuuuucucucuccucccucaccaauuccaauuguaagagaauagcuuaguauguauccuucuauauauuuucuaugcauuugcaaacguguauguauguuucuauaaauucuuuauuaacaguuuuauuaacaugacaaaugacauacagcugauauuuugcagaccuggugggcauggggagcuuggagcccagugccacccacccuggcccuccauggccuuaaaaaaaaauuauauggggccgggcaugguuucucaugccuauaaucccagcauuuugggaggccgaggcggguggauggccugaggucaggaguucgagaccagccugaccagcauagugaaaccccaucucuacugaaaauagaaaaauuaccugagcgugguggcgggugccuguaaucccagcuacuagagagggugaggcaggagaaucacuugaaccugggagacggagguuacagugagcugagauugugucguuguacuccugccugggcaacagagcgagacuccauuucaaaaaaaaaaaaauuauauacaaaucguuaugcaguguuuuccuuuauaguaugcgcuggacauuuuuucauuucaguguacuucaauuugcaucauuacucuuuuuuuuuuuuuaguacugcauaguauuacauauuauagauguuucaugauuaaucccuuaucgauggacauuuggacuauuucuaguuuuucacuaccauaaacaauauauaaugaacauuucuuuucuuuuuuuuuuuuuuuuugagacagucucacucuguugcccaggcuggagugcagugucucgaucuccgcccacugcaaccuccuccuccuugguucaagcaauucuugugccccagccuccugaguagcugggauuacaagcgugcaacaccaugccugccuaauuuuuguauuuuuaguagagacgggguuucaccauguuggccaggcuggucuugaacucuggccucaagugauccacccgccuuggccucccaaagugcugggauuacaggcaugagccaccacucccagccuuauuuauuuauuucucuuuuaauacagaggcuggguucucacuauguugcccaggcuagucuugaacucuggccuuaagugauccuccugaccuagccucccaaagugcugggauuacaggugugagccacuaugucaaaacauauguauaucaaaacaucauguuauauaccauaaauauaauuuuuguccauuaaaaaauuaaacuaguuuuucacacaacuacaugaaaugagaggauuuuuucauucuugcccuuaccaaccuuagauaugaaucauaaacauuuuuaaagaucaguaagugaaaugcuaaccugguauuucaaauuuugcauuaagaggaaaguugaguaucuuuaucuuuuugaccuacccuaucacaaagauaguuuaaauaugguuacuuauaaaugucaugacuaucucacaauaugucuucagccagaaaaugagacuauauauaauuuagcacagugugcaacuuaugcuuagcauucaauaaaaugcuucuuaucauaaaugaauauucuuauuuuaauccugaucauuucauaccauuuauuugcugauuagaguuguuuuucagucaaugauuuucaaauugcagcacacauaggcaucacuggauaaugcuuuuuauuagacguacuuaguuuagcgauaguccauuaaacguuuuuauaauaccuuuguauuauccuugccuggagaguucuguucccagauugucaccuggcugucucucaucauucagguuuuaacucaaaugucauguccuccaagaagccuuccuaucuccauucauuuuguaucuucuugcccuguuuuuucucuuguaugguagaguguuuuuuuuuuuuuguaugguagaguguaagcuccaugagagcagaggucuugucuguuuuguucauguuggagcugcagugccuagagcaauacuaaauaauacuaugcucaaaaaauauuuguggcugagugcgguggcucaugcuuguaaucccagcauuuugggaggccaaggcagaaggaucccuugagcccagaaguuugagaccagucugggcaacauagugagauagugagacccugucccuacaaaaaaaauuuuuuuuuuaguuagcugggcauggugguacacaccuauagucucagcuacucaaaaagcuaagguggaaggauugcuugagcaugggagauggaggcugcagugagccaugauugugccacugcacuccaaccuaggcaacaaagcaauacccuguuuccaaaaaaaagauauauguguauauauauauuugugaguuguacaagaggcuagcaacaagccuuucccugguuuaauuuugcuucaguuauuggagacuuaagcauugacaguuacuguuuauucuguuuuuuuuuucuuaaaguagcauauuuuaauuaacagaugcacauaguaaauuaacuuucugaugcaacagucuuauuauaaugcauuucauacuucuuucucccuaaguagcuauuaaguuuccaaguuuucuggggaaagcuaugaagcucuaggcuuugucuuguucaaguaaaagguuaaauuuuucauuaaggucuguugauucccaugcgauccuucucaccuugcuuaauucugauaccaaucuuuucuuaauuuuaggcauacagagccaacaguaauuauuuuuaaguuacuuucaauuaguuuucaguuguaauuuugucaccuuuguuuuuaaucauguaggcauuggggcaugucggucugaucuggagaaaaaaaauucucuaggaucaaagacaggacagucacuugauuucucuggcauaugagaagugcuguuccucaagccaaacauuuaauuguuggaauuuuauguuggagcaaguaaagaucuuaagcuuacuucaucuguuuaaagagauuuaagacaacugcccuuuuuccuuguacucaaaaccagucuuagugauuuguuuuacuguggaaaaacugguuugcuuaaucuaacuaaacauuuuagaaugaguaguaauuuuguaaccaucaugccacacuccucuuucucauaaauucuuguguaacaaaagugugggacagggaaugacaaaugugacuuuauuuuuuuaacaaauguaaguuuucaguucuuuuuuuuaaauuuuuaauuaacagauaauaauuguauauguucgugggauacagugugauguuucaauacauguauauguuguggaaugaaaaaaucaggguaauuaacacaucuauuaccucaaauacuuauuucuuuguggugaggacauuuaaaauccacucuuuuuguuauuuugaaauacacaauacauuauuaugaauuguagucaccaugcuaugcaauagaucaccagaacuuacuacuccugucuaaccacaaccuuguacccuuuaacuggcaccuccuuucucuaucuaacccacucccuccagccucugguacucucuacguguaugaguucaacuuuuuuagauuccauauaucaugugguguuugccuuuguaugccuggcuuaugcuuauuucacuuagcauaauguccucuagguucauccauguuguugaauaugacauaauuuucugcuugaggcugaguaguauuccauuguguguauaugccauauuuauuucaucuguuuauccauugaugggcauuucaauuguuuccauaucuuagcuauugugaaugaugcagaugcuacagcguaguucaccuuuguuuugagagagggagagagagagacagagacagagagagagagagaaaaggccucacucuguuacucaggcuggaguguacugaugcaauuauagcucacugcagccucaaaccuaugggcuuuugagauccucccaucgcagccucuuagcuacagguguguaccaccaugccuagcuacuuuaaaaaaaauucuuuuggcugggugcaguggcucacaccuguaaucucagcacuuggggaggcugaggcaggaggaucaccugaggucgggccaacauggagaaacccugucucuacuaaaaguacaaaauuagcugggcgugguagugcaugccuguaaucccagcuacuugggaggcuaagguaggagaauugcuugaacccgagagauggagguugcggugagccgagaucgugccauugcacucuagccugggcaacaauagcaaaacuccgucucaaaaaaauuuuuuuuguagagacagggucuuguuacauuguugcccaggcuggucuugaacuccuggccuuagccaggaguugaauucaaccaacucuuuggcugaauguguagccaaugcuacuucaccuauuuagauagcuguauuauggcuccaaagcugaaaacugaaaaauuaauauuaacagccaggcauagggcucaugccuguaauuccagcacuuugggaggcugaggcaagaggauugcuuagcccaggagguugaggcugcagugagccaagauugcaccacugcacucuagccuggaccacagagugagaccccaucucaaaagaaaaaagaaaaagaaaagacaagaaaagaaaaaauuaacagcacuuagaaaaggaaagcuaaguaccuccaagcauaucuaguuuuguaacuuauauaguuuuccuuuauaauguuaaaacauuauaauguuauaauguaaagaacuuauacauuaugaauuauuauacauuauuacauuauuuauaauguaauguaaagaacuuccuuuaacauuucuuuuguuuuuguuuuguuuuguuuugagauggauccuugcucugucgcccaggcuggggugcaguggugugaucucggcucacugcaaccucgaccuccuggguucaagcgauuguccugccucaaccucccgaguagcugggauuacagacaccugccaccaugcccggcuaauuuuuguauuuuuaguagagaugggguuuugcaguguuggccaggcuggucucgaacuccagacgucaggugauccgccugccucagccucccaaagugcugggauuacaggagugagccacugcgcccggccucuugaacauuucuuauagagaaguucugcuggugagaaauuauucauguuuuuaauuucacuuaaaaauagauuuauugagguauaauugacauauauauguauacauaauauauauaauaaguuauacauauuaaaacuuuacaguuggaugaguuuugauaccuaggaacccaucagcacaagcaagguagagaacguaucuguuauccccaaauguuuccuugugcuaagcagugccucacuccugcucuuuuguccucaggcuacuacuaaucugcuuucuguuacuacagauuaguuugcauuuuuuagaauuuuauauggauagaaucaucauauagcauguacuuuuuggugggauguguguaucaguaguucauuccuucuuauugcugaguaguauucuauccuguggauguacuacaauucauuaaucuguugaagaucauugggauuguuuuugguuuuggcuguuuuaaauaaaggugcuaugaacagucauguacaaguccuuccuuguauggaaauauauuuccauuuuucuugagucaaaccuagaaauagaauagcuggaucaugugguagguauauaugcugcuuuuauaaaauggaaaaagaagauuuugaaaaggagaugagauggggcacuucaucccaggcacauccuugggcagaugguuuuuaguaaggaauucacaaggaaguugaggaucaggaaauugauuccuuuuaaaaacugucuaugccuguuagucccugaaaaguuuuccugcacuccagggguacuguauuccaauuagaagauagcugacuuagagauguccccagcuacuucucuuaguucuggccucugccccagcucuguucuucagacggaccuuaugcccaggaaauucuggcugccaucuuuuacacaccaggcugucuggaggccugggagaaaaaggaauuagacugggguucaccugggagaaacccuuggcagugguggaguggggauggauucagaagugagguaugauacuauaauauaaugaaaaaauguaucugcuauucaucgcugguuccugacagugccuaaaacccuuguucaaguaaaagguuaaauuuuucauuaaggucuguugauucccaugagauccugaguaauagaagugagaagagcaucuuuuguuauuuaugauaagccccugccaaccaaaccugauuuuaugcuaaugagguggcucuuggaggauggcuucugguugccagaggaaucaaccaugugguuaucucuaaggugggacuuuucagccuaccucccccuuauuucugaggagggcagaggggccuggagauggaguuaaucaccagcagccagugguuuaaucagucuugcuuagguaaugggacccccuuaagaacucaaaauguagggguucagagagcuuccugcucggugaacaaaucaagguccugggagggugguacaucuggacccggcuuggaagcucuguguccccccguaccuugucccauuaccucuucaucuggcuguucauuuguauccuuuauaauauccuuuauaauaaaguguuuuuguagcaaauuguuuaacaugaggaggggguuguggguguaggggccagggaaaagcuuccccauugaucuccaaagguuugcugaaaaaucaacucacaagaggcagauuaauuggagaaaagucauacagauuuuauuacauguacacgggggaaccacagagauuacucaccccccaaugggguucggaagcauguauaauauccuggcaaaacagguuauauggcugguccaggugcagugguguuuacagcuaauugaucacagccaguuacagauuucuuuguuccuuccacucccacugcuucacuugacuagccuaaaaaauuaauuaauuaaauaaaacagguuauaggagaagggagaagaggaauucuguugugaggauuacuaggaagaaugaauggaucagggaagggagauuaacuuguacauuaucuuguggaaggaucuguucaggugugauuacauucuuggucuuacugggaggggaaugcaaaacaguuguucucggugggucuggauuuuaggcgauaaaggaacuucagagaacgucauucugacuuugggagaagucaguuguaggggugggugguugggggaagucagagagacccugagguauugguuacugagucccaacaugggaaugcccaguuuguagccaagucagacuaauuugacugauuuguggcuaauuugaggauccacuacuugcaauuagcaucugaaguuggggguagucugugggacugagcccuaaaccuacgggggucugugcuaacuccagguggugucagaauuuaauuaaauuguaggacgcucgauuggucuccacagagaauagauuugcuucuggaaaacucacacaucuggugucggaagcauugugaguggagaaacaguuuuuuauuuaugaggcaagagaggcuaugggggucuugaggcgguauuggggaccuuagaugcuaucaucugcuccaguaucugggaaggucuguccuccucauuggcaucccgucuccaguugcccugucuucuuccucucccucauagaccacuguucacacgggauacacuuaugauccccacacuguuuucuccuuacucucacuucuccaucccuaggcaaucacugaucugcuuucugucacuauuccauacauauaaaugacaaaauauaguggguuuuuuuguuuuugaaagacaggaucucacuguguugcucagguuggccuccaacuccugggcucaagcaguccuccuagcugaaacuacagaugcacaccaugacuccuggcucaagcacaguguuuuuguacuuuuuaauaaaugacauuauauaucccauauucugaaaugucucuuuuuucccuggauguuaugucuuuguuuuuuuuuuuuuuuuuuuuucugacacaaauccuuucuuugucacccaggcuggaaugcaguggugugaucauggcucacugcagccuaccucucaggcuaaagcagucccccugccucagccucccgaguagcuggaacuacaggagugcuccaccacgcccagcuaauuuuuuuucuuuuuuuucuuuuugagacagagucucgcucuugucacccaggcuguagugcucgcucuugccgcccaggcuggagugcaguggcaugaucuuagcccacugcaaccuccgccucccguguucaagugauucucuugccucagccuccugaguagcugggauuacaggcgccugccaccaugcccagcuaauuuuuguacuuuuaguggaaacaggguuuugccauguuggccaggcuggucuugaacuccugaccucaagugauccgcccgccucggccuccuaaagugcugggauuagagggcugagccacugggcccagccuaaauuuuuuauuuuauuuuuuguagagacagagucuugcuauguugcccaggcuggucucaaaacuccuaagcccaagugauccucccgcuuugcucucccaaaguguuaggauuacaggcaugagccaccaugcccagcagaugucuugagaucuguuaauguaguuagagaacuaguguacccuuuaaaaauuuuuuuauuguaauuaaauauaaauaagaaaauuuaccaguucgaccacucuuaaguguacaguucagugguauaagcacauucacaguguuguacaacuauuaacaguauccuucuguuuccagaacuuuucaccaucccaaucagaaacuguacccauuaaacaauaacucccuaucccuccuuuugcagucccuaguaaccuguauuaaacuuucugucuaugaauuuaccuaugcuuggucaccuuuguuuuuguguuuuugaaagaugauugugauugguaaauaacuccagguuggaaguuuuuguuuuuuuuucucguucaguacccugucuuauagcuugcauuguuucugaugcaaaaucugcuaucaacuuccuuucuguaugugaagcaucucuuuggcugcuuuuaagacuuuuuuguuuuguuuuguuuuggagacagagucuuugccuggagugcagugguacagucauggcucacugcagccuugaccucccaggcucaagcaguccucccaccucagccucccaaguaggugugcgccaccaugcccagcuacuuuuuuaguuuuuuuuuuaaauagagaugggaucuugcuauguugcccaggcuggucuugaacucuuggacucaagcaauccucccaccuuggccucccaaagugcugggauuacaggcgugagccacugcagcuagccuuaaaccacuguuuaauccaguguuuuaaaauuguuuuagagggaggguuaugucuauuccuauuacuucaucucuccugaugugaauguugaggcuggaugcgguggcucacaccuguaaucccagcacuuugggaggcagaggcgggcggaucaccugaggucgggaguucgagaccagccugaccaacauggagaaaugccgucucuacuaaaaauacaaaauuagcugggugugguggugcaugccugcaaucccaacuauuugggaggcugaggcagaagaaucacuugaaccugggagguggagguugcagugagccaagaucgugccauugcacuccagccugggcaacaagagcaaaacucugucucaaaaaaaaaaaaaaaaaaaaaaaaaaaaaaguugaggaugagcggcuucaugggauggcauguauuucuguaaccacugacuuccaccucccagaaaaaggaagcaacaagccaaaaauucacuacuguuguuauugggccugauagugaaaggaugaccaccuaaaaauuauggcauccuuggaaaauuuuugcaaaucuguauuuuaagcaguguaacccuuuacaguaagggaguacagugacuuuugcaagugguuuaguguucugacugcauauccagaggcaggauggcaguacgaagguccuagugggaacagagagugagagucugugagucuguggcuaacucagacaucagggagaagaaugugugauacugucucagagguugccaacuuugguauuaggcuguguucuuugaaauguggggcacugaauuuaggcauauacugaaauaacuaaauaaaacaagaguuacauauauguuucauguucuacauccugucagguuaucucauauaaauaauuggauugugaauauuuaccuaacuuuuugaggucuaaugcccuaauuugcugcuuucuuuuuguagguaaagaacaacagcagcaacaaaaacaaaaacaguagauauauugggggggggaaaaaaccugcugguuaauauacagauuucauuaccuugaaguucacugcacugaacaauucucacucuggauguauuccugcucuaggaugugaauuuagacuuuuguaauagagugggcuuugagaaauagcuuuucugcucauuuuaguuucaugaugacugcauggaauguuuugcuucacgcuuaugcauugaguuuuaucaagcauuaagcaguuggccgaaacagguaauacuugaacauucaguccaagaaaaacaaaauggauuugaacauacguagaaucaguaacucuuauuuucauacuuccuuaugguuauucagaaguguuggucucuagguacauuuugaaagcaaguacuugaucuggcuuagguuuuaacuaacagcaagcagauacuggccugauaaaaagaugauguacagcaaaagugagauggucagaauuggcuuuuuucuuuuucuuuucuuuuuuuuuuuugagagggagucuugcuuugucacccaggcuguagugcaguggcaugaucucaguucacugcaagcuccaccucccagguucaugccauucuccugccucagccuccuuuguagcugggacuacaggugcccgccgccacgcuuggcuaauuuuuuuguauuuucaguagagacgggguuucaccauguuauccaggauggucucgaucuccugaccucgugaucugcccaccucggucucccaaagcgcugggauuacaggcaugagcuaccgcgcccggccagaauuggcuuuuuucauuauagacuacuacaguaaaaucauccuaacugcagaagucacuugaaauguggaaaucacaguuugcuauguauuugauuugguucaaucuuuuuuuuugcuuucugggacaucaaaaucagccagcgagucuagggaaauuuggacuuaagguuuuaauguuuagauuuugaaaagccaggaugcuuauaaaacacucauugguaucauuuacgacagagagagagagagaaaggagagagagagagagugcgugugugcguuuauguguguauguauaucuuguuuaaaaaacagucuggacucaguuuucucaccuggaacauuagaaaugaaguguuagcugggcgugguggcucacgccuguaaucccagcacuuuuggagaccaaggugagacgauugcuugagccuaggaguuuaagaccagccuggucaacauagggagacgcuguuucuacaaaaaaagaaaggaaaaaaagccaggcaugguggcaugagccugugggauucagcucccaccuuggaaggcugaaguaggaggauggcuugagccugggaggucaaggcugcagugaaccaagaucaugccacugcauuccagcuuagacaacagagugagacucugucucagaaaaaaaaaaaaaaaugauaccaacuuucauauuuguggcaaaaugagauaaauuuacguaacugaaaaagggagucuuuuuuuaaugaauuacuuuauuucuuugaggaaaaauaaaacagauuuguaaacuuugcuccuggacuagaaugcuacuuugcaggcaaacuuacuuuuguaaaaaugcuagacucuggccagacaugguggcucacacccauaaucccagcacuuugggaggccuaggccgguggaucaccugaggucagcaguuugagaccagccuggccucugucgcuauuaaaaaaauacaaaaacaaaaaaauuagcuggacgugguggcacacaccuguaaucccagcuacuagggagguugaggcaggagaaucacuugaaccugggagcuggagguugcagugagccgaggugucaccaccacacuccagccugggugacagagugagacuuggucugaaaaaaaaaaaaagcuagacuccacauucuuuaaaaaaaaaaaacaacuuugcuaagauauaauucaccaauguaaaguguacaauucauugguuuuuaguauaaucacagaguugugcagcuguuaucaccaucaauuauagaacauuuucauuaccaaccccccccccccaaaaaaaaaucucgugucuauuagcaguugcuacuuguuuccccccuaccccuuucucugcaggccccagaccuagacaaccacuaauccacgauauguuucuacagauagacugauucuagacauuuccuauacagugucauuacuaauuccuuuuauggguggauaauauuccauuguauggauauacauauuuuauuuauccauuuaucaauugauggacaauuggcuauugugaguaauguugcuacgaacauuugguuacaacuuuuugugugaauauguuuucauuucauaugguaacuguuuaaccuugugaggaacugccaguuuuccagaguggcuacaccauuuaccuuccuaccagcaguguaugagaauuccaauuucucuauauacacuuagacuuguuauuuaucaguguacugaguuuugaucaaaaauaguguaccuguguagugugguuaaaucauguugaccucacucucuuucaucuagccucuuaaaauaucaauacuaagacuuauaaaaugagcauaugaaaaccaguaacuuuccuuccuacagauugaaaauacucaaucagaaaguauauucaaagaaaauauuuaauccacaguagcgacauaaaaauagguuuuaaaaaaaaucuaguaauaaaccuuagagaaauuugaagaaacuauauaaagaaacaagaaacucaauugagugucauaaaacgaaacuugaaugaaugguuugggaaaaagcaacauuauacaaagugaauucccugcauaucaaucugugaagaaaacauuucucccaaauuuccaacaggauuuuaaaucugacaaaaauuucaucaggaaaaauaaaugcucaacaauaaacaggaaaauuuugaaaaagaaaguuuggaaagagaagacuuuuccuaauguuguauacaggaauaguaacaacugagagaaaauauuugcaacauuuacaacaaaggauuacuaucucuauuguacaauaaaugccaagaagaaauagaugaaaaaucuacauaaugagguauaaauagucaauucauaaauaacaggcucaaaaaucacuaauaauuaaagaaguuuugaaauauuaaagugagacauuacuuuucaccuauuggacuggaaaauacagaauuuaguaauuaucucuaagaaauuagggccaggugugguggcucacaccuguaaucccagcacuuugggagaccaaaacagguggaucacuugaggucaggaguucaagaccagccaggccaacauggugaaacccugucucuacuaaaaauacaaaaacuagcugggcaugguggugggcgccuguaguccuagcuacucaggaggcugaggcagaagaauugcuugaacccaggaaguggagguugcagugagccgagaucacgccacugcacuccagccugggcaacaacaagacugucucaaaaaaaaaaaagaaauuaggaaagauuggccgggugcgguggcucacgccuguaaucccagcacuuugggaggccgagguggguggauccugaggucaggagaucgauaccauccuggcuaacacagagaaacccugucucuacuaaaaauacaaaaauuagccaggcguggcggcgugugccuguagucccagcugcuggggaggcugaggcaggaaaauggcaugaacuugggaggcggagcuugcagugagccgagauugcgccacugcccuccagccugggugacagagcgagacuccgucucaaaaaaaaaaaaaagaaauuaggaaagauacccuguugguugaaugaauguaugugucauaacucuuuuggaggacaguuggaaauacuuggccaaauuuuaaaugggcagacuuuuuuuuguuaauuuuuuacuuuaauuuuaauggauacauaguagguguauguguuuaugggguacaugagcuauuuugaugcaggcauacagugcauaaucauguugcguaaaugggauauucaucaccucaagcauuuaucauuuauuuguguuacaaauauuccaauuauacucuuuuaguuauuuuuaaauauacaauaaauuuuguugacuguaauuacccuguugugcuaucaaguacuagaucuuuuuuuucuuuuuuacuuuuucuaaccuuuuuuuuuuucugagacagugucucacucuugcucaggcuggaguauaguagcaugaucacagcucacugcagccuugaccucccaugcucaagcaguccuccugccucagccuacugagacuacaggcuugagccaccauuccuggcuguuuuuuaaaauuuuuuguagagauggaggucucacuguguugcccgggguggucuugaaccaaauacuagaucuuacucauucugugugaguauaguuuuguacccacucuccaccacuaucguucccagcuucugguagcuaucauucuacucucuaucuccaugaguucaacuguuuuaauuuuuagcuuccacaaaugagugagaacauaagguuugucuuucuguaucuggcuuauuucacuugacacaaugucuuccaguuucauccauguuguugcaagugacaggaucucauucuuuuuuguggcugaauaguacucccauuguauugcuagacacuuaaguugcuuccaaaucauggcuauugugaauagugcugcaauaaauaugggaguguacauaucucuucaauauacugauuuccuuucuuuuggguguauaucuaguggugggauuucuggaucauaugguagguguguguuuaguuuucugagaaaucucuauacuguucuccauagugacuguacuaaaguacauucccaccaacagcaugugaggguucccuuuucugcauauccuuuccagcauuuguuauugccucucuuuuggauaaaaaccauuuuaacuggaaugagaugauaucuugauguaguuuugauuugcaguucccugaugaucaaugauguugaacacccuuucauauaccuguuugccguuuguaugucuccuuuuaaaaaugucuguucaggagccgggcacaguggcucacgccuguaaucccagcacuuugggagguugaggugggcagaucuugaggucaggaaaucgagaccauccuggcuaacauggugaaaccccgucucuacuaaaaauccaaaaaauuagccgggcgugguggcaggugccuauagucccagcuacucaggaggcugaggcaagagaauggcaugaaccugggaggcagagcuugcagugagccgagaucgugccacugcacuccagccugggcgacagagcaagacuccaucuaaaauaaaaaaaaaugucuauucagggcuagggauggugucucacgcuuguaaucccaccacuuugggaggccgaggcgggcggaucacuugaggucaggaguuccagaccagccaggccaacauggugaaacccugucucuacuaaaacuacaaaaauuagcugggcaugguggcacgugccugcaaucccagcuacuugggaggccgaggcaguagaacuacuugaacccaggaggcagagguugcagugagccaagauuacgccacugcacuccagccugggugacagagcaagauccguuuccaaaaaaaaaaaaggaaaaaugucuauucauaucuuuugcccauuauuuaaucagauuauuagguuuuuuuuuuccuauugaguuguuugaacuccuugucuauucugguuauuaauccuuugucagaugcauagugugcaaauauuuucucccauucuguggguugucucuucauuuuuuugauugcuuuguuuugcagaaaccuaaguugaugugaucccacuuaccuauuuuugcuuugauuaccugugauugcggggugcuacucaagaauuacuugccuggaccagugucauggagaguuuccacaguuuuuucuuuuaguaguugcauaguuugagguuuuggauuuaagucuuuaauucauuuugauuugauuuuuguauauggcgagaaauaggggucuaguuucauucauucuucugcauguggauaucuuguuuucccagcacuauuuauugacagucuuauuuauugaaggcugucuuuuccccaguguuauguucuuggcaccuuuguaaaaaaugaguucacucuagauguauggauuuauuucuggguucucucuucuguuccaucgguuuaugugucuguuuuuaugccagcaccauccugcuuugguuacuacaguuuguaguauaauuuaaaggcauagaaugugaucccuccaguuuuguucuuuuuguucaggcuagcuuuggccauucugggucuuuugugguuccauauaaauuuacaaugauuuuuuucuauuucugugaagaauguuauugguauuuugauagggauuacacugaaucuguagauugcuuucaguaguauggacauuuuaacaguauugauucuuccaauccaugaacauggaauaucuuuccuuuuuuuuuuuuaauguguaugucuucuucaguuucuuguaucaguauuuuaugauuuucauuguaaagaaagagaucuuucacuuuuuuuuuuuuuuuuuuuuuugagacagaguuucacuuuuguugcccaggcuggagugcaauggcacgaucucagcucacugcaaccuccaccucccggguucaagugguucuccugccucagucucccgaguagcugggauuacagggaugcaccaccaugccuggcuaauuuuguauuuuuaguggagacgagguuucuccauguuagucaggcuggucucgaacuccugaccucaggugauccucccaccucggccucccaaagugcagggauuacaggugugagccaccgcgccuggcugagaucuuucacuucuuuugugauacuuauucauagguauuuuuuuauuugcaguuacuguaaauggaauuacuuuuuugauuacuuuuucagauuauuugcuguggcauauagaaaugcuacugauuuuuguguggugauuucauauccuucgacuuuacugaauuaguuuaucuguucuaauaguuuuuuuguggagucuuuagguuuuuccaaauauauaagaugauaucaucugcaaacaaggauaauuugacuucuucuuuucuaauuuggaugcccuuuauuucuuucucuugucucauugcucuagcuuggacuuccauuacuauguugaauaauaguggugaaagugggcauccuugucuuguuccaaaucuuagagaaagacuuucaauuuucucccauucaguaugauacuaggugugggucugucuuauauggcuuuuaucguguugagguauguuccuucuauccccaguuuuuuuuggauuuuugucaugaagggauguugaauuuuaccaaaugcuuuuuuuagcaucaauugaaaugauaguaugauuuuuguccuuuauucuguuguaucauguuuuauucuguucuaucaugugauauaucacguugauugauuugcauguguugaaccauccuugcaucccuggaacaaauuccaguuggucaugaugaaugaucuuuuuaauguguuguugaauucaguuugcuaguguuuuguugaggauuuuugcaucaauguucaucagagauauugaccuguaguuuucucucuuuuugacauauuugucugguuuuaguaauacugaugaguauuacugggucuuagaaugaguuugaaacuauucccuccuccuccauauuuuggaauauuuugaguaggauugguauuaguuuuucuuuaaauggcacugaagccauuggauccugggcuuuucuuugcugagagacuuuuuauuauggcuucgaucucauuacuuguuaguacucuagucaggcuuuggauuucuucaugguucaaucuugguagguuguaugugucuaggaauuuauccauuucuucuaggcuuucugauuuguuggcauauaguugcucaucguagccucuaaugauccuuugaguuucugcaguauuaguuguauugucuccuuuuucaucugugauuugauuucuuugggucuuguaucuuuuauuuuuaguccgguuaaagguuuguugauacuauuugucuuuucaaaaaaaucaaguuuacauuuuguugaucuuuuguguguuuuguuucaauuucauucauuucugccccgaucuuuauuacuucuuuucuucuacuaauuuuguguuugguuugcucucgcuuuucuuguucuuuaagaugcaucauuaguuuguucauuuagcgccuuucuccuuuuuuugaugugggcacuuauugcuugcuauaaacucaccucuuaguacugcuuucacuguaucccauugguuuugguaguaguuguguuucuauuuucauuuuuuucaagaaauuuuucaauuuuuuucuuaauuuuguauugacccccugcuuaauaaggggcauauuguuaacuuucauguguuuuuguaguucccaaaguccaucuuguuacugauuucuaguuuuguuccauuguggucagagaagauacuuguuaguuuuuguagguuaguaacaauauuuggauuauacuaaggaguuuuuaucuagaguuauagagauuuucuuagaaugcugccaugguagagaauaaguggguggguauauaggggaaaacaacauuuugaaauauguuucaaauuuuccagauuaaacaguuaaaaagaacagguggugaaccuagagaauaguguuuuagaaaccgagacacaggauuucuuaauagugggcaacuuugucagggacugcaagagagaucaccuagaauaaggacugaaaagaugucauagguuucagcagcugguuucaugaccuuugcaaccgcaguuuugguggaguguuugggcuaaaaccuggcagcagcauuuugagaaauguguggaagguaagaacauggagaaaggauaugaucacuaugugaaaaaaaguuguuucauuauaaaagauuacaaacuuaugauuuuuaaaauauuaaagagaaguaugaagugaaaaaaaacccugccccuuuuccuuucucaucuucucaccuguuuccuccaguuuuagucucuaguuuuacucuugagauuuguggcuacugaaugaauggagugucaaucugaaugggaaagagaauuuuuuuuuuuuuuuuuuugagacaaagucucgcucuuguugcccaggcuggagugcaauggugugaucucgguucgcugcaaccuccgccucccagguucaagcgauucgccugccuuagccuccugaguagcugggacaacaggcacgugccaccacgcccagcuaauuuuuguguuuucguagagacgggguuucaccauguuggccaggcuggucucaaacuccugaccucaggcgauccacccaccuuggccucccaaagugccgggauuccaggugugagccacugcaccuggccugaaagagguuuuugagagggagacucagaaacgccuuugccugagaagagcuaggaaauagaaggaaagaaaaaaauggaacagaggagcucagagaagauaaaaggaaguagggaugcaguggucaagugggagaaaaaaaaggagaggcacucuuuucuuugaguagccaggaaaaaaugacuuuguuuuucuuucucaauuagcagaccaagcuguaugcuggugauugagguuuggauaggguugguggcaucuaguguguaguaacuaugggaauuagcaaaucaauggcagagugaaggacucacuuucacucgcucagguccaaacuaggcuuuaaaugacuucuuuuuuuuuugagacagucuugcuuuguugcccaggguggaguucaguagcacaaucuugacucacuacacccucugcuuccuagguucaagcgauucuucugccuuagccucccgaguagcugggacugcaggcacacaccacugugccuggcuaauuuuuguauuuuuaguggagaugggcuuucaucauguuggccaggcuggucucgaacuccugaccucaacccgccugccucggccucgcaaacuguugggauuacaggccaccacaccuggccugaaugacuuuuucacugaggaaugccauaguccaggcagaugugccaccucauugaucgccagggaugacucaguugucuggcuaguuggguaagggagguguuuuuuccaucacuucugugugucuguuacuaaaacuguucauuuauauuucacagcagcucaagugcaacuguucuucaguacuuuuguagcuuuucauuucugugacuccuuugaggaggcucugucaugugaaaggaaaaauuugauaaaaugauuacauggagacuucuaacuaaucguauuguggcaauggaacuacuuucacuuccucuuuuaaagaaacagguaacagaaagccuccucuuuagacuuucccauuagacacauagcagugacaauuuaaacuguggucaguagccaggcaugguggugcacuucuguagucccagcuauuuggaaggcugaggcaggagaaucgcuugaacccaggaggcggagguugcagugggccaagauaacaccauugcacuccagccugggcaacaagagccaaacuccaucucaaaaaaaaagaaaaaaaauguggucaggaauagauucuguuugcuguauuugggauauauacaauguuaagaacaaaauggccaggugugguggcucaugcccauaauuccagcacuuugggaggcccaggcgggaggauugcuugagcccaggaggucgaggcuguagugagccgugaucaugucacugcauucagccuugagugacagagugagacccugucucaccaaaaaagaaaaccaaagaacaaaauuuuauaucuauauacauuggugucugugaaccucaugugguauuuuuaugcaaauagaaauggaaguuauauguuaccuacuucagaaaauugaauugucuaaauaaauaucuaaauauuuguccuuaggccaggcacggugcuucacgccuauaaucccagcacuuugggaggccgaggcaggcggaucaccugaggucaggaguucaagaccagccuggacaacauggugaaacccugucucuacuaauacaaaaauuagcugggugugguggcacacaccuguaaucccagcuacucgggaagcugaggcaggagaaucgcuugaaccugggaggcagagguugcagugagccaggaucaugccacugcacuccagccuggguggcaagagcaaaacucugucuccaaauaauaauaauaauaaguaaauaaauauuuguccuugucauauauuuguuuauaaauaugagauuauuuuuucuaaaaauuuacauuaugaaauuuguuuaguaaucaucacauuuagggguuuuaaagugaccuuuacuuuacuuuuguguuuuuuaggagacccguguacaguaucaucucaguuggaguuagaagaagccuuuagacuuuaugagcuaaacaaggauucugaacucuugauucaugguaagagaguagucauuucauacucguccagacugauaauuucuuugaaaucacucuuuauucuucaccauuuugaaacauaaucuuaaugucauuuucucaaucucugugacucaugccuaaguaauugucguuauuuaguaguuucucacgugcuacagaagguaaaauuaaucugcugcuuauagucuggggaauuuuguggucucuguaugucuuguuggauauuaaaaugugauaucucaguguaucacagcaaauuuaugauagaacuuaaaaauugagagccuggggaaucuaagucaucuacuugaaauuuuguuauguauacaaauaaugaccuccaaagguaagguaucuuaaauauccuuucuuuugcuuaaagguuaauagugaaacuauuuacaugauuccuuuauuuuugagacagucucacucugucacccagguuggaguacagugguaugaucucggcccacugcaaccucugccuccuggguucaagcaucucagccucccaaguagcugggauuacaggugugcaccaccauggcuggcuaauuuuuauauuuguaguagagacaggguuucaccauguuggccaggcuggucucgaacuccuggccucaagagauccgccugccuuggucucccaaagcacugagauuacaggcaugagccacugcaccaggcccauuuacaugaugcuuuagagacauuaauauguuuauaccucagcaaccuugagauguaggaaguggcauagaagaaguaaccuaaacucaguuaucauuguaacuggcacguuguagaccuggauugugaaucuaggaauucugauuccaaauuuguguuucauucaacuaugcuaaccaucaaaagucauguaaaacuuuuuuuuuguuuguuuuuuugaggcaguuucucucgcucuguugcccaggcuggagugcauuggugcagucauagcucacugcagccuugacuucccagguucaagcgauccucccaccucagccuccugaguaacugagaccacaggcacugccgcaccacuaugacuggcuaauuuuuuuuuuuuuuuuuuguauagaucggauaucacuaugaugcccaggcuggucucaaacuccugugcucaaagaguccuaccaccugggccucccaaagugcugggauuagaggugugaaccaccaugcccagccaagaaccucuuaauauacugcauuuaauugcaauauauugacaguauuucguugaacauuuuugagagcuaugagaccagacuuaggaaucuucuaaaaaagugaaacgaauguaaaucuuuccuuaaguauaaugaaucauuucagugccuuauuauuauuucuuuguauuuuccuuuacaguguuuuuuuuuuaaaaaaaaaaaaaaaacagugguuugauuuuauauuuuauuugagacacaguuucacucuguugcccaggcuagagggcaguggcacagucucaacucacugcaaccuuggccuccuguguucaagugauucucaugccucagccuccaaaguacuugggauuacaggcgccuaccaccaugcccagcuaauuuuuguauuuuuaguagagaugggguuucaccauguuggccaggcuggucucgaacuccugaccucaggugaucugccugccuuggccucccaaaguucugggauuacaggcgucagccacuacgccugaccugauuuuuuucuaccuccagaauuugacauagugacucacaagggauccauaauguacuuuguugagauucuaaaagagcuuuaagagucuauuuuuuuugucaucucuuuccagaauaaaauuacaaugaaugcauaaagaagugauugaugaaugguauuaaacagucaguuuuaagucuuauugccuuuuaauacuacaucacagauguuuucagaagcuagcuuacguuucagcuuuuaaaaauaugcauuaggaacugugcuuccuauagucugugcucuuuauuaaacuguguccuuuaguacaucacagacuaagaauagcugacuagauauucauaaauacauuguugcuuuauauucuaccuuguuauaaaaaugguuuuaauuaguauauacauuuaaaguuucuaauguaaauuuacauuuuugauuuugguacuguuucugguguuaauuuauuccuaaguuuaguauacaucuuuuaaaaaccaauauuuuauguuccauauuuguauacauuuuuguaauuuaauuuucauccuucauugugacaaacuuguccuacuauaccaaggauuuaaggcgauauuaguuaaugauuucuuuaaggauaagaaaauaauucaugauguaacagggacuggaauuagucauuugagcuucugaugcauugguuuuuuuguuuuguuuuguuuuuguuuuuguuucugagauggugucucauucugucaccugggcuggagugcaguggcaugaucucagcuuacugcaaccuucgccucccagguucaagugauucccgggccucagccuccuagggagcugggauuacaggcacaucaccaugccaggcuaauuuuuuuuguauuuuuugguagagacagaguuuuaccauguuggccaggcuggcauccccugaccucaagucauccacccaccuuggccucccagagugcugagauuagaggcguaagccaacgugcccagccuaaugcauuguuuauagacauguuuguuuucauaagaacuuuuuucuuucuuucuuuuuuuuuuuuuuuuuuaacaucaacaaagcaaggcaaauaaaaccuucuuuuguggccgggcgcggugacucacgccuguaaucccagcacuuugggaggccgagacaggcggaucaugaggucaggagaucgagaccauccuggcuaacacggugaaaccccgucucuacuaaaaauacaaaaauuagccgggcaugguggcgcgugccuguagucccagcuacacgggaggcugaggcaggagaauggcgugaacccgggaggcggagcuugcagugagucgagaucgcgccacugcacuccagccugggcgacagagcgaaacucugucucaaaaaaaaaaaaaaaccuucuuuuauauggccuugguaaaaugaaucccuuuggcaaauaauauugaucacaugcuaaguaucuugucucaagugaagagagggucagguugaaaucugggucaguuucuuuuacauuugaauuuuaaauucuguguaauuuguauguuuuaaauaugcuguuaacucauguucguuuauuuucuuucaguguucccuuguguaccagaacguccugggaugccuuguccaggagaagauagugaguguuuauauacuucauaccuuuuacaagaguuacuaugcuaugguacaagugaaaaagaaaucagagauagaauuuuuagcuaggugcaguggacaguggcuaaugccuguaaucccagcacugugggaagcugaggugggaggaucgcuuaagcccaggaguucaagaccagccugggcaacaaagugagaccuugucuuuccaaaaacacacaaaaaaauuagcauggugugugccuauaaucucagcuacuugggagguugaggugggaggaucccuugagcccaggaguuugaggcuacagugagccaaggucgcacuacuugcacucuagugugggugacagagacaggccuugucucaaggggaaaaaaaaaaaggaaauagaaguucuaauucauuugauuucuuuuccauuuuucagucaauuuagaauauauuagugacugcccaaaugcuacuuugccagaucaaauucagauaguucuuaguuacaacuuacaugauugccuguugcacauaugaaaggaauauuaaguuaaauuuaaguuuuaaaauucaauuuuggaaauguucaaaccuauacagaaguugaaacaacauggaaaacaaggauaccuauauauccuuugcccagauuuaccaauuuuuaacguuuucccuguuugcuuuaucucuguaucugucuauaucucauauaugcaugcacaguuauacauaacaaacacauuuuuuuuuuuuugguuauaccacuugagacugacaugacacucagcacauguaauuaggaauuggcuuuuuuuuuuucugcaguguuuuuuacuuaaacagguauuaagucacuuuuguuguuguuguuuuugagacagaaucucgcuuucucacccaggcuggagugcagugacgcaaucuuggcucauugcaaccuucaccucugggguucaagcaauucuccugccucagccuccugaguaccugggauuacaggcgccaacaccaugcucagcuuauuuuuguacuuuuaguagaguugagguuucaccauguuggccaggccggugucgaacuacugaccucaggugauccaccugccucagccucccagagugcugugauuacaggugugagccacugcaccuggccccaagucacuuauuaaaugucuuuaaauauugcagacuuccuacaguugacccagagaaauguguauauuuauuagaucuccaauuccuaguaacuucagguaaccaaccagaguccacaguggaacggugauucuuacccuuggacacauuaaaauugugggauggagggaaugaucaaugccaaauuuccauccccaagcuuaaugaauuaguguggaggugaaaucuggauaucuuuguauuuuaaaauggacucucaaaauguagccauugggucccacagcaucagcuucaccugagaacugaauagaaacugcacuccaggcugggugcaguggcucaugccuguaacccuagcacuuugggaggcugaggcaggcagaucaccugaggucaggaguucaagaccagccuggccaacauggugaaagcccaucucuacuaaaaauacuaaaaaaguuagcugggugugguggugcauaccuguaauccuagcuaccugggaggcugaggcaggagaauugcuugaaccugggaagcggagguugcagugagcugaggucgcgccaguacauuccaaucuggacaacagagcgagacucugucucaaaaaaaaaaaaaagaaaaaaacugcacuccaaucuacgugauucauaaacucuuggacuggggcugagcuaccagauuuaacaagcucuucaggugauucugaugcacacuaaaguuugagaaccaccauuuaaaagcuuccccaggucaggaauuguuaacggaauuucuuuggaauaucuaagccaaugguuacuauuaaugagaugaacuaagaguguccaacuacucuuuguucuaauguaauuuaauaugcaaacuuauguuugauuguaaguuauugcuuuugguauuuuggcauaauuuacuaauuguggauauuaggcaacucauuuucauuugugguuucugcacaugcccaucacuuuagaaggaauagugguaaaugcuuugcuuugaauuaaucgaaauagcucuaaacuuucuuuuucuuuuuuuuuuuuuugagauggucuugcucugucgcccaggcuggagugcaguggcgagaacucggcugacugcaagcucugccuccuggguucaugccauucagccuccugaguagcugggauuuuaggugcccacuaccacgcccgucuaauuuuuuuuuuuguauuuuuaguagagaugggguuuuguauuuuuaguagagugcuagccaggauggucucaaucuccugaucuugugaucugcccaccucggccucccaaagugcugggauuacgggcgugagccaccgcgcccggccuaaacuuucaauucuguauuaagcuauccugagauuucuaauugagagcauugcaacuggucuuuaguaucuuaauuuuaaauaguaaacccauugcuauauuugcuuuaaaauaugacuuugggaaccuguuguaaucuuucuaugguauuaacuauuacuguuauuaccauuacugugggauguuauuauuaaugacuaauagacaauauauaaaauaaugauggacuuaaaaauaugaagguggacuagauuugaucguuuggaaccucuuucucuaacuauauuugagaaacauauuaauauaaagaccacuggaugaaaaguuguuggggaaaaagauaugcuucugguacaaaauaucacuuuacagauuaguuacaaagacugaaauguaccuuuacaaugaagagaucuagcagucacuaccuuuaaugguuauugaacaucaguagugggaguugauaauccgacauuuguguaccucaugaaaaguaaugagauaagaaauacacaacacuaccuauguguuauuuuugccaaagguauuuaauacugccucuaaucguaaguaaacagacaaauccagaaugugggauauaauaugaaacaacuaaccagacucuuuaaaaaaaaaaaaaagucaacauaaugaaaaggaaguaacaacaaauaaggcagagugaauguuuuaaaauguuaaggagaccaaaaaaagcaugaucaaaugcagucccugaaucuugauugcauccuggauagaaaaagugagcuuugaaagucacuuuggggccuggcaugguggcccaugccuguaaucccagcgcuuugggaggcugaggcagacagaucaccugaggucaguaguuugagaccagccuggccaacguggcaaaaccccaucuuuacuaaaaauacaaaaauuagccggguguggugguguguaccugcaaucccagcuacucggguggccgaggcaggagaauugcuuaaacccaggaggcggagguugcagugggcugagauugcaccacuggacuccagccugggugauggagugagacugugucucaaaaaagaaagucacuuugagaccaguuagggaaguuuguauaugaauuguauacugguugauauugaauuaauguugauuuucuaagacaugguaaaugguauugugguuagguagaauuggguggcgggggggugcggaauauccuuaaucucagacaauggauacuuggguauuaaaggguauuuaagugccaugaugucugcauuuuacuuccaaguaauucagaaaaaaaaaaguauuuuuuuuguagugaugaaaguaaauaugacaaaacaugaauaauugguaaaucucggugaaagaugcaggugucuauucuuuuaccuuuucugugggauuaaaagauguucaaaauaaaaaguuggaggaaaauuuuuaaaaagaaaagcaguaguaggccgggcgcguuggcucacgccuguaaucccagcacuaugggaggccgaggcgggcggaucaucugaggucgggaguucaaggccagccugaccaacauggagaaacccugucucuacuaagaauacaaaauuagcugagcaugguggugcaucucuguaaucucagcuacuugggaggcugaggcaggagaaucacuugaacccgggagguggagguugcagugagcugagacugugccaccgcacuccagccugggugacagagcaagacuccaucucaccaaaaaaaaaaaaaaaaaaaaggacaagcaguaggcaguaguagucaaauauuuauacucuguggucuuuauuuuucuuuggucccuugaugaaucuauuuuauuuuuugacguucagguuuuuaucaguauuuuuuuuucuugcagugaguaucaugaaaaaauuacagacuuaauuauaaaaugauuuuuacucaaacuugcucuuuuuucuuuuuuuaacuauuacucugucuucagaauccaucuaccguagaggugcacgccgcuggagaaagcuuuauugugccaauggccacacuuuccaagccaagcguuucaacaggguaaacauaguuuguugaaugucgauaaugugaaacagcuauuuuuucccuuucuacuaugaaagaaagguaguuuguuauuaagucuuguuauacacuuuuaaauacauaaguagcaugaccuuacauuuccaguuugccugaggcaguaugccuauaauuuuuaauagcaucucuuucacucuuaaaaaugcuccaggccaggugugguggcucaggccuauaaucccagcacauugggaggccaaggcugccggaucaguugaggccaggaguucauaccagccuggccaacauggcaaaaccuuaucucuauuaaaaauacaaaaauuagccaggugcagucacaugcaccuguagucccagcuacucgggaggcugaggcaggagaaucacuugagucugggaggcagagguugcagugagccgagauugugccacugcacuccagccugggcaauggagcaagacucaguuucaaaaaaaaaaaaaaaaagcuccagauuggaugauuaauuauuccacauaauauacccuagcuguaagaaaauugaauuuuaaaauauaauuuaaggcaaccagaaaacaagcaagguuuauuuauuuaauauuaaucuuuauuuuuccaguuaguguuguaauuugauuuucacuguuuagaaaauaauaauagcaaacacuuaucuggguuguacuacguaccaggcacuuuuccaaaugccuuauauacauugauucauuucauccuuacaacaacccuguaagauagguacuauauguuuccacuuuauagauggcaaaacucaagugcagggcaguaacuugcccaagauaauacagcuaguaagugauagaaccaaaguuugaaagcagcagucugucuucagaagucaguuauucauuuauuauuuauuuauuuuuuuuuuauuuuaaagacagagucccgcucuaucgcccaggcuggagugcaauggcacagucucagcucacugcaaccugcaucucuuggguucaagcgauucuugugccucagccuccugaguaccugggaccacaggcaucagccaacaggccuggcuauuuuuuguauuuuuaguagagauggaguuauaccuuguuggccaagcuggucucaaacuccugaccucgcgugauccguccgccucggccucccaaagugcugggauuacaggcuugagccaccaugccuggccagaaacgaauuuuuuaaauacucuugauaaccgcaaauuuuuggaugccauuuccauucuaaaacuaaugccauguaauuaauuaauguaaauagaaaccaccacccgaaaucccucuccaaacucucuuacuuccaguagcacugacauuuaagaaggcuuugaggcugggugcaauggcacaugccuguaaucccagcaguuugggaggcugcgaagggggaacacugaagcccaggaguuugagaccagccaggguaacguagugugagaucccaucucuacaaaaaauacaaucauuagcagggcaugguggcacacaccuguaguccuagcuacucaggaagcuugagcccaggacguugaggcugcagugaaucaaagugacuccacuggacuccagccuggcugacagagcaagacccugucucuuaaaaauaaauaaauaaauaaaaagagagaccaagugcgguggcucacacguguaaucccagcacuuugggaggcugagguggguggaucaccugagguccaggaguuugagaccagccugaccaacauggugaaaccccaucucuacuaaaaauacaaaacuuagccagguaugguggcgcauaccuguaaucccagcuacucuggaggcugaggcaggagaaucacuugaacccgggaggcggagguugcgguaagcugagauugugccauugcauuccagccugggcaacaagagugaaacucugucucaaaaaaaaaaaagaaagaaaagaagaagaaggcggcuuugaaaugagaagucacuuuagguuauugcucuuuaagaaaacagagcuuuguuuugaccucugaacagccugcaagguuuauguuugcuuaggaguccuucaauggcuuuuucugccauauauauuucuaguuuaauucuguuuucauuauuuugaacuugauuauguaaagacugaaaauucuuagacuuagaaagaaaugugguugcagauuucacugucucuuuaaaauaagcucuguuuuucgcugaccuucauagcuuuuaaaaaauuauguaugaggaagcuuuguuuugcuuuuguuuuuguuuuuguugugggcugacaguugacaccgugacaaagggaauugagucagcaaacuauuugggaaaugguuaugaccuucuugguuaauaaaauauuguugaauuacucuuuucagcgugcucacugugccaucugcacagaccgaauauggggacuuggacgccaaggauauaagugcaucaacugcaaacucuugguucauaagaagugccauaaacucgucacaauugaaugugggcggcauucuuugccacagguaagaugucuguccuuuuuuuuuuuuuuuuuuuuaagagcgugcuugauaacacugcuauaacagagugcuaaaauagggagguguucaggaauuacagcacaacagaguagcuacagaguauggggaggaauaccuuacguuacuguuaacacaccgugaacuuuggaacuucgaaauaucugugguaauacuugucugugggacacaguuaacuucuuuaccugcuguaaaauccucuggucuaaauuaggaagcuauagagagaaccauuuaagaguuuuuucccccucuccuuuaaucugaacguauuaguuuauagcucacauuauucuagcuucuauccuaagcagauaucagguaagaagagucaaagguaucauguuuguuauuuaaacugugagauuacuggcgaggaaagcauuuaaaauuuuuauuuauuaauuucuauuuuaaauauauaaaacauguuuguuaucgaaaaaaauacagaauacagaugaauaaagaaaacuaaguaaaaguccacauauauucuaccauguaaagguaauugucauuugguggauauccuuccagaacuuuuccugugcaaauuuauaugcauaaacauuuuuaauuuuccauauggaaaaaauguaaacauguauaagaguagguggaacacuauaaugaacucccauuuacuagacauccagcuccaacaguuaucaacucaugucuaaucuugguuucaucuguacccccauucacuuaacuuccccuugcccuguauuauuuucaaacaaaucucagacauauuucaguauguaccucuaaaagagaaggacuuuuuuaaaaaccuaacuaaaaaacaaauucuuuaugucaaauauccaguaaguguucucauaaauauuauaauuuuguuuuuauaguuuucauuaugaaucaggauccaaaugaaaugcacuuguacaauugauugaucucuuagauauucuuuaauuuacugguucuuucuucauuucucucucuucuuuuuuuccuuacaauuuaauuguaaaagaaacaguuauuugucauuuacacuguuguaaaauuuugcucauuacuucuccaugguuauguucaguauguuauugucuucuuuauucuuuuaucuuguacaguaguuggaugucgagguuugauuagauucugggguugguuuguuuguuuugguggauuguuuuugagucgacuuuacagaggguuguuuauccaccagaaggcacaugugcuugccugugucuuuuuuguuauuguuuugagacagagccucgcucugucuuccaggcuggaauguaguggcacaaucuuggcucacugcaaccuccaccucccagguucaagugauucuccugccucagccucccaaguagcugggauuacaggugugugccaccaugcccagcuaauuuuuguauuuucaguagagaugggguuuuugccacguuggccaggcuggucuugaauuccugaccucaggugauccaccugccucggucucccaaagugcuggaauuacaggcgugagccacugcacuuggccaaucuuagugaacuuucuggcaaaucuuacuuccuuaaggauccagaauuagaauuacuggguuaaaagauacgcauuuaaaaaaauaccuggaugcagcuaucuaagcacacugccuaucgauuagcccugcuccacaaggaacagucaaaaaaagaaagaaaaauaccuggaugcaucuuucuaaauuguccuuuagaauuguuauuccauguuuauucaugggacuugcuuuggacauugugaaagcagguuauuaccgguagcucuuugguauuagaaucuuuaauuaguucauauaagcuuaggaauggguuuguaguaaaggggaaaauccaaucuuaaggaaaaacagaaggcugacuauuuccaacauauuuauguagguuacuauuaauauuuuugaguauucuuuggugacauauggaaggaaagggggcaggguuagugauuauauugaaguuuuaaaaauccuuaagcuuacuuaugagccuuucuuuaacgcagccuugaaaugcuaacuguaucauuaauguucuuucucaaguuuacuuuuuccugcugguauucauuaaaugugagucuaagaauaaaucaguaauaacuuggguuugaauuuaccuuuuuccugagauuauucgccauuauuuggguaaguuggauucuagaaaguauuucuuuucucuuuuuuggggccacugacacccuugagaaucuucaggaaaaugggaaacccacaaaauuuuacauguaauuuuaagagguuauagacauccugaagucuaccccggaccccagcuaaagaaugcauauuccagaaacuuauuuuugccaaagaucugaaguggagcuugaaggaagaauagguaguguugaagagaagcaaagcagaauauauggcaguuuaauaugauuucuaauugguggucugaaauuaguuuuguauuuucuuuucuguaaaaugugacuaacauuaccucauucacagcaguauuguauaguuucauaaaacaaaauuaaaaguaaauucucacuuaaguuauauucuuucaaaauuaaauuuuaauaugcuguguguuguugaaauaguguuauuucugguguaauagagguacuccacugaguuacugugucuuuggaaauguuuguaggaaccagugaugcccauggaucagucauccaugcauucugaccaugcacagacagguaagaguggugcuggcacaacccauuguucauucacagaguagcauguaaagacuuacuuaggugacucucuuacccaaguuuaaaaacauuuacuucuucccaauuaaaaguaaauacauauauuuuguaguggugaaaucagucacacuauuuaacauacacauuuggcauuuuuaaaagacaacugugggcugggugcggugguucacaccuguaaucccagcacuuugggaggcugaggcagguggaucaccugaggucaggaguucgagaccagccuggccaacgugguaaaaccccgucucuacuaaaaauacaaaaauuagcagggugugguggcacacuccuguagucccagcuucucaggaggcugaggcgggaaaaucgcuugaacccagaaguuggagguugcagugagccaagaucaugccacugcacucuagccugggugacagaacaagacuccaucucaaaaaagagagagagaaaaaaaaaagacaacugugggcugggugugguggcucacggcuguaaucucaucacuuugggaggucgaggcagaaggaucccuugagcucaggaguucaagaccagccuggccaacacagggagacucugucucuauuuaaaaaaaaaaaaaguauguaaacuacaacaaaugacuauuuuuucuaguucacauaaauuucuuuugagacgccuuuaaauucagcaaacucaguuuuuuuccauaaugaaaaacaugaggcugauuuuguggcccauguugacuguguucaggugacucgcuuuuuucuuuuucuuucgagacagagucuugcucuguugcccaagcuggaaugcaguggcgugaucucggcucacugcauccuccaccucccagguucaagugauucuccugccucagccuccugagcaucugggauuacagguucaugccaccaugcccagcuaauuuuuuuguauuuuuaguagagaugggguuucaccauguuggccaagcuggucucgaauuccugaccucaaguaauccacccgccuuggccucccaaagugcugggauuacaggcaugagccauggcacccagcugaagugacuuguuuuuauuaaaagcuuuauuaucagaaguagaaauuaugugaaacauagagagaugcaauauaggaaauuccaggaagaugguguaacugaaaacguuagauagauacaaaaccuuaaacacguaucugggaaauuuggagagcagugcaaggagguagaacagcaugaucuucucuggacuaaaucaagaaagggaaaacaagggaguuuuucuggaaagacaaaaugcaaucucguagucauagaaugaucaacucuaugaaaugcaggcucuuuuuuuuuugccccaaguagcuuuaagaaguagaaguuccauccuugucuguucuuuacuugaccauugugguaguuaggaaaauucugaguacaauggagugagaagugaaaaccagagguccuguaucucuaugucuuagucauacuaaaaaauuuaaacauaucuuauagagucauuuguuuagaaggaaguguuugauuaauuuguaaagaagagaaauguuuuaaaaauaacgaaaguacuuguuaaaagcaguacuuggcuaccagguugugaugcuugcucucuuuacccucacuaaagauuaggauuuaacuauuguauuuacauacaauuuguuauuaguaggacagauagucaguuuuaaauaaugaaaauuuauucagaaguaaaaacuaaaauaaaaaucaggagacaauuuuuauuucaaacucauuaaugguugcuguuuuuuucuccugcaccuuuuuuuuuuuuuuuuuuaauguuugguauuggguuuuuaguaauuccauauaauccuucaagucaugagaguuuggaucaaguuggugaagaaaaagagguaagauaauuugucuuauuguacauuauaucauuagcuuuuuaauaaggcucaggaguuuaaaaguaugacauauugaccugcuuagacuuuagaucauaauggugaaaugcaaaaaugauuuguaaugauuccagaguuuuauucugauuuaauuuaguaauuaaauuacuaauuuaaacuaggaaauaauuuagugggauaacuuauuuucauuuuaaaauagcuuaaucugaaaauuacaauguauuuaaggauacuguuuaaaauacuugguaguauuguuuaaaauauauaguagacccuuccguuuugugccugaauugcuuauuuagacaauaaaugauuaaacauauuaacugucauuguuuuuuugacuauuaaguauuuuaucaguuuuuaaaacaaaacaaauaauuaaaaugauuugauuaaaauaauaaucaguuuuuugaaaaaagcuuauagugaaaaagauaaucaugucucccaccuuccacucccaguuuggcuucuuggcaaccuuuuaaaccauuucuaguuauguccauaauauuuauauuucuguuuuucaauuuuuuauuuuuguguauuucuggacaugaaagauuuaguucacacugccuccucucuuucccguaucauucuuuuuuuuuuuuuuuuugaguuggggucuugcuguguugcccaggcuggagugcaguggugugauuauggcucacugcaaccuuaaacuccugggcucaaguuaucuucccaccuuagccucccgaguagcuaggacuauagcccugugccaccacacccagcuaauuuuuucauuuucuauuuuguagagacagagucucacuauguugcccaagcuagucccgaacuccuggccucaagcaguucucccaaaucagccucucuaaguguuaggauuacaggcaugagccaccaugcccagccaaaacuuugaaacauaaauaaaaguaaacaauaauauaacaaagcccuuguaucuauuguuaguuaaaacagcuaucaauucaugucuagccuuauuuugucuacucacuucccucacuccuguauuauuuugaagaaaccuguuagucaccuauuugauguuauguuuuaguuucuuguucuguuugucugaaaaagucuuuuuuucuuuuuaacuuuuuuuuuucuuuuuauuuuuuuugugagacaggauuauugcacaggcacccgugcaguggugcaaugauggcucacuacagccucaacuucuugaguucaagccaccucagccucucagguagcugggacuacaggcaugugucaccacuggacccucaucacaauauacaaaaauuuacucaagguggaauaaagauuuaaauguaauaccucaaacuauaaaaauccuagaagaaaaccuaggaaauauccucucgacauuggccccggcaaagaauuuuuggcuaagucuccgaaaacaauugcaacaaagccaaaaauugacaagugggaccuaauuaaacuacagagcuuccacgcagcaaaagaauccaccaauaaacagacaaccuaaagaaugggagaaaauagucacaaacuauacauccaacaaagaucucauauccagaauuuauaaggaacuuaacagcaaaaaacaaccccauuaaaaaaugagcaaagggcugggcaugguggcuuacaccaguaaucccagcacuuugggaggcagagucaggcagaucacuugaggccaggaguuugagaucagccuggcugacauagugaaaccccaugucuacuaaaaauacaaaaaaaaaaaaaaaauuagggcgugguggcacacaccuauaauacuagcuacuuaagagguugaggcacgaaaaucauuggaacuggggaggcggagauuacaaugagccaagaucaugccacugcacuccagccugggcgacagagcaagacacuguuuaaaaaaagaaaaaaaaaagggcaaaggacaugaacagacauaucucaaaauaagaccuauaagcagccaacacacaugaaaaaccacucaucgucacuaauuaucagagaaauagaaaucaaaaccacagugagauaccaucucacaccagucagaauagcuguuacuaaaaaaucaacuugggcgugauggcucacacauguaaucccagcacuuugagaggcuaaggcggaaggauugagccugagaguucaagagcagccuaggcaacauagucucuacuaaaaauacaaaaaauuagccaggcucgguggcaggcgccuguagucccagcugcucgggaggcugaggcaggagaauggugugaacccaggaggcggagcuugcagugagcagagacuguaccagugcacuccagccugggcgaaagagcgagacuccgucucaaaaaaaaaaaaaaaagaaaauuacaaauaacacuuuuacuguuucucuagaagaugcagugaccuuggcacaccuuaaauucauuccuuuuccauuccugccuuuggguguuauuauuaucagaguuuaaaauucuguguguguguauauuuguuuuuuuaaacaguuacuccuuauguagauuuacccacauuuuacccuuuuuguuuuucuuuccuuccuacgucuguuccuccaucugagaucaugcauuuucuccuucaagaacucaauuuaguuuuuccuuuagugagcaccuaguagugauggauccacucaguuuuucuuugucugaaaauguuuuucuuucacuuucacuuugugagcuacuuuugcaggauagagaauucuaggucagcuguuuucuucuuuuuuaggcccuuugaagaugacauuucacuguuaaguggcgucuaucauuucauucagccuuauuauugugucggugaaguuaacucuaucuuuuuugcuccacuugauucucucuuauaguuuccaguuagccauauuucaagucuauguguugacuuacuuucuuacacuucucuucuuucuuaaccuucucaaaccugguuucuuuucacucugcuguauuuacccuuguguguuagucuguuuuguguuguuacaaaggaauaccugaagguuggguguggcagcucacaccuauaauccuaggacuuuagaccgggaggaucauuugaggccaguaguucaggaccagccuuggcaacauagcaagacccuccaugucuacaaaaaauaaauaaaaauuagccggguuuggaggcacaugccuguagccccagcuacuugggagacugaggcaggaggaucacuugagcccaggaguucauggcugcagugagcuauguucgugccacugcacugcagccugggugacagaacaagaccuuuucuuaaauaaauaaauaaaugaaggaaggaauaaaggaauaccuaaggcuggguaauuuauacaagauuuauuuggugcacgguucugcaggcugaucaguaaguauugcacuagcaucugcuucucaggaagcuuucagucuuggcagaaggcaaaggggaagcaggugugccacauggcaagagagggagcaagggagucaggggaggugccacacucugaacucacucauuacacaggaacacaccaagccauucaugaggaaucugucccugugacccaaacaccucccacuagggaucacauuucagcaugagauuugagauuuggaggggucagauauacaaacuaucaccuuguuaccaaaucaaauuauuauuauuauuacuauuauugacagggucucacuuugugaugcaggcuggagcgcacuggcacaaucacagcucacugcaaccuugaccugccuggcucaggugauccucccaccucagccucccagguagcugggacuacagugcacaccaccaacauccggcuaauuuuuguauauuuugguagagaugagguuucuuggcacauugcccaggcuggucuugaacuccugggcucaaucaguccaccugcuucagccucccuaagugcugaaaauacaggcaugagccacugugcgcagccuaaauuauuauuucuaaguuuuuaaguugucauucucacucaguuuuucuaauacccuucuuucaguuuugugcuugcggguuucuuuaucuuucucaaaauuuacuauuugcuuuucuugguauucuucacuucagagauuucauacuuuauucucauggguccauugugugcugaugauuuugcaggcaucuaauaaaagacugucuucaggcuucucuguaaauugcuagaagcuuacauuuguaguugugaaugaauuuuaaggcuuacuuugucgucccaaaggggucuugguauucuguggaaaagaaugucuuccauucgcugaacuacuucaugcuuguuuucugucuauagcauccaaaaacgccucugaaugugugcucucacuagcuuacauucuauguaucaagcuuccagcagacucuuucaucuugaugucucauuauaacuucugaauuuaucaugaaaaacccaaucguucucuccaguaacuuugucaaucuuauccuagccacacacuugacguucccugucagugguacccccaaucucuuggucaccaagguuaauguguuuuuuuaauuccugcaucucuauugccucuguacccaaaaguuaucguauccuuuuuaagacauccuucgauguuuuugugauuucaacucccuccccauucuuauuaccaucccucuuaucucaaaauucauccauauaaucuggauaguuagauuauuugguuuggaaugacauuugaaaaauauuaagaacuuaaaauauuuuuauguuaggaaaauaucuuuaaaucguuauagguacaacuagguguuagaaauauaauguacuacgcaaagcauuucccauuauaacucugauacaaauguucucaacaggcaaugaacaccagggaaaguggcaaagcuucauccagucuaggucuucaggauuuugauuugcuccggguaauaggaagaggaaguuaugccaaaguacuguugguucgauuaaaaaaaacagaucguauuuaugcaaugaaaguugugaaaaaagagcuuguuaaugaugaugagguaagcacugcauauuuuauugcuucuaaacugcuugagaauacuauucuuuuuuuuuuuugaaacggaguuucgcucuugucacccagccuggagugcuaguggugcaaucuuggcucacugcaaccucugccucccagguucaagugauucuccugccucagccucccaaguagcugggauuacaggcaugcaccacuaugcccagcuaauuuuuguauuuuuaguagagaugggguuucaccauguuggccaggcugcucuugaacuccugaccucaagugauccacccgccucagccucccaaaguugcuaggaauauaggcgugagccaccgcacccagccaagaguacuauuuuaaagaaaaccucuauguuugugcuuuauuaucucauucugcuuuucuaaauaugugcuaaguaaaugaaauauauuauuucgguuuacuuuucuuauagaugguauaagauauuuaaaguaauuugauuauuagauuuuuuuaaaaaaacaaaaaucaaaccacauuauuaucaggagaaauacuugagcuuuguaaaaguuuucuagacaguuuuauaauacugaaagauugacuaguguuauuuuucucuuuguauguaaauuuucguuucaugauuaucaaugguuuugauauuuagccuaguuaaccauugcauuugugaccauugaauugcucagagcaaauuuaucauuaauugugauaucaguuugacauagauuucuuacauguuucaaaauaggauauugauuggguacagacagagaagcauguguuugagcaggcauccaaucauccuuuccuuguugggcugcauucuugcuuucagacagaaagcagguaagauugaaagauaguagaaugauuacugggcuucauauuuuuggucauauuacacaguuagaaccuuucugcccuaauucaugaaguugauaucauggaggaugcaacaguguuaggcuuauaacuuccugcuaauaauacugccaucagugauaucaguuugauauuagaucagcauuaggaaaugaccuacuuuaggcagaacaggaaauagccaugucguaauuauggcaguagaaauccaaccuuuuaaauauccccaguauucuaguuuuaugacuuaaaauuuucuagcauuuaacaaggaggaaaaauaccuugacagucgaaaaugacuuauuuagcaaaugcuaaaauuaggaugguaaugaguggcucuggauugcaagugguacuacuuuagaacagaaguaguagguuacaaaauuauuaucaugcugguuuacuuucucguauguuccguacccuagauacccuuuguuuccaccaaaauuuuggcaucuuuuuaaaggcuaaauaguagagaaugcucucuguugugaugguuucugaaaaugcaaaguuacacuaccuuauuuuggaucuugauuucauggguucucuccuguguuuuagauuguucuuuguuauagaguauguaaauggaggagaccuaauguuucauaugcagcgacaaagaaaacuuccugaagaacaugccaggugaguuuuuguuuacuguuuguguuguuuucuuuuuggggccauguggcuuuuuaugugcagugguuggaaacaguagauaaauaauuuauuuugauacuaguuaauuauuuguaagucaugcagaggcugagcuaaaaguuaauuuacauuauauauauguaaaacaauuauauauucuuuuacauuuauacacauacauguacauacacaugcacacagugcuuccuaagcaauugaaaagugugaacaguauuaaaaggcaaaccuuuagucugcuaaaaccaauccuuuucaaauauuaugucuauguagcaucagccauuuaaauaauugagacuaauaaacacuuauuagucuuuucagguuuguaguggucucucagagaguucuucacgauaagagugcuauucauacauacuugagaguaauuaaacgaucccucuggcugggcacaguggcucacaccucuaaucccagcacuuugggaggcugaggcgggcggaucaccugaggucaggaguuugagaccagccuggccaacauggugaaacccugucucuacuaaaaauacaaaaauuugcuggucgugguggcgggugccuguaaucccagcuacucaggaggcugaggcaggagaauugucugaacccggaaggcggagguugcagugagcccagaucgcaccacugcacuccagccuggccaacagagcaagacucugucucaaaaaaaaaaaaaaaagaucccucuuaaacuaguauauacuucugacuguucuuccugugauuuauuguucuuuggcuuuuuuuuccucuaaucccauaauuauugaugaauaaaauaauaucgaauaggccaggcgcaguggcucaugccuguaaucccagcacuuugggaggccgaggcggguggaucaugaggucaagaaaucgagaccauccuggccaacauggugaaaccccaucucuacuaaaaauauaaaaauuagccgggcgugguggcgggcaccuguggucccaacuacuugggaggcugaauuaggagaaucgcuugagcccgggaggcggagguugcagugagcugagauugcgccacugcacuccagccugggugaaagagcgagacuccgucucaaaaaaaaaaaaaaaaguauugaauauuaauuuugugcccuuaauuugauauuaauauacaagacuguaaauuguuuauguguuggauggaggagauaggugggaagggaucauggccuugaguaaaaaguuuaauccaucaguaccauguuuuguuucuuauccguaaucagcaguaauucucacccuuuccuacuucacaagaguaaugccaaaaugaagcaugugaguuuguauauguauguuauuaucaugcagggaauaaauauuagaaauuucauuuaaauuaaaaacuuguagaaaauuugcuacuucauuauugcuugucaaaaauuucauaagaagauauaaauuguacuugucuaaucuugaggccaaccuggguuuuuuguuuauuuggguuuuuuuguuguuguuuugguguucauuuauguucauuguguauuuaugccuuaucaaauggucacccuucauagagccacagaugauauuuugaauugugaacauagccaauauuuguuccuuguuuguucaguugaaugugggaaagcuagucugguuuuuacuauauuaaugugccaguuuugguuuuauaccaucuuugcuuuuguaagaacuaaagcccaggacaagggcuuaaguucccaaaucacggaauuaaguagcuaggagguguauguuacguaccuccacacaugaucaugauaaugugccaccaaagcagccauacaucagcucaggcauuccauuuucauuauucaggccaaaaguucuggguugucaccagugaguugguagcaguuuuuuuaaguucuucauuuaauauuaaauuuuacaguuguuuauaguuguagaauauuuucauuuaauuccuuuucuaaaaccuucaugaggauuuuauaguauugaguagucagcuuguaguauucuuucuauucucgaccccauuagugguucuuagccuucucggaggaucacgggucccuuagagaagugaugaaagcuuugaggacucuguagauacugugcauguacauacgggcauacaccuuugcccccaguuguagaaguauggacugccugaaguucacccaaggacccagauugagaaccccuguuugagacuaucaaauuaauagcuuuaugaaaaaugugaguuuaaguuagacaggaacuuuuacaauugugucuugggcucagauguuuuaaagugguacuucaguucauuuuucaaauuuguuccuaaaaucacugggagaaaaaaauauguuuuaauaugaauuuuuguguuuccaguuguaaauguagaacuuaaauaugguugaaucaaaugacuuauuuuuuauuuaauuuuagauuuuacucugcagaaaucagucuagcauuaaauuaucuucaugagcgagggauaauuuauagagauuugaaacuggacaauguauuacuggacucugaaggccacauuaaacucacugacuacggcauguguaaggugaggaaaauuuucuaguuauuuuaaaaggucuucagcagcuaguagucuuuguaaaauaacuucauguuuaaagaugaggaaaugauuacuaauuuugcuaauuuacuuaagcuuuguggaauucuagcacaaagacaaauguacuuuuuuucuaaccauuugcaaaauuuguaucuucuguguuauguguacuacaauaagagcuaauuucuuuuuauuauacauaacuuuuuaucuugaaaguugaaauacaauugaagacaauuuggaaauaaaaauugucugcaauuccacuacuuaacacaaccauuugcauaugaccuuccaauuuuugccauuuaguagugaaucuuauauaaugcauucaggauuuuccucagaagucaaacauuuuuuauauuuaaauuuuaaacaucugacauaaagcauaauaggauaaaacaagaauuucaguuacucccggaauaugucuucauuucuuuuuuuuuuuuuuuuuuugagacagggucuugcucugucccccaggcuggagugcaguggcgcaaucucggcucagugccagcuccgccucccggguugacgccauucuccugccucagccucccgaguagcugggacuacaggcgccugccaccacgcccagcuaaguuuuuguauuuuuagaagagacgggguuucaccauguuagccaggaugaucucaaucuccugaucucaugauccgccugccucagccucccaaagugcugggauuacaggcgugagccaucgcgccuggccuauuucuugauguuuuauucuuuuauaacaguguuccauuuuaaaugucugauauuuucccacuaaauguguaaggaacuauuccuuguuaagguaacugguacaaaauuauccucacauagcaauacaacaaccaguauguaaaugugugaauugcauucccuguucaccugugggaagugccuccagagccuggagauuaucuaaaugcuaacaacauggcauaugacaaccuaguuguaucgaagauuuaacuuuauuaucuguucagcaugcauuaaagaauaaaaucuucacuuaaacuauguuugcuuuuauguacagaauucaaccguacuuuucacaugauacuuauuaauuaauuauuguuguuuuuuuuuuuuggagacagagucucgcucugucguccaggcuggagugcaauggcacaaucuuggcucacugcaaccuccgccuccuggauucaagccguucuccagccucagccuuccaaguagcugagauuaaggugcgccccaccaucccuggcuaauuuuaauuuuuuuuuuuuuuuuuuaauuuuugagacagaguuuugcucuuauugcccaggcuggaguacaauggcacaaucucggcucacugcaaccuccaccucccagguucaagcaauucuccugccucagccuccugaguagcugggauuacaggcaccugccaccaugcccggcuaauuuuuuuguauuuuuaguagagacgggguuucaccauguuggccaggcuggucgcgaacuccugaccucaggugauccacccgccucagccucccaaagugcugggauuacagaugugagccaccaugcccggcccuuacguauuuauauuauacaaguuuucaaucauaaacaauuagaaagcuuagcgaguggaaccccuauguaccuaucacuuauauuugugguaccuuuuugaucucugugucauuuuuuuuccuaagggauuuuuuucucauuucagaaaaaagugacagugauagaggagucuuauccccaagaauaaaugaaacugaacaaaaaacauggagaguauuacccuucauacgaagugcacaaauuaaaacaaugaggcuuuuuuuuuuuuuuuuuuuuuugccugugagauacggguuuuaaaguuagaauagccuguauguacaagaguuuaaagaaaugggcauaugucacugguguguauauaaauuguuacaaaccuuuugagaagcaguuugaugggggaauuaucaggaauccuaaagauggccauguucuuugauccgguaauucugcccuuggauauucugaguaaauauuuugguuuaugaggagagauuucugaccaaaacuuuuauuguaguuuaugaucaauauuauaaagucauuuaagaagaucuuuauuuuuauuuuauuuuuacuuucuuuuuuuuuuuuuuaaauagagacgaggucucgcuguguugcccaggcucgucucaaacccaagaguucauaauguuagcauuuagauaaucuccaggcucuggaggcacuuuccucaggugaauggggaaugcaguucauacauuuacauauuugucauguuacuaugugaggauaauuuuguuccaguuaacaaggaaagcaagccaccacgcccgacugaagauauuuguaaaaaauacauaacacaugauggcucagaccuguaaucccagcaauuugggaggccgaggcaggcagauugcuggagcucagaaguucgacaccagccugggcaacauggcaaaacuccaucucuacaaaaaauaggaaaauuacacuggguugguugugcuuguagucccagcuacuugggaggcugagauggggggaucacuugagccuggggcuguagugagcuguaaucgcgccacugcacuccagucugggugacagagugagauccuaucuaaaauauauauauauauagagagagagagaguaauaaauauauauauguauauacauaaugcuuauaacagaugaagucuuaacauauagaauugucugauucuuuuauguaucauucuguuauguagcaucacacguugauucuguuuacuuuucagcauuuuucaaguuguuauuuuaaaauguuauguuaaaugugguuaccaauugcauuacaguacacuaaugcauuuuaauaacauuuuaaaauguuauuuuuaaauaacaccuuuaauggaaucacugcauuguuuaaacaaucaaaaugggcagggugugauggcucacaccuguaaucucagcacuuugggaggcccggcaggcagaucacuugaggucaggaguuugagaccagccuggccaacaugguaaaaucuugucucuacuaaaaacaccaaaagauuagcugggcaugguggcacaccuguggucccagcuacucaggagacuaaggcaggagaauugcuugaaccuggaggcagagguugcagugaguggagauugugccacugcacuccagucugggugacaaagugagacucugucucaaaaaaaaaaaaaaaaaaaaaagaaaaucacaaaaaugaauuaagacuuuucucuuggccgggugcgguggcuugcaccuguaaucccagcauuuugggaggccgaggcaggcggaucacaggucaggagauugagaccauccuggcuaacauggugaaaccccgucucuacuaaaaauacaaaaaaauuagccaggcgugguggcggacgccuguagucccagcuacucgggaggcugaggcaggagaauggcgagaacccgggaggcggagcuugcagugacccgagaucgcgccacugcauuccagccugggcaacagagugagacuacgucucaaaaaaaaaaaaaggacuuuucucuuuuugucuuucuuagucuuuuguuacucuuacuggaaaauaauauuggcuucuuauacauuuucauuucuuacagggauccucaaucaaguuagucaagguguuucauaaaucugagaucuuuaucgaguaggucuuuaaaucaaauguccuccuaccucccuuucugccuuuccuccuucuccaagagcugccuagggcgggugcaguggcucacgccuauaauuccagcacuuugggaggccaaggcaggcggauuacuugaggucaggaguuugagaccagccuggccaacauggugaaaacccaucucugcuaaaaccacaaaaacuagccaggugugguggcgagugccuguaaucccagcuacuugggaggcugaggcagaagaaucucuugaaccuggggugggguggagauugcagugagcuaagaucacaccacugcacugcacuccagacugggcaacagagugagacuccgccucaaaauauauacauauaaaauaaaauaaaaaauaaagcuuaugagaaauuaacccuccaaaaguuugaaugcucuuuuaugacuuagugucaauauuuaacuuaccugaagcuugacuucaugcaaguguuggaugaauuucuuuauaaagauugcagaggauagugaugaaaacuugaauuaguaucuuuagaguuauguuugaaauauuuuaugaacguugauuuuauuaaguggcagccuuucgugguuuuaugaacugaugugccuuuaaguguuuuuuucaucaacagaggaauucuaauaauaucuguuaugcugcagaaaacuuagcaaauggaccuacauucugacauucagucaacaagugaaugauuaagcauagcuguuacaaguuaacagacuacaucucuuaccucugacuauuguacugaaaguacaugucauuuuucaugagaauguauugccguugccaauaauagaaaacaauaaaaaccauauucauauuucuaaaaauagcauauaauaucccuuuuagaaaucauuuuaaaauucuuggagucacaacauauuacuaaauauuucuucuagauguuuauagcaguguuauauauaacagggugaaauuugaagaaaaauauguucaccaugcccagaaugucucuggagggccacauaauagugguugccucuagggagcuggaacugggugagucagggacaagaauggaaggaagggccgggcacagugcucacgccuguaaucgcagcacuuugggaggcuaaggugagugaaucaccugaggucaggaguuugagaccaaccuggccaacauggcaaaaccccaucucuacuaaaaauacaaaaagccagaggcucggcacaguggcucacuccuguaaucccagcacuuugggaggccgaggcggguggaucacuugaggucaggaguucgagaccaaccugaccaacauggugaaaccccgucacuacuaaaaauaaaaaauuaggugggcgugguggugcauaucuguaaucccagcuacuugggaggcugaggcaggagaaucgcuugaaccugggaggcagagguugcagugagccgagaucgcaccauugcacuccagccuggguaacgagcgaaacuccaucuuaaaagaagaaaaaaaagccaggcgugguugcaugcaccuguaaucccagcuacuugggaggcugaggcgugagaaucacuugaaccugggagacagagguugcaaugagccaagaucacgccacugaacuccagccuggaugacagagcgaaacucggucucaaaaaaaaaaaaaaggaaggcuugaguuuugugcugccccucuuuuuugguuuagaauuuuguaccguauaaucuauaggaaagugguuaaguucuagguacauauguucuguugaauuucauauaguuguuaauauuagaaagucuucgguuguguaggaaaugcuuacaaaguuuuaaaacaugcuuaauuauguaugauucaguugucuuuagacuuuuuuauuguugauuuuuuuuuuauuugccuuuuggccagagaaugguuugaauauuaguucauuggaauacauugagauuuccuuuaugaccuaauauauggccaguagcccauguguacuuaaaaggauauauaaucuuuacaugcagggagucucucucucuaaugucucucuuccuucucccucacuccacacacacauauagacguacauauauucuacauguauauguauuuuguauauauauauauauauuuuaacucuagcuuuuuuccaaaucuuucucugccuacugauuuuuaguaugugugaucuaucauuuucuaauauagauuauucucauauuaacuucuccuauuaugauuggagauugugaaauucuccuaauaauuuuguccuuuuuuacucuuuguauuuugaggccauguuguugaguguaugcaaguguauauuuguuacaauuucuuggugauugucccauuaauuauuggguaguuccuuuacucugccuguuaguguguuuugccuuauuuuuuuuccauccuacagcuauuaaaauacaggcccggcaugguggcuuaugccuguaaucccagcacuuugggaggccgaggugggcagaucaucuggucaggaguuugagaccagccugagcaacauggagaaaccccauuuucuacuaaaaauacaaaauuaguugggugugguggcacacgccuauaaucucagcuacucuggaggcugaggcaggagaauugcuugaauccgggaggcggagguugcagugagcugacauugugccauugcacuccagccugggcaacaaagugaaacucugucuccaaaaaaaaaaaaguguucuuaggaaaaauaaacagaaggaaaauauuguagucuuaucaaugguuguauuaggaggugagauuuaaagugcuucuuuucuucaugaaauaugccuuauucuacuaauauuaaaauuuuguuauuaaauuuuaacuuguauguaaauuauuuuaaauucaagucguaccuuaauugaaucaacucuagcaacaucuaaugaggacagguuuucuucaagcuauuuaguggugaucugugauuuuaauaauaaaggcaguugccaggcaugauggcucaugccuguaaucccagcacuuugggaggccgaggcagguggaucacuugaggccaggagaucgagaccagccuggccaacauggugaaacccugucucuacuaaaaauacaaaaauuagcuggguguguuggugcaugccuguaauuccagcuacucaggaggcugagacacaagaauugcuugaacccaggagguggagguuguagugagcugagaucgugccacugcaugccagccugggcgacagagcaagacccugucaaaaauaauaauaauaauaaaggcaauuguucuagugauguuaagugagcuuaauguaucacugcagaugcugaacuuauaugauaggugaaauagaaagggugaauuuaaaacagaacuuuuuaucucauucuuucuuucuguucuuuuuaauaaaaggaaggauuacggccaggagauacaaccagcacuuucugugguacuccuaauuacauugcuccugaaauuuuaagaggagaagauuaugguaauaaauaaauuggugguauuauuuuagcuauugcuagaugggugguaaaaugugguaccaauugcauuacaguacacuaaugcauuuugacgugaucuuauuaauauaaggauucuugauccuguuaaaaacuacauggagagucccagacuuugaaaucgagacagugggaccuuggcaguauuuggggguaccaagcugaauaauauuuuauuaguggcaaacacuaaacaguagcaggcacuauucuaagcaguuuacauauauuaacuaaguuaauccucuuaacaacccugugagguaaguacuauuaauucuccuuuuacaguugaagaaacugacauacggaaaguuuaaauaacucgccuaaggucaaggauucagaacagcacccaugugacuccagagucaugaaccccuggaaaauuuuucagauuuccugggauauuugccccaggaaucugaaagaugguggaaagauuaacuguaucucaggcacccgaagauacacuuaucuugagaaaacauuugacuuuuuggguuuuggcccucugccuucagcagauauaaaggacaaugugguacuugugagagcugcucaaagucugaauccacuguccuucacuggucuuuaucagcuagcaaaagaucaaguuuaagaccaaggaggcaggagaauggcgugaacccgggaggcggagcuugcagugaaccgagauugugccacugcacuccagccugggcgacagagugaaacucugucucaaaaaaaaaaaaaaagccccuguccacaccuccagcaguugccaacauauagccgggcgcgguggcucacaccuguaaucccagcacuuugggaggccgaggcaggcggaucacgaggucaggaaaucgagaccauucuggcuaacauggugaaacccugucucuacugaaaacacaaaaaauuagccgggcguguucacaggugccuguagucucagcuacucgggaggccgaggcaggagaauggcgugaacccgggagguggagcuugcagugagccgagauugcaccacugcacuccagccugggcgacagagugagaccccaucucaaaaaaaaaaaaaaaaagaccaaggagauuacucugaaauacaauuuaauuauauccucaacacacaauauuagauauugggcaugagucugaaaguagaaauacauggagaaagaaaguuuuuuuuucucauaauuuuauuuuuaaaauuaucuuuuagguaccuacccuuguugauaaaugaagcauuucuauaaucuucagugccuaccaugauaguuggaaugcauuuagaguuuacuuuuucauuguuucuuuuuccuuuaugugauaaaauuuccaguuacuaacuuucaagaaugcaaaguguauaauuuauugcuuuaaaauuucuuucugaagguuucaguguugacuggugggcucuuggagugcucauguuugagaugauggcaggaaggucuccauuugauauuguugggagcuccgauaacccugaccagaacacagaggauuaucucuuccaagguaauuuggaguauuuuacagagauucucugagaaaaaccuauucuagaguacaaaugagagugauucagguuacuacuuugaguaagaaaaaugagcauaaucuggaaaauauaauccugacuggugguauuagguuuuguuguuguuuuuguuuguuuuugagacaaggucucacucuuuugcccaggcuggagugcaggggcgcaaucucggcuccaugcaaccuccaccucccugguucaagcaauucuucugccucagccucccgaguaacugggauuacaggcacacucccgaguaacugggauuacaggcacacaccacuaugcccggcuaaauuuuguauuuuuaguagagacagggucucaccauguuggccaggcuggucuugaacuccugacuucaagugaucugcccaccucagccuccccagcaugcugagauuacaggcaugagccacugcaccuggccucuguguauuagguuuugauguuuuuuaauacauucuuucuuuucuauagucuucacuccuguucacaguuaccuucucauacucaaaaucauaacagggguuauuuagaauuauccaucacaaacagauuggagaaaggaauccuguggcuagagagauaaucuuuacacagggacccugaggcugagugcauaaguucaagaacaguaugaggggaaaauagagcaccaagaugaugagugaucaaaagauggggaaaaaaggccccacaucagggaauauacagaauugacagaaacaagcagacaagugcagggaccucuagcacagaauccaaagaaguaugaaaacuacuauaaaauucuacauuuaauaauuaaagccaucacaggauauaaauaggcauuucaugcccaaauggccauggaauaugugaaaagacauucagucucacuagcaauuaagggaaugcacauuaaauguuaaugaguuaccauuucauaucgguacauuugaucaaaauauuaaaguuggguaauaccagugcuggugaggauguggagcaacuggaacucuucuagacugcugguaggaaugaaaacugacacaacagcuuuaaagaauaauuuggcaguguccaaaaaaauugcauauuauauaugcuaagcauuuuacaaauguuaacucauuuaaaccucauaacaauccuaugaaguauuuuuuuauuccuauuuuacagaugaggaaacugaggcauaauuagguagucaaagaauaagacauucauguaaaugauaaauaguauucagauuagaggcuuucucugagaagaugggaaaagaagggguuuaggaaaguacaggaggcacuucaguuauauauguaauaucuuauuuuuuuuccuggaaugccuuaaauaucuuauaauaaaaauuuaaagauugcacccaggcauaguggcucacaucuguaaucccagcacuuugggaggccgagaugggcggaucacuugagguuaggaguuugagaccagccuggccaacauggcaaaaccccgucucuacuaaaaauaaaaaaaaauuagcugggcgucguggcgggcaccuguaauccuaacuacucaggaggcucaggcaggagaaucacuucagccuggaggcggagguugcagugagcugagaucgugccacugcacuccagucugggcaagacagugacacucugucucaaaaaaaaaagaaaaaagaaauuuaaagauugccaggugcagugguucacaccuguaaucccagcacuuugggaguccaaggcaggaggauugcuugaacccaggaguucaagaccagcuugagcaauauggugagacccuuaucucuacaaaaaaauuuaaaauuagccagccauugcugggcgcaguggcucacaccuguaaucccagcacuuugggaggcugaggugggcggaucacuuaccuucaugaggucaggaguuugagaccagcccggccagcauggugaaaccccaucucuaccaaaaacacaaaacucacugggcauaguggcacacgccuguaaucccagcuacucaggaggcugaagugguagaagcacuugaacccgggaggcagagguugcagugagcugagaucgugccacugugcuccagccuggaugacaaaacaagacuccaucucaaaaaaaaaaaaaaaaaaaauuuagccgagcgugaugguggcgccuguggucccagcuacuugggagguugagguggaaggauugcuuaagcccgggaggucaaagcugcagugagcugugauugcaucacugcacuccaaccugggcaacagaacaagccccuuucaaaaaagaagaaaaaagauuaaagccauguaaaaguuaaauauaauacuauaauuuuuaucuuucuaguuauuuuggaaaaacaaauucgcauaccacguucucugucuguaaaagcugcaaguguucugaagaguuuucuuaauaagguauaaauuguguauaagaauauuuugugauuugucucuuucuauauauaucaaacuggucaguagcgguuugggaaauguaaaauuccaaaacaguagagaauguaacuuuuucaguuugacccagaauuugucucuuacccaaagaguaauugacagcauuagauccugagauaaguuaguuguccuuuccauuuuggcaauaaaauuuacuccccagcuauauauuacauaauuuuuguguauguguaaauaauauauaccauauucucacauaggggaagaguuaaucuuuggguuuagccauaauuguacuuugaacucuguuuccauuuucucuguaucauuauccauagaaucuauuuauuaccauguacuuuuugagcacgugggccgcagugcucccuacaaauucucaugucaaaaaugcuauaauuagguaagauucggaagaaaugaaaugcuaucuuuggcucuuaaaaaugugaacaucauucaauuguuuguugcuguugguaggcuagaggaguuuuaggaucuaggaguguggucuuggcaauuauaaauucuacuuuaaauaaaugguaugauagaaaaguugauguacauuuaccuucuaagguaaauagauaagauaaugaguuuuaauaaaauaagaaauugaagccuuuuaaaaaaugaacaauuuaugugaggaaagauuuaaacuugaaaccuaauuuuucacauagugaaaaaugaaggcaagagguguugauaugcaaaauaaaauaccuuuuaucagaaagaaaaaugggaacauauucucauucauagugaugaauaagccaagacuuuuuauaaguugcaggcuccucaguccagugauucagauaaugguuguaucauugucuuacacagguggugguuuguugcuauaauugggcauggggauuuuaaauuaagcuaaaaacaaacuucucaugaaguuuggagguuugcauguuuugacucucacacuaggucaugcaaagaaauggcugggugcugucaaaugauucugcuguucucuuuuuccuccuguuuuucuuuagcaaggaauuggugaugauucucuguuuuaauuacaugauggguggagaaagugccuugaggaaucacaaguuucaaauaacucaauuuguucuggaguuguacuuucuagaaauaaaagguagaccauuccaacuucagaaauaagaguaucaugugagggcacacaacacagaucacaaagaugauuuauuuuaaagcaugacauucacccaauucuugaaacauuucuuucaccauaggacccuaaggaacgauuggguugucauccucaaacaggauuugcugauauucagggacacccguucuuccgaaauguugauugggauaugguauguaaauuuugauuacucaacuauuagguuucauuauuaucuugggccaauuuuuuguuguuguucuguuuguuuuuagacagagucuugcucugucaccgaggcuggaguacaauggcacgaucucagcucacugcaaccuccgccucgcgaguucaagcaguucugucucugccucccuaguagcuggaauuacagucacucaccaccaugcccagcuaauuuuuguauuuuuaguagagaugggggggguuucacaaugucggccaggcuggucucgaacuccugaccucaggugauacacccaccucggccucccaaagugcugggauuacagaugugagccaccacacccggccuaucucgggccaaauuuuauugucuuagcuaacauaucacagcuuuaaaaacuuaaaaccacuuucuaaacugcuuuuuagaaaacuuuuaaaacaaaaaaaaaauucaauuuuuuuuuaauuuauuauuuuuuuucugagacggagucucauucugucacccaggcuggagugcaguagugugaucucugcucacugcaaccuccaccuccuggguucaagcaauucugccucagcuuccugaguagcugggauuacaggcacacgccaccacgcccagcuaauuuuuguauuuuuaguagagacgggguuucaucauguuggccaggcuggucuugaacucuugaccucaagugauccacccgccucagccucccaaagugcugggauuccaggggugagccaccaugcccagccaaaaaauugaauauuaauguaauaaagcagguuguaauguuauuaaggcccauaucaauguuuauacuuguuuuuauuuuuuuaggagaaacagucucaguccguugcccaggcuguaguguagcucacgacagccuugauugaacuccugagcuuaagagauccuccuguguaaccucccaaguagcugggacuacaggcauaagccaugguacccagcuaauuuucaauuuuuuuuuuuuuuuuuuuugagauggugucuugcucugucucccaggcuggaguguaguggcacaaucucagcucacugcaaccuucgccaccuggguucaagcgauuucuccugucucagccuccagaguagcugggauuacaggugugugccaccacaccuggcuaauuucgguauuuuuaguagagacgggguuuagcuauguuggccaggcuggucuugaaucccugaccucaggugaucugcgcaccuuggccucccaaagugaugggauuacaggcgugagccacugcacccagccaauuuuuaauuuuuuuauagagaugggaucuugcuauguugucugggcuggucuugaacuccuggccucaagugauccucccaucucaaccuaccaagcgguugggauuacaggcgugagccgccaugcccagcucauauuuguaaauuauguucaucauugcuaauaucauugaaccaugcuucaggacucacuuuaauaagguaaacaaugagugcagaggagaacuguagagguggaguuuuucuaagaauacagacuugagcugucauccaguaugucuuuucagauggagcaaaaacaggugguaccucccuuuaaaccaaauauuucuggggaauuugguuuggacaacuuugauucucaguuuacuaaugaaccuguccagcucacuccagaugacgaguaaguaauucuguacacugaaauuuuuuuuuaaguucuuuggaaaucccauuuuuagugacuaugcaauguuucauuaucagauuauacuauaauuuuuuuauuuucuauuuuauuucauuuuauuuuauuuugagauggagucucgcucuguugcccaggcuggagugcaguggugcaaucucggcucacugcaaccucugccucccagguucaaaugauucuccugccucagauacccugaguagcugguacuacaggcgcgugccgccacgcccagcuaauuuuuguauuuuuaguaaggacagaguuugccauguuggccaggcugaucuugaacuccagaccucaggugauccacccaccuuggccucuuaaagugcugggauuacaggcgugagccacugugcccggccuauacuauaauuuauacaaccauucaguuacugguauuuguaucuacuguaccauuauaaguuuuaauaguaacugucauuuucuccuuugcuuuauagugcauuaucuuauuuucacaacaacuuuguaaucuaguuacugucaucuucguuuuacagaugaggaaaccaaggcucagagagguuaagcaaaguuacacagcuaucagguggcagagucaggauucaaacccaaaucugacugacuaaggccugugcucuuucuaccacgcugcacuguuucccauuugacaaggacugucuuugaguuccugaguauugccuuaagauagauuccuagaaagagaauuaggucagaggguauuaacauuuuaaagcucuuguauugccaaauugcuuuuuuuaagaaauuacauugaguuauuaaauccagccaucagugaucugguauauuuuuugugcuuauacuucaucuuuuaaacauguaguuuggaauaauugggagauauuuugauuauuuaccuguuguuacagauucauucucucuaaucucagggaggcccuuauuguuuggcagucauuucacuucuaucucauuucuuaccacauuucucccagcaccugcuccaaacagucucuucauuucagaagccuucaguucuacuccuuuuuccaucacuguuaauggauuaaccuugucuuaauuugaugcaaggacugauaaccucucugacgugaccuugccuccuuugcagcuguccccagaccaccuugcaucucagaauugcuuucuaacucuuuucaucauuuucuuauucccuacucuuggaagacucuccuuuacaaggggugucccugcuauuuuccuagaccuguuuccuuaguuuucuccaagauuucauuuugucaguuaucuuuuuauuagaccuucuuuauuuuuuucuagcuuguuucccucuguguaagcaugcucagauacucugauuuuucccccuaacucauggccccucuuugaacaaccacguuuuuccucauuuucauuucaucuuaaagccucaaaaaaaaaaaaguuaauagauguucauggucaaagaaaaauaaauacacagcaccucuaaucaaacuucuucagacuagucaacauugauugucuugaauuuuuuuuuuuuuuuuuuuuacugucaacacuucaaccccuuacaaucgaaccuguccuccagcuuuugaagguugaaucaauuucuuaauuucuaaauuguaaagcauuuuggggucaguccuccucucccuugauuaauguaaagcauuugguacucauggcuuugccuuggguagcacugccuauucugguucuguuucaucucugugacuacuuuccucucauguguuuucccuguccccuugagaccaggaugcuccaugguucuguucaugacagccuucuuuuugcuauaugcaguuuguaccuuggagauuucagccagcccuguagcauagauaccagcuaauuaaauggcucucaguuaaauggcaaaugguuauugagcaaaagguguuaugguaaauacuagacauucaaagacaaucaagacagucugaucuccccaaaagcgugcugucuacuagaggagaaagauguguaccaagucauuauuucugacagcauuguguauuagaaggaacacuggauuuaaucaaaagauaggaguuugaaucccgaugccaccucuuaccaacuggguaaccuuggauaggaauugcauaacuucucugagccuguucucaaauugccuaccucauaagguugcugugaagaauaaaugcaugaugguuucugaagcacuuauccccugccguuagaucuccugagcugcauuucuguuuaacacggcccccaguuugucagccaagcagcucaaauauaugaagucuaaaaugaaaguaaugacccuuuaugaucucuuucuauuguucucaaucaguuccuuuuuuuuuaguuaccuaauucugcucacggugugucccuguuguucagauuccagaugucagugauuguggacuccuccuuuuucuuaacagauuacauaauaccugcagcugccaagucuuugucuguguuuucauuauuucaucauuuacaucagaucuuucuuuucucuucccguugacacacccuaguucaggccucauucaagucauacccagaguauuguaucagccuccuaauugaucuuuacuccuucacuuugcaaccuauucuguaugccuugugaaguaccacuccaauucuugaaccccuuuaauuagaaaccuucaguaacuccuucauugccuaucagguaacaucuauccucuuggcuagcauuuaaggccuccccacaucugcuccagccugacuuucuagcgauaccucucaccauaauacaaacaguguucugaucagucuuagcuacucaccauucccuaguaguauuauugucucugcuucugccuguucauuccuguguaucccgccuucauuuuuaccuauugaaauuuucccaucuuucagagccaccucagaugcaaccagaucuuugauggaucaaggugaaacuccuuaguguaaacaucacuggccucuuugauuuagccauuauuuuucuucagcaucaucuaacacacuucuauuccugugcuccacccuaauuacuugcauuucccaagaccuaccacagucuuucaucauuccauucauuaaguguuugcagaaugaauacugccuuccuugauuucuccaacuagaagucacaccuuucuuuagaaccaugguuagaacaggacuuagcuuauuguguauaaaauuuaacaaguacugcuuucucuuccaguaggaauuaccucccuuccuugaaggaagggacuguauccucuguaacuuugugcuucuuaguauggcauaauacauuuauguauuaaauauuugauagcacuacucacuguauauuaaaguagaagcccaguguaacaaaaugccaaccucuccccucucugugacccaugaucucccugcgguguucucuccucauuccaggucucucaguguacuuguuccuauugccuuuuccuuuuggcuaacuucuucugggcuacacuaucuaacaucuggcuguugaggugacuacuaaauugaaugcuaauucaaaccuggauguucaccuguaacuaggaauguuguucuggucaaaaguuaagauuaacuggaauggugacaacuggugucuuuuuuauucgcaguccucaguuuugaacuccuuuuuggcucuaaacuugcuugugggauuaucgggguuuuuuaaauuuucaguacuccauucuugauucgucuagaaaaucugggggauuaaucuaaaaauuuauagauuuccuuucaguacaauuagccuaauuacuugauuuuuaaucuuauuuuaccauuuaaagguugaagaaaucuugauuaugaugaaaauaaauuuauuuuucuuucaacagugacauugugaggaagauugaucagucugaauuugaagguuuugaguauaucaauccucuuuugaugucugcagaagaaugugucugauccucauuuuucaaccauguauucuacucauguugccauuuaaugcauggauaaacuugcugcaagccuggauacaauuaaccauuuuauauuugccaccuacaaaaaaacacccaauaucuucucuuguagacuauaugaaucaauuauuacaucuguuuuacuaugaaaaaaaaauuaauacuacuagcuuccagacaaucaugucaaaauuuaguugaacugguuuuucaguuuuuaaaaggccuacagaugaguaaugaaguuaucuuuuuuguuuaaaaaaaaaaaaaacacugcauuaaaaaaguaucuguugcauuaaggcacauagugggauuacaucauaaaccucccauaauuuuugucauucuguguuaaaucauuucaggguuuaauuuugaaauaaaagauuaauauaaaaugcaacaacuuuuuauauuaccuauuaguuuuggaguucuuuauguuuaaaaauucagguguaaauuuuauugccuuggauaaauaaauuauugaucuuuuuuaaggcagcaguuauuaaauugguaauagaagaugcugcuugcuuagaauugggaaauucggcugggugcagugacucaaugccugugaucccaguacuuugggagguugaggcgggcagaucacuugaggucaggaguuugagauuggccuggucaacauggugaaauccugucucuacuaaaaauacaaaaauuagcugggcaugguggcacauaccuguaaucccagcuacucgggaggcugaaacaggagaaucgcuugaacccaggagauggaguuggcagugagccaagauuagccugggcaacagugagugagacucggucucaaacaaaaaccaaauugggaaauucuucuugaguuaaaaaagacacuuuuuauuaugaaucagauuccaaaucauuaacuauuuuugcaaaacuggcacaagugguuuuucuuuuuaaguauauuaacaggguagcuccugagccuuucccuuuauuggaaacuuuaacugcaguguuaauauauacacugcaaaagaccaaggaugcaguugaauggaaaauuacucaguguauagaaaggaaaaaaaccagaaauuuaaaauagauacagaaaaguacacugguaauauuuuuauuuccuauuggagagugaauccccacaguugcuuuuugugacuugauucaaaugaggcacucauuauuguuaccaaacuuguaaaagcauuccauguauucaguggaggcagaauguauaauauuuuuuccuuauaauuuagcauacaggaaaaguauuuauuuuuuaaguaggguaucuuaauuaugcucauuucuuccccuaaaccacauuaucuauaugauuggacccuuuagugaaaucagaaaaauaaaguaggcaugaauaaauguucaggacacacacauacacucacacacaucacaguaucagcucuuucagugaguuuuuauuaacuagauaacacauguaauacauaguagaauacauuucagaggcagaguuccucggauuauuuuuuauggauauuaguguucagcagcuuauuauuuaaaggggugccaaauauagcauccuucuguuguuuauuuuaaauauauuuuuaaugaaaagggacuuaaaaaguaaacaugauuaucuaaauuacuuaaaauuuuuuaaucuuaguaaaaauuuuaggaaaguuaucuaguuuaaauuucaaauguuuuaaaauuuguaggcauuuaauaaauuaucuuuuuuuggagggguggaugcugcauuucauuggaaaugucauuuuuccaaaguuucuagcuauauacucucuuuccuucaaauaacauaagucugaaagcaaugaaaacgucaaaggaaaauguuuauauacauccacauguuuauuuaauauguuucucuuaacaccugaaacuuguuuuaaaacaaaaagcaguauucacuucaaaucauaaacuuagaauucuguaucucaugucagaaauauguuuauggccuugcuuuuaaguggugcuguuucccauagggcauuaguucucagauuuuggaaugugaaauaaucaccuaggaaguugguuuaaaaugcacacuagugagcccaccuuagacuucuuuuggggccuucgaccucacuuugagaaauaccuucuucagguuauucuuuauguuuguccugugguuaaauauuagaguauucaugauaaaacauuuugagaagggguaagcagugaguuauuacccacaauuuaaagcaaauuuugaaugaaucuuuaaguuagguaucuaccuucccaccagccccccaaaaaaccucucaguaguuucuuucaguguacaaaaugaugagcauuuuucuaugaugagguuuuaaccauuauucaggguggucuuuuguuuuuaaaucuuuuuuuaacuaauaagauuuacgguguguauuuuauacagaaaugcauuauaaauguuuuuaauuguguucuguuuuuugcagucuuuaagugccaugccaauuguucuuauauucuauagaaguucgcucaaaauacucaacaggggaauaggcagcggacagucagaaugguuggaauuuuggcuuucuaagaaaaacuuuauuuugcauaagcauguggucagaucauuuugugcauaugcagccuggauuggauguuaaguaaaugcuuguucagugccgguacauuuacuuaaaucuguuuuuauuuuugucauguagaauacuacuguggucaucauaauguaaucuauuucuguaccuuuuuuuuuuuuuuuuacuuugaagucuuuaaauaaaauguauaauacccauugag

SEQ ID NO: 191293 - RNA, 19714 nt, Homo sapiens
uaaacuuuaaaauuuguuuacugagaaucuguuuauuaaggaguuaacauuuuagaguugguucaauacuuuauggaacuuaaaauccugaguugccccucaauaauacagacaucuacaguacaggcauuuguacaaaauacuauaauuacuggugcuuaacauuauuagacuucuauaacuuccauuugucagguaaauaaaacacuaaccuuucaaaguugcuacaauuuuaggaguucacaaauuccuauuucuccaguuuuuauuaguacauuuuaaaccuucuuuggggacuggaagccaaacuccucaaacaaaagccucaaucugaaccaacacugagagacaguaaugucagaggcucuuuuguuuuucacggagagcaaaaauacagaauauauuuauuaauuuauuuuccaauaaagagaauauacuuuguauuuggagaaaaaaaugcuuaauugucaggaguugcuuucggagaaugaucaauaaguuccuugucaauugucucauaguaauaccaggguccaucuccucucacaugcaucaauuuucgcacuuccagcuccuuuacccuguaacaaauggaacagcaauauugagauuccagcacuuccaauuauaaauuuaaugagccauuuccauaaaggacaaucacuggagucugcuuuuauguaaaguauaaugcuccuccacagacccuuauguaggcauacaucugguauauaucuauaaccaaaauuugggacuuauuuuugacuuuuauuauguugcuuauauagauagcuaucaaacaguuuuuuuguuguuuuuguuuuuuugagacggagucuugcacgguugcccaggucagagugcuauggcgcagucucagcucacugcaacuucuaccucccaggcucaagugauccuccugccucagccucccaaguagcugggacuacaggggcccaccaccaugcccagcuaauuuuuguauuuuuaguggagacaggguuuuaucauguuggccaggcuggucucuaacuccugaccucgucgugaucugccugccuuggccucccaaagugcugggauuacaggcgugagccaccgcacccggccuaccaaacaguuuuuaacaccaaaacauuacucaaauugauagcgaauucucuccuucagugugccugcacagaucacuuucaucugaauuguuacagugcuuuuccuaucuucucaccuuuuagaugcuaggagagucauuuacagaaugucuacuacuauggccauaugcugugccagguguuaggaauuaacaaaugaauaagcuuuuuuggaguuucacaucuugugucugccuaucaccauuaggacagaaaacuuuucgagaguagaacugguuuuuuauucaccagcauuauaccaggcccggucaacaucagauacucagucaauauuuauacaaacauaaauagaaagcaagaaaaaucaagauuaagaaaaauauucuccaacucuaacaucuacuuacuuguccuuguccuucuucacaaauugaauaaucucuuauuuuauacaggugcuuucccucuuccauaucuaagucuuugcacaaacaaucacacauuccugaaguagucccuucuccaucaaaccuuuuacuuucuguuuuuauagaauacauaguuuuucauaggacuaaaaauuuaucacaguuaaauaagucacuuuaugaaccucaaccagcucacuuacccuaugggagauuauaugccuuugugagguuauguuuauugaucuuuuuugaaggauuaaauaacguucucuuucuugucuacucuuuagaguauaacuauccaaaccguaauuaaaauauuuaucaacaugagacuaacugguuaaauuaugauucauccacauaauggacuacuauguaccuacuaaaaagaauaaggagaaucuguauguaguaacaugggaggagaugcuacauauacuguuauguuuuuaaaaagcaagguauaaaauaagcauguguagcaccuuccuauuucauuaaaaaauaguaagcugggagcaguggcacgucuguaguccuagcuacucaggagcugaggugggaagguugcuugagcucaggaguucaaguccagccugggcaacagagcaaguccccaugucaaauaaaaaaaaaacaaaaacaaaacaaaagacaaaaacaggcugggcaagcugacucaugccuguaaucccagcacuaugggaggccaaggcaggaagacugcuugagcccaggaguucgagaucagccuggccaacagagcaagaucccaucucuaccaaaacaaacaaacaaacaaaaaaaccccccuaaacaauuaguugggcaugguggccagcaccuguggucccagcuacucaggaggcugaggcuggaggacugcuuaagcccaggaggucggggcugcagugagccaugacugcaacacugcacuccagcugaggcaacagaacgagauccugucucaaaaaaagaaaaggaagacauggugaauauuaaaaaaaauaauuuuggaauuacauauuuacugauuuaauuaucaucagagaucucuguaugacacaaaaucccaaaagcuaaagacugucaaaccugacaauaauuauaaaugaguaaauacauagaaaguaauuaaaacacugauauuaaauguacucaaaaauuuauuagcggccagguaugguggcucacguauguaaucccagcacuuugggaggcugaggcaggcagaucacuugaggccaggaguucaagaccagccuggcaaaacccggucucuacuaaaaauacaaaaauuugcggggugugguggcgggcgccuguaaucccagcuacucgggaggcugaggcagaaucgcuugaacccggaaagcagagguugcagugugccgagaccacgccacuguacuccagccugggagacagagcaaaacugucucaaaaaaaaaaaaaaaagaaaaagaaaauauuauuaguuacuauuacagauuuguuaccugaaaauguaaaaacacuucuguguugcaaaaauuucuacacugccaaaagacaauauauagagaaagaaauacacauagccaggugcaguggcucacgccuguaaucucagcauuuugggaggcccagaggguggaucgcuugaacccagguguuugagagcagccuaggcaacacggugaaacuaugucuuuacaaaaaauacaaaaauuaacugggcauggugucaugcaccuguaaucuuggcuacuagggaggcuugggugggaggacagcuugaacccaggagaccaaggcugcagugagucaagaucaugccacuguacuccagccugggcaacagagcaagacuuugucucgggcggggggaagaaagaaaagaaauacacacaauuaauagauauuaaaaaaacuacucaacuuuacaaagaaauauaaaauugaaaugaugagguaacauuuuucaauuacccuaucaacaaaaauguuucacuuugauaaauuccauuacagagaaacauggaaaacugaaacauggaaacugaugaagaaacaacuggugcaacuuuuuggagaagaguuuggcaauaucuacccaaaguuuaaaagcaugugcuauuuggcuuauuaaugccacuuccagaaauuuauuuuccagauauguuacauaaauaugcaaacaauaugggggaaaauuaaacacagcaguauguacaauagcaaaaaacuuggaaagaacccaaguaccagcaauaggggacugguuaaaaaaacacaggcacuccaagucaauccuaagccaaaagaacaaagcuggaggcaucacgcuaccugacuucaaacuauacuacaaggcuacaguaaccaaaacagcaugguacugguaccaaaacagagauauagacuaauggaacagaacagagcccucagaaauaaugccgcauaucuacaacuaucugaucuuugacaaacuugacgaaaacaagaaauggggaaaggauucccuauuuaauaaauggugcugggaaacuggcuagccauauguagaaagcugaaacuggaucccuuccuuacaccuuauacaaaaauuaauucaagauggauuaaagaccuaaauguuagaccuaaaaccauaaaaaccccagaagaaaaccuaggcaauaccauucaggauauaggcaugggcaaggacuucaugucuaaaacaccaaaggcaauggcaacaaaagccaaaauugacaaaugggaucuaauuaaacuaaagagcucugcacagcaaaagaaacuaccaucagagugaacaggcaaccuacagaaugggaaaaaauuuuugcaauauacucaugugacaaagggcuaauauccagaaucuacaaugaacucaaacaaauuuacaagaaaaaaacaaacaaccccaucaaaaagugggcaaaggauaugaacagacacuucucaaaagaagacauuuaugcagccaaaagacacaugaaaaaauauucauaucacuggccaucagagaaaugcaaaucaaaaccacaaugagauaccaucucacaccaguuagaauggugaucauuaaaaagucaggaaacaacaggugcuggagaggauguggagaaauaggaacacuuuuacacuguuggugggacuguaaacuaguucaaucauuguggaagucaguguggcgauuccucagggaucuagaacuagaaauaccauuugacccagcaaucccauuacuggguauauacccaaaggauuauaaaucaugcugcuauaaagacacaugcacacauauguuuacuguggcacuauucacaauagcaaagacuuggacaagccaaauguccaacagugauagacuggauuaagaaaauguggcacauacacaccauggaauacuaugcagccauaaaaaaugaugaguucauguccuuuguagggacauggaugaagcuggaaaccaucauucuuagcaaacuaucgcaaggacaaaaaaccaaacacugcauguucucagucauaggugggaauugaacaaugagaacacauggacacaggaaggggaacaucacacacuggggccuguugugggguggguggaggggggagggauagcauuaggagauauaccuaauguuaaauaaugaguuaaugggugcagcacaccaacacggcacauguauacauaacuaaccugcauguugugcacauguacccuaaaacuuaaaguauaauuaaaaaaaaaaaaaaaaaaacaggcacucagcaccauaagagaggggaaaaaauauaugugucuagcuuuuuaauauguauauaaaauauaauguauaagaaagaaaauccacauagcuuuccauaacagcauauaucccuuucuuuuuaauggccacauuauauauuucacuggauggauauacccauccaucugcuucccagcuggggcaacagagcaagacuuccacucuaaaaaaaaauucaaaaauuuaaaaaagaacucuuuaaucugacacauaucuccuaauagucuccuugucaccaguuuauaguuuucacuccaaacaagcuaauucuaucuuuauccauuuuuuuuuuccuuuggagacggagucucacacugccacccaggcugcagugcaguggcauggucuuggcucacugcaaccucugccuccuagguugaagugauucuucugccucagccucuugaguagcugggauuacaggcacguaccaccacgcccggcuaauuucuguagccucccaaagugcugggauuacaggugugagccacugcaucuggacguaucuuuauccuuuuacauaaaguauccuauagugcugaaauauucauaguuuuauuaauuuuuucuggugguuugcuaccuuaggaagauuuucuuucccaccuacccccucguuuuuccuaccguaauucagccuuuucagcuucaaucugaaggacggccauuguucuuucauauaucuuuucaggacuaucauagaaauuacgggcaauccaucuugauaugggaugcuacaagagaaaauucguuuaauauuaguccauuucugaauaauacuuugcuuuucuaguugacuauucuuuaaaaugaucauuucaguuagauaaaccaguaacaucuacuauguaacuaauauaccuauauauaaaauaauuuuaacagaugagguggauacuauuuuuguccgcauuuuaaagauaagugaauugcacaaaguuacguagcuaauaaauggcagcaccuggacucaaaccaggucugucugacuccaaagcuguguacucuuuuccauuacacuaugcugaguaucuuagguggcagauucagaagacaaacccagguuuugguaauucaaaaauggagcucuuugcaccaguuagcauaaacaaacuaaguguaaggucugccuuaagauuuaaugguuuaagauuuguauuuaaaauauaauucauucagauaauaaaacaugaugggauauacuccauucaaggcucacaauaacacuuguuaaaacaaguaacaaaauuaauuuuggauuuugguagcaguggcaguaugguauaaugaccaacaguucaggcucuggagucaaaguugcccggguugaaauagugaccccaucuagacaggucacuuaacucuuuuagccucacuuucuucaucuacaaagagggaauaauaauaguacauuuuacaugggaugaaauaauaaauauuuguaaaacacucagcacaguaccuguuacauaguaggugcucaauaaaugacagcuagcauuaacauuggugaagucucuccuaaggcauugaacuuaggauaaauuauguuacucuguuaggcugagaacacacugcaaucauucuuuaaaaaauuguaaagcuuaaaaugauuuuuuuaaaaaugaaguaccaaaauucguuguuuauaaaaaguaugcaaaaaaauguaucugcuugauauaaaaaaugaaauauaaaacucuaucauggcuggucacaguggcucacacauuuaaucccaggacuuugggaggcugagguggguggaucacuugaggccaggaguuccagaaaagccuggccaacauggugaaauccugucucuacuaaaaauacaaaaauuagccaggaguggcagcacacaccugugaucccagcgacgugggagacugaggcaugagaaucgcuugaaugcgggaggcagaaguugcagugagcugaaaucgcgccacugcacuccagccugggcaacagagcgagaugcugucucaaaaaaaacaaaacaaaaaaccugacuauaucauaauugcugaauuaagacauuaacuagugcguugacaaggcauguaacaguauguaauugucaauguccuauacaaaccuuauaauauucccaguguucugggacauagccuucuggaauuucugcuaguucagcuugaccuaauaagaaaaaaugguuauguuuaacuuuagcaugaggaguuuauaaaauuaauuauucaccauuaaaguaagaaaccaacuucuugugguuuuaaaggauucuuuaaaaaauuuguaccaaugaagauauguaguauuuuuaauucacuuuaaucugguugaaaaucaauucauuuguuagacauuuuuagacaucucucuguguaaggcauuauuuauagguauuccaugaguuucucauuuuguuuuucuauacuguaacaagauauaauaaaagacauauuauuccuucuggucuucccuauaccuaugauacaaaacauuuuaggauucaagguguuagaaguacuuugaacaaaauuucccacgaaaaucuaauguuuacugucauugacacuuucagucuuuguaagaggauuauaguuuuuuuuugggggggggacagagucucacucuguugcccgggcuggagugcgauggcgccaucucagcucacugcaaccuccaccuccuggguucaagccauucuccugccucagccucccgaguagcugggauuacaggcgccugccaccacgcccagcuaguuuuuuguauuuuuaguagagacgggguuucacuaugucagccaggcuggucucgaaccccugaccucaugaucugcccgccucggccucccaaagugcugggauuacaggcgugagccacugugccuggccgaggauuauaguuuuauauguucuaggauggauuaaaaaauucuuaguucagauugagauuugguuauuuuaagauaaacugccaugcuuaugcuuaauuauuuaaagagcuuuucauuacaauauccauaauuucuuuuuuauauuaauguacauauguuuaaaaauuuuuccaaucugguggugcuggcaggggauggaagugacuuaccaaugaauacauucaccagaguuaugaaaauugcuacuggaaucccagucaaugcaauguagaaucucuaagauaaaaaaaaaaguguuucucaugaccauuucguaacucuccccacacacaaaucauccucaugauaugauuuccucauauuucuuauaaaauaaacuugccaaauugggcauacaguaccaaauuauugauuucugugauuuuacuuuuugguaaagcaaugccaugaaagaaaauaauauguuaagaacaaaagucuaaaagcaucagggugauuucuaccacuaaauaggauuugagcuggucauaacaagaaaaguaagggcucaaccaaggagaugaaaaaggucauuaaacacaacggaagggcaagagaaaguuuuaaggucaguacucaaaugaugauucagagcuuuaucuaccguggcagaugguccagacaaucucccauuuucuaagccucuacuuuguucguauagagccuugagacagaaauauagucagcauucuaaauaagcaauguaauuauauuauugcuaaauuaagauugcacuauagaucccuguuacucucugaaauaaauguuccugaacaacauauaaauauaaaaucauaucccaaaauaauguagcuccuuuauuuaagcaagucuuucaacaaguucuuugguaauuuaaagaauauuuuaguuauaggaacacagauucuauuucgaaacgccauaaucuucagaagaaaggaaugguucaaguuuuaccuccauuuaguguaaauccuuuugugaagaaggaaagcuucacuaauuuaaagagaaauucaauaacaaaucagacuuuacagucucaguaucuucuacagaaagaaauauaaauuuacaaaauaaaauauuucauaaaaugaaagauguuuucuaaagaggcaaaaauuuuuucccuguuacaugcaaagacuuuaauucaacaaaaaauuuaaacuuaccaauaacuucaaaaaacgccugucauagaaucuagaaggucugaugacaaauagucuuuucccauggucuccacugugucgaacaggagcugggaauauugaauuacccuguuuuauacaagguucauauggguauacuguuauauucugaguuaaaaucagauuauaaaaaaauacaaggauccuuuuguagcucauaagcaggaugacuggguuuucacacucaggugugagaugugccucccucaaaccuuguuaugagguaggcacauuacccaucugacaugaaacaaaaagaaaauauacauucuuagauguuuaauaugaguuaagauuuuaaaaugucuuauuugaguaauaaggccaggucagauaggguaucuuuaaacaaagauggaucuacuguucuaaagcauaacuuuccucauuuuaauucaaaguuaaaguaucuaaauaaucauuuuaauuuguuucaauagcaggcagggagguuagguacuuaaugagcugcucaucugugucuccucugcaacaaauauuugcuaaugcugcaaaagaaauacauuuaauuuaaauuauuccauuaugccauuucacaugacacauuaucuguauuauauguauuauuaugcugcaaaauagauggaaaggaccagccguauuuacucaacaaaucaccagcaggaauuagaacuuguuaucaaacuacacacucuaaaauaucuugauaaaaucacgugguaaaccauugcugauuaagaauauccucuucaagucucccccugacagaauuuaaucaagccuugcuggaaguaaacugaggcaaaauuucacuucuggauccucuuuuuauauucuuccucuugaaggucugcaaggaucacuagaggcauuccaagcccuuuccacugggaacaggaaaggaucuagcuguuacuuagaaacugaagguuccuaucuuuucacuguguaacuacucucaaggauauuuugcaugugagucacuguagaauaaaaaacuuuaauuucccauuaaaggaauuucagucauaauagaugucagaaagaucugaaucuuuuguucauguuuaaugucuggaaugcuguccccucuccugaaaucuauguuaggcccagauaacaucuuaucuuccaagaugccaacauuuuucccaaccacacgagaucuuuccuacuguugaauuacuguacguuauugugacauguauauuuguguuuacugcugccacuuuuaaguauaaauaucuugaaagcaggaacuaucuucuuaauuuugguaacaucugcagcagcuugcagugaguuugggagguugauucacaagagaauuagaaacuggcaugaauuuacuacauauaauucauacuacuaaggcuuuuuaaauaacaagauuaagagaauuugacaaaguaaguauggacuucagcaaaucaucugaaacauacauaauuuuuuuuguggacuagaugaagaaaacggguuggaugacaguacaaaguacucauuaauucaauacauauuuaauugcauacuaugugcagauccuaugcuagaacuauauacggucuaagagggauauagaucuugcugggagaaauacacacuacacaaguaauuacaaaucuguaaggguaacaagggaaagaaauaggauacaguggcccagaagaaaaguuccuauuuagacaagauggggggguugggaagaggggacauuauaagcugagagaaagaggaaguuagagaaauuuguaauggguacuugauugacuguaagcaaaagguacugauuaauuacugcaguaaccuggcaaagagaucucucaaaagcccugcagcaucaagguuuuuaugaauggcuuagaugagguggauacagcauuccugacuugucgagucuuagaaacacaaagcuacugcuacaagaguggccauggggucccaaaagagucuuuacacacauuacaaaaggcuaaaucuaaaaggauucaacauaauaagguaaguggaaguuccgccuggaacucccagaaauuuaguugcucacaaaaaagccaaaggccaauucagucuuaaucugauacacuagaagcacagggucaaaacaggaugaucuucccugucgcuuauccccugacuacaccugcagaaauguguccauucaagagcauacucuuuuagagggacaaucuauuuucagcuuaguauuaguuuggugcaaaaguaacugcaguuuuugcaacugaaaguaauugcgguuuuuggcugagcgcggcggcucacgccuguaaucccagcacuuugggaggccgaggcgggcggcucacgagaucaggagauugagaccaaccuggcuaacacggugaaaccccgucucuacuaaaaauacaaaaaaauagccgggugugguggcaggcgccuguagucccagcuacucgggaggccgcaggagaauggcguaaguaaacccaggaggcggagcuugcagugagccuagaucgcgccacugcacuccaaccugggcgagagugagacucugucucaaaaaaaaaaaaaaaaaaaagguuuaaugcacuuaguaaugugaacugcuugcucuuucuuuacacauauuacccaauuauuaaacaauuagucaugucauuaaagguccuagauaacuuauuaauauuguuucaaaguauauuucauagcauguaacuuuuuuuuuuuuuuuccagagacaagguuuuuugcuauguuacucaagcuggucucaaacuccugggaucgagagauccucccaccuucagcuugcggaguaacugggauuacaucacgcaccaccacaaccaacuugccuuuaacucuuuuuaaauguuuugagccuucaggauuguugauguaguagggccaucugcuuaaaucuaaaaauauuaguguguaaccaggaaugguggugcaugcuuguacucccagcuacucgggaggcugaggcgggaggaucacuugagcccaggaguuugaggucagccugagcaacauagcuagacccuucccccucaaaaaaaaauuaaauuauuagggugaauauugcuuacaaugaggugacuaccaggauuucuggaacccugaaccuccugacaccaaaaauaagcaucuuucacugcucucuaaagccugaaauuucuccauuaaguauuuauuaauuucauaggcccaaggcuucaaugacuaauuuuuaaaaaugcacguagccucagaaaaguuauuaagccuuugaugauugcgauuuuuauaagaauugaauaagauaaugugggaaugugggaacuuuuugugugucaaagacaacaacugggccgggcacaguggcucacaccuguaaucccagcacuuugggaggcugaggcgggcggaucaccugaggucaggaguucgagaccagccuggccaacauggugaaacccugucucuacuaaaaauacaaaaaauuagccaggccugugaucccagcuacucgggaggcugaggcaagagaaucgcuugaauccaggaggcggagacuguggugaaccaagaucgcgccacuacacuccagccugggugacagagcgagacuccgucucaagaaaaaaaaaaaaaagacaacaacugaaaauuggucauuuucuuucccucauucccaguaaagggcaccaccaucucaauuaccuuggauaaaaaucucaaucaucuuccuugcaucuauccuucauucaucauuugccaaggccucuugauucuaagaguuaaauucuccauuucauuccaugccuucuuuacuuuacugaccuagguaaucaacauccccuauaagccauccaauauucagaagcaucuuccuauaacacacuccugauauugcucuucugcuacaacacucuguugccuacaaaaucaaaugaagauacguuggcuuuguagucagucccuccccucccccaauuuggucccaacuuuccuuuauuugccuuuucucccaacgccuaccuaccccaagagucacauauccaauaaaaaaaacucaaccuuuacuuuucugccaguuccaccuauuaaaacuaucccuauacuucaguuaaaaugccccaucuauuccaugucuggauuaacuccacagcacucuguuuauacauccauauuaauacucuucacauuuuuaaaaaccauaauuuaugcauaucagucuucaauuauaaauuaaauuuaccugcagcugaggggagaacuuagcucauuucuggaauuacaccaucuuugauguuuaauaaauaauuuaauuaaacagaauagcuuuaucugcuaauuuucugagaaagguuuacagagggugaugaagaacaugacagcacuagaucuuuaggaaggaugaggcuauaggaauuuguagaaggcuaaugccaggacuucaaaggcacaggcaaaaaaagaaaaacuagacaaacuggacuucaugaaaauuuuaaaauuuugugucugaaaggacgcuaucagcagaguaaaaaggcaacccacagaaugggagaaaauauauguaaaucauauaucugauaagggauugauuucagaacacacagaaaacucaacaacaacaacaacaaaccaaacaauccaauuuaaaaauaggcugggcaugguggcucauuccuguaaucccagcacuuugggaggcugagguggggaauuucuugagcccaggaguuugaaacuagccuggucaacauagcaagaucucaucucuacaaaaaacuuaaaaaauuagccgggugugguggugugcacccgucaucccagcuacucaggaggcugaggcgagaggaucaccugagucuaggagguugaggcuacagugagcuaugauugcgccacugcacuucagccugggugacagagcaagauccugucaaaaauaaauaaacaaauaaauaaaauaggcaaauagccuggcagaguggcauguaccuguagucccagcuacuugagaggcugaagcaggauugcuugaguccaggcguucaaguucagcaugggcaacauuagggagaccucauacucaaguuaaaaaauaauaauauaauaaauaauaagcaaaggauuugaacagacauuucucuaaagaagauauauacacaaauggucaagaagcacacaaaaagaugcucaacaaaacuaauuagagaaaugcaaaucaaaacuacaaugauaucaucacauacccaucagaauagcuacaaucaaaaaaccagaaaauaacaagugucagugacaauauggaggaaguggaaucuuuguacacuguugguaaacaaaggaauguaaaaugguauuguugcuauggaaaauagcaugaggguuccucaaaaaauuaaaaacagaauuaccauauuguggaauccuaguaagauacauaagcaacaaggaaggggccccagguggaggaaagcaauucugcugagacacggcuaaucacaggcaacccacaggcacaacauccuguucccaaauaccucguucaacacauagccccaguagagugaccuuaucugcacaucuucucugcucauagccccuucaguaugacccuauaaaacuucccuccagucccugacucugcagauagccccuucucugcugugcugcccauuguucucuugcaacucuaucuucguauuuucucuaauaaaucuguccucuguaucuaugacugucuugguaaauucuuucaccacccacaaugccagucccagccaguaacacccaugacacacaugacccagcaauuacacuucugcagauauacccauaagaauugaaagcagggucucagaagagguauuuguauauccauguucacagaaacauuauucacaacacaagucauacucaaugucacugaugaguucuuggaaacugugacuuuaagugaaaccacauacagcagguccuuaaacaacaucacuuccuucuuuauuauagguucugacggucgcaguuucaagagccaaugauguuaagugaagcuuuacaguaauuaaaaucugcaagugcuucgguguaguggcucacagcuguaaucccaacacuuuaagaggccaagacagguggaucacuugaggacaggaguucgaaagaauucuuaacagaacccauuuaggauuaaacaaguuuuugugggucugaagaaacuccccaggccuccacaaacaaguugacuggaggucugaaggaacuucccaaaccuccgugauuuagcaggagauaagauaaggguaaucaccccagcaccuggauccauuuaaauuaaguaaauuuacuaaggcuccagaggaagguccucaggacucagaccuuaauuauagauuuuaaaaaguuagucacuuuugucuuuagauaagugcacacuuacauguagacauauagcuuaaaaggucuacaagcucuggaaaacuguaauuuuaaguuggucuggcgauaauuuccaggacuucucccuguaaccaguuacaggaauaaaaacucucuucuggcagggcgcgguggcucaugucuauaaucccagcacuuugggaggccaaggcgggcggaucaccugaggccgggaguucaagaccagccuggccaacauggugaaaacccaucucuacuaaaaauacaaaaaauuagccgggcauggaggugugcaccuguaaucccagcuacucaggaggcugaggcaggagaaucgccugaacccaggaggcagagauggcugugugagccaagaucgcgccacugcacuccagccugggcaacagagugagacucuguuucaaaaaaaaacaaaacaaaacaaaaaaaaaacucucuuccuccccaguucaucugcaucucauuauuggauggcaagaaauagcagccugaccuucaguuugauaugagaacacgggaagccagggguugcagugagucaagauggugccacugcacucuagccuggaagacagagcaagacucugucucaaaaacaaaacaaacaaacaaacaaacaaaaccuagaugcaacccaauugacagaugauggauaagcaaaaugggguaaauacauacaauggacaacggacaauucagcuuuaaaaaggaaggaaauucugacauaugcuacgacauaaauaugccuuggggauauuaugcuaagugacagacaaauauuauaugauucuacuuacaugagaaauagaguagucaaaaucauaaagacagcagaauggugguuaccaggggcuacguggaaggggaauggagaguuauuguuuaacggauacagaguuuuaguuuuaccauaugaaaaaaguucuggaguuggaugauggugaugguugcauagcauuaggaauguauuuaauaccacugaacggugcacuuaaaaaugguuaaaauaguaaauguuauguguacuuuaccacaauuuuuuuaaaggcuacugcugccaggcacuguugauuuuuuccacucacucuucacaacuaccuuuugaggcagguuaaaauucucaucuuuuuuaaagaggaggaaaugcagguuaugagcaauuaggugucuuccacuuuagcuuccaagaugugaugaucacagacauggcuucugaauucuagagccagaauuugaagauaggcagucuaucuccagaaaaaacaaaacaagacaggcucucuacuacauuagagcuuacauucuuguagggacagauauaaacaaccauguaagagauuaaaagcuuucauaucacagugacagaugcaaaauaccuuugaaagcagguacacagcugaaaacacaguaaccuuuaguaaacauagcuauuagaaccuucccugcucugauuggaaagggcgcagaacacgguaaugauccuuugagaaccccaagaaagggcaauaauguggaaagagaaacugggggugaaauuuugcugcaguuuaucuccagcuggauuugauugaauacuaccagagcgaguauuugaaggauuuguauuuggcuauaugagaauaucuguaaucagaaauggcuuauaaagggauuuucaucaaggaauguaguuuuguaacaaguucaaauuccugcuggaaauuuguuaaauaccacugguucuuugcaucauguuuccagcaaaucccuauguauauugccucauccuguggaguggcauaauucaaauuaaacugggagaauagggguaaaaagagaacaagauauuuugaggcuggagacaacuuucugacuuuaaguguuucacuuccucuuuaccugcuucuauugcacagggcaaauagcuuacaguauauaucuaaugaagaggauuaaauaaauuaauacuuuaaacccuuaaaaugaugcuugaggucaggugggguggcucacgccugugaucucagcacucugggaggccaaggcagguggaucacgaggucaggaguucgagaccagccuagccaacaugaugaaaccccaucucuacuaaaaacacauaaaauuagccgggcauggaggcgugcaacuguaaucccagcuacucaagaggcugaggcaggagaaucgccugaacgcaggaggcagagguugcagugacccaagaucacgccauugcacuccagccugggcaacagagcaagacuccgucuugaaaaaaauaaaaauaaaaaaggaugcuugacacguaacaggugcucaguaaauguuggcuauuauuuagugacacauuauuuaauaauugagucaguuuccucaucuguaaaaugaaaauaacauuguaauuucuuugcagagucucugagauaauaaaguacacugaauaucaagcauuugaucuuugcuaugauuauucacaccgccaugaugcaacucacugucuccaaggagguccaaauagcccuauuaagacuguauuggucaggugcaguggcuuacgccuauaaucccagcacuuugggaggcugaggugggcggaucauuugaggugaggaguucgagaccagccuggccaacauggugaaaccccaucucuacuaaauauacaaaaauuagccaggcgugguggugugcaccuguagccucagcuacuggggaggcugaggcgggagaaucgcuugaacccgggggguggagauugcagugagccaagauggugccacugcacuccagccugggugacagagugagacugucucaaaagaaaaaaaaaaaaagacuguauuaugacuuuccugagaccuaggcacuuuugccuucaagggccccuucgucuaaguuauuaaaaauaauauuuuaugacugcauugguauaaaacgaacauaauacaggcuggauucguuaucauauucauaaacauuaugguuuuuuuaaaaaagaaauuuaaauuaaaagacuuucguagaccccuaaaacuaucauggguucaggcaggagaaucgcuugaacccaggaggcggagguugcagugagccaagaucgcgccacugcacuccagccugggcaacagagugagacucugucucaaaaaacaaacaaacaaaacaaaacaaaacaaaaaccucucuuccuccccaguucaucugcaucucauuauugggcggcacgguacuuacugugccuaaagaauaaguuggcccugagccucuuuaccugucuacauauuaccugucuucauauuccuuagcauaggugggcuucucggcaagaugacuuugcaucugugggacuagaaccuagccuuugggcagguggaacgcaacaauaagcuugugcccuagagauacagaucucagcucuauaccuuucuagacucagcuucauccgcaaauuagcauuaauugggauggugaauaacaacguuuuagaaaugcuaauaauguaaacacgaucuaucuggcuacuucaggaaaaccccucauauagcucgugcuccgucucuccugucaagccccaagcccacaacuugucccggcucccuccggaucccaccaaggucacccuggaagcguccucccuuuucucgccccgcacccgcuucacgcccguucucccuaggccagcacccaccagcagccuucggaaagccacgagugaggaagcccccaaauccgaggcgagugccaaggggccggccagacagagcugccaccgcaguaaccgaaacccgccgcaacaaacucauggccgccauggcuacuacgggcaggaggaagaagggag

SEQ ID NO: 191294 - RNA, 260328 nt, Homo sapiens
uauugaucaaagagagaauuuauucacagagauuuucaaauacaaacaaaauagcacuuuuaaauuuuuuacaaaaugaauauagaaauaaaugugguacagcacaguacaauaauggacaaaagaaaacacgauccaaugacuggaaaaugucucucauuacucucauaucuucggcugaauucucuccuauaguggacagaaaguugccccuuuucuucauaagaauaucauagcagaagcuacucagagaaauauugcauauuguggaauaacauggaaauacaaaggcuuaacucuaaaggucugcauaaacacugaaaauauguugaggaacuaaauuagaguuuaugcaggauauacaaaauacugauaguuuggcuuauugguccauuuauuaggcuuaauguauguuuuauaaagugauaauacuguauuuuaaauguauauuaaaaagaaaacagaggagaaaugcaccacuaaaccucccagucugugcgauaauccacguuugugcauaggcguguguggggaugcauaugucuguaugugcuugugugcuuuugggagugccgugaccuacagggaacaucuuuggggguacccugcuucccaacauaacacuguuucuacuagcccuuugauuuucugaguccucaccuuaaaaaaaaaaaacuaaaacccaaacccuuguuuguauauguagauuuguuguguguguguguguguguguguguguguguguguguguguguguguuguacauuaacaauacucuguggaauagaaacacccgaugcccugcaauauuuuuagccuuugguccauuuuucuccaucauucuauacucuccuuuuuuuucccccacaaaucuccuacaauccuuccuuccuauaucauguuccugauuuuaucggguuucauuuuauuagcauuguauuggauuagaacuacuaucccaccuuuugaagguagguggauguuuugaccucuccaagccccuuuggcccaucuucuccucugucugcucuugguagcuccaucucaguauggguagugcuucuguuucuugcccgaaaagcaagccagccacgugcacagcagcauggcggcaguggcaccugcucccgugcaguaguaggcccagccgauuucacacuucccuaaggacaaaggaaggggaaagaagaaagucacagaugaggaugauuuugcagcaggguuucuuauugcuuccaguguguggguucugaaacacccuuuaggaauaugguauccucgcuuaaauggaauaauaaugugcugaaaguuaucuugacagugaagaaagcaagaauggcuggaugcauuucagaaggaucucaaugucuaccucucacacgggcuaagagaagucuagucuccuccaccaauauccacacccuggccaaaaauagagaagaauggcagcaaccaggauaggagaugaaggaguuaauuguaacuuacaucacccaagcucaccugcguaacaaaguacuuuagggaaaaaaauauaaauguugaugcaauccuucugcaaaagggccacuuugaggaggcaacccauuugaaggauaauggcuaaugcuaaggugaauacugccauuuauguggaauggucaagugacuuacucucuacugucugaaucagaaaacaaaaauucccagauucuucugggaucaacacucaccuugaagauaaagugucauuuaaaugaaaauauaaugacaagcauccaaguggguccugauuucucagaguuggauuagucuuaauauucauaacaaacccaaaauauuaaaaauauguaaguagauuuauuuaucuguauugucuuugucaauucuuuuaucaacauuauaagguagaauacuagcucaacaugguugacaaaaaagcuucucagcauuuaaagaaguuggugacuuacccauagucauaugcuuauaauuuggaauaaagugagccagggcucaaaucuggguucuagaucccaagaauaggucgguguccccagauggguuaauggaauggauuucugcauucauuagcuuuuucuuucuuaaugacauccaaguuauucuuuuugugugcacaguaaagaaggccucuauaucuuauacuggacacuguacuuucugcuucaauucuaauucauuuuucagccggucuuaccaucuuaucagaugaugcuccaacagcaaccauguuccuccuuuugguucuugcuuugcauuacauuagauacaaacauaaacaccaagacauuuggauuucacagucacugaacauaaaggccauagauugaaaaucacggggcugggcgcaguggcucaugccuguaaucccagcacuuugggaggccaaggcggguggaucaccugcggucaggaguuugaaaccagccugaccaacauggcaaaaccccgucucuacuaaaaauacaaaaauuagccaagcaugguggugggcaccuguaaucccaacuacucaggaggcugaggcaggagaaucacuugaacccagaagguggagguugcagugagcugagaucacaccacugaacuccagccugggucagggagcgagacuccaucucaaaaaaaaaaaaaaaaaaaaaaaaaaaagaaagaaaaucacaucccuucuuuucacaagucagucugcaggaaaacagccuguugcuuggcaagagugacacugaagugaaaccucaaugacaaccagcguuugacuacugcauaccgaaguguucccacagcguagauaaccccccauaaagaaacaaugccuauggcauagauaaccuuucauaaagacguuuaucucaucucccuagaggucacaaguuuuggcaaggaagugugagaugugaccagcugcacuugucuguacccuaaaagcuugcuauguaaaggcugcuuucuggagggcaggugcaaagauccaccaucucacagcugccagagacauggcuucuguuuguacgucccuaucaaauguuucuuucugagaaacuggacgugucagccucuuuccucaccucuuuucucagccucucacccuguggggugggguuugcauagaccugcucaccgcggaacacagccacuuuuaccuuguucauuugugaaaaauuaauaacuucccugcugaaaauuuccaagacuguuagguacaaugugcaauuaaacuuuggaucuucacuggacguuuacuggagaaguaguuagcaugugccccaggcgcagauaaaaaggcaacgcaagacagagcuaagggaguuauuggcuuguggucaccaugagucaacagcagcaaaauuugaucaagagccuccacaucuuaaaaguucuuaggccauuaccuaagcacacagacaucaagcuauguuguucaguccucaaccuaggugucauccuugauuucucccuuuccacauccaaugaauaauuaaaaaauaagcaaauguguauugauuaccauuuucucaaaauugucauggagcuuuacauggaguaaauauuaaugcuuaaauucucauaggaacacaaugugguagguauaugaguaucauucucaucuuucagaagggaagacugaggccagggaaaguuuaauaagcugcuccaggacuucuccuuaauaaguagcaaguccucugccacucuccccuauaucuauccuguguccugccccuucucaaacgcccgaucaucccccaggcagucucgucugcugucauugcuuucuugucucucugcuucuacucauaucaucaccaacagcaaaguaggcagcugucuuuuuaaaaaucaaucagaucaagccaugcucuuacuuaaaacccuguaaugacccagcacuuugggaggccaagguggcuggaucacuugaggucaggaguucaagacuggccuugccaacauggugaaaccccaucucuacuaaaaauacaaaaauuagccgggcaaauuugaucaagagccuccacaucuuaaaaguucuuaggccauuacauaagcacacagacaucaagcacacagagcaaauuagcacaaguggcccacccauaagaaucacuugaacccgggaggcggagguugcagugagccaagauugcaccacugcacuccagccuggauggcagaauaaaacucugucuccaaaaaaaaaaaaaaaaaaaaaagccccguuaaugaauucucaaaaaucaauguccuuccuauagccuaugagggcuuaaaugucugcugaccucucacacuucaugaccacucucuccugugucuugucucuggccacacugaccacuuuuucuggagcacaucagccuuguugcugacaugagagcuucacacuugugauuccuuccacccagaaauucuacuuccagaucguggaaaugccaggccucugguaaacaccuaauaaauaauuguugaaugaaaggcaagguaaaagaaaagcagaaaggaagcaaaccgggcaggcagcuaauaccugaaaaacaguaagucuagcauuuuaagaguaacucguguccuguuuuggcacugaaauuuuggagagaacuucccaaaccaaguauguauuuccggccucaucuagagagugugcuaaauuuaacgggguaacagauucugaaagaucaccucuccaccucuggguaggucucacuggcacaaugaccuccauuaauacagauagaauaagcauuuuucacugguaaccgagucccccuucacaggucagauuugcugacaaccaugaacuaaugugguugugagucuugggaauaaucuccauuuugaauuauucuuuagcuagauuaaauacaccuaugagggggaauuaauuaauagguagagaagagauggccaaucguguagaacauuucaaagaguuggcaaaauuugugguccaucuguuuagcacugggcucauaacacagaauacaaucaauuguucauuauuaauaauguauugaccuauacauaguucuaugaccuaacaugaaaaguagaguauauaauucuuuauuaauuauuuggcacuuaagaaaaaauugcugaggcuaauuauuugaaaacaguguaugugacaguagacacauuuauuaaacaaagauggaaaaagaagcuaguaaaggguuggcuaucagaggacaaugagagagaggauaguauugguuuugcuuuuguuuuuggcagagaagucaauaaaauagcagaaguuuaagcuucagggucucguaaguggcaggggagcuacagccgaugcuguagauucuccagccaguuccucucugucccuuugcugguucuggacucucaaucuccagcuucuguucgugcuuugcucccaauagcuuauauuugcaacgcucuucagaggacccaugagugacuggcauuacucugucccagcucucugacagcugaagugcccccuggugugacccacagccagcgauguacuuguacuggagugugcacaccgggcuuucuucccuccggguggaacaaagucugcaguguaaugauaaugaauguucccagcccugugaguucaggcugaggcugaacccucaugacaaacugcacccugcuggguguuuacuccuucccuaccuugcuuuuccacuuccccacuguuuuuuccuuggcacauuuccucaaucacuugaacucaaauccucaucucaggaugcacucuggggaaccagaucuaaggagugaaugaacaaagacuuucuugcuuuucuuugucaagggaucuguaaguuucuaccauugucagaagcuaagccaccccacccgccuacccaagcccugcuauccccugagagaggcagagcagagcuuucggcaccagcucucucccacucuccccacacuacccucuuccuagggcaaauccuugucuugcucagguguaauuguaauuucuagucauuguuaucuggauccauuccuguuuaugucauaaaacagguaguuaacguaucaggcuaaaugucuaucagaugaaaacuggcagaaaauuaagcaaagaucuuuaaagaguguaacauaauagcagaaaauguuugaggauauaagaaaauauggccaccaaucagacauauaugcaaguuuguguguaugauuuacaaaauuugggauuaaaauucaacaacugguuaagguccaaaaugagcuguuaauguucaaugugauuuaaaagaaaaagaguccuucauuuaagacaugaaggcuuuuucauuuacuaaguaauuuuuaaaauaauuauuaauucaaaaagugauuuaauaugaauuuguucuaguauuacaaauuauauugagauauagccagccaaucaaaguagccucaaaaaauauacaaaaguacauaugcauacaugucuuuugagaaaaauggucaagaucagucuaguuagaguaaggugugucaauagaauuuaagcaaaucugaaaaaauacugucauccaacccugauucuugauuuucuucuucccuuccuuuuuccuuuccucgcucccucucucaauuuauucauugauucaacaaacauucagugagugccagcuccaacuaugaaugaaucacuggguacugggagcuuuguugggaauaauauaauuccugcuaucaagaagcuuauugucuagucaaggaaauaagcauuaagcaauaaugagacauuucuauacugauaauugugauaugugcuuugaagaaaaaaauccaggaugcgaaggcagcauauugcaagugaucuacguagugcggucaggucagugaaagagagccuuaaauuagaagugagaucuaagccaagaccugcagauguucaggagugagccaagcgugaauguggggggccagggaacaguaugcuuggagugaggggaugggaaauauaauggagaaaugcagacagauuugggucuugcuaaaguauugcucaaguaagagauggaucccauuuuggguguaaagcaagggauggguuuggguaugaccaccucuagaguucggagcuugaagccugaaaauucccucuuugaaacugucauuuguauuguuggguaggaauaugagguauuuaacagucacaaauaaaucuuaagcuccugcuaccuguuuugcuauguuauagaagcuggaaacgcagccgggaacaauacagacagagucuuuggucucaugaagcuuacuuuccaguucauaucacucacaucagcuguauuauucugaaacauuccuuguauauuacacauguuuuguagaaauucaguucaaugaaauaaaccagauacaauaggauuuuuucauaaaacuauaaaugugaaagcaaaacauccagaauucugugagagauuaaagguuuaccaggcacaggcuugucacuuugaacuucuccaaaggaaaaggaaaaauagauuuuucucucugagcaugauccuauuguuaaaaccuaugugcucaauaacaagaaauuagcaccauguuuuacagucauagaaaaaaaguguuucugcauacucuucaugaguaguaaugaaacuaaauaaaaccaggaaauacagggccauucuuccauggccucccucuaugccugucauggcaauaaaugcuuguuauuauaaugcaaacagaaagcauuuuuccagagggcaaguuuugucugugauccuuucaggaaauuagagaaggaaaucuguuuaaacuuucccuuuugcucuccguaaugcuccaucaaacaggacuccaagcuugcuugguuggcaaauuacugcuuucaacaauggggaauacuauucuugacagauaaaauagagguuaaugggacagaaagcagcauaccauagccaccugccaagucgacagaaaaagacuguggcggaauuccagggcagccccagaguagagauagggguggggagggauguugcugauuucuuacgguggcucaaauuaguuuuuaguauagcuuuuggaagugauagagacagaaagagagguacaaagaauccagucuuauuacauauaacaauggaauuccagugaucguuucaucuuuuaaggacacuggaguuuaaccucugccuuuucauuaauuuguucaauuaacaauuuggagccuaccaagugugacugucugcuuauuucaauguucuauucgggcacucaguaugaugaccugaucacaacaaccgauacacauuuguggcaugaauggauaucagacguuauacuugugcuaagaauagaaauacaaaauuaaucgucauauaacagcugucauauauagacagcaagugaagggcuacaaguuaugaaggggucucuccuuuaaucauuuuugucuaggauccuugaucuguuuauacuuuccaacauuauucucacuuugaagaugcagaaacugaaggauaaguaacuuacccauuaucucaaauaaauagcaaagcuugaacucggaacuugggucaaacugauuccagaguuuuuuccugugcucagauaauguauaaaaaaagaucuuaaucaaaugcauuuuucucauuuguuaaauaguacuugucuuggcacuuauaugcccgagaaaaaaauaaaacauauuuuaccuuaccccuucaauuugccagucuucuuagaagacuacaugcuguuaaagugaacuaaauauguccugggaauaacucuguacuucuauauuugaguccuuguggaugaacuauaaccuagcuuaauaggcagacaagauugaaaaccuaacuuaggaguacgcacccguaauaauugcugagucuucgccagucccagcagccauaguucaaccacucauauacugcugaguguucaaacuauauucaaauaaagcaaacaccaaacuguacccaauccaguuguuucuguaccucacuucugauuuuuguauguuacguuccuuuuuugucuauaaauuuguacugaccaugaggcaccccaguagucucucugaaucuguugugauacaggggggcugccugauuugcgaauuguucauugcucaauuaaacuccuuuaaauuuaauucagccaaaguuuuacuuugacaaugcccauguucaacagcaugguuucaauugcuaaaggucugcaccuugcaaagacuugacagccccaauuccugaggcaaugaaaccacacuuggcaccuuuggcaaugcaucuucuuuaaggauguggaaaugugaugucuaaaauaagcuugcuugaggaacagauaacuaaugcuaccugcaggagaaacugccucuagauauggucccagacugaauguuuuugacccuaccuugacucugugugagcccuagcugauuaagagcuucagcuccuggauacacuuuaguuccacuccagagcugcugucugccuaugaacccucagaaguuuggcuggugccaccauaccauccuaacuuucacccagagacuccaugguagcgcccuccacuguguacuguauugcucuggaaagcgcagcacaggacacuguaacucgggcaguuccugcccucugacugcaugccauuuaucacaaaaccuccauguuuacaguuucuuuucuugaacuugagcuccaugggauccccauuucucuuuccccacaaagucacugcugagcacccauaaugccuuguagccauagugucugagucaggauaugauaagcugacugacuucauuuauccaggcagaauaucuuuugucugugauauuuugaaaauuuuaacauguuaauauuuaaauguaaaguuuggguaaaaaaggauacauauuagauuguauccuuguugcuguauuaauaaugaaggcaggaagguugaaggaucaguagaaagagggaaaacauuuauauauauauauguguauauauauauaaauguauauauauguguauauauauauauaaauguauauauauguguauauauauauaaauguauauauauauaaauguauauauauguguguauauauauauacauacauacacacacacacauauauauauauauauaauuuuuuuuuuuuuuuugagacagagucucagucugucucccaggcuggagugcaauggcgcucacugcaaccucugcuuccucccagguucaagguauucuccugccucagccucccaaguagcugggauuacaggugugugccaccaugcccagcuaauuuuuguauuuuuaguagagaugaugggguuucaccauguuggccuggcuggucucaaacuccugaccucagauaauccagccgccucggccuuccaaagugcugagauuacaggcguaagccaccacgccugauccuaaauaaaacuuuuaaugagacaaguaguaaaaaugauuugucauaugccuauaaagagaagaccacccaaacuugguuggugggcagaaaauguagaaguaaaacggcugagagaagaauguuugugggguguggugcuuuuuaaaagcuacuuugcggccgggcgcgguggcucaugccuguaaucccagcacuuugggaggcugaggcgggcagaucacgaggucaggagaucgagaccauccuggcuaacauggugaaacccagucucuacuaaaaaaaaccaaaaaauuagccagguguggugucaugcgccuguagucccagcuacuagggaggcugaggcaggagaaucucuugaacccgggaggcggagguugcagugagccgagauugugccacugaacuccagccugggcaacagaacaaaaaacaaacaaacaaaaaaacuccuguuucuuuaugucugcuuauuacaaaaaguauaaacucauauugauugucagggcuguccuauacacaacuccaaggcgucuauuuauuuugcauucuaugggcuuccuaauggaugugcccugggggugaggugcugcacacaugcauauaaugggaauaccgcucccugcacaguauuccccaaaagaauagguagugagaagguguguguaaugguagaaucucacaaaucccaugcauugagucuauuuucaaaauaucccaggaggccaucuugaugcuuccaaagucaccagagcagcacugcagugggugggaccaguauuuccucucaagaacugcagcucuccacugcugcugugaaugcacugaaauaugaaagaagugugccacugaguaagagccuaucugccagcccuuacauguaugcaccguccacuggauugcagccugaauuacaccaucaaacaaaaauucuuucaccacacaucacuggugaagugcaggaaucuagccacaaauaaagauccugcacagagucuugggccucugaaagcacccagaagaagccaauugacuguacaugacauacaccacagucaaacccucagacaaauaaagaauauaaaaaaauaaaaagccccacccaagcaacaacaauuucaaaaagauaaaagaacaccagcccucucagaugaaaaauaaucaggcaagaacucuggcaauucagaaagucagagggucuccuuacuuccaaaugaccguacuagcucuccggaaaugguugcuaaccagauuaaaauggcucaaauaacagacacagaauucagaauauggaugggaaagaaguucaacaagauucagcagaaaguuaaaauccaacccgaggaaaccaguaaaauaauccaaggaaaccaguaaaauaauccaagagauuaaaaagacacggccauuuuaagaaagaaccaaacugaacuugugaaauugaaaaauucacugcacgaauuucguaauacaguuggaagcauuaauaacagaauagaccaagcugaggaaagaaucucagagcucaaagaccagucugaugaaucaacucauucaggaaaaaauaaagaaaaaggaugaaaaagaaugaacaaaaccuuugagaaauaugggacuauggaaagaggccacaccuacgacucacuggcauuucugagaaagaaggagagagaguaagcaaucuggaaaacacaguugaggauauagucuaugaaaauuuccacaaucucacuagggaagucaacauucaaauucaaaaaauucuaaaaaccccagcaagguaccauacuagaugcauagugaucagacucuccaagguugacaugaaagaaaaaaaucuuaaaggccauuacauaaaagggucaggucacuuacaaagggagccucaucaggcuaacagcagauuucuuagcagaaaauuuacaagccaggagagauuaggggccuauuuucaguauccuuaaaggaaacaaauuccaaccaagaauuucauucuagccaaacuaaacuucacaagcaaaggagaaauaaaauccuucuuagugaagcaaaugcuaaagaaauucauuaccaccagaccagccuuaccagauguccuuccucuaaacauggaaaugaacgaguaguaccugauaccacaaaaacacauuuaaguaccuaguacacauauccuauaaaauaaucacacaaucaaguauaaaacaaccagcuaacaacaugauaacaugaucaaaaccucacauaucaauauaaaccuugaauguaaaugguacaaaugccccacuuagaagguacagaguggcaaguuggguaaaacaaauaagacccagccaucugcugucuucaagagacccaucucacauguaauaacaaccaugggcucaaaguaaagggaggaagaaagauguauugugcaaauggaaaacaaaaaagagcagggguugcuauucuuauguccaauaaaacagacuucaaaccaaccacagugaacaaggacaaagaagggcauuacauaacgauaaaggguucaauucaacaagaagacuuaacuauccucaguguauaaacacccaacauuagagcaccucgauuaauagaagaagcacuucuaaacccaugaaaagauuuagacagucacacaaaaauagugagggguuucaagaucccacugacaguguuaggcagaucauuaaggcagaaaaccaaaaaaagaaauucuggauuuaaacucaacaugaccaauuugaccuaacagacaccugcagaauauuccacuuaaugcacauuauuuucaucugugcaaggaacauaugcuaagauugaccacauguucagcgauaaagcacgucucaauaaauuuuuaaaaaguaaaaucauaccaagcacauucucugaccauacugaaauaaaaauagaaauugauaccaugaagaucucucaaaaccacauaauuacaugaaaauuaacuuacuccugaauaacuuuugcauaaacaaugaaauuaaggcagaaauuuaaaaaauccuuuuaaaucaaugaaaacagagacacaacauaacaaaauaucugagaugcagcaaaagaaguguugagaggacacuuuauaacgcaaaaugccuacaucaagaaguuagaaagaucucaaguuaauaaucuaacaucauaucugugggaaaagaaaaacuagaaaaaacuaacaccaaagcaaacauaagaaaacaaauaaaucacagcagaacuaaacaaaauugagauguaaaaauucauacaaaagaucaaucaaaccaaaacuugguucuuuggaaggaugcacaugauagauagacugcuagcuagauuaacaaagaaaaagcgagaggauccaaaacagcacaaucagaauugacaaagaugacauuauaaccaaucccacagaaauacgaaagacucucacaaacuauuaugaacaucuccaugcacacaaagucauuaaucuagaggaaauagguaaauuccuggaaacauacaacuucucaagauuaaacaaggaagaaauugaacccugaacagaccaauaaugaguucugaaauugaaucagaaacuuaaaaagcuaccaaucaggcugggcaugguggcuugcaccaguaauuccagcacuuuggaaggccaaggcuggcagaucacuugagcucagaaguucgagaccaccuugagcaacauggugaaaccccaucuuuauuaaaaaauauaaaacguuaucugggugugguugcaugaaccuauaguuccaacuacuagggaggcugaggugacaggauggcuugaaccugggagguggagguagcagugagccgagauggugccacugcacuccagccugggcaacagagccacagccugucucaaacaaaaaauaaauaaaacaaaacaaaacaaaaaaaguaaaaagcuaccaaucaaaaaagccuuguaccaaauggauguacagucaaauucuaccagacacucaaagaagaguuuuguaccaauucuaaugcaugauaaaacccucaacaaacuaggcaucaaaggaacacaccucaaaauaaaaagagccaucuaugacaaacccacagccaacaucauacucaaugggcaaaaccuagaagcauuccccuugagaacuggaacaagacaaagacgccaacuuucaccacuccuauucaacauaguacugggcucccuagccagagcaaccagccaagggaaaguaacaaauggcauccaaauaagaaaaguauaagucaaacuaucucucuuugcuggugauaugauucuauaccuagaaaacccuuaagacucugucaaaagcuuccuaguacucuucaauuacuucaguaaagguucaggauacaaaaucaaugcagaaaaaucaguagcauuuuuauacaccaaucauauucaaguugagagccaaaucaagaaugugaucucauuuaaaauagccacaaaaaauaaaauaccuaggaauacauguaaccaagaagugaaagauuucuacaaaaagaacuacaaaauacuguugaaagaaaucaucgaugacacaaacaaacggaaaaacauuccaugcucauaaauuggaagaaaucagaaacuuaaaaagcuaccaaccauuaauaucaauaucauuaaaauaaccaugcugcucaaagcaaucuaccaacuuuguagguugguagauacugcucagagcaaccuaucaacuacuaacaucauuguucauacaauuagaaaaaaaauucuaaaauucguauggaaccaaaaaagagcccgaauaaccaaagcaauccuaagaaaaaagaauaaagcuggaggcaucacauuaccugacuucaacuauacaacaaauuuacaaaaaccaaaacagcaugguacugguacaaaaacagacacagagaccaauggaacagaauagagaaccuagaaauaaaacugcacaccuacaaccaucugaucuuuggcaaaguaaacaaaaguaagcaauggggaaacgauucccuauucgauaaauggugcucguauaacuggcuauccauaugcagaggaauaaaaguggacaccuuccuuauagcauaugcaaaaauuaacucgagagauuaaagauuuagauguaagaccucaaacuauaaaaauucuagaugaaaaccuagugaacacccuuucaacauagguguggguaaagaauuuguggcuaaguccucaaaaacaauuguaauuaaaaaaaacaacaugugggaccuuauuaaacuaaagagguuuugcauaacaagagaaaugaucaacggaguaaacagacagccuacagaaugggagaaaauauucacaaacaaugcaucugacaaaggccuaauauccagaaucuguaagaaacuuaaacaauucaacaaggaaaaaccaaauaaccacauuaauaagugggcaaaggacaugaacagaaacuucucacaagaagauauacaagcggccaacaaacaugugaaagaaaaaaugcucaucaucacuaaucaucagaaaauucaagucaaaacuacaagauaccaucucacaccagucagaaugacuuuuguuaaaaagugaaaaaauagacugggugugguggcucccgccuguaauccuagcacuuugggaggccgaggaggguggaucacaaggucaggaguucuagaacagccuggccaacauggugaaaccccaucucuacuaaaaauacaaaaucagcagggcgggcgccuguaaucccagcuacucgggaggcugaggcaggagaaucacuugaacccgggaggcggauguuucagugagccgagaucacaccacguacuccagccucgguaacagagugagacucugucuccaaaacaaaacaccuaaaaacauagguguuggcaggacugugaagaaaagggaaauuauacgcugcuggcgggaauguaaauuaguucaggcauuguggagagcagucuagggauuucucaaagaacuaagaguugaacuaccauucaacucaacaaucucacugcuagguauaugcccaaaauaaauuguucuaccaagaagacacaugcaccuguauugaucacugcagcacuauucacaauagcaaaggcaugugcccauccaugguggauuggguaaagaaaauauacaaauaccccauggaauacuacauggccauaaaaaaaaucaacauaaaggccguuuuccuaagcaaauuaaugcagaaacagaaaagcaaauaccacauguucucauuuauaaaugggggcaaaauacuggauaaacauguacauaaagaugggaacaauagauauuggggaauacaaggagaaggagguaggacaaagguugaaaaucuaccuauugggugcuaugcucacuucuucggugacggauucaaucauacuccaaaccucugcaucacacaauauaccucuguaacaaaccugcacauguacccccagaaucuaaaauaaacauugaaaaagaaaaaaaaaacugcagcucugcucucuaaugugacucuaacauacaaggcucuuuugaccuguucuguuauuuauuaucagauuuagaggacugcaugguaggauuuggacucucuuaaaagugggauaacaccuuuccccaaagcacgcaguaugccucgauguaugauguucuagcuuagaguauuggagccacuucaacagaaagaggagacaggauuuuguuuuguuuuguuuuguuuuguuuuugagacagucucgcucugucgcccagguuggagugcaguggcacgaucucugcucacugcaagcucugccucccagguucaugccaaucuccugccccagccuccagaguagcugggauuacaggaguccgccaccacgcccggcuaauuuuuguauuuuuaguagagacagaguuucacuguguuagccaggauggucucgaucuccugaccucgugauccgccugccucagccucccaaagugcugggauuacaggcaugagccacugugcccagccaagacauuuuuuaaagacucccuucaucuuuuuuguuugcccuacuuucuccacagagcuaaccagaagauaaaaugcagauguguucaucaguaagaacugacacacucaagcuauggcauuaagcgcucuccauaaccacgcaugucaaagggagcagagauuuaugcucuagaaaagauaagauguguauuggcaaagagcucauaacagaacagugcuaugucuaaggagauauguuaggggugaauuuugaugggaaaauauauaucagccuugucaauuuuauccaguguagguuaauccauucuguagcuggaguaggaggaguaaggaaagagcucuacagagacaugcauuagagggcaaugaccagcuguucaaacgcuaagcucaaauaggagcacauguuagaugggccucagauuguaaggggacaaaaaaaaaaaaaaaccuuucugaauuacaaaugcauucuuuuauauucaaugguauaaguuucccuucuggauucccacaaaaauuuugcugaagagccauaguuuucauuugcucuguugaaucucucuugcccgcccccucaaauguuuuagcuccacuuucaagguaagagacugugggcaaaagaaaauaacagguuugugcccauuuauuuguaccaguuauuguccuccaaagaaauggugccggccaucaucaacacaagaauuuaccagaaaauaccuauaugagaucucauacuugcacagcugcucaaaucugugaaagggcaggacacacugaccaguagcuggacuugacacaagggucagcagugcugagcccaaauuauacagcagaggauggaagacauugcuagccaucauuauuauuacuaacgccgucacuauuaauacuuuucugacaucuuaacaauuucuaacaucagaaugaaguuagugaagaaagcaacuuuuuuucuuucaaauuuugagccucugaagaauuuuuuuuaauuuuuuuuauuuuuuuuuauuuugagauggagucucacucugucgccaggcuggagugcaguggcgugaucuuggcucacugcaaccuccgccucccagguucaugugauucuccugccucagugucccaaguagcugggacuacaggugcaugccaugacacccggcuaauuuuucuauuuuuaguagagaugggguuucaccauguuggccaggauggucucgaucucuugaccuugugauccacccaccucagccucccaaaguguugggauuacaggcgugagccaccgugccuggcccuugagccucuuaagauuuuaaaugugcuuuucauuuguuauauuuugcaagucgcaaaccguaagcauaaagaaaguccaugacaaacaauacccagcacaaggaaaugaguuccauuucuuuuauuaauaauucuguauguaaaauauaucgguauaaggucuguagauuagauaauagcauuuuaucaauguuaauuuccuaauuugguaauugcauugccagauaagagaauguuauuguuaggaauuacucacuuaaguaucuacgguugggagggcagcaugucucagaaggagggaaaagggcaggagggagguagggauugauaaacccagugugaugaaaucaaacauuaagggaauccaggugaaaggaauauaggacuucuuuguauuauucuguagcuuuucuauauaucuaaaauuacuccaaaaucaaaauuacacaaauauaaacaagaauuugaagauaucuaugugacaugguuuggauuuuugucccugcucaaaucucaugucaaacuauaauccccaguguuggaggaggggccuggugggaggugacuggaucaugggggugggcuucgcccuugcuguucuuaugauagugagugaguugucacgagaucugguuguuuaaaaguguguaacaccucccccuuucucucucuuccuccuguuccggcuagguaagacgugccugguuccccuuugcuuucugccaugacuguaaguuuccugaggccuccccugccaugcuuccuccacagccuguggaacugugcaccaauuaaaccuuuuuucuuuaaaaauuacccagucucagguaguuccuuauagcagugugagaacggacuaauacaauggguguauguauauguauaaguauacacaaaaucaguggggacuuuuacucuuguaaguuuaaggagcaagaaaucaauaaacauauugaccauaugauaugcaaaaugagacaccugcauaauggccauuuuuauucuguaauuuuccucaugaaaauacucaaugacccucuuacacucuguguggcucuguuaagcacagcacacggugaggcagcucaguugguuccugcccucuggccacaucccaucuaacacaaaacuucaucccauuccugccaaccauacccaacugagcaaacaaccuacaaauugaaucaauuaaauaaagaugacacaccagcacgaaucauacaauguucccgugagacaauucaggagaugaauaagugugcaggaccuguguccaguggggaaggaacagagugucauccaucuucuccagcaggagcugcccagaggaugagggaaacacaucggggcacagagcccauuuuccuccacaaaauuuccccagccuggcaagguaaagugguuauauauucgaugugggaaacaauauuucccacugaaaaaagggguuuuuccagcugauacauuugaaggauuuuauacaagcaaagccugucuuccaaagagaaagacuauuugugcaaucaaagucauccccaggcagcuccagcugugagugcuccuggcaagacaggaaggcagaagggaugggaggcagggauuagaggaaagggauuagaccugaacaggacagagccucuuuuaaauucaagccuugucaaaagccagugcaucaccccucuguuucugcauccuuuugauuuuauccuugucacuucugccacccagagcaucauagcaucacagacuuuagagacagagggaccuaggagaaggaucauuuaggucauggguuggcaaccuuauucugaaagaagccagauaguaaauauuguaguucaaaagcaaccacggucaccaaauaaacacaugagcauggcaguguucccauaaaauuuuauuuacaaaaacaugcaaacuagauuuggcccauaguuugccaaccccugauguaagccaucucccguacuuucccaaugagaacacugcuccccaggacaccgacagggcuuucccaugucucuugaauguguucucuucaguagcugaguccuauucuuuguuuauaauuuguaauuuccuggcucccagucuaaagcaggccggugaugcuggguuacucuaaucuaaaaaugcaguccugacucuuuggguacuugcaccacauaauuaccugccugcucuuuuaauuucacacacccagaacaaaaagcuauaaaguuaugggaaaaaaacaaauuuuucaucaauaaaccaggccguugggauauauauacacauugggacauauauugcuuaacaauggagauacacucugcuaaugcauuauuaggugauuuugucauugugcaaacaucauagaguauacuuacacaaacguagauguauagccuacuccauuacauagcuccauccucaucugguggguccaccaucacacaugcgauccaucauugacugaaacaucauuauguagugcgugacuguacuucaugucaauauaaguaaacuacuuguggaaaugagaucguuagaaaacaaaaggggcaggguuauguggcagggaagagaguagagaugggccaaucagagaaaccggcccuggaagaucugagaacuagauguccaggugauguugcuggguauggcugcacaggaacaaacucucugcacuuccccucuuaucuagaguccugugggguuucccuuucauaccacaccaaaccuaauuauuuuuccuuccaucagauccauccaggguccuuccuccuaaauuccacugagucaaggcccugugucaccccauccugaaaucccaguaggaagcacaugccauggaaaggguggcagaugcucugccuauuuagcauucccccaaugcagagaaauggcaaaagaaacagaaauacucuggcuucuccagaaacauaaccacauuucagcaggacgaguggagcggcuucugaauucuuaugaucacaccaaucaaauggaccucuguucuguggcccgguggauaguuuucuuucuuuucuuuucuuuuuuuuuaauuaacuguaaaaguucugggauacacgugcagaacaugcggauuuguugcauagguauacaugugccauggugguuugcugcacccuucaaccccccacccaauaguuuucuuaacauacacauuugugccacuuacacacaaaaaaugguuuacccuuugucuugucuggccagcugaguaucugcuagcacagcugcuaucaauccuugcuucuuagcacugaauccauccuaaaaguuuccuuagagaugauguacuguuaagaugauaaagcaaacauguuggcucaauguauagugguggccuuuguguucacacugugaacugacacagaaucugaucuccagguggggguggcuaagauaaccaaucaggcuuuauuuaguguauggugauaaagauuauccuucaguuucugucuguagcugcuauuuauaaaggcuggaaauaccugaaauccagcuccucugacucauggacugcccagaagacagugugaaaagaaccagucugucucuaauuacugcuccuccaugugaacuauggcugcagccauuuuccuauaaaacccaugugaagaggugcugcauuuccucgugauguuauuaaucugcccucccugucuguaccggucauacuaccacuggccaccaagcagucucugaauauacucucuagguauccgguuacauaccuagagaaccggaacggaacugcagcaagcacugcuuugauguuuguuagcugcccucaaucuaaaagguuuuccuugaugaucccuuuuugcuuguacaguagcucuugggaacgaaccucauucaauuugggcaagcauagccuugagacucuuuuugguaaauuacaaucuguugaaaaagugcaagacgugguaagauacucuuccacaaucucauuuccaacuuauaaugaaagcaagucucggaacaaauccuccuacacauacagacacuuauucaacaaauagccaucaaaaagcaggcacaaaacaucaaacugaccugggagcuaguuaaguccuagcucucuuuuuagguauuuggacgaccaacuucuugaauaaacugcuagggaaaaugcagcaagguuccauggcaggauucuguucucuuuggcaacaaaaaaccagaaaucuuccaaaccagagacuagaaacugaacacuuuagggaugaucaagccguggauaccauuccuaagaauagugagggcacagauggaaugcaucaguaaggcuguacuggguaucaaaauacuaaaauauguaccucugucuguagguaaacagccacugccccaaguucccccaaaacccuuucuucccuugaaaacccuagggaauccuugccucacaucccagaaaccaaagggcuagugccuggcaaaggagggccccaugggagccucugcacauggccaguacuuguuuuagcucacauuuuucauagccuaugacauauugauuauuaaauauuuugaauaucacucagacuuagagugauaacacuaugacuggauggaugcuuaaauccuugcaagcaaaaauagggagugucucuaacuacuuauguggauucuaccaauccacaaucuugaguauuuuuaauuucaccaaugaaaguccauuuuuaauauucaucaugcuauuuaauaagaucuaauucuaccaauaaaaguccauuuugaucauugcugugcuaauuaguaaagcuuccaguguuagucaagauaugaauaacagaaccacuuguacuagcacccaugaguauccaguccggaauaugcacucgaguugugguuucccuuaaauaauacccauauaucacugucuaugaugaaguauuuuucaaggaacuauaggcauuguaacaguagucuuaagaacugugaagguuugauauuuuacucuauuugcaauguaacaaguuauacuaucacaauuuuguggacgcuggcaaaagauaggagacuccuggaucagagacaaaggacuguauuacucacagcacagcaggcagcaugagcuccauguuuauguccacucccuuuguugcccucuccucacaggggcugaugugaaacagcccagaugaaugcaacaaacauaguggguuugugucacaguugaggaacccaaacuaagggaacucaaaucuuuuauaauggacugcaauaaaaucugcccaaucuuuauuuaccccagagaaaggcauuauuuuuauuauaauggacacuaaacacaccuauccucugcucuacuuccaagacuguuuacuacacaaacaucuucgaaaugauaguucagaauagagugucugugcugacaaguugugcuaacacacaagagaucugugaagaacaaucuccaacagcggcacuaaugaaacuggcuaagauccuaaguggaagcauauucaauucacuaggaaggcugaacacucauuuucacagaugugauuuugaauuagaacuggugcauggcauggauauaaacaugggaaccacagacacaggggaucacuagagugaggcaaaacagagagggguaagggcugaaaaacuaccuaugggguacuauguucccuaccuggaugaugguaucauuuguaccccaaaccccaguguuacacaauauauccauguaacaauccugaacauguauccccugaaucuaaaauaaaauuugaaauaauaaaaaagacaaaaauggcuuaaaaaauaaaaauacaaaggaacuauuguaugguagcauuuauuugcauaacacuucuuguaagcagaggugcguuucuguauaauaucccuuaacaaauacuuucguagauaaugaaaucaagucaaagggguucaacuguguucuagcuuucuggaggaauuugaggauuguugggaggugaggucuagaguucagaucucuaagcuuucccauguaagacuuccaaauguuguuuacuauauagguucuaagucuucaggugucaggaauccauuugaauaauaacaaaagcuaugaauauucucuccagaaaaaagcacauguccaaaagccuaugaaaauugcaaagcauuucaguagauucugaauuucucugaagccuacugauggacuaugagccacuuaaacggucuggagaccuuaaguuaaaaucagucugaagaucaaagguuaccauaacauuuaacucuucuaccagugucaucaaaacauccaguugcuaacccaaaguagcuuacuuagccagauaucaauuaaguauuaauaacaucuccaccuauccaaaacaugaccccaaaucaggagguuaaaaacuacuagccagaacauauaaacaucaaugcuucaaagauguaaaauccagccaggcaugguggcucaugcuuguaaccccagcacuuugggaggccaaggcgggugggucacucacuugaggccaggaguucgagaccagccuggccaucauggugaaacccugucucuacuaagaauuacaaaaauuagccgggcauuguugugcauaccuguaaucccaacuauuugggagggcgaggcaggagaaucacuugagcccaggaggcaaagguugcagugggcgguggaggaaaaaaaaaaauacaggcugggcaugguggcucacgccuguaaccucagcacuuugggaggcugaggcgggcagauaacgaggucaagagaucaagaccauccuggccaccauggugaaacccugucucuauuaaaaauacaaaaauuagcugggucugguggugcacgccuguagucccagcaacucuggaggcugaggcaggagaaucucuugaaccugaaagguggagguugcagugagccaagaucacgccacugcacuccagccuggcaacagagugagacuccgucucaacaacaacaauaacaacaucaaaaaagacacaaaauccucagaaaaaaggacugaagauuguuccuucauagcaugauuuuaaaaugauuuaugaucuuuagaaagggcacaaauuagaagugagagaauaaaaagagacaggcaucauuaaugacugcaaugaauaaucaauaacugugacauaaaacaauugcaaugcaacaacaaaaccagaaagaacaaaaaaauuauuucagucuugauuucuuauuaaaauggcaacagcauucuauaaauguccacaggucucaggaaugacuauuugacaacagagccacuaaugauaaaaaggggcuucuuucuguuuuauauuuuauauauucuggcugaaaugaugggaaagaauauaaugguugagaacacauaauacaaaaaauaauuagaaugaaacagcucaauuuccuaaauguccuuaaguacuuuacaucugaaaaggcaaacucagguacgucuuuuuuuuuuuaaacuaauaaaaggacaacacugaaaaaaaaaaaaaaagaagaaucuuuaaaagagagacuagcauauucuccccaauaguuuuguaaccauaucucaagaaaucuuauuucccacagguuuucuaagagauuuccuuuuucccacaauugcuugaauuucccugcuauaaaucucugcaagccacugaaugaagcuuuacaaaggcauaaauaaaagaguaggaaugauccacacugaaauaaccaagccaaaauagacuugagaaaaaaagaauguagagcaauuuuuuuuccaccuaucaggguaucugguucuuuaaaugauuacccugacuugguuuuuaaauuuuuuuuugggaggugguuaggccauuagucccuuaaaaagugaugccaugauucuugguaggauaucaguggccaaauauauacagaaacaugauggcagcugcuguuucugugaucaaaaauucauaguagguuuccuuccuuccuuccuuccuuccuuccuuccucccucucucccucccuuccuucccccuuuccuuuccucucauucucccuccuaauuuuuuaaccauucaauagauggcagauauauggcaugccaguaagaauuaugucuaucuucuucacaauuuuguuuguggcacaacuuuuguugccuagaaugugcuuaauaaauauuugcuugaggaaguaagugaaucuauugaacaccaaacaccaagcuaggcaccgaaguugaaaaauccuaucccacagguucaucugggaucugcaaaacuguguuuagggaaacagaucaaauugaaucuaugauuguacagagugggguccuuuuucccaaagcaggacaagagguguuuacuaaguuauaaaauagaaauguucuggcucugauuuugaaaacguggaaccuacuggaaugggcagguugaaugaacaucccugaaaaaauguggcauucucccuacuucuagaguaaaggcagaaaacucuucaucugauggaaagaggccccuaagaaaggcugagugaccagaaaagcuuauuauuguugccuugcgggugccugaacacuuugcucagucaugucaucacuggccagggugggcucccuuggacgcggaaguuucccugcaucauuuggagccaaguuccugagugcccccauggguuccuauacaauuugggucuuuguugaauucacagcagcugcuuggcuuuccugugauucugugcuagagcucugggugaggaaauccaggcucaugcuggaccuucuaaaugacuuccagugacuuggauuuaagugucaaaaguuuagaaaauauucaguuaauagucauuugggagguaggacaucauugcugcauuaacggccuuaaauuugccuacauuucaaugcauguucaauaccuuacuauuaaccaaccucccaaauagcaaucucaaaauggaauaauccauuuacucuaagcaaugaccagugcaucaaguguuaggagucucuuccugagcugagugacagacacuuuaacugccgcucucugcaaacacuugcugcuugagucaggagaacccugcucuggcacacaacgcagaugccugcagaaacugcacagagcugccuggccugccugagcaugaagcaacccgaaaaguccacaggagucauaggagcuuucuaacuucuggacaaaaugaagcgagucauauugaaugucacagagaccaauagcagguucucuugcuugagaagcauccacuaacaccaagagcucaaaauuuuuuuaaaaaauuauacuuuuguuugcauuuuuacccagcugaccuagccagaaauugcaaacagauuuuucucaaguaugauuagauuugagaggcaagacggcaugagucaggagucaaagagcuaaaggauaugugucuaaagagaugugggacagucaguguucagauuaaaguagaagagauuucuuccuuugauugaaaauuggaagaaacagacucucaucuuuaucaacacugggaggcucugaguuuccaguuuacggcacugcucuuaagaagccaccagcauaauuucaagaacaggaaccaugauggcuucuuaaucaaauuaaauagcaaaaugaaagcaauaauuacucaaauuuacuuggcaaaauagcgagacaaauuaauugaaacacuacuuuugaucacaaggauauaauuagaaaagucuuugguggaugagaauaucucugaggcaugaauuaaaucaauuggauaaccugauuauaaagcccuuaugcuuaauggguaaacccaaacuuacuguugcggaauguaaaaggaagaauaaagauugaucagccaauaugcauuuaaaugguccuguccaacugcaaacauuacugggcuuuuauuaugugccagaugcugugacacuauguauucuuaucauuuauacuguuuuauucucucaaaaagcaauaaauaaaaaucagcauuauuaacaccugccacgacugucccucuguccacaaccacaggcuacacugaugauaggaccacagacagugaagucugacaaaagaaagaaaagacuaaaaugccuuuucuccuuuuuaucucaucuuccucuuacaaaucccacuacuucucaguaaaaucaaaucuuauaaaacucuaagugcaucuaagcugaaccauaagaagcacguggcauucccuggcagccauuaucccuuugagcggacacaugacaaagcuggcccaauuagagugaggagagagacucugauuccauuucuggggagaagcuuguccucuccuuuuggcaugaacaaggauguuuaaagccacaagugccaaacgcucuuacaaccauggggagaacuaacgucaaaaugaagccagccuacagauggcggaugguuacagccagucuacagacaguucuuccugaacaugggcccuggaaaacaucuuugagcuccugagucagucaagucuguagcugaccuuagcuccugccuugcuauaauaagagaucucacacguucuuccugaacaugggcccuggaaaacaucuuugagcuccugagucagucaagucuguagcugaccuuagcuccugccuugcuauaauaagagaucucacacgucuucuuuguuuuggccuguuugagccagacuuguauaaccuaaaccuaaagcauccuagucuauacaaaacauaaugaauguuuguuaagcaaggcaaguacaaaacaaaaauacuuuucuauacaacuaaggacgauuuuuuucaaguaugcucacugaccacuuacaccuaaaucacacuggauacuuguuuaaaccgcaaaagaaagaauuaugcagccugucugaauucuuguuucucuguuuaaaaaaauguguggauucacaccuacuccuugcuucuucauaaauuagcgugauccaaaaguaagcagaguaacagacuuugauuugugaaagugaauacuuuugcaagauugcuucagagcgcugcacuuaauaaaauauaaaaaugcuugagaaucaaucggauuauaagauuguuuuuaaggcauauaaaaaaguucucuccaauucuccuuucuaaggaaaagagguauuuuuuaaaguagguucuuucagauuccuacacauuauacuacaacuacaaaugugagguuuuuaugaaauccuucuugccuaacuauuacuuauauuuuugaacucaguuuaaauguucugaccuugggaggcucuucaaguauuauuuuguaccauggcugauacuuggaauuaaaaccuguccaaacagggaagcaguacauaaaguagccuccuuccugacuuuuccuccugcccucucugcaaccuaucucuccaugucaccccagaccacaugcagacucaaacccuuuaccuaccuaaagccuacaagggcugagagcuccgccuguauaauacuuccugaggaagcucacaggugagguuagguccccuugaaauaugagauagcaacuaaauacaagucaggcuacuuucauuugcgagaguaaacaggccucaaacaucacccaauauggaaacaaauuacuguguuuuuuguuuccauaaaacacaggcuggacguuccuagggaaggccagcuucagggaugacugcuccacagacugguuucucugcccacuccucugcaggcugcuuacuccugcagguccccauggucagagggggcugucagagggggugagccaggaauguguggccucucccuuaggcauaggaucccuucuuccccaagaugccucuagacucacugguccaaaugaggcuacgcauucccauucuaugucaguguuagcagugggcugacaaaggcugagguacagugcuugccaccuuccuucccacugccacucaacaagaaaauuguaguauuuauacagcguacuaggguaauuggauggggcugcucagugcagucuucaacuauccuggguccugaccagcugccuugagagccgcagggaucaauaaacgagcacagcugaaauguaaccauuucuggcacaccagagguauucuuugcuugagaucagggauugucaaacuauggcuccacugcuugcuuuuguaaauaaaguuuaauuggcaagcagcuaacaaacaugagaaaauguucaacaucacuaauuaucaaagaaauggaaaaccacaaugagagauacccuuucacaccagucagaauggcuauuauuaaaaagucagaaaacaacagaugcuggcgaggcuauggagaaaaaugaaugcuuauacacuguuggugggaauguaaauuaguucagccacuguggaaagcaguuuggagauuucucaaagaacuuaauaaagaacuaccauucaacccagcaaucccauuacuggauauauauacaaaagaaaauaaaucauucuaccaaaaagauucauguaccccacauguucaucaaaguacucuucacaauagcaaggacauggaauuaaccuagguguccaucaaugguggauuggauaaagaaaauguaguauuccacaccauggaauacuacacagccauaaaaaggaaugaaauaauguccuuugcagcaacauggauacaacuggaagccauuauccuaaggaguaaauacaaaaacagaaaaccaaauauugcauguucucauuuauauuaauaagugggagcuaaacacuaaguacucauggacauauauguggccaacaauagacacuggggacuacuaugaggggagggacggagggggcaaggguugaaaacuaacucuugggcauuaugcucauuagcugggugauuagaucaaucauaccccaaaucuccgcaucaagcaauacacucauguaauaaacuugcacauguacccacugaaucuaaaauaaaaguugaaauuauaaaaaaaaaaaaguucuauuggggccaucuaucuuuucugcagaguuaaguagcugcaauagagaccauauaacucacaaagcggaagauauuaucugacccuuuauagaaguguuugccaaccucuggcuuagaugcaacaacuaguguggaauaaugucagcaagucaaccacaauuuccauucuagcacccaacacuuuuccuuucuaacauacuucacauuuauauuaucuuuuugaacaucugccucccuugcuaauuuaaguucccugagggcagugaauagugucauuuuuuauucauugcugaugccacauccccagcaccuagcccaugggcuggcucauuauaagcacuccauaaauauuuguuggcugacuaauugagauaaaugcacuacuuaaauaaucuucuauguaggaguaaaagcaauuauuucuuucaggaugcuccagaucagagaguaacaacauaucaaaaacagcacgucaacaaagagacacguauucuccaauaagaagggcaugagcuuuaauaacauuaacauuucacaacccuugggaggaagaugugucuacgugcugucucccuugagaagaggcagaaacaaacuuggauucucagaaucugagaggcaagguguggcagaggcaagcagcauguuugcuggagccaucuuaaccaagaaugcucacucaugaccucaugcugcagcccaccagcuacaguuccagguacgcucccuauuuaacuucauaauuugugacuucacuagguaacugaagcucaacuuucauuaguguucaggggaacaguaaugauuucuaaaagguagaaagcauagagagugaacagggaugggccaggcaggguggcucaugcccauaaucccagcacuuugggaggcugagguggguggaucacuugaggucagggguucgagacuagccuggccaacacggcgaaaccccaucucuaccaaaaauauaaaaauuagcugggccugguggcgggugccuguaaucucagcuacuuaggaggcugaggcacgagaaucgcuuaaccugggagguggagguugcagugagcugaaaucucuccacugcacuccagccuaggcgagagagugagucuuugucucaaaaaaaaaaaaaggaaagugaagugggaugggccuagagauaucucuaugccacacuuucucuuuaggucuucuuuucaaagaauagauaacagaguccacaaagauaacaguaaccuagagaaacagaccuugauaaaccccaaaaaacuuaugcaguggaccuagaacucauuuuaucuguggaugaugccaguuuuuuuuuucucauuaaccaaucuaaggaaauuuagaaacgcaugaucagaaaugaaaacaacuuuauaguuuuuuaaauugccagaaugguuuuagaguguauaauaacauuaaaaaacaauuaccacuaguaaagaggcaaguauuuuucaacguuuaguuugacauucaaaguuuuauuccacaaugcuggggacauacaaaauacugaggugcaguaaugaaaauugcaauaacaggaccugaacuucauuauaaucugcuaauuaauauagcaauacacaauaacaacaggucagcauacacaggaucaugaucaaguugaggccuguguugaacagccaagaaugccucaaacaccagggaaagaaaaaugccaagcacuguauuaaaauaucuccccuagacacaguuugcuuuccaaaaaaaagcuggcagucagcuuugcaugccagcauuucaguauuuuucccccuucucuacauuuauggcaaacccaaacuaaaccagauuuaggaaagccuugucaucaaagagggaagaauagguaaaaggaaaucucuuauuuguuuuauccaugcaaauuaggugguauuuagaacagucuucucuaccagaagagccaguauuauauucgacggaaguagagugguugucacccaugaagucaaauaaaaauugcuucauuuuuucauuuucaaauucacagaccuuuaauacuuuuuuucugucccuuuuucucagaaucuaacagaauuuuuuuucauagauguucuaacauaaaaauuuaaaauuaauauuuggaauauaguaauacugccauuagaucaauucccucacaauuuuucuucuuaaaguauuuaauguaaaaaguagaugucuaaguuaguaacugacuauguacuaauuaugagaaucucagucuguccauccauauaguaggggaaaauauauuugcuaucacuuggcaaugaugggcuucaggacaugcuaccguaaaaugcagcaccuugacauuugagaaagcagcagaagcaggaaagucucucucaccuuccccugcugcucuucucuccuaaagcagaucauaaaaccuagaaaggauuaucugaccuuccucugaagcagaucauaaagccaccacuggaaagacgcucucaccauacccagaagaaaggaauauucuuaccuccggcaauacaaggacacagagaggagucugaacaaacaggucuugcuaaguucugcaguuuauuaccacuagaucauacccucuuuguccaaucauacuuuuccagaacaaucccacuucuucauuaaaccuagcauaaaaaguauacagguuuaccugccucuccaagucuucauuucuuuacgaaggguccuaugucaugaaaauuuuauuuuaaacgaauuuguaugcuuuucucuuguuaaucugccuuuuauuauaggagccuuaggucugaaucuagcaauggggaagagaaaauacauuucuuuucccauacaaugauaaguguuuuauggguucauauucuuugaucuaguaauaccaauucuagaaaaagauucuaagaaaauauucaguaggaaaagcacuuauauucauuaaacuacucaucauaacaugucuuaaaacaacagauacuggaauagacuaaaugcccagcuagaaagaaauaagaaagugguuaaguaaauguagguuuaucaagcaagugaaauauuacccaauuauuacaaauuaaaaugacgcaaaccauggaguauucugcaaaauauuuuauagaucgcaacauaaguaaguagacuacacuaugguuacaaaugaaaacuaacugaaauuuucuuauuagucugcagaaaaacaaauuugugaguuaagagccuuuuaucaaugugcagacucucacccaaucaucacauuuaucagaguagcaccugacucuuccuguugcuggaaucccuguggucuccugaugagcuuuucccauucuuuccuugugccuuugcuauacuguauuccucaccugcaaagugcuuccaucuaauccugauaauccauauguagcacuuuguucaagacugaacuccauucucaccucuuucacaaaguggccuuauuagaccaacgaugugaaauugcuuugaauugcuuagcuuguauuaucauuuccuugacuauuuuguugucaccucuucucagacugcaaauucuacagaauuauuuuuagcccaugcaauggguaaaaaauacaugauuuugaaaaaugaagugaucaaugaguauaaacucuucggggcaggggccauuucuuaucuuuguaucuacaauacucaucauaguacugagcaaacaguagauuaucaauaacucuucacuaaauaaauggauacauuuauauuguuacacgugacuacuggcuguaauacccagggagguuuuucuuaucuguccccuuuccacuuucugcuucuaugaaacaucagauaagguucuuuuucuaaaaggagugccauccaugaagaaagcuuacccaggucaaacuggccagaaguguagccacaagucugccggacuuccucacugucccagcccaagggguagagggcacagccagcaccaaucaacaagccugcaaagagauaagacaagagggcuuuaccagugcuucucugcaucacuagauaaagguggugggaucaauauuuagcaauauaacaagaccauagcgucugcuuuuuagacagcaccagccacaacucuuuuaagcaaucuaaggucaguuugacuccaacaacaauuucaagucagcuuaaaagaaaaaaaaacuugacagcucaguuuggguccaacuuugccuuuuaaagcauuaaaagccuugcaaauccuguuuaggaaauacaauucagaagcuuuuuaaaucauucuugcaaaaagccaaccaauuccaccauuaauccaugcaaacaaguauuucaagagcaagcaaaaguuccuaauagguuaugauuucuuauucacuagauuuuuguuuccuauuuaagaauaaaauagaaugauucaguguugucaaauuuucccaggggcagaaagaacauaaagaguuucaugaauggccucagcacauucaucaaaccucugaacgguacugcccauuauuaggcgauguggagaaucacugagcauccacgcaucucagaaagucucaggaagacagacauuuaucauaaucuaagcaccccuugcugcuaaaaccaaaaguuuugaugacuaaaccaaagaaagugaugguuuucucuuaauauagauuaaguuauccuggcagcacucucugagcugacagcuuucaauuggugagucuuuaguuugcaucaaagccuaacaugguuuuacaagaagcuaaacgagauuuaagcacucacuauuugaauuugugggcuaaucugaaaguaagaucuuguugugucaaucacagguguuaucaacaucugugaguaccacaaaugugcugaacccauaggaccaacagauacauagucuaauguuggggaaguggcuuaucaggugcuaaaugacagagcccccuaaauaggaaaauccauuaauaugguaacguggaagaggauggcagggcccggaauguaucuaggaaaggagaucuucaauauuucugcaccaagucccuuccgggccgucuuuugucuuuuuccucccuaccccagucagucaccccugguggauaaauugaccaguaguaauccauacaaauaaucuguuuccuuacagguaacuaaaggagagcuagcuacuuuccaucccuguccucaacuacccugaggaaaggccucccuaaggaaaggccucccucacccccacacccauccugauacauuuccuacccugguaaugcuuuccccagucugccccuugguugacaugaagggccuucuauaugcaaggcagagggccaucuacuugugggagugcuagaaagaaugauugaaacuaugaaucacuagucucaggauguccuacaugcaacugcauaaauaugaauuauguugaagcugaagaauaaucuagaaagaaguuauacaagcuuuugcugacgaggcaaauguccuaguggccaauuuccuuaggcuuuuccccuugggauagaauguacagcauucuaaagacaacuccaaacuaguuuugggcaccauuaaguaaagaaauuauuaaugaggaugccaagcuuugugcaaaaugaauuccaugaauguuuaauaaacaaugagguaucaugucugcgauacucaguucuuaaauuaauagguagcaccacuuucugagaagaucuugugaacaauuuuuuuuaaaggaugacaaaugcagaaaggcaucuggacaagaaguauuuaaguguaagaaaaauaguaacauuuaagccagggggacccaacccccgagccaugaaccaguauggguccauggucuguuaggaaaugggccacagagcaggaggugagcagcaggcaagcaaguaaaguuucaucuguauuuacagccacuccccauugcucacauuaccacaugagcucugccuccugucagaucagugguggcaucaguuuuuuuuuuuuuuuuuugagacagagucucgcacugucauccaggcuggagugcaguggugcaaucuaagcucacugcaaccucugccuccccaucucugccuccugaguagcugggauuacagguggcugccacugcacccagcuaauuuuuguauuuuuaguagagaugggguuucaccauguugaccaggcugaucuagaacuccugaccacaggugaucugccugcuucagccuccuaaaguccugggaugacaggugugaaccacugugcccggccuagcauuagauucuuguaggagcacgaacccuauugugaacuaugcaugcaagggaucuagguugcaugcuccuuaugagaaucuaaugccugaugaucugucacugucucccaucacccugagaugggacugucuaguugcaggaaaauaggcccagggcucucacugauucuacauuauggugaguuguauauuuauuucauuauauaaucacaguguaauaauaauagaaauaaaguccacacuaaauguaaugugcuugaaucauccugaaaccacccuccuccacucaguccguggaaaaauugucuuccaugaaacugguccgugguguaaaaaagguuggggauuucugacuuaagccaucaguaauuuccucuuuaccugacaaguaaaugaaaaacaguuuuauuugcuaauguucauuacgaguaaaaacuaugugccaugaagucaugaaaacaccuagucuggcccagucuuaugcuagucacuuugggacacuaaauagaaaggagcuuacauauggaacacuuaggccaggggcucuccaaggggcagaacacuuggcagucagagucuuuuguggaauucuggguuguuuuugugauacuguaaccagggaccuugguuuuaacaaucacccacuuucuuuuucuuccuucucuccccucucacccuuucauuccuucacucucuagauacuccccuccaacaacgcaugcuuaucuaauugugcucuugcucuugaaacaaaccaggcuggaaccccauggcagaauccucccacuuaggaagaguuccaccauuaguccaccaucacugaagucaagauaaugccagccagacuucuggacaggcaauuacccaagauggccaucagaauguuaaaauaaaacuuuagacaaauuaaauuuaacagaguuuaauugaguaaggguuaaaaaaaauucacaaaucaggcagccuucagaaucauggcagauucagagagacucccgggauaccuucuggucagagcaaauuuauagacaaaaaaaaaaaaaaaaaaaggaaagugacauacagaaaccagaagugagguacagaaacagauggauugguuacagcuugguguuugacuuaucugaacacaguuugaacagucagcagcauaugcguuguugaaguauggaugcugggauuggcugagauugcagcuauuguuacagaagcauacuccuaaauuagguuuucuacuaagucuacuuacuugucuaccuacuaaguuagguuaugguucauccucaaggacuuacguauggaaguauggagguuuucucaggccacauuuaguucaauuuaacaagaacaagauauacagacuguguacccugcacuacuccggaaugucuccuauaccaaguuucccuuuaaaaguccuaugguaaauuuuaaaauguaagaugguauuuagaacacuagauugccaucuucucagguugcugguucuccgauuaaaccugcuuuuccucccaccaaacuuugucucuugcguucugucuggcuuucuaccggcaagcagccaaaccuagaguagguuacauuacuuuguuuuuuguuuguuugguuguuuuguuuuguuuuuuugagauggagucuugcuguuucccaggcuggagugcaguggugugaucuuggcuuacuccuggguucaagugauucuccugccucagccuccuggguagcugggauuacaggcgcguacccccaugcccggcugauuuuuguauuuuuaguggagacgggguuucaccauguuggucagguuggucuugaacuccugaccuugugaucugccugccucagccucccaaacugcugggauuacaggugugagccacugcgcccagccacauuacuuugaaauguagauucaaccauauaaauuaggaacaauuuuauacacagaaauuugugguacauguaugaauuuuaaaaacauaccaugaacauaugcucacauguuuaaaaaguuguucaguggagggcaacuagcuuaucugaauuuuuauauuaauauuuauguagcucuuguuuugucaccugcuaguauuugcuagcaggaaagaaacugcagacuccaaaaauuugagaaacauuucugggaaaaaaauguacguuacaaaccguaugaucaggcuaauuggcuaucacagugauuaggauauguagguaaacauuucaguggccuccccacuaacuugcuaccaccguauguuaugguaaaagggaguuucagaccaaauuuggccaaauaugcaacaaauguuuauuaguaagcuggcacgaaaaagagucagaagaccaauucuguaagcucagugaaauccagugaccugccccccugcccaacacaacuccaucauauagucauuguaacaaggaccucacaugaaauuuucaacacucaguggacaaauaugagacaguucagggaaacuuuaggucagaucaggccacaauauuuuccauuaaauggaaguggagagggagcacagguccaaagagaaagaucuuaaccuggacugccccaugcaguagccaauagccacagguagcccuuuaaguuuaaauguuaaguuaauuaagauuaaauacaacucaaaaauucaaucccucaguugcacuagcuacauuucaagugcucaacagccaccugccacuaguggcuaccauauuggacaguguaaauuagaccauuuccauaacuguaguucuacuggaggauggcugugcuagauauaagacacacuuuaaaagaaugcuggauuugucagguucuuaggccuuaagccugauggugcuuguuaagaaucaaaaucaucacugcucuuuaaaguucuuccuuuuagguagggcuagaggucaggaaacuauauuucauaaacuagugggaguucugggucauacucugucaauaagaagcucucacguggaauauaaaaaauaaaaaggauaaacugguauuccacauucacaccugcagccaggggcaagccuuucugcagacaguagacagugacauuuugggagugauuuccaggugucccccuccucaucacccacuaaggguggauuaucagcuguagcuucuuuugaucccagcacuuccugauuuccugaauucuucaaaacagcuucucugaccuucacuuucucagaccucuuaguaggucuacaaaaaacguuaaaucccugggcuacaucccuuccugcuggaaauaucuggagugguuucucuuacuggucaaacucugacugguacaugcccacucacaaaagggcagaagagccaauacugaucuuaauaccccaccguauuucuugaacaucauccauuuccuuaaguaaaaauuaucucgaagcacaauuuaugcuaauuauuaaacuucuggggcaaguguagagagcaauauucuaaagcuuugccuuuaagcaugccugugguauggucucucguuaggaaauguaacaggcuaaguaaccuccccugaaauguagauuucugaagaggauacuucaaauguuaacuaauugucuucugggggaggacugaagucaacuaguauuuuguugucuauacugaaguacuauuuuguaaaguagaggcaauuaaauguaaaagugagaacaucuuuuuaauggaagaaaucugccauuguucauuuccagcaguguuaaaucuuagcccauguuguggaaaucaauguuugauggaagcacaguuuagaaaucccugaauuagauaccgcuuggguauuacacuguaugcagaaauagagcucagaaaauuuucuggaauuugaaguaauugcccaaaugaugucuuagugaccugacagauuuuaauagcucuaguugccuaauuugcuucuggggaguauauggcucaauuagaaucucuagcucacaagcuuuaauauuauuuacauggguuuuauuagauuucuaaacccugugguuaccacauggccuuaauuucaaccaaauuccuuugucaccgccauaaaagacaacauaaaaaaggcgucaguuucacacauuuuggaaauuugugcauacgaguggaagugaggaaagauguugugaagcaagucagcaaccagaggaaggugggaaccaagguggguugcaggaagaggugugagaucauuugcagcuacaagcucauuugcaauuaagaagcaaucuauuucugcgaccccaaggaugugcaacuuuuaaggggucauaagucaaucacaaauuacagcaaauuagcucaaucuuuaguuucuaccagcacuuugcugcaaucagcaaucuagaggcaaaaggccauggggaagauuguuuuuaaagagguuuuaggauuguagagagaugcugccuccuaaaaaagaaaaagcaauaauccaacagaugacuugauaauucuuaaauuugaaaaaguucauuuuaauaaugcauugacuacuacaccauuuccuccugagugcccugcgguuuuuggguucacccuguucaaggacaauuaaaauauuuuaagacuaagucaguggaaugaccucuaaggaggagccagugggaauggaaaagagcuggcauagacaauuacaaaaaggugggcaaugcugcugugaugaaagucuguucuuuagcuccaaaugggcccuugggcccaaacgugagcuuggauacacuggccguaaaccaccuacaggagcguuccuaguagaaacucuucgauuucacaaaaugcuagaaauaucagcaugauacuaauuguuucuuugaauuugagugugugaagucugaagucuguaaagagcucaguggucagaauaagaaccuggggcugggaauuuucccuucugcaaaacucuuucuauucaaacacaguacuuaacacuuagccagcggacuauuaacauaacaauucagcuccugccaagaaggcaaaacaaaccucuagucagccaaugccaauuacucuccacaggugguaagaauagaguccucauguuaaacucauaaagccuuauuuuuccaggccaaucuugaaaguuuuuuuaaugugaucucacuuuuuuccaggacuauggcuccauucuuuuuccacuguuuauuuuauuuuuuuaauggaaugacuuuuuccacccuuggccccuugaguggucacaccaguguuucccaucaauucaucuuuuauguuuuuuggauacuuuuauccauccuccaguuccuuuaucuuccuuucugugguaagcaccgagggaaauuguuuucuuuacuguucucaugaaagcugcucaaucuugcagucuguuaucugaacuucucuuuggaagaggcuggcauguuuccaucucaaauucuccauaugcuaauugauguacacgaguuuuguccauuuucaucccuagauaauggccccuuuacaaaauguaagaacaagaaauguaacaauaaaacaaauacagugguggggaaggaacaagagcaggggucagcaguguaauucuucagacccuggaaacucaaggaguacauucuuuagucuacaaaaaaaaaggcuugguugcauucuaguaaaccacaccuccuaucaaagugcuuucuggaaacugaggcacagaggauguaagaagccuguccaaggacacagagcucagauuaaucccgggccuccuggauccuaggccagagcucuuuuuccaccuaucaugaucucaaugcuuggacauaaguccacuccacagucacacacucaccacccauaaucugaguucaaccagagacauguuguauuugaccaucaucauguuuuacuaagugggacuugguauaucuaaguccagauuucuuguaucucuugaauaauugaaacauaugucaacacagagccugcaaguggcuggcuggagccagguccuggucauccuguuaacugccugggugcccuggccagacucaaagacauuucugacuggggaucccugacuuacugcaccuauuacugguucuuugaauauauuuugagcuuuuucaucucugaaagucaaaucccuucucuuugacugagacacucacugcuuaccuuaaugcucagaaaauacuaccacuuaaggucuacgaagccucaacacauugccuuuccuggucaucccagcagcgagcuauagguuuugccucuccugugagcugcuauuuugaugcacucucuacccuuuacuugaggcugaccauacauugcaguuauuuguaaguauuacauguccuggaaggccagacacucuauguuuacuugcauccagcucacucauucacaauauuuguuaaauauuaaauauaguaauauuauuuaguacuuuaaaauccucagaaaaauguauuuuuguacacacauguuuuugaaguccagauaucgacucauaguuauagaauauaucagcugggcacgguggcucacgccuguaaucccagcacuuugggaggcugaagugcguggaucaccaggucaggaguucaaaaccagccuggacaauaaggugaaacuccaucucuacuaaaaauacaaaaauuagcugggcaugguggugcacaccuguaaucucagcuacugaggaagcugaggcaggagaaucgcuugaaccgggaggcagagguugcagugagcugagaucacaccacugcacuccagccugggugacagagugagagacugucucacaaaaaaaaaaaaaaaaaaaaaaaagaauauaucauuaccccuguuuaauaggugaaggaaaccaaagcuugcacaagcaggccuaugcucauaaaucuacucaagugguagauccagggacaaacauccagguugagcccugagccagugcuccuaaccccucuucuccaaugccucccaaauccccaaguguucacugucccaucucugggcuuacuuuccauagccacacacacacugaacccuguguguaaaugggaaggaggaaugggguagaagaucaagccagauuuccagucaccauuugucuaagaaugacacugcuuuagccacagggaagucucccacugcugccugugacuaacgacaagggaugggcucuuggaaacccugcaaaucccuuuccugggggccggugagugagaaccccaguugugagcgcuggcacacaaaaagcuucuguccaaagagagcacauggagguauaaagaugagaaauggguuauuaucagaagcuuagccaaggaaagcauaucuuauucaaacacuaaaauauaaaacagaaauaugauaauuugacaaccuaucaaaaauauuuuaacaaaucacaauaaggcuauuucuuggcugaaaacauccugcagaagagaguauacuucggguuuccuuaaaauguuuuucaaaauggugccuugauucucauucuucuuuuuuaauucaugugacagaaaacacaaaagacauguacaaugcguuaugcaccaaaauacuugcuccuuagcucagagcaaaaauucacaagcuaacuucagucaugagugacuugucacuuuuuaucuuccugggguccuaggcaaucauugggagaaaaaaaauaaaguuguuucaaacaaugaaaauuuggggaagauuuugcaauuucuacgugacaguuuucugggaaauuacaucugauugaaagcaacaccuuucuaaccccaguaguuaagggcaucuuaauucuaccauuucacuucuuuaggacucaguuuuccuuaucuguaaaaugggggaaaauuaugaggagggggagguaacaccuugaacauuuauuuuuauuucuguaacagugacuuuaugaaaacaaaguagaccaucauuacauuaggaugcacaguguugugggagagauuugcaaaacuuccacuggaauugcagggcagaugauacuguguguuugaagucucacaggcaacacaccuuggcaucaugaaguagaaugccauccccagccaccuccaagccuuccccugacaucuguacagaucuuugauuccuguuagagcccuaacucacaguuuccuucccggcaggcuuguagagcgauuuacacuggccgugggaaaucacgucuuuucuaccgauugcacucauugugcgauccucucagggauucugggugagcugauaugagggacauuugugaugggauugaaagccaagccgugcauagacagaguuagcuggagaagagacuccugcaauacacuaucuccugcaaaaacuggagcagauuuggggguugcauuccugucugaauggagacaacgauggaaccaaguugcccgauucugugcagaucauaugaggaacuacauuguuugucaugcuaauuaauacacagcuucuacacuggaucccaugaccucaggggaggggcugacuggguggggaacuaguggggugugaguaaccaaauucccuuggaagaaaggaagagugagcuuguggguugagaagggucccagcgaauguaccuucucauauggcugugagaaauaguaauucauuauuuuuuaaucauuaccuaaggccaaaacguauaaagaagggguauggccaagcuuuaacucaaaugggguccugaaauaggagccugcuguagaggaagggccauaagcuuuggaaccagagagugauuggucuggagccaggcucugcacuggugagugguggccuaggcaggucacuuguuuugaaacuuagccuuucucucagggccagugugaacaaagccaccugcaccucuuggggauggugugaccaucagagcaacgcacaccaauuccccgguguguggcagacaguggcauguuauguuugcauaugaugacagaagauguucuauaggagaucacucaggagaagcacaugcagagaaagcaaacuauuugagggaaaauaucucccuccuuaguuuugauauacuaauaucauaaaauuacccaagacagugcagagcucagguagagaaaucuuacaaagcagugaugaguucccuggggcuucuacuucagcuucucuccuguguaaguucuauugcagaaauuguuucaguucuaacauaacaauauuuaggaggaagaguuaaaccucucuccccacgagugcccuuaaccaacacaucaagagcacaagcaccaacagacucccaacuaccuucauucauuucuacuuaacuuuuuuuuaaaaaguuuggauaagaaauaauuccucuucuuacauauuucuaagggucuuaaguaaaucaggagccccacaccaacaguaaaguaggaugucagacauauuuuuaaaaaaguaguaaaaucuacauuuguugaacuggauagugaaagaaggacuuucuacaaauuuauauagacucuguguaguuugcccugccacagugagcuaacugaagccucuuauacagauaaauaagaaaaguaccagccugggcaacacagcaagacuccuucucuuaaaaaagaaaaaaaaaauuagccacgcguggugguacaugccuguagucccgacuacuaagguggcugaggcaggaggauugcuuaagcacagggguucaagccugcagugagcuaugacugcaccauugcacuccagccugggagagagaaugagacucugucucuaaaacuaaaaaagaaaaaacaaaggaaacaagauuuuacaauguaauaaagagugggaagcaggugagagacgaaauacuaccugucagguacaaugugcacuauuuaggggauggcuaccagacuuccccacuacgccauauaaccauggaacacaacuguacguguacuccuaaauccauacaaauaaaaacuuuuuaaaaauccaauccaaggccgggugcagaggcucacaccuguaaucccagcacuuugggaggccgagacgggcggauugcuugaggucaggaguucgagaccagucuggccaacauggugaaaccccaucuauacuaaaaauacaaaaaaauuagccaggcgugguggcgugcaccuguaaucccagcuucugggagggcugaggcaggggaauugcuugaaucaggaagguggagguugcagugagcugagaucgcgccacugcgcuccagccugggagacagagcgagacucugucucaaaacuaaauaaauaaauaaauaaaauaagaauccaauccaaaaacaguaaugcagaaaguaucaauugaaaagccucaguacuaaugaaaauaagcauaucaugccuugauauagcacauuucuucaaguccuagauacucugauggcagauacuacuuaucccuagcuugcaaacaagaaaauuaaagcaugaaacugcguagauuuuugucuugacacacuagaggacagacuugaauccaggucuuuacuacugauuuugauaccacagcaaaccaaacacccugugaauuucacaaacacuacugccacguuguaugguaaugaaaaggguggccuuaaaaguguggcuauguuccccuuuggcguugugaucaugggcaacuuucuugccuuucucuugaguauguuuccucaucaguuaagaaggaauaaaauccauaucauagagcucuauguuguaaggauuauaaggauuuauguguguguguguguauguguguauaaaacauacagacauauacauacauauguguguaucaaaccuuauauauaaucauucauuuuuaauagaauauauaagccauuuauaacagauuucuacuaacuucuacuaacuuuucagcuuaggauauauauuguuuucacuauuuaugcucauauagcaacuuuuucaucacuaaaaauuuagagaauaugaacguaucauaagauugcugauaugcaccaucaauacggugguacagguggccaacucacuuaaaagaaacaauucuuuaaaaauauuuuccccuucauccuuuuucugggacaucaggaaagaagaaccucauccauuuuccucaggucuuuuuaaaauaccaucacuuccacugaaaaaacaguaaaaccaucuggaauagcugacagacagcaguauggaagcaauuucuuucaagacagcuaucaugauuuuccuuuccguuuucuuucucucuugaaaugucaaggauaacugcaacuuuuuacuuuuccaucugugauguacugaucagucccaaacaaguuuugaaaguacuugagaauucuguuuccaguaaguucaauacuuuuuuuccacuuugacuuaauuuaaaucacaucugucuuuaguguuuuuuaauauuaaaagauauaaaaacguaccuugaaauaugguuauaaaguauuuuacaaaggaagaaguauuuaaaauacuaccacaagcggucacaaugacucauaucuuuucaaauagauuaucauaaccagcacaguaaaaugaaaauaaaaaaagacuccaaaaucgguaaaaguggccgggcgcgguggcucaugccugcaaucccagcacuuuggaaggccaaggcagguggaucaccugaggucaggaguucgagaccagccuggccaacauggugaaacccugucucuacuaaaaauacaaaauuagcaggguaugguggcaggcaccuguaaucccagcuacuugggaggcuaaggcaggagaaucgcuugaaccugggaggcagagguugcagugagccaagauugccccauugcacuccagccugggcaacaagagcuaaacuccgucucaaaacaaaacaaaacaaaacaaaacaaaagaguaaaugcugcauuucacauuauagaacuagcagaagguagaaucaggaauacucauuuucagccugaucuuuuaauuaucucaauaugaauuuuccacaaacaaaaaccugaauaccaguuguauacccaggaaucaaagcacgagauacauuuuaagguauuuuuuauguaguuauauauaauauauaauaaagauauauguguaaaauauauuuauaagauacaaucggcccucuguauccaugaguucugaauccauggauucaaccagcuguggaucaaaaauauuuugaaaaaauuuacguucacacugaacacgcaaacuucuuuuccuuguuauuauucccuaaacaauauacuauaacaacuacuuacauugcauuuauauuauauuagguauuacaaguaaucuggaggugauuuaauguauacaggaaaugugcauagguuauaugcaaauacggugccauuuuacaugagggacuugaacaacugcagauuuugguaucuaagaaagguccuggaaccaaucccccaaggacaauaaggaaugacuguauauuuuaaaauauauuuggcagagaaaacaguacugauuaaugucuguuucaugcacugagcuggugggcuuugacucugugucaagcaugggacuucucacuguggaaacauucaaaacacggaagaaguggucuuuuuacucuggcaucugagaggaagaauaaugcagaaacaacccaaagacaaggcuauauuugugucauguuagcagcaaaaccaacagauaccagauaagucaguucauuuuaggcuggaccugaggggaaggaggcuguuaggggaugaguacauucugagaaguagacguggucaucucaggugaagagaacaggcugggagauggggaggcacaaaaugaaaacaagagcaaguuagaauucagggaguagaggacagugguggcuaaauggugaggauggggucaaugacccucgcagaaggucauuaauucugggccaaggaaguuggccuuuacguaguagccaaaaggaaccuguaauguuugcuaagacugcaaucacaaaacaccacagacuggguggcucaaacauucauucauucauuuauucauucauauauuuauuuauucucguucuagagacucagaaggccuagaucaaggugugggcaguuugguuucuugugaggccucucuucuuggcuugcaaauagccauuuuucacgguauccucacacggucuuuccucucuaagcagacaucccuaaugucucuuuguaaguccaaauuuccuuuccuuuuuucuuucauagagauggagucucccugugucauccaggcuggaguauaguggccugauccuagcucacugcagccuugaacuacuugggcuaaagcaauccucuggccucgccucccauauagcugggacuacaggcauacgccaccacacccagcuaguuuuuuauguguuguagagauggggucuugcuaaguugcccaggcuggucucaaacuccuggccucaagcaauccuccugccggagccuccuaaauuguugggauuacaggugugaaccacugcaccgagccccaaauuuccucuugcgauaaagacaccaaucagauuagauuaggauccaccuuaauggccuaauuuuaacuuaaucacuucuucaaggccuauuuaugcauagucacauucugagguacuggggaguagggcuucaacauuugaacuuguggggggcaaguucaaaccucagcccauaacagagguuugugguugaauccucaaauguaauaguugaaaggcagccucaagaugaucuaaucuagugcuucucaaacuuugccaugaaaauauuccuaaaaucaaagaguagugaacucauaccuuaagucaguacuucucugaaacagguuuuccuuguaccuacugaaaaauuguugugaaguucuccauucuacuccauggguagccuuguuucucauauaaaaaugcuuuccucaaaaugauggaguaaaauugaugcucuuagaagauauuuuggguuuaucucguggcuucacauaucuggagccauuucccuuuaaguacauggauagcucaguuuuagaagaaugaaucuaggcugcagcucaaagagauuagguggcaugcucaaagucacaguuaguaaaagaaucagaaauggaaugaaaucuuuuguugcucgguccaaagcauuuucugcagcaccacgcugucacacagaaaagaagaaaguacuugaucugccuggcacagacuauaucacauucaaaaaguucugaggucacccagcgcuacccuaagcgugagacaccggcuuccccaauuggccccauggacuccccacugcuccuucccacggggcuccaaacagaaguguccagaggugugaaagagguggaucagaccagcuuccuccagggaaacuaucaucagcugcaaauuccuagcuuauuuaugaagggagaacagugucucagauaaaugccuccuuuuuucagcagaaugagcagcugcuaaucaaagguugucaagcacaauuuauacuacccagggcuucaagggaggcauaaaaagaaagaucacaacaucauguuuaucucccuuucauugcuguuucuggcaauaguauuacagucaggcaggcugaguaaaaacaauuuucuaaaaauauggaucagcugagaccauuuaaagccgcuuuuuauggaguuaucguuaggacuuuuccccuugggcugcuuuguguacuauuucccagagccuccucuuccaggaucuaguuaucuaaaaaauauaauucuuucuccuugccagggagaucacagccucccaaagacugauaaggacgucugcauuccuccccggagccugggcaaacuauucccaagaguuccaucacuccgggcgggaggugccguggaccucagucaggguuucugcuguggagucauugguuuuguggguggacccugugcugcucagcagguaggacuggcugugacucccucuguuucagucuuuacaagaaugaauuucccacuuucccagucuuuaugaaaggaggaagucacauucuagaaggugagcuguaugcuaccauucuccauggacguuaacauuuagaagggaaaaaucagcccucagucugugguaggcuuuucacccaacucugaauggcugcugguggcaaagcaaaggugacaguggaggaaguuugcuuucaguauagauucuauuuccuuuacauuaaaaccaacaaaggaaaugcgauugcuuucuaacaagccuuauaaacagacuauuuucacaauuugugugccuuaaagcugccugcuaugaaggcauaggguuuuacuucagaaaggaaaccaauggaacaucuaguuuugcagcuuuuucugcugugacccuugaaccucugcaggguguugggggugucucuguggugucuaaagaacaugugcccaggugggauggagcaaggugagcuugggggaugcagagcagagauguugcccuccacugcugcccccaccaggauggggcugcucuaccugcuuucugauggggcugcaccugauauuguauauaagggcaagguucagcuccuccauaauuuugaaaacuauccuaaccugguguuauuggcuaaacugcaucgcccuaucuccaaaacagagguauauugagguccuaacccccaguaccucagaaugugaacuuauuuggaaauaagguuguugcagauguaauuagguaagaugagaucauacuggaguaggguaggucacuacucugaugugacugguguccuuauaagaagacagccaggcugggugcaguggcucacaccuguaaucccaacacuuuaggaggccaaggcaggaggauugcuugagcccaggaguucaagaccggcccgggcaacauggcaagacaccaucucuccaaaaaacaaaaauuagccagugugguggugugugccuguggucccagcuacuugggaggcugagguggugggaggaucacuugagccagauaagucaaggcugcaguaaacugugaucaugccacugcacuuuaaccugggugacagaaugagacacugucucaaaaagaaaaaaagacaggaagacaggcaggugaagacacacacacacauacauacacacacacagaggcagaguuuggagucacgcugcuuuaagucaaggaaugccuaggggaaccagaagcuaggaagaggcaaggagaaacuucucuagaaccuucagagggagcauggcccugccaacaacuuuauuucagacuuguagccucagaacugagagagaauagauuucuguuguuuuaagccucaugauuggugguccuuccuuauaccagcccuaggaaacuaaaacaccuaguuaaaaauauauucuucucucauuuaauuuguuuuacccucuuaggcaauaaguuaauaaaguaaauugaaaaaaaaaaguagauuuucuuaauuuacuaacuucuguuucccaccccauccucaaaugucuuaagaaaauggccccaagaagagacauagauagaggcucugguuucuccaagcacaacaucacggcucacaugcccuagacucagaugccacacauaacaccaucaaucucugucuuaccacugugucaaagaagggaggucgauccaggauccucacugcuauaaccuggaggaagcauaacuuacacgucagacauaguuaaccaugcaugccugacaugugagaugcaagcugcaugaucauaauuuauauuuaaauagcuucuuucuccaaagagcuugaagaaauuuaccgacuuuuacuuaauuaauucuuguaagucauccgugacgaagguaaaguaaggucauauaucccucuuuccucuggcaucucaggguuuggcuacuuguucuccacuuuuuguuuuuagaauuguggaguuucuccucuccaaaugcacagacuguuauucugaagccaauguuuguauuuccauauaaacucuauuucugggagcuucggaaagaagcucuuuggaaagaaacuuguuccgggagccacggaaagaaaauaauuuccguugucuuccuuuuguuggaaaggggggguuacucagaaaggcccaaucuauucugaaauuaccauuuauuuagagccguaacuaaugaauuauuuugagaucuaggaaagucagacuuuguguguguguguguguguguuugugugcauuuguguagagagagacagaagcaguaacucugcugaacagcauuagaaugacauaguguuuuaggguggaggcagcaucucagccaaacuuuuguucaccacacacaucuuuagugacacuuuuggccagucuucaggguguguuccgugggcccuccuccgaggacugcauggcugggacacauggagacaacauaaucaaggaaagagaagaaggaaggacuucggaggcaaacuccauuucaaccagggcugcuucucuuugccuguuuuccuacugaguuucugaauaagcucaaugaaacaaaauuuuaaaaaauuguaaaaucuccuaaggaacuuccuggauguuacaugaagauuuaagaaagaauaguaaauuucuuugagcucuuugaagaacaaaguuauuaaacauucuggcauugaguucucuggaccugacuugagaggaucuuccuuuaauuuaccaaauaguaagaaagauguauuuccagaaaccuguauuucucaacucccuaaaggguaaagccuuucugcaaagggcagagcaaugguaagcugcuucagucuucacuagcccaaacuugaggugacucugcagaagugauacauuuuaccagccuuggaagcuuuguuggcacuaguuugccuucuuggauauuguaaauuuacuggauuuaaccaagugccaccagccucuaaaacagggguccccauccccugggccacagaccgcuaccagucccuggccuguuaggaacagggccgcagagcagguggggagcggugggcaagugagcauuacugccugagcuccgcauccugucagaucaacaguggcauuagauucucauagaagcacaaacccuauugugaacugugcaugcaaaggaucuacguugugcacuccuuaugagaaucuaaugccuaaugaucugagauggaacaauuucauccccaaaccauccucacuacacccuccuguccauggaaaaauugucuccacaaaacaggucccuggugccagaaaguuaggguuugcugcucuagaacagcagaguacguuucauaaucauucgacacaaguguggccaaccuacccuacaacuccaagucuuuccuagugccuuccuagugccacugauuagugcaggaauucaaguuuuaaaaauccuaugguuauccagacaccauaaaaggggcuuucaaaguuucaacauacauguuuguaagccaaaagagcauagggucaaucugguuuauucugcuggcuucuauuaaaauauauaaccauauuucuauaguacuuacagcuaucuuguugagaaaacacagacaccacagucuaaagugguuuuacauauucauuucuguuuaaaauggucugaagaauucagggaaaacuaaauuuagccucuuuacacagaagaauauuaaaacagaaggcucuaaaccagcaagaaaaguauuuuaauuagcauuuauuagaggaggaaaaugauaaguaggaaagagacaaacuuggaagcaagaguugaacaagcucuuucuaaacuccuaugacaacacuuauguagguguaucuuaauuggaaauuuaggauagcagaauuggcaaaucaggacaagaauuaugaacucuuuuuaguggaagagggagaagcaugggacuugaaaggauagcguccuauaaagaucacgcuguggaaagcaaagaaauucacugagaagccaaaauguuaugacuaauauugccucuuacauuugugguaagauaaauucuggcaucaucggcaccugaaaggagaugaaggggauccaagaucagaaaacucugacugccaggguuaaauaagaaaauucauaaaacuaggccaggugcaguggcucacgccuguaaucccagcacuuugggagaccgaggcagguggaucaccugagguugggaguucgaggccagccugaccaauauggagaaaccccgucucuacuaaaaacacaaaguuagccagaccugguggcacaugccuguuaucccagcuacucaggaggcugacacaggagaauugcucgaacccaggagguggagauugcggugagccaagaucgcaccacugcacuccagccugggcaacaagagcaaaacucugucucaaaacaaaaacaaaaaagaaaagaaaauucauacaaccaaauuugauccaagaaagcaggccuaaguaaggugaaaauuauuaauagccaaauuuaaaaugaaggguggcaauaaugugcaccucagcauaccuucacugcaaauugguauuugcuguugauacuaacuuggaaaaaacacugacgugaguucaaucaaaaucuaagucucuagaaaauaaucagguguuugguuucacagccauacaagccccauuuuccauguucaauagccacauguggcugguggcuuccauacuagucaacacagaugggagacauuuucaucauuugcagacaguuccacuggacagugcuguguuagacagaaugguuuucagacauuucagacuacuguaagaauggcaaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaagaauggcaaauauuaguaauacucuuauauaucuucccagcaccaaaaugccuguuagcaucaacuacuauguuuauucuaaaccuuuaucauuccuuuucacuacuaaguaccaguuucaacuauuuucaagcuuaaucaccaaagaaauaaacaaagaaguauuauagaaaauuauaauugaaaccauagagcaagccauccuauaauuaacauauagaaaagugauuugaacuauuccuuuauagagcuuaugugacauuaaauuccagucucaugacuauguugagcgcaacuacaaauauccauaguagacacacugaguagucuaaguucaacaauuacauaaccccugaaauccuuucacguggcuuuggguggugauuuuacaaugucuuuuuuaauuuuuagaaaugcgcacacagacaccaaagucauuugcaugaaccuguuacauaacaaugaaaguagaggcuaggcaggaagaaaacaaguacaguuuguuccucccucucugucucucuccuuuaaaacugagaguucacuguuuccacuuaagaggggaaauucaucaguuucaugaugauacaggugaaggagacuuggagucaacagugggaaaugaugaccucacugucucaugcugucagauucaauaagguguggagagggaggcauccuccauuugugucuguucuuuccagcagucauuacuaggcuggcacugaagcagaaagauaagcagcaugaguauuuaugagcuuuuuggagauacauaugcucaguguuuuccuucugaguuguuaaaauucagguuucacaaaaguaccaugaguucuaccgcuuaaucauucucacaccuuuccuaacuugccaauacuccacuaccauaagcaauuagucuacuucuaucauuuuuauaucacugugaacaauuaaccaaaauggcuagggcaugggacucaagacuuuuauauauuugaauuucaaaaagccaauuagcugcuccccaguaaugcccuuaacccugucaucucaacaauaggugccuuggucacgacaaccacuaggaagauagggaaugauccaggccugugcuuuacaaaaugaacaauggguuauuuagauaacagguuucuuaguacuuuuagacagauguauaccguccgauaugguaaccacuaaccacauguggauauugagcaacagaaauguggcuaguccaacuugaaauguguuggaaaaguagaaaauacacaccaauuacaaagacuccauaagaaaaaaagaauguaaaauaccucauaauauuuuugaacugauuacagguuagaacaacaauauuuuugauauacuuauuucuauaaaauguaaguuaauuucauguuucuuuugcuuuuuuaaaauuaauuaauuaauauuuuauuauuuuuugaguuggggucuugcucugucacccaggcuggagugcaguggcacaaucauggcucacuguaaccuugaacuccugggcccaagcaauccucccaccucagccuacugaguggcugggacuauaggcacgcaccacuaugccuggcuaguauuuuugcaauuuuuuuguggagauagggaucuugcuaugugggucaagcuggucuugaacuccuggccugaagugauccuccaguccuggccucccacagugguaggauuauaggcaugagccacugugccuggcccuuuuugcuuuuuuaaauauagaaauauagcuccaagaaaauguaaaauggcauauguaguccaaacuauauuucuauugacaacacaaauacagaccaggaucacaggcuccaucuguaacauaaaagagcacagaaaaugcagacucaugaaaagcaacccuaaaaaugaucugcuaugaaggcaaacgaauccucuggcaacaaaagcagaagaguagcuggaaauggagaaggcuucauaaauaucucugcuauugagaauggcauaaaggcguagccagcagcuuaaucuauguaauccagcaguaucaaaaagaaaucaaacacagauuuuaaaaucccugccuugucuuuugaacuggcugugggaaaguagcucucacagucugcuagagguuagggcugugacucccacaguacucaaguccucacuuugauuuucucuugaucaaagauggaaccuaauuacugaaaaagcaccaaaggguccucgaaggaauucccucaacgggacacacagugacccagggagauaacaagauaauuuaauacuuguaucagaaguuuucugauuaauauuuagacucccaucuauugagaaauagggaaaaacagggaucaauacauugugugagguaugggagaagcaaugcuuuugucaaguggcaauucaagucauucacagagcuagacaauuugccuguuuauaaaagggaacauccaagcagcucuccauuuccuccuuauuuccuugcucucuauaggcucuuguguucuauaaauaggcaagaaagaaaguuaauuagugucagcuuucucacccaagaagaauuuuaucauugccuccuuuccaaucuuuccaggcucugagauggccauuacucuucuguuacagucuguaaucuacuuuaaauuacugcaguauaaucaaugugauauugugcauauaccaguugguuuacacuuucauguucaggagucaucaaggaaacgugcuauaaaggaggcaagacuaggguggcaaaguaacauucaaucaguaagagccacacuccagaggcagcgacuacaagcccuuuuauuaucucuauaucgaucaagagcagaaacuuugccaauagccaauaaacaucaacauuagauuuuuauuggugaaaguagugguucacuaauuagcaugauagauguaauaaugaaauuucauuaggugauguuuaagauauucaaaguaugugcauggguaaaaauauguuggacauacccccaccacuguauaaacauguaagaauccagccaggccuguuaucauguaucccuuaggcuugaaucccguaccucuuagaaaaauggcgucuguggcuugauaccuaguuggauaugugcccagcauugguuuaggagaauuucugauuuaugaggccaaguagaaggccuggaaucaugccugauaaaugcuguuguuuuugccucaaguaaaccuuuguacaaggcaaggucaacuuaccuggacguauagagagcugagacuuuguggagcucaaggaacacagugugugaacugcuuugugccugcuuugcuaauggcugcuuauuaaauaagcacgugauggaauuuuguuugaaauuuacauguuuuauaaccuaguagccaggugauaagggaguggcuuucucucaccuauaauacuuuaaacuucuuaguugcuaacuaauaaaaucaaucuaaguguuguucaugaccaaacuaguuuagucaguagucaacagccccauuuuucacccugauccaacaagcaagccuucuuucaguccuuuggguguacaguccuuccaacucaagaacacuauauucccucaaaauucuucaccuggucaauucugauucacucuucaggucucggccuaaaucacuggcucucaaacucugcuacauauuagaaucacccagacagcuuucaaaaaucccaaugcccaggccacagccuauacaaauuaaauaauaacaacuggaggugggagcuucaguuuuaaaaagcaauguuuuuaaagauucccuagaugauuucauugugcaccaaaguuugggaaccacugguuucaauguuacuuuuccagcaaagacuucaacaaucacuccagcuaauuuagguuucucugccauuuaugagcuccaucucauagcuuucuguacuuuuucuuauuuuauccuuagcuaugccaucuuuguucugauccucccuaugccuccuagaugguguacccuaugagagccaagaccuagacuguuuuauuaucacagcaucuaagcaucugguacgguaccugggacaggacaauauguauuugugcaaaaugaauggucaauaaauucaauguuuaccuuuucacagauacuuaaucccccaaauuaaaacuagccaacuaaccaaauauuugaguacuaugugaucaguuuucuaacagguacuguggagugacagagaaaaaacuuguaaucucuuuacaagcauaauuaaugcauauguaacauaagagagcuggauaaugcagaauauacaaaaacaaagaccaauaaaauugagugugaggugauaaagaguaauacacauauguggacaucuguccuccuugacuuaaaugagugaaacugagcauggacggucuaauuuauaaaucacguaguacaggcuaucuauccaucccaacucugccuucugucucagccuugaauuucauuacccagcaagucuuccugagcuauaugaaacauuugcauaagucagcagccuuuuguuuaucugagucagaaaaccagauucacucauaaaaugugaaagaaagagcuccauuuugaaaacugucaucuuuacuuaauuuugaucaagcauuugggauaauauuuaaaugauuagccugaugaaucaaagagcugugcuaaaagaaacagauugguuuaugugcucuaaaauauuuacccucuucccauuuuuaucuuccacccaaauccuugacgauauaaacaucuucugggcugucuccacaaacuaccauuccuacauucagcaugaacagacaacuucugagcagaaacccagacugggggcaggggacaagaaacguucuugcuaauuucaaaaagcugucauacaaacaaacagaccaaaagaagcucucaggcacuuuugccuaauaacaaaagcaggugcugcaaauuaagguaguguucacaggccacaucagagacagaguacgcauaaauucuagggagcuccagggugaaaacaggcaugugguaaaaguacuaaugaaggacacacaagauuaguccgaguugcucgagggcagagacagcucuuuuuccaaaugaaaucugaguuaaccacaggacucauccuauuaaagcaaaggacggaauuuguccaagguauuuuugcaauggguaacauuaaaagaguccucaugggugugacugacauuaauuuauuauucuguauuguagcugagcucaccagaguucgggaugaaugagaaaaugaauaaggauucacaguacaguuucgcucccugguccagcucaguccugugccacagaaaguggcugauaacucuuuuccaauaggggcuugaccauaauaauguguuagauguguuuuacauaacaauuuacauuguuauguaauacaauacaccauuugaggaagaauugugucaggauaguaucaauguaugacuuuuugugcacagguaagauuaccuagaauuuauuuuuuucaaaauaaauauucucaaaguuucuaaauccaacuuaaaauauuuuaaaauucucuuuugaaauuuaggaaauauuaacaauugcuuuuagggaaucuuugaucaaugucuggucucauguauuuaaucaaauuccuuaaaauuuuaaacuuauauuuauaaaguuucuuuucaauuuccuuaauugccucaauuguuugaguaaaaacaaauacuaccacauacauaaguaauucuuguaaaugcaacaaauuaaaguacaaacacgguggauccuaaguuaucucaaguuguucaauauuuuugauaaaacauuaaaauuucaacuuaaaaacccaacucugaauaaaauagucaauuauccauuuuaauguaaucacaguguucaaugaaaauacucauacauuaaaaugccauauacauccagauuuauuaauacaaaagcauuuaauauuauggggugauucucuuaaacacuguacauuuaauuuuaagucuuauagaaacuacugaaucaccugaaacaauuuuguggucaugcugacaagcaaauguucaaccacugggagugguugaguaucaacugcagguuuuagccuagagguaaguucugagauugcaagagauccaagguaauuuuucucaccaccaucaucaacacaccaaagaaacccuguuugacagucauuaaaccaacaugggucuacagacuuugccuggucuugcagcacacauggcuagauuaaagccguaucuuuguuuaauuuuccucuauuggcagaauuuugcaacccacaugaagcuuugagcuaacauccuucauugcuucaguuguauuaauucaaauuuauuugaguuucauagauaauuaauuucuccauuggauuccaaggguucccugcccauuuaaaaaaaauucuguacugaccaaguaauuaaugauuuuccuaaucucuccaauccuuuuauagauacucugccugagaaagaacucccagggcagagucugauucuuccagaccaagcccuucugaguacccccaccuucuggccauacugcaguuugaaguucaccuugaugcaggcuaaggcauuugucugcagcaaguaaguuuuccauuuuccagacuuuuagccacaaacaucuucacuaacuauucuugauccuucccagguaagugccaaaugggacaugggccaaacaucuuagaaauugaaaacuggaagaauuaggucaugucaucaaaacuugcuauuugcuaaggaaaaugacuuagaaaugcuuuagaagauaucugccuguaauggaaaaaauaucugagccauaaauaggaguuaaauguaaugaacuaugaaagugaugcucuacuaccuaauaaauauuuuuuaaaaggguguuccacuuuaauauuaacugagccauucauauacaaguacacagaacauauaccuuugcacauaauuuuuaacaaugaauuuaugaccugucaacuuuuuucuucaagaaccacguuauaaaaguugacucauuuaauuagccaucaauaaauauauaaaaaacaauuuuagagucagauaaacaguaguggauuaucuuggaaagaaacgggaguuuuccuucugagaaugaauggaagguggcagacgcugucugggacacaguguucaacgcuucccuuuccuucugcauaacagcguaaccaaaauggaugccagagacuacuuacucaucuuuguaccugacauggucuaaagcaggauguuuauacucagcuaucucaaaucccuuuugaaauacaguggaaauaaaauaaguaaauacaacauauaugcauuccccaaagugucaaaaacuauugaauaaguuacucaauuuugcuaagaaauagcugaguuuaauguaaauuuauuaauaagucagacauaaauugaaauugcuauuugauuuauggaaauaucuuggcuaacuuguagacuaaacuuaacugcccuaaugcaggcagaagucuuuccccagauuaucagaccagaaggccagggaauuauuccauaguaaugaagauaucuuuucauccccaaauugaaaacaauguuagaaaguuccugguauaaucacuuuaauuaagugcaauucauuugauccuuacacagaucuuccaggauuacugcuuacauauagacaauuauaaauauccagagacuucccaguucuuauuacaggaaacuaaaaugacuuaauaaacaaugcauucucccauaauuugggccgauucuauuuucauuauagugcuuuccuauauuuuguaccaaacaaaaaacaaacacuuauuccuuauuguugaacugcuauggcuugagccuuugaaaauaaaagucagguucaaauauaagcggaccauggaaaacagccgaugccuucugucacaaugacacucugccugucaacauccaaaacagaaagcagauccaguuuggagcuuccagcagcaugaccagaaauguaauuuagaacaaaauuuguaauaguaauagaaggaaugagagguuuguguuguuauuauuauucuuuaauugacuauauuggucaucuaagaaaguaaaaacuccuuuuuuggcuuuuuccaacccaaagccaccugaauguuuuguaaagagccaucacaauaaucaaaguagugguccauuugugcaggauagugggaaaguagcuuagugcacuuuaagauaugaggaauuuguagcguuaagcagguaacuuugacaucaccuaaaucuaugcgccaaaugccuuuuguuucauauuucuaaaugaauuuuuccuucaagacauucccugagucaucagaccuagcucaaauugaaauguacugccagacgcgguggcucacaucuguaaucccagcacuuugggaggcugaggugggcggaucacuugaggucaggaguucuagacuacccuggccaacauggugaaaccccgucucuacuaaaaauacaaagauuagccgggcguggugaugcaugccuguaaucccagcuacucaggaggcugaggcaggagaaucgcuugaaccugggagguggagguugcagugagcugggauugcaccacugcacuccagccugggcaacggagugagacuccaucucaaaaacaaaaaaaacaaaaaaacaaaaaaaacauuugaaauguacugagauacuacgcaugaccaccacugauaggcauuauuuguugucacaguguucucaucccugaaggguuucagggacuuauaugucucugggccaagcuguacuuauugauucaaaugccugccuuccacaguacacaaauuugacaugacaguucaauauaugcacuuacuucuuauguuuccuaaaguaaccauugaauuauuuggguaaaacuuaccagaaugucuucagguaacaguaauuacaaaugucauuugguuagggaagauauaaugugagacaggaaaggaaaggaagaaagaaaaggaaaagaaacaauuccaaaauaaauuguucuguaacaauagcuuccuuuuagcucagucaucuagaaaaagaauaauucaauagcauucaaugcuauucaacaauauggcaagaucucuaagccaacuucuacagaguuuaucauuuuuguuacagaagcaauaaucuuuuguuggaucaugcccagcacaaaaucccagacaaauguuuaaaaggggagcuuucacuuaauauaaaaacucuuaaaagacuuaccuagccucugcaacucauuuguaaaucauguguuaaaauugucuaccuaccuucauuauacaucagauuuuggauaacaaagauaucaucugaagaaaaaauuugcuaguggugauuugaaagaaaaaaagaaaccuaagacacaaaaacucuuucacaacaguucaaaaaucuugaggccaaauuuaugcauucauuuggcuuucagcaggcaacugcuuuguccucagcaguauuaugcaagcuuacuuaagaaugcagaagagcucagagagcugaaaauucuauucccauugccauggugaaaaccacaaugaaugaagauagcagcccccaagcacaaguaggguggucuccaguauccccauggaacaccaccacuaaacuugaaaacaauguuauuacacaacuuagaagugaacucuccaucuaggaucuaaacacauacuucaaauaucauuucagagaaacagauccucuuucuccccaucccaccaacaaugacaaaaccaacaaaagacagucacgaaaaacaggaauuuuugaguauccaaaaaaaauguaugaauaacauucacaacagauauuucucauguucuggagaaaugcagcuccuuauugcacaauccaggaguauuuuguacaaaaccucccagaggacacccccacugagaugaucaaucagcccacaguggcuucaggaugcuuuucaaaagucaagucuuugaagaauguuaacauuucacuacuuccuuuuccgaagguuauugaaucaagaagucauuguccccuaucaaucuuugcagggaaaaagagaaaucuacaacuuccugaucacacaacugcuuggcuuacggacaacauuccauauuucaagcaauuauuacauauuaaaccauuguauuauaaauaagcgguuuauuauaggggagccuuccuuagugacaaucucugucagagggauauuuaaauaaaaggcuaaauuuaccuuuuauaauauuuugcugccuauaauaaacacaugucugcacggguaguaugauauguaugcgugaauaaccuguuuauuccugggggcagugaguugcucuauguacgaauaugcacaucaacuguaguugcuaauauuucaucaaaaggccacacuccaggguggcugcuacagaucugcuuuccuuauuuuuauguccacaccaaccugagaaguuuuucuaauuggcaaaacggguauaagagguggggguuuuuguuaguaaaauuauuggugcucaauauauguggauuuggauagaaucuaaagacauucuucccuuuuauguguaacacuagaauaauccagggagcuaaggaggugagccacuuuuuggaagugaggugcuuuuugaaaugguugcugaacuugauuccaaaauagugguauauccaagcaugauucacaggacuucgguugccuuauuccuucucuaagcuuaaccaaguccugcccuuauaauaguguuguguuuaucucacgaggacccuuucauaucagcugugauugaagcaccuacagggacagagaccugggacuuucaugagcuucagaaaaggcgcuaugauuacuggggccugauugcuaugacauaucugugugggaauguuaugaguaugcuucuguauuugcaauggaauugucgggaaguagaacuauagcccuugccuaccucuaaauaaugacaagcacugccagcuauuuacaaaauucaauuucuccuucugaggcacauacuuaaacuguauuucccagugucucuucagugggauguggccauuaagugaaaucuagcuaaggaauaugggaguaagugaugugugcuguuucucaucauggcuuuuaagaaguagauggauacagcuucccauacucucuuucacuucugugggacauaaguauuagaagagacuuaggggaugguauaccuaucaauagaaccuggauucuugaaucaucauauggaagcugacugguaauaucuacuugggcuguaaugugagcuagaaauaaacuuuuaccguguuucaaccguuauacauuuuuaggucuauuuauuaccauggucccaccuaccuaacugaaucaggagacuaucgauacuuacaagaaauaaucuaguaauuguuuaugaccagacugauuuagaacacuuugaaaauauucaacuauaaaugaucagugcacuuuauuugaagaacauuugagaaaaaaauuguauuggggaauuagcagacagaaauuuuaccaagcaauuuuagauuuuuacauaugacuuuugacugaccacuacuucuaagucuuucuaauuuuuuucuuuucuuuuucucauucaggaaucacagcaggaaucuuaauuauacuaccaugccuaaaaauagcagcuagcaauucuugagaacuaacuauguuuugggaacuguccucagagcuuucuggcgauugauuaauuucacaacauuaagaggcagaugccacaauuguucccauuuuauaaagaagaaacugaaguacagagagacuacuuccccaaauuuauacaaauuguaggccaggugcaguggcucacgccuguaaucccagcacuuugggaggccaaggcggguggaucacgaggucaggaauucaagaccagccuggccaagauugugaaacccugucccuacuaaaaauuaaaaaauuagccaggugugguggcgggcuccuguaaucccagcuacucgggaggcugaggcagagaacugcucgaacccgggaggcggagguugcagugagccgagauugcaccauugcacuccagccuggucaacagagcaauacucccgucucaaaaaaaaaaaaagaaaaaaauuguaaauggcagcaagggaaccugaacccaugucuagcaccaguaggcacucucuuaacaucuucacuauauuacaccugccuucugcagauaucacaguagauucaaagaugaacgagcccuaacucuaccccaaggaguuuauaaaauuagacauaauacaaaguaguacaauauaugcaucgcuaagugaaauacaacauauuguggacuuucaaaagagggagagaugauaucuaaucaaagaaaucuggaauauuuaacgaaggaaaaauagcauuuguuauucauuuuaauccaauuuaacauacuuguauuaugcaauauuuuaugccaauucuucagagccuguggucaaauaauaacuaugaaauguauccacauugauauguacucaggaaaauauccuaaucuuuaaaguaggaaaauaagauuaaaauauucguaaauuauguucuuauuuaaaugucaaacccgaaacuacucaggauuuuuuuuuuuuuuuuuuaggaauuggggguagggggggugggucucacuauguugcccaggcuggccucaaccucucugcucaagagauccuccugccucaaccuccuguguaucugggacuacaggcgugugucaucacaaccgacuaguuuuuuuuuuuuuuuucuuuaaguaaguuuuaaaugaauuuuucuguuguguugcugucuuuaauaagugaacauauguuugcauuugcacaaguguauuaaacucuaacaugcauauugacaaguguacauauaaggucagagcucaaggaauuuucauaagcugaagacaccauguaaacuuuacaaacauuaaaaagaaucaaccagcaccccaguagccuuccuucuauuccuuuuuaaucaccaccccuucccaaggguuauccuaccuccugacaaaauagauugguuuugccucucuuuguacuuaaauaaauggaaucauaaauuauggacucuuuugcuauggcuucuuugacucaaauuuauguuuacgagacucauccauagugaugaguauaauuagaauugguuuauuuucauugcugcauagcauuucauuaugugaauauaccacaauuuauccacucuacuguucauaggcauuuggacaauuuccaguguuugauugcucaaaaaaauaauucugggaacauucucauaugccguuucauucacauaucuauacauuuuuguauggacuauauggaggggugaaauugccagaucacaggguauaaaagcauuuagaaagauauuaccuauuuggaaaucaagcucaauaaauaauguuaugaguuaguaguagcacaaaccaaaugagaaaugcuuaauaaaauaagcauuagcugugagaauaugugucaacauucacacaacaucuuccuaauuccaucuuccaucuuccucuuuccaguaucagauuuuagccacaguucauuagaagcuuaucuugucauuuuucaggaaauuuauuuuauaauaccacauuaugcuucagggcauguguuucaggacaacugagggagucuucaugguggauuugggcuggaguugagguagagcaagggccccugcauuugguguuaucagucuucugggacuuucuugggguacuguuuucacuucuucuucuuauuucuaguuuaguaaauuucacauauaaugcuucaagcugcugugggcuuauuuuuuuugccauuuguguuaaaacaugcuaugaaauucuugcuuacaaaacuuggauagaaggcaugauaacaccaauuauuugucuuaucucugcccaaccaccuaaaugauauaauuacuggcaacugagguuuuuuccuaugccuguuggcauuuagaccccuaagaguauuauacaggcuaggguaaauuaaccugagagaaaauagcaugguaacuuauuucaaaacacaaaucauuuuuacuagaaccaggccaaaucaaugucuuugagaagcuacagggucuugagucaaauuacuggggguggacaugguacuuuuuccuaaacacacaaugaaaaggaucacucugauuauaaagucugaguuucccuuucuaacccgucuguggcacaugaccaguuuauuugguggaaaacacauuccucagaccccaggacaggccaacuuguccuaguuuaacuugugcugugcuuuuuuguaauagcaaccuaagacggaaacaucuggaaaaauaccaugacugagcuggugggaucaaagaccaaagugaaaugcucuauuguuaauuuccaggaacugacacagaacgcagagugaaauaacucagcugggcaugaaucccguuggauuucugaaaagcuugcauacuacuauauugccucagccgauaacugaaggaaaaguaguucagcaaaguugaggaaaaacaaauuuuugugcauguguaugcacaugcauguguaugcauacgcacauguggaagaacucaggucuguguucaacauguuaauaguguauuccucugcuggcaaagacagcuugccauaaaaauacugaaaaaaaaaaaaacaaaaaacaaaagcaagcugaagaaacacuuaaguccuucaugaauugaaauuaagaacugugcuugcaaagaagcaucccggugccccaccagacugaacuccagggggcaguggcuuucuggcauaucuuugcuccccuuggcagcuggggcagugucuggcucauaguuuugcaguaaccgaagguguacuggaugaaggauuaauaaaugcauaaaugaaugggagaauaaauacaacaagcagcaaagcuucauagucucagugcugaauucaaagugagaagucuaaaccuugacacuuuucaagccuuucucauuugcagccaguuugccuccuugaacuuuguucaauacauuacgaagaaagaaagaaaacaauacuuaccuaccuugaguagacauuugaugcuuagauauuugcagaaucaggacuagaaagguccuucagacaucaccccuagauucucuguccauagcaaguguauaaugacagaauggaugugaaaugaagaaauguccaagaaaugagauuaugcagucuccuuggguaacgacugaaguuagaguacugagcaaauguaaauugcaacagaaaugguaaagaaaauuaauaugaacugacgucuuugaugagaguaagaguaguaagacuauguggggaaaaauaaucugaacaauuugaaucagguucuauugacucaaugaucaagcccuagaauauaaacccaaggagggcugauauguuuaucuguuuuguucauuaauguaucccaaggguugagaacaaugccagacauauuacagaugcuuagcacauguuuguugaaugaaugaaccuuaauauguuaaaaaaaaaaaagaggaggcaugaaacuccauuauauuaggccaauucauucuccaguucauuuacucuauguuuuccccaacuguggugccacacaaugauacuuuugaucauacaguuuaaaggacaaaaagguagagaauaaaaugccuuuucccuuccccuaccuugagcuccuuuuccauacaaccucugaauauuugggcaauaaagucaaaagucugcagcuggagaacagugguaucaguuucauguacuuaaugugugaaugcaguauguaauugcaagagaaaagagaaagugcuagcuuucucucuuuuacaguuugugugaacauaaaucaaauacaggaaaguuauaaagucauugugcaguuuuuuaaacauuuauaauucugaugucagaggugguagaaaaaauuuguaaauggcaugcaaaucaaauuuuccuccuaaaguuguuaaaaccugaguucugcuagucccagcaccuauuuuuaucuucuugucuaccauaggcauaugaacauuugucacagguacuugaauaaugaauacaucuuguacaaucacauaaggguuuucuucuuaaacaugaacauguuuuuguuuuaaaaugucaucugcagauuucuucuagccugccgauacauuuagguuauuccaaguuuagaagagcccgaagguguagggagacuccucuuaacuccaggaagaaacaaaggugggauaggccaaguugcuuuuauuacacuucuuaccaguguccagugucuuuucucuucuuuggaaucauccugccuuauucauaucccucuugaaacaggacaggacuggacucuaccaaaaagacuaacuacccaagcuuuuucccaaaggcacuguugguuaacagacauguugcagaagaaucugugugaagcccucaacugcucugacuugggugcccccagaggcuaaauuaggucacaccagcugcauaauauuaaauggggcaggggcggccggagcaacgcugugagaagcugacauuccucaaagcaugaauuggaagccaaagugguaguuuuuguuuugccuuuugaaaauacaucuuucuauuucccucugucauuuaacuaacagcuccucuaacuuuccacccgcucaaaaggcaaaagagacggagggaaggagucacaucaaggaccaauuuuccuuaagcaaaauucuuccuuguuagccauucugcaaaaauucauuagcugaauuaaccauucuccacggaccucaucuuuauuccucucuucuuuccccuccccgcuucuuuuuaaccuuucagcacagaauuaagucuuugugauauucagcacaucaaugaacucacccagccaggcggagcuccugggccggggcaggggcgacuuugugggcugcauuccaauugacugggguggugacaaggagacccagccccagccaucaaaugggcccugugucugaguaugauucauaacacaaacauguuuagaaagcgaaagaaaggaagaaaggagcaugggauuugaagucauugagucaguauuguugcaagauuuagagcauuauguggggagagaaagaguguuagucuuguguccuagcacccaauccacagacagaucugcaucaaaacaaggcauuucacaucuucuaagauaagcccaaauuaaaacaaaaccaaacaaaccccacaucuacucuucccacuccaccaucccacucccacccuguccugguaaaauaaaugaaugcaugaaauaaacaaguaaguccuggucaaucuuacuuacauauuuuaucuuaugaauacuguaguaugccaaauuagcugcuaauucuuuacaugggauuugaaaaaaaugcugcagggauuuuuaaauauucaaugaacuuaaagaacaaauggaauauaauagauucaaaaugaaaugauugccuagaaguaugcucugauuccuaaaauaagauuuuuuuuuaaaggguaaaguuuuuuuggucuuuuuuuuuuuuuuuuuuuccagaaugccauauaacuaaaaucugaguaaaaggaauuggccaugucuaacuuuucucuuacucccuuauuuuuaacagacuuauguacauuuuauccagaaaucuccuaacaaugcaaguagcgucugggggaaguaaaagcugcauauuaaaaguaggguggaagagaaugucagcuugaaugugugcagccccuaaagauuaucauccacuuuaaaugauaaagaucggcaaggccccucauuaaagcagaauuccuugaagcucccaauagcgguugugcauuuucuucauuuauaaaauacaauaucugauucagucacagaaaccucacaauauugucuuaucuuugacaaaauuaaacagcuuugccuuuccuaucuucuacucuaguaaucuuuggcauuaacaugaaauuucugcugugaccaaacagccuugccgacuuuacagcauguaaagaaucccauucauccugagcugccugggagauaaaggugggaaauggguguaauguuuagugauacacaaauauugcugcccaaugaucagaauacagauuccacagauucaccuuccuuaaacguuucaguaauguuuuccuuauuuuauuuuauaauauuuauuuuuuaagaaaugguuagggcauggauuuagcuucccaauuaguaaguaggugaaucagucuacauuucaaaugugggcuguaccaguccaucuacuuagcuucuggagacagcuucaacaaaacccagaacaggcugcacucccuuuuguccugaccccaaucuugcuuaugaaagagaacacuuuuagaugugaaaaaaauggcaaauaaugaguuguuucucuacucuggacuucuugugaaauacaacuacaauuccuucaucucucccuagucccuaaguuuaagcugaugucacuaaugugaucacagugcucuaaaguuacaguguuuuaccuaucauugaacaaagaaaaagagaaacauuuccagccagcuuuggaugaaaugguuucaaaacauauuugguauucccauccucuucucuggauaaguaaggaaacaaaaagugaaaagcuuuauaaccaauaaaugucucauucauuauaugugaaauaagaguugaauuagucuucugaaaugaaucaaaauguuuuagcuuuuacuaaaguuguaauauuccuaauugagcaaaguaguuuaaguucaugauucuuucuaaaucuuauuuuuuuaaagguuuuaaucauuucagaaaugaaggacagaugaagaaauuuuuuuaaaaaauuuaaucauuucgaguuguauaaauauuaggcccauauagauuuuuaacaaucauauucuccugcuugcaaagaguucauaaguuauuuuucuaucuuuuccugagagucuuucccuaagguaaaccucaccaauauagguuaugauugacuaaauuuuuuuuagaaauauauuuaaaaauccaaguacuuuuuauaacucuuaauaagauacauauuucuuuuacagaaguaaaaaugucgagaauaaugauuuucaauaaagugaacaaagcacaaagcgcuuuuauagaaaaugcacagccuaacagccuguguguuccuagaaggucuggaucaccagcuguguuugcaccugcuuagcugccccuggccuuuacgcuaacaggcaagccuccuucaaaucaggcuaucuggagucuguauucacucuucucccacagcucuuuuccuaauugaggcacaucacacucucagaaauaaggcuuauuuuccaaagacuuuggagugucugaagauuaaggucuggguuacuauauaauccucaacuuacagaguacgccuuugcccaucaaaauguaauccauaccucaauuugaaccucuuuagguagguuugguuaauggaucauucauccuuugugucuucuuucuguaaguagcaaugaauguugccagcaucaugggggagaaauaguaagacaagcacuuaaaagaacuguucuaaaagaagcaaacaggagagugcuuaccagccagaaacugggaacaaccacaccgguuuccuuaauguaucaaaaugacaagauuuuuaaaauacaugaguauaacccaagacucccuuccagaacugauuuguagauacugaaggaagugggguuugugacguuugaguagggaaauuaauaucucaagacuuucaguagggaagaaggaggugaacuuggucaaaaguuagaaaacuuucaagaggcuguuugaaaaguguaaauaauuuuauuuucacuuuccuuccuuguaagagauacuugagggauaugaauuuggugagagacaggaaaagaagacccucaugguaugcugucgcaaacaacaacaguagcaagauaaaaacuguuauaaguucuauagauuguauuugcccagaaguuucucaauuuguaccagaaguccugaaguuacguguccuggaaagaacuuccuucauauaguuccguucuuauagacagcaauaucauaucuuuagguucugaaucuguguuuuuccccccccucaaaacuaggaaauacuuugguaacagaauugaaaaggaguugugcuuuaucauuucuguuuugccaggaaggcauucuuauuccuagugguagcaauauccaauaucugucuaucagauaacaacaacaacaaaaaaaacuaaaucacaagugugaaugcccguuuacucuccuguuauauccccuaaaagaaagccuucccaucauggagaaaaggcaaaagauugaaaguaaaacuccaaaauucaccaaagugaugcucagguaucauauuugcuuauugguuuaaaauucuucaaugauaaaaauguuugcuuuaaacuuuucauaaaauauaaccaauaauuuaaaaauuucucagagauauuacuaaauguugaauucuacaacuugaagucuuagguucauaacacaacaaacacacacauacugugaugaaauagauuccagcauuaugacugauccugcauauugaaauaauaaaaaaauuaaaaaaaauucucauugucauuuaggagauuucacuggguggaugacagucuacuguuccacuuuuugguuuacaagguaugaaaucagauguuucaugauaaaaauuaucaucauuuccaauugaauauucaaauggcaagaucccacauuaacggguggacaaguucaagguuccaaguucauucccacugguaaacaguggagaaauuaauggggacuauuuuggaaauucacagcugucaucuguuucuacuuccccaaagcaguccaauaaaaggauauuggggagaggauggaaaaggcugaaaaaugguuucagacugucacauuaauaauuugaagguuggcuauaugaaaaaaucuuuuuauaugacauauuugaauucuguuccuuuaccuggagaaaugcacaccuacaaaaccaaugugaggaaucuguacacucauaaagaauggucagguagacuaguugucuuaauacuuggcuagcccaguaacacaaagaaugaggcaaucauaaacaauugguuuggguuuuuuauuguugcuaccauuacuauuauuacuaaugauuaagucuucaggagaugaucauaucucaugcccuuuuuagcagauuuuguuauuucauuguauugcauuuaaacauccaauuguucuagccuuauuuguuaaucacaggucaauaaccugggagcaaguaccaggaaaugacaaguuaugagagaagcugugcugcuaucauaaucuucuauguaaguggcagcagacuauaugguauguucuaauguuagguauaaugaauucuaaaauaauuaugcuggugcaguuaacgucaagaagaaaacacaggccgggagcaguggcucacgccuguaaucccagcacuuuggcggaucaucugaugucaggaguuugagaucagccugaccaacauggagaaaccucaucucuacuaaaaauacaaacaauuagccaggcaugguggcacaugccuguaaucucagcuacucaggaggcuaagacaggagaauugcuugaaccuaggaggcggcaguugcagugagcugagauggugccauugcauuccauccugggcaacaagagcgaaacuccaacucaaaaaaaaaaaaaaaaaagaagaagaagaagaagaaaacacaaugcgcaacagcuacaaauuccuuauaaaaauacacucuuuuaucuggaaaguucucaugacaacuccuuuccuucagcaguuuauuuuggguuaggagccucauuuguguggcuuguaaggaagacaaguguauuaguccauucucaugcugcuaauaaagacauaccuaagacuggauaauauauaaagguaagagguuuaauuaacucacaguuccaugggacuggggaggccucaggaaacuuacaaucauggcggaaggggaagcaaacacguccuucuucacauggcagcagcaaggaaaagugcagagcaaaagggaaaaaagccccuuaaaaaaccaucagaucucaugagaacucacucacuaucacgagaacagcaugaggguaacagccccauguuuaaauuauaauagcuccaaccaggugccucccaugacauguggggauuacagggaacuacaauucaagaugagauugggguggggacacagccaaaccacaucaccaagaaucaaagaaaggaugcuacuuguguauaauucucaacaaaucucuuguaguacucagauuaucuaagacauuacacaaagauuuacuugguuagaauaucaacaacacuucuaugugccaaauggcuuuaguuaaaucuugcuucaggaguauuugaagcauauauuuuucaacuacauaaugcaauaaaucuaaaggaucugacaggaggaauacaggauguuucgcaaugcacaaaggcaaagcaucacacucagcuuggggaaagaaaggcuucuuuuuuuuuuuauuuuuugagaugaagugucacucuuguugcccaggcuggaacacagugguacacccuuggcucacugcaaccuccaucucuuggguucaugcgauucuccugccucaccuuccugaguagcugggauuacaggcaccuaccaccauggcuggcuaauuuuucucagggaacauaaugcaaaagcugacacacaaaggauacaugagaaucaugugaggugaggaaaagugaucccaggcauaggaaucaauaucugugacaaagaccugaaagaauuucaauguagaaagagucaagcaugagaaaggaaacagagcaagugagauaaaguagugccagggcacacuggaccucacauaagucauguggaguugucuggaugcuuuuaucaaagcaacauggaauuggggaaggauccucugcaguacugugacaugcuuauauuuuaacaugcucacucugguuagaauuggauuagaaguaggagaaauucgacccaguaaaaccaauugagaaacugcaacaguacagcaggugagggaugggaguggcaggagcuacaguaaaggcaaggggaaggaagaagguaaaaucucuguauugaacuccuaugagccagcauauguauuauuuauauuauauaugauacacaacacauauuauauauuuuuaaagagcacauacaaaauaguuauagaaaauuaucguuuuuccuaaaguagcucaugcauuaaaaugaaaguguaacccaaauacugugaaagugaauaauacaaaagguuuuaaaauaauuugaccuuagaucuggaaagucaaugaaaauuagaaguagauuuccaucuuagggucugaaucacacaauaaaggaauaaaggaaucacacaauaaaggaauaaaggaaucacacaauaaaggaauaaaguuguaagaaagcuuaaauaaaugaaaacugugaaaaaugagaaacaccagguagguaugaauagguuauugaauaaagcugucagcaacugcgccaggagcucagccucguaugguugauaaugugggcuaugaaggaaacaucccuauugugugaaugugaaguagaagggcacccgaguaaaggaaauugcaaaguggagcuacagaaaaauuuaucaccuguuuaugugccaguccacagucacauaaacagguaguaagauaacauccaauuuaauauuacggggauuguuacaaagugaaaaaaaugguacugcaauuuuucaaaaugaggaaaauguacugguauaauuucagagaucuggaaucucuguggcuaucauaucucauuucuguaauauauuaaugugaaaauuagagagagggcacugcacauuucuagacuauuucccagaagucuuaaaaguaauagggcaaagaaucguagcauuauuugaguacuaaaguuacaguuuuauuuuguacucuuaaauuguuuuagacauuuucauuagguacaagcaacauauaauaaaugccacguauuugaaagguacaaucugauaagguuaggcauauguauacccaggaagccauggccacaaugaagauaaugaacauaucuaucacuccccaaagguucccauuuguaacccucccuuccaccccugccagcacuucucccuccaauccacaggcaacuauggauugcuuucaaucauaacagguuaguuuguauucucuggaguuuagagaauauaaaugaaauaauacauauguacucuucaucuggcuucuuucacucagcauaaugauuuugagagucacccuaauugagcauauuaucaauaguucauucaucuuuauuguaacaguccauugcauagguauaucacaauuugcuuauccauucaccuguugauaaugucuguguucuuuccagugcuugacuauugcaaacaaagcugcuauaaacauuuguauacaagucuauguauauauggacauauauuuccuuuucuuaugggauaauaccuaggaguggaaugguugagccauacaguaaguguuuaacuuuugaagucacugccaaacugcauuagcaguuuaugagaacuccaguucauccucgcccauauuuuguaugguuuuccuuucuaauuuuagcaauucuaauacgugugaagugguaguguauugugguuuuugauuugcauuucccuaauaucuaaugauguggagcaucuuauaugcuuauuugcuguccauauauuguuuuugaugaaguguccaaaucuuuuucccauuuuugcuaauggauuauuuuauuaugaaguuuugagaguucuuuauauauucugacgcaaguccuuuaucaacauacaauaugcuaauauuuucucuucaucuguaaccugucuuuucauucuccuuuuuaaaaaaaauaugagacaugguuucacuaugcugcccaggcuggucucaaacuccugcccucaagugacccuucagccuuaguguucagaguagcugggauucuagguucaagcuaccauggcccacugucuuuucauucuguuaauagucuuuuuuaagauggugguaaaaaauauauaucauaaaauuugcuauuuucacuauuuuuauguguacaagugaauggcauuaaauagauuugcaauauuacgugaccauuaccacuauuuccaaaacuuuuucaucaccucaaacagaaauucuguaaccaucaagcaauaacucccuauucuccauucccuccagcuccugguaagcucuaauuuacuuucuuuucuuuuuuucuuuuucuuuuuuuuuuuuugagauggaguuucacucuuguugcccaggcuggagugcaauggcaccaucucggcucacuacaaccuccaccucccggguucaagcgauucuccugccucagccucccgaguagcagggauuacaggcaugugccaccacgcuuggcuaauuuuguacuuuuaguagaggugggguuucuucauguuggucaggcuggucucgaacucccgaccucaggugauccacccaccucggccuuccaaagugcggggauuaaaggugugagccaucgcgccuggccuaauuuacuuuauuuucuauaaauuugccuauucuaaauauuucagguaugugaaauuauacaguauuuaaccuuuugcuucuggcuuauuucacuuagaauaacauuuucaagguucacccacggugcaccacauauuaaaacuucaaucuuucuuauggcugaauaauauucuauuguacguacauaaaauaguuugcuuacccuuagaaauauuuuagugaagauaauguuuuaauuuuauuaucuccaguuuauccaucuguucuuuuauugauugagcauuugguaucguaucuaagaaauacuugacuaacugaaggucacaaagauuuucucccauguuugcuuauauauuuuuauaauuuuagguuuuacauuuagguauugaccaauuuuggguuaauuuuuguauaugcugugagauauggaucaaauuucauuuuguugcauuuaaacauccaauuguucuagcuuuauuuauuuaaaaaaauauucuuucuccacugaauugccuuaauugccuuugcaucuuuguaaaaaaaaaaaaaagcuugcccuauaugugcuuguugauaauauauuaaaauagaaauacuuuuuauuugaagugauuuuguauccugaaguuugcuaaauucaucuauuaguucaagaagcuucuuugaggagucccucuuguuuccuauacggacgaacauggcaucugagaauaaaaauaguuugccuuucuaaucuggguuugucuucuuucuuuuccuugcuuuauuccagugauuacaaucuccaguucaauguuuaaugaaagauagagaggacaucuggccuuguuccugaucauuggagaaaacauucagucuuucaccauaaaaaucauguuaacuauagguuuuucauauguguccuuuauugagcuguggaaguucccaucuauuccuaguuugcuaagaguuuuuaucaguuauagcuguuggauuuuguaaaauguucuuauugcaucuauugaaaugaccagaugauuuaauuuuuaaacuucuaaaaacacugucauuuaaauugauuuuuuuucaauguuaaaugagcccugcauuacugggauacauuccaccucaucaucaauauguaaaaaaauuuuuuuacacauuauuggauaugacuugcuaaaaaguguaacgaaauuuggcacuaggguucaugagugauacugauuuguaggcuucggauaugcuucagaucuauguccccacccaaaucucguguugaauuguaauccccaguguuggagguagggccugguggaagaugacuggaucacagggguggguccuucaugaaugguuagcaccgucaucuuaguuaauuugauagaguuaucaagagaacugguuguuuaaaaauguguagcaccuucccgcucucucuuccuccuacuccagccaugugaagugcuggcuccccgcuucaccuugagccaugauuguaaguuuccugaggccuccucagaagcaaagcagaugcuaggauugcgcuuccuguccagccucuuuggaacuguuuacuuggcucauuggaacuauaagccaauuaaagcucuuuucuuuauaaauuacccagucucagguauuucuuucuagcaguaugagaaugaacuaacacagcuucauuucuugaaugucuuugucuggccuuauacauaaugcuggccuuauaaaaugaauugagaaguauucucuccuauucaauuuucugcaagagauuuguagaauuaauauuacuuuuucuuaaaaguuucauagaauucaucaggaaagucaacuggacaugaagcuucuuauagagaagguauuuuacuacaaauugauuuuuaaaauagauauagaauuacugauauuuucuguuuccuuuuguuguuuguguuuuucaaggaauuuuccacaucaucuaaguugucaaauguauugguaugcagugauuuauaaucuucccguauuaucauuguaaucuauagcaucuuuagugauaucaccuuccucauuccugauauuuauaauuuguaucuuuucuacucuucuuuuucuucaucaaccuggauagagcuuuauuauuuuuaucaaucuucucaacaaacaagcuuuugguuucaucaauuuucucuauuguuuuuccuguuucuauuucauugauuucuauugugacauuuauuuccuuuacuuugaauuucucuuucuuguuuuuaaagugcaaguugauuugagacacuucuauucuaauggagcaauacucuuuuagacugaauuucccucuaaauauugcucuagcagcaucucacaaauuuugauguauuucucuuuauuuucauuccauucaaaauacuuucuaauuucccuuuugacuucuuugacuuacgggcuauuuagaaaugucuuauuucauuuccaaauaaugcaguacuuuucagauaucuuuauaauacuuacuucuaaguuaauuccauuguggucagacaacaugacuugaaucuucuaaaauuuacugagacuuguuuuaucauacauauuccucuugcacuugaaaaaauguguauucugcuguuguuugggagauuacugugcaaaugucaauuagaucaaguugacaguguuguucaagucgugcauauccuuacuguuuuuuuuuucuauuguucuaucaauucucaagagaggaauaucaaaaucucugacuauaauuguggauuucucuauuuuuccuugcaguuuuauuaauuuuugucucauguauuuugaagcucuauaaauagguacauauucaggauuauaagguauccugaugaauugacccaucuaucuuuacaaaaucuuccugauaacaaucuauuuugucagcuauuaauauagccacuccagccuucucuugauuaguguuagcaugguauaucuuuuuccauccuucuauuuuuacccuauuugugucuuuaaauuuaaagugcauuucuuauaggcaacauauaguuaggucuuacauuuuuauacaaucugacaaucuuugccuguauuucuauuuaaugugauuacugauauugauuuuucaauaucaauauauugaccauuuauauuuaaugugauuauugcuacuauuuuuucuaauccucuuuaugaaaaaaacucuaaaaagaauuauauacacucacagucuccaaauccucuucucccauucuacuuugaaccuguuuaagucugguuuccauuccuacuauucuauugaaacaagucuuugucaaggccacugacuuccucuaucuugcuaaauccaaagguaaauucucaauuuucauuaaacuugaccucucugcagcauuugacauaugugaucacugucuccuuaaagcauauuucuuucccuggcuuguagggcaccauacccuccuugcaaucaaucagcaacacuaacuacuccuucucugagaucuuugcuuuuuccaucuuauuacuucaacuucauaacuuaauaaugccguagggcucagggcucagcccuugggcaucuugucuaagcacacucauuucuuuagugaucucauccuucuuguggauuuaaauacuacugcaguguaugcuggguguaccacucaaaugccugcccuuuaggacugaaccacucauuacccccacugcugagaauguuaaugguugauuucucaaaacuuauuccccaucuucaccaagcaacugccaucagcugaagaaaguugacucacucaaggucacaagcuugggcaucaaguaacugacugauguaggggguauaaauuaugacaauucugcgagguuuuuccagcucuagagcucuccaugagauugguggaaggacuuacuucugaucuuauggcagcccaacuuuucccucuguccauuccuacuuccuuuacuccucacaguuauuaaucucaaaaguccuugccaauacaugucugagugcaaaucuucaucucaguuucugcuuccugggaaaacugaucugagacaucauuuacaugcugacauugagaggugaagccagcuagacuuccuggguugaguggggacuuggagaacuuuucugucuagcuaaaguuuugcaaacgcaccaaucagcacucuguaaaaaugcaccaaucagcgcucugcgucuagcuaaagguuuguaaacacaucaaucggcacucuguaaaaaugcaccaaucagcacucugugucuagcuaaagguuuguaaaugcaccaaucagcacucuguaaaaauggaccaaucagcacucuguaaaauggaccaaucagcaggacaugcgcaggaucaaauaagggaagaaaaacugguuauccaagccagcagcggcaaccugcucagguccccuuccacgcuguucaagcuuuguucuuucacucuucacaauaaaucuugcugcugcucacucuuugggucugcacuaccuuuaugagcuguaauacccacugcaaaggucugcagcuucacuccugaagucagagagaccacaaacccacugggaggaaaaaacaacuccagacacgccaccuuuaagagcuauaacacucacugggaaggucugcugcuucacuccugaagucagcaagaccacgaacccaccagaaggaagaaacucuggacacaucugaacaucugaaggaacaaacuccgggcacaccaucuuuaagaacuguaacacucacugcgaaggucagcggcuucauuccugaagucagcaagacuacaaaccuaccagaaggaagaaacuccagacacaucugaacaucugaaggaacaaacuccagacacaccaucuuuaagaacuguaacacucaccgccaggguccacggcuucauucuugaagucagcgagaccaagaacccacuggaaggaaccaauucugaacacaacaccuacaaacucauacuuccagcacauaccuuuugucugaaucccaagacugaaauauccauuguucuucucaaccuuccaacuuuucuuauuacuuugaugucuaauggaaaucucaaacuuaacauaucugaaacugaauacuugaucaauaccacucccucacuuaaaaaacuacccacacacugucuucuccaucuaaguugaugagaacuccaaauucucauuguuuauuacauaagccaaaagcccuguagaauuuguggggggggggggcuuccucucauauuccacaucaaauuugucagcaaaccuguuuguucuauuuuaaaaauauuuaaccauuucucaccacccagcuaucacuccagcccaagucacccuuaucucucaccuggcuuaacugcaaucccucccauuuuuuuuuccuugugucugucccuacccccugcuauggucugaaugugugccccaaaauucagguguugaaacugaaucuccauuguggugguauuaagacguggggccuuuugagaaaugauuaaauuaagggggcuccaccuucaugaauagauuagugccuuauaaaagggcuggaaggaacccagcuugggucccuuuuacccuucugucccuugcaccacgugaggacaucuagaugaaugagucuguaccagacaccuaaccugccagcgccuugauuuuggacuucccagccuccaacugugaggaaaugaguuucuuuuauuucaaaauuaccagucugugguauuuuguuauaacagcacaaauaauuuaagacacauccaauacagucuuuuuaaaccaguggcaagagugauucuauuaaaacauaaggcagaucacuuuacacugugcucagacuuuauaauggcuuuccccucuguccauucccucccucuucacuccugucucugaccucacauucuacacaugcuaccuucccugcugucuccccucaaugccucugcaugggcucaucccuuggccugaaaugcuccccuccucugcaggguucaaccucucucccuuccucugcaggguccacccccucuccuaugucaucuuuguucaaaucucacucucgauuaggucuuccucaacugccccauuaaaauugcaacccaccuccaucccaggcaguucuuguuuccuuuccuggcuguauaaguuuuuccuuccuuugcacuuaguaucuuucaaugugcuuuaugauuuacuuaaaaaaaauuguuucucccuccucccacuccacucccaaaauguaagccccacaaauucagauauuuuuaucaguuuuauuuauugauguuucuguaggaccuagaacacugccuaccacauaauaaguagccaauacauggucauugaaucaauuaaucagucaaucaaucuaucacugaacugaugacuaaacauuuuuguuauaccccaauuuuauggcugaaguauagaauacauaccuuguuaauaugaaaacaaauaccaaaacagaaaauaaauuauuuucaaguuauccuccuaugaggcuaagaaauacauaugcaaaaauccauucaagcuauccagucacuagaucuugccuucugaugcuaaaaucaacagauuggagccuuaugccaauuuagagguaggagaacuaagcuggccagcuaagcucuucuaccucuaaauuguuauaaggcucugauaauuaaguaucuaucagugaguuguuaagaaacaacuaauuuggugaguaaugcuuuuuuuucuaaauagcaccuaacuuucaccaugauguauauuuaacucuagcaaacaagucaaccaaucaacuaaaaaauaaaacaaaagaaauucuaacaaagcuaaguacuggaagugacuggcauuuuuuggggaucaagagcuuuauaacuuauaugauagaugcacaugugcaauucuaucuuuaauacacuuuauauaaaguaaagagcauguaacacacauaauccuuugaugauccaucauguugaggagugcuuaauaaauaucaaaaagcaccgauuaagccagaggaaacuccugacaagguugcagacaucuggacauguacaucuguucaaagucagugaucuguacagaagaccccagagaaagaauuagugucaaucugauauucagugauaaacaauuauuaccaagaauccaauaugacacuggaaauaauaauaaaacuggcaaguuaaguauaaauugagugaccucagauguuguggaaauuugaagcccuugauugcugcucaaagcugucauguuggcaagaaaauucuuauucagccuaaaaguauaagaauuccuauccaucccacccuggcccuguaaaccagcucucucagccaagaaguuugaauaauccagcagucaccaggagccuccuuugggaugaaauuuguuuccucuacucccuucaacccaucgauuuccugcuccuguuucccuggcucucugggagaggauagcaaagagccugcuaucugugacccucuuucuguuuugaugacucuuacagacucuuguaucaggcuuuuggauuccuauuuuucuucccaccuccugcaaccacaucuaccaauggauucuuugauuugcaugcucagaggcagcaugggucuagauaagagaccucuuggccccagcccuugauuuggggagaucuuuucucauuaauaaaaauauaauagcuucuaguuaaggaagaccuacuacauguuggguacuauaucaggcacuuuccacauagucuuguuuugccuuuacaacaucuuuguaagaaaauauauuauugacauuuuacagaagaagaaugggaaauuaaaugacuuguccaaagucauacagcuaauaagcaugcaaagaaggcagcagaauucuaaccccagaauccauguuuucugcucugaugcuguuucucuaucaagcauuugcaacaugagugauucuaauuucauuuuuuccuuugcauauuauauauguuauagauguuauaaaacaaucucaaauuguuauaaauaugucaaucauuuuggugccaaguuaaauuguuuuuaaacuugcuuucauaguaacauugcaauguuacuacccauuuucaccaagcugacauccucacugauggcccaaaugaaaugguggguuaaauugccuggacuuuagcaugagucaugguugcagcaccaaacuguacuacuccuggccauguagacuucaccuccacgcuugcaauaaaaaaaugccaauguuacuuaagaauauccuugauaaagaaguaaaucaggcugggcgcgguggcucacgccuguaaucccagcacuuugggaggccgaggcggguggaucaugaggucaggagauugagaccauccuggcuaacaaggugaaaccccgucucuacuaaaaauacaaaaaauuagccgggcgcgguggcgggcgccuguagucccagcuacucgggaggcugaggcaggagaauggcgugaacccaggaaguggagcuugcagugagccgagauugcgccacugcaguccgcaguccgaccugggcgacagagcgagacuccgucucaaaaaaaaaaaaaaaaaaaaaaaaagaaguaaaucaaccucagcacauaucuuuuucauauucugugacaaaaugagaaauaugcacauagaaagaugauggcuaucuugagauacagcacuuguguaaugaguuuuuggguuucaagccaaauuaaccuuuuuuuaaugaaaauauuucacuugaaacaacagaugacaaaguauuguuguccagacuugagcauugggcuaacguuuuauccaagaggaaagugaacccacauugacaguugccauuguugccaaugguaaaauuugagcuuucaagcaaauauaagaauuuuggaagauuuguuucugucacaguaugcuuggcagcuucucaauacuuaaagaccuuuagaugaggucauuagugguauuaauaaauaccauauuuucuauguuauaaaguaaaauguaucaacauuuagaaguucuauauaauucagaauguuauuuuccaaaugacuaauguacaauguuacagaauuaugcgugaguaaauucuccauugaaaaugcaagacaggaugguggauuuaauacauacauauguauauacuacauacauagacagcgaaauacgaagaacucauggauuccacauuuccaccaaccuuuagaaacaauuaccugucaaguuuuggugugacaucaaagaagaauauucaaaauuaucucaaaaugcuauuaaaauaccacuuuaauaacuacauauuuguaugaaccuguauuuucuucauauuuucaaucaaaacaaccuauugaaacaggucauaugcauacauaugagaacuuauuaacuauuuucuauuaaaccagucacuaaagaagugauguucacaaaaaacuggaaaacaaugucacucuuaacuauucuuuuguucuggaaaauauauuuauuuauauuaacauguauuagguuuaauauuauuuuuaaauuaauaaauauauaaauauguuaagcuuuucucaguuuuaauuuuuacuaagguaaauaucaauaguauaaaccagaauccuuuggaguccucaacaauuguuaagcauguaaagaaagggguccugaggccaaaucauuugaaaaccaguaauauaagaaaauuuugugcagccacugaauauucuagaggaguacaugcagaaagaucccaaaauaaaauauaacaugcagagaaaaauagcugaagaaagauguacuucaaugucaacuauaucaguaaaguugugaaauuaugaguaauauaauuuuuauuuuugauguccuguuaaaauuuuuuaaaugagcauagcuugcuuaaauaaaaaguaacaaguuaacaaacaaaugaauaacugaauuauaucauacaugacagcagcuuuagucuagagaaacaucucuuccuuuuucauugcccuauucauauuuauucaaucccuuccuuucuuccugcucugauggcaauucuugagauacauauuucuucuccauagccccugucccgucaagaguuuuuaaccuucuaguuccuaccaauacuuauaaacuauacuaccuuauaaaacaacuuuuccccucaucugcagguuaucaacaaauauuaaaucauuguucucuaaaauuauguauuauaaagcacagcaauguuaugguuuguguggucacaccuguugcagguuacacaucaauaucacauugaucacuguguuuccugaguuaguguggcuuuucaacaucccagugugugccuaacaauagcuguuaaauacagcuauggccccaacaaugggagguguauguggaucauaagagugaccuacacauuggguccacucaaccacuugaucgcacaguaguuaagccacuggaacucaacagaccugugaugaaauccacagcucuaaauccccagauauauuuuauaaccugccuagaccucuccucauucaaaaggugacaaauuuuacagacuuauuauaauauaaaaaggcuuacauauucugguagaugguaagugcucaaaacauguaagcugcugugcuuuuauaaucauauuauuaguaucguugcuauuaguguaauucuagauuuuaccucuccauuuaauccugcuuuccuuauacaucauuauaauggguaaugaauaugguuuggaucugacucccuacccaaauaucaugucaaauuguaaucuccaauguugguguuggggccugguggaaggugauuggaucaugggggcaguuucucauaaaugguuuaacaccaucacccuuggugcuguacuugugauagugagugaguucucaugagaucugguuguuuaaaaguauauagcaccuccccacucccucuuuuccucuugcuuuggcuaugggaaaugccuuucuccccauuugccuucaccaggauuaaaaacucccugaggacuuccuagaagcagaaacuucuaugcuuucugcacaaccugaagaaccacgaaccaaugaaauauuuuuucuuaauaaauuauugagucucagguauuucuuuacagcagugcaagaauuaaauaggccaggcgcgguggcucacgccuguaaucccagcacuaugggaggcugaggcgggcggaucacgaggucaggagaucaaaccauccuggcuaacacugugaaaccccaucucuacuaaaaauacaaaaaauuagcugggcgugguggcgggugccuguagucccagcuacuugggaggccgaggcaggagaauggcgugaacccaggaggcagagcuugcagugagcugggauugcgccacugcacuccagccugggugacagagcgagacuccgucucaaaaaaaaaaaaaaggauuaaauaauauaaaaguuuguaccaagaagagggacacugcuauaaagauaccuaaaaauguggaacugggaaacagguagaggcuagaaccauuugggagauccaaaaggagacagaaagaugcaacaagguuuggaauuuccuagagacguauuaaauuguugugaccaaaauucugauagugauauagacagugaaguccaggcugaggaggucucagauggaaaucaggacaggaacuuauuggaaacugcaguaaaggucacuuuugcuacgcuuuagcacagccuggcugcauugugccccugcucuaaggaucuguggaauuuugaacuugagacugaugauuuagacugaugauuccacuauccaguggaagaaauuucuaaguagcaaagcauucaagaugugaccugguugcuucuaaccaccuauggucauaugaguaaauaaaugaacugaaacuggaacuuauauuuaaaagggaaacagagcauaaaaguuuggaaacuuugcgucuuggccauaugguagaaaagaaaagcccauuuucaggggaggaauucaaccaggcuguagaaauuugcauaaguaaagaggagccaagugcuaauauccaagacaaugagauaaaggccuugaaggcauuucagagaccuucaaggaagccccuccuaucacaggcccagaggccaaggagggaagaaugguuuguugggcuaggcccagggccucacugcccucugcagacucagaacccugcuugcugcauccuggccguuucagcuacagcugugguucaaaggggcccagguaaagcuuaggccacaguuuuugagggugaaagccuuaagccuuggcaacuuccauaugguauuaaaccugcagguaugcagaguacaagaguugagguuugggggccucuaccuagauuucagaggauguacagaaaagccuaaauguucagguagaagccugcugcagggauggagcccucauggagaaccucuacuagggcagagcagaggcaaaauguggggucggagcccccacacagaguccccacuggggcacugccuaguggagcugugaaaagagggccaccauccuccagaccccagaauguuagauccaucaacagcuugcaccaugugccuggaaaagccacaaagacucaauggcaaaccuugagagcagccaagggggcugaacccugcaaagccucagggguggaauggcccaaggcuuugggagcccacccauugcaccagugugcccuggaugugagacaugcagucaaaggagauuauuuuggagcuuuaagauguaaugauugcccugcugggugcaggacuugccuuuaucccccuucuuuugaccaauuucuccuuuuuagaauaggaguauuuacccaaugccuauauccucauuguaucuagggaguaacuaacuuguuuugauuuuacaggcuaauaguuggaacggacuagccuugucucagaugggacuuuagauuggauuuuugaguuaaugcuggaaugaguugagacuuugggggacuuuugggaaggcaugauuguauuuugcaaugugagggggacauaagauuuggaggggucugggauauaauaauaugguuuggaucuuugucccugcccaaauaucaugccaaauuauaaaucucaauguuggagauggcgccuggugggaggugauuggaucaugggggcaguuucucaugaaugguuuaacaccauccccguuggugcuguucucaugauagugagugaguucucaugagaucugguuuuuuaaaagucuguagcaccuccccacucucucucuuccuccuucucuggcaugugaagugccuaccucacucccccuuugccuuccaccaugauuaaaagcucccugaggccucugcagaagcagaagcugcuaugcuuccuguacagccuguagaacugugagucaacuaaaccucuuuucuuuauaaauuacccagucuuagguguuucuuuauagcagugugaaagugaacuaauacaguaacuaacaguggcuacuguuuucucuagugcaacuucauuaaguaacuguuuuuaaguuuaaucaguuaauacacagagccugaauggugaaguauguauuagaggaagaagucucaucaugguuuaaaaggguagagagagagagaucacauaacuguagcucagaugagcagaagauauuuuagagaguuaucuggagagauugugcaaugauacaucacaucuccuaaggaagaguuaauuauaaggacugggugaaggugguggguauaaauuuaaagauaaauuuagucaacuccauaguuuuacucuggguuagcucagagcccagagcuuugguguggucuacacucuguuuaaaaaacagugagcaggucaggugugguagcuuaugccaguaauuuaagcccucugggaggccaagaugggaggacugcuugaggcugagaguucaagacccaccugggcaacaaagugagauacgagucuuuauauaaaauuuuuuaaaaugcaacucaaacaaacagaaaacagagagcaaauacauaggcacuuucuuugacuuuauaaucuccaguuacauagauaggcccuuucuuggagcuugauaugugccuuguuuuuguuguuauugcugucauuuuugagacagggucuugcucugucacucaggcugaagagcaguggugcacucauggcucacugcagccuucaccuccugggcucaagcaauucuccugcuucagccggauaugguuuggcugugucccccacccuaaucucaucuugaauuguaacucccacaauucccacgugucgugggaggaaccuggugggagaugauugaauuacgggggcagaucuuuccugcccugcgcuguucucaugauagugaaugagucucacgaggucugaugguuuuaaaaaugggaauuucuuugcacaaacucucuucucuugucuaccgccauguuagaugugccuuuuaccuucugccaugauugugaggccucccccccagccaugcgaaacuguaaguccaauaaaccucuuucuuuuguaaaauaccagucucagguaugucuuuaacagcagcaugaaaauggacuaauacaagccucccaaguagcugggaccacaggcaugugccaccaugccaacuaauuuuuuuuuuuuuuuuuuuuuuuuuuuuuggagaaaggcucucucuguugcucagguugaucuuaaacuccugggucaaacuauccuauccuccugccucucccucccaaaguguugguauuauaggugugagccgcugcaccuggccccugccuuguuaaaugcauuguuuauuaggcuauuaguugaucaggaagucaaaaauaccuaacaaaacaccuaaacuacccuagacauagggauuuaaaauauggcuggggcagcaauuuguaggaccaccauggaggaaaauggagaaaaaagucuaccgccuuccugauauauugcuucaauuuugucaucaauuaaauucagaauuucugaaaaaaaauacuuuauuauuauuauuauuuugagacagggucucacuuugucacccaggcuggggugcagaggcaugauuauggcccccugcagccuugaccuccugggcucaagugauccucccaccucagccucccaaguagcuaggacuacaggcacaugccaccaugcccagcuaauuacuguauuuuuuuguagagauaggauuucagcaugugucucagcuggucuugaacuccugggcucaagcaaucugccugauucagcuucccaaagagcugggauuaaagcuguaagccacuacacugcaccugggcuaaaacuuuuuuuuuuuuuuuuuuuuuuugagacagaguuucacucuugucgccuggacuggagugcaauggugcugccucggcucauugcaaccuccgccucccagguucaagcgauucuccugccucagccucccaaguagcugggauuacaggcaugcaccaccacgccuggcuaauuuuguauuuuuaguagagacaggguuuuaccacguuagccaggcuggucucaaacuccugaccucaagugauccaccugccucagccucccauagugcugggauuacaggcaugagccaccgcccccagcuggcuaaaacuucuuuaggugucucuacauaucaaauagucuucuaugaucaugggaaagaacugaguuuaaaaaaaaaauuagguaguugaaaaaucugaauaugucaauaaguauucuguuaaauuguuauaaaugucauaucacaaauucccuuuauuucuuaucaggguauauauuuuuagcuauuaagagaugauguguaaguuuuucaguauaagaagcucuugagcaaaccuuaagaaaaauauguuuaauacuuacauugccccaaacaaguuuccauguguggagaaacuuucuggugagauucauguucacauuuaaaauaucacuauaaucaaaacuuuggaaagugcuaaagggucugaugggcacugacuagcugcaaagggaagggaaggcaugaaagaagaaggcauaggcugggaaucuggagacagaaccaauucugggaacgauugcugauuagcuauguagcucuaagugucuaucuuucuugaucuuaguuuucugguauguguauuguauuaaugaaaaucucagagguucugugggcucuguaauucuauucuuuuuuuucuuucuugcacugugaauuuuugccuugucuuuguucucccucuuuuggacuucucugcaucauuuggcaguauugagaacaaucuccuucuuaaaacuccaucccucgcuuuuauggugagaacaacucagggacucauuucaaauacuacuguccucaaucagagcugacccucauggcucaguuccugagcuaacugaagcuucuugucucuuucucucucucucucucucuuauucucuccuuuuucagagaguugaaaauaucuagugucuuccauuagucccugcuguggcuucaaugcauccuccaaaguucauguguugcaaacugaauccccaaggcauggugucuagaagugggaccuuuaaaaagugauuagguuacaagaguucuacucucauaaaugcauuaacaauguuacuaugggagugagcuaauuaacaugggcauugguuaguuauugcaggaguugguucaugagaaaaggaugaguucuguccccuuuucuuccucugucucucauaugcacucuuuugcccuccugcuuucugucaugguaugacacagcaagaagacccucacaagaugcagucccucagucuuggaauucuuagccuccagaccaugagcagaauacauuucauuucuuuauaaacuccaaaaucucugguguuguguuauagcagcacaagcagaaaauugguacagagaaugggguuguuacuguaacaaauaccugaaaaguggaagcagcuuuagaauuggguaaugcauagaggcuggaaaaauuuggagcagcaagcuaguaaaagcuuggauugcugugaauggagugguaagggcaauucuggugaggggucagaagaagacaagagcuguaggagaaccuaaaucuuccuacggauuacuuaacuggucauggucagaauguugguagaaauauggaguguaagggccauuccaauacgguaucagacagacauaagaagcaagauauagaugguccccaacuuaaacaauuuuuuuuacuuuaugauggugugaaaguaauacgcauucaauagaaacaguucuuucaguacccauacaaccauccuguuuuucacuuucaauauagcauucaauaaguuacaugagauauuccauacuagauuauacaauaggcuuuugucuauaggcuaaugugaacauucugagcauguuuaugguaggcuauccuaagcuaugauguucaguagguuugauguguuaaauguauuuugacuuauuguauuuucaacauacaauggguuuaucaagauguaaucacaucauaagucaaggagcauuggaaaguggaauaaaggccauccuuuauccuaguuauacaguuguaaagaacuucauggaauuauguccauguccuagaacuuuguggaacgggggacucaagagugaggaacuaggauaucuggcagaagaaauaucuaagcagcaaaguguuuaagcugugcauagcuucuuuuagauacuuacaguaaaaugaaggaagagagaaaugauauaaaaauggaauuuauaauuaaaacgaaagcagaauggaaagauuuggaaaaauaucagccugaccauguaaagaauaaaaaaguuuguucagcagagaauacuaaggguguggccaagagacguuugcuaaagagauucauauggauagaaggaagccagguucuacucaucaagacuauaggacaaugaccuugaaggcauuucagagaucuccaaggcaagcuagaacuucaagggcaagguuuccagagagguaccuacaagaccucaacauucgcugcccuacauugccuugggacuccacuccuggaauucugguacagcaccccucagcugcucuggccaugguucaagugagcugagguguggcuucaccugccacuccacaggguacaagcuauaaaucuugauaacauccauauggugcuaauucugaaggcacacagaaugcaagaguuguggggccauggcagccuccaucuagguuucaaaggauguuacagacagucgggggcucaggcaaagacuugucacagggguggagccacuggagacagucccugcuagagcaaugccuaguggagccaugggaaugguguggccccugagaccaugaaccacagagucaccagugugcaacuccagccuggaaaaacugcaggcacaagacuuuaacuugugagagcugcuggguggacugagcccagcaaagccacaggggcagggcugcccuuauuaauuggguuaaugucauuaccucaggagugaguuugucauuaucacagaagugaauucaguccucucuugcuaucucuugugcacauugucaccaugugaugcuuucagccuuauuacgaugcagcaauaagguccucaccagauacguccccuugaucuugaacuucccaaccuccagaacagcccaguaaacuucuauuguuuauaaauuacccauucugugguacucuauuauagcagcaugaaauggacacagucccuuuaccuugauaacuuauaaaucucuaucucuaugccauaugacaucacaucacacaauggaaagaacaugaauuuggggcuuuaacaauacuuagguucuuuaacucaggacuuugugaagauuuacugaaaauaacuuuuccaguuuuacaaauuaaaaaacacaggaugagagaggucagaugaauuucucacccagcuccuaaauuggaccugacccaaauuaccaggagaaugcucagucuuaguauagaacagauuucaauagacguuuaguaaaguacucuggaaucccugcccaggaaggguauuaaaagaaacaaauucugagcugaguaaguacucagguuggugguuaucuaauguuugcuuuucauaauuuauuuaacaauucuuuccaaauaauuauucaguuguccauuaacuacauauuugguacagcagaauaaaacaaacaaaaaacagugguacaucagaauaaacuggucucuucaaauagcaacucagagucuuucaaguagacauccuaccuuagaggacaucaaaguuuguuugaaauggaaacagccucuccaaaaugagucuucaaagguugcaaaguaccacagaagagcuuuaaauuuaggcuuuuuuuccugugguacuuuaaguauaacagaugggucuucauaauuagcaucacauuugcauuuuucucuccacaaaaaagagcuaauaaucuuagaaggagaauuaaaaagcaucauuccaucauauuuuuauugaucuuauuuauaauuuguaugccaagucuucuuuaagauaccuauuacuuucaacucucuccugggagaugaacaaauuuacaaaugaggaaaugagcaugguaguuaggagcacaaacuugaaaaugacuuugggaugauaacucacuggaaggcccugauaaaguggaagaaauaugaagauucagauacagccugaagcccaucuauguaaucuccuccaacagaguaggccuacuuaucuuuuguguauguaucuaugagacucccauccucuccugugcacuguaacuccuaccacucagaaccauuuaguugaaaggugcuaugaaauaagaggaaucauugaacaaacuguccucauaggcaagcucucaagcucucccgauguacagcuggagacagcuauugaugaacuauggugggugcagaaguuaaacagauaccaucugcagagcacagaguaagcagaggcccuaggacauucagcaugggacaguauacccugagagaacugggccaggguaaacaaagaucgugucccaacuguguaccacaaucaacgucguaucugaggaucucggugauccucauagcuucccuaugaggcugauaccaucuucauucuguagcuagagaaacuaagauuuaggaaaguaaaccauauugcccaaaguacucuaguuaaguggcaaagccgguauuuucauuuaggucccguccaauagcaaacuucacgauacuaaguggcaugccauuuugaccuguuaacuauaugcaauacauuugcucugguaaagguuuugcuuuaauuuguccauauccaaucccucauaaucaauaacacaacuuuguaagucaccugaauacgaauaaggaguguaaucaaugaccaagaaacagaaaagauaaacugguucacagggagauugagcccucgaccuuaagcucucuagagcugaauucuaaccaacccaguuaauuagccacagacuauuaaaugaacaaauuagagcccaaauccuuucaaaccacaaaucuaaguuggccuuguauaggaacacagaguuaaauauguacugauuuuguuucauaucagauggguaaugugccaacauccuaauaaggcugaagaaggcacaucucacacguuacugugaaacccaaucaucacgcuuaugaagcacaaaaggaucaauaugcacugaauuugagugugcccauuuaguacagugcagacucucuugaguguccccaaauagaugaaauuauaagggaaauuuucauaaucuuuuuuuaagcuuucucuugcuguucauaaugccuauacuucacgauauuuuuuuuaaauugauauaucuaauuuaggaaucaagucuuuaagaggauccugguugaacugccaauuuuucaucagauucauuaaacuccaccccauagguaagaucagaccuggaauucuugaguuggagaguacuccaugaaagauacuguguguccuaaaugaaaagcaguaauaccacaaaucuaauugauaagaucugcaagcccagagagccugaaagaggaauucccuuuuguugcuacuggacuucaggccucuucaacaacacauggaguauauucugcacccagggcucagucuuacccauccacuucucaguggcaccaaggucacucaacgguugaguucucacacagcaagagaggaaaagggaaggaugcaagaagagggagauccauccccgaccuaguauaguauuugggccauugcucuucuccacccuucauaaauuacugauaauuuugaaaagucuggaaagugagaaacaggaaggauaaggagaaacuauaaggaaaaaggagggaauucaucuggggauguucuuccauuccucuuuccucauccagacccuucacauaguccucccaucuucauucuaauuccuugacccugaauauuugugcuacccucuucccaaauccuaaucuccuucauuguagccaggcaccaggccaaaucaaucacacauucagaacugugggagucuccucccaguucucagggguggugggaaggcacagaucucaaagcuacagaguuucagugagagcagauuuguugcuugcauuuaaauuuuuggaagccucacuuuucauggaaauaauguucuccaagaugacucaguuugauagcacuguuauucaggguacauuuuguguuaaauaugcucuugucuauuggccucagauccuacauaucauaauauaauauucugagguccaaacaaauacauuauggaacacgaccugcuucuaugcaggagcuuugucuguacugcacauuuauucaucagguaggaaaguggggaaguuugcaaaauagagaaggauucuuuaaagaggcgggaacaagguuaucuaaagaaucuagcacauuggcuaaauuauauaauuaugaaaagagcagacauuaggcacaagagaaauucaucauuuuuguaucucuacuuucauuuucuguaaacaauguacaacuuaacguacaaaauugcuaugaucaggucugcugguaguucuagauuuaaauauggaaaagccucauuaacagaaaucacaugccuacaauucuuuuuaacagaacuuuugguuguccaaaccaucauucaugagagaacucuaaauucagacaggugaaauacacuuuuaauuuacugauguuaauccaaccagaucauuuggaaauauuuaaaaugccuguaacaggaaccauuuacuggaagacuauaaugaauuacuuaaugugcuuauuucaggacaaaacuaagaguaauauucuacuuuguaaaggggauuagauuugcaaugaaaggaacuuacuggggaaacuggccaauugaaagcuggcaaaacaaugugagcagaugcauuagaagucaucugaucuggggagcuaaucccaaugcugucagaccuucuaaaacugccucaaccaugucaaugcacaaauggaaacuuauugcuagucugcagcuuuaauagggcaagggaggugcuacuggccucacaagccagggaagcuuuuccacugcaucucggcugcaugggccuccagcacucacagauacagacguccacaucaacuguaaacugacccucuguucugaaugaccagugauauuccucacuacauuucacgacaguuacuugaaauaugcacuaaacacauauguguaaaauguacuuaaauggcaaaccaaagaauuaacaccugauucuaaaucugacaaauuaauaaaguaauauuuacuuauacgguuauaaaagguuaguguuauaauaaaaaauguccucauuuguccuggucaagggugugaauggauaugaaauaagaaaauaugaaaaaguaguauugauaggaaaaguauuuuccaacauugcaauuguuaugauuuucccacaauauuauuuacagaaguagauuuacaauuuugccauuugaaaaauauuguaacugugaaauaguuaacauucaguuuaaaguuugggauuuaaaaugagccuaaauugacgaaacagacugccuuaccuuuaauuuauaugauggaacuuguuuucaggacagaauauaagauauacagauugagccaaaucaucuaagcaauuaagauuucauuauuguggauaccacuggagcccacacugaaaacugagugcuauuaaccuaaagauuuaaagucacgauaucugugacucaguugccaaguccauccaaggucaaugguuaagaguucaaugauucugaaaguagcaaaaaaaaaaaaaaaaggaauuucaaacuaagauugaauaguuugcuaauuuccacagcucugcaucagacuuaccuucccuggcuucuucuuauaacaucuccuuuauccacaaauacucaucugacaaucucauauauuuggaacacaacugagaaucaauuagccaagucacaaaagucaagccaucaaauucuuugcucugucuuggaggagaaacucauacaccaucaauuuuacagauuauuugcuuuuaugcuuuaccuaaaaauauuacaaauuuggcaaccuguuuucuaaaucucuaaagagucuaaauuucuaaagaauguuagaagccauaaauaaaugggguuaguacuuguuauagguucuaugagagcagagauacaauaguagacaaaauagaaaaucugucaaaacugacuaaagcuuaaaaagcacaauagucuggggauacugcagugagaaccaauauaacucaauagguccugcuggcaucaugguacugcauucauaguagaagaguugauguucauucugaugucugauucauucagaaaguuccuauuuuguuugguuuagucaguuuaaugaguuaugaaaguacuaauucauuuuagaaagcuauccauuuaaaaggcuuaaaacaauauguauguguaugugggugugugggugugagauaucuaccuagauauggcuauauaaagagauaucugugucucucucuaucuauccaugcuuagauucuaagaacuucaagcugauuuugccuacacucaguaggugcugcuaguacacccagguguacuaaguggguggcuucuugauuugaaccacuaaauagugggguuuugguaggucugaaccaagugaauuccguuucuguaggucaaaaacagucaaauaucagucauuucauauggcuccagcuaauguuauuaugggccauuuugugauauguauaauauucccauacaguauuuuacuuagcugaauuauaaaauuaaauuagacuauaaacauacaguaacugagcaguagggacccugaacugcaaagaaaaaugugauuaaugucacaauagaaguaaaaauaauaaaacaaaaccugauauuuaagaguucacauauuaggacccucaauuaccacaaauuuaccacgaagaguuuuauucuaacucacaauaauacuagguaauauuuuauuucuacucuccggaagauagcuggauuguaaacaccaguugcuggcuuaugauugcccaggaaaugugcacugaagcuaaaauggaaacuugucagguuuuucucccagucaugagauccauuuuguuuguuuauuuauuuauuaagggggagaugugugauuaaaaauaguuuacagagucaauggaagauacuauuaaguuuguucauauuucuguuaaaaacaagaaaaccugaacuuuuguuuuauucugcagcaacuaagauauugggugauuaacaauggguaaaggaaaaacaucaauuggcaguaugauuuuauuauaaguaaauuuauuuccaagcugggaauaugcuuugugauuucagaagaucaggguuuauaaucauuguuaaccuugcugagaaacaguuggccuguagccaaccuauuacauaaccuagccaaagaaagaaaacuguuucacaaaaagccacuaaaucaaacucgcacuauuguuggcuauuaaaugagcuuguuuugaacucaaauguaugcucuucagaagauuaaaguaguauguuuagaaaguacauaaaagcuguuuauaacaaagcagggucuuauaaugauaguuuaauuccuuacauguccuaucagcauaugucucuacuguuaauauuuucuuuuuaauaagucucauaaaguagguugagccaaauagauucuccuuuccuggucuuuuuuaaagcauuaucaaguuacacccuuuacuaauauuccuaaagaucuaaagauucuaguauauauucaaguaauuccuguuaaauauugugagaaaaauccuaucuaagcauaguaauaaaacuauagaaagcagaaguguaaaacuacaggaaauaugugugugugugugugugugugcgcaugcacgugcauaagacaagcuuaaaaacuauuuuuggaccagggccaugaacugaaugaauaugaucuucaucaaggcccaagaggaaccuuacacuuuaaaggaacaaaaacuuucuauggacaauuuguuauguacagcuacaucaagguuaaaaaaaaaaaggauauaacagagaguuuaaaugaggucaacagaauuacaccagcuggucccacuccccacugggcugcggagggaagugaagcaauccacaggacacagguuuaauccagacaaggcuucacagaaaaagaaaaucaacacagcacauugcacugaaaaacaaucuucagccgguccagauuauggaguacuaggaggacuccauauuugaaauguuugcccuucaaagagaaacucuuacauacuaagccaguuagcccagguuuugauacaaaucaccaaauucagaaauacagacuucaacuuagagaagagaaagggaggagggggucauacauuuuggugaaagcaaauggaaaaccacaauugccuauguuacgauaaugccuuaaaaauguaaaguggagcaguagggagaugcuccucccuuucuucacagaucccagugcugucucacauggaguguggggugacaggaggacuuugugcagggcucugcuagacucauuaugaugauacccagacaccgggugucucacacacauuccucuucugcugccucauucaaacaccacaauuaagaugcugaagacuguaauucaagcuaaaggaagagccgcaagaauaauggccaaugcauaaauuuagaugugaaaaacagacauauccauugauaguauuauugggacagccacuccauuuaaaaauagggcauccuagucuuuuucccuuuauaaugcucuccucuugcuuagcuggcucuguucucuauaguucuguaccauccucugguuuuguccaucugucucaguuuccuucccccagagauagugauagagauuguuacuuuugccagaggcagccuggaauaaacugagaugccaggaacaaagaggccucccuggaauccugaccuuucaaaagcuuuuuaugaacacuugagauagagagaagccugcugacuucacucaccugcauauaccagacagaagaacacagaaggccguucuuuuuuuggccuuacccugagaguugaggucauucuugccccuaauagaauacauuuucacuggcuuuacuugaaaaacuacauuuaagugauggcauggcaguuacggcugaaaauaagccuaguuuauucaaauaaaauaagcaacauuucauugaauuuacauuagagcaaaaaauaaaaugaaagguagcaucaggcaaauuaagaggaugaaugaagcuauaucaauguuaggcuuauguaguauuucuacugugaguagccuugaaguauaucaugaugggcauuuaacucaugcaguaccuuuugccuaaaaauagagaacccuuuaucucaaaaagcaaauaaaauacuuugugucauguuuuuauaauguugagauuuguaaaaacuuauauugauuaucucauuuaaauuucauuaaaauauucaacauuggcaaggcaaguauuaguaccccagcuaaggaauccagacugauagaagcagcagcuaagugaaaaucaggccacgcuauugguaagggaguguuucuacuuccaccucaugacuaacuaccugauauaaagugagucccuugccuucccugggcagguaguccauucauuuguucuuuaacucaacagcaugggugugaguugaacaagacagacaaauuacugcaauguguaucaugacuggagaaagaauucaacaagcaagucgugugugauaugguuaaggaaaagaagaaucuaacuuucucuucaaugcaguucuagcccaucggccaccugagagcaaugggauaaggccaaagucaaggucaggcucagggguuuugaguguauacguggacuuccuaagauacacuucgauugaguucuuuuauugcauccccuaggcaaaugcaauugauuucagaauuauugauuguuuuggauguuccaacccaguuucccuucauacuuggggauaaucaagagcugauuucugauucucaagaaaaauggagaauuuaaggaauauuagaucucaaacuaucgguauaaucuucuaauuugucucauuauaaaguauucuauuucuauaggacagguuaauaauccagaaaaaugaaacuaagaugaucaaaaccuguaguuaauacuuuaaaauacaauccaacaccauuuaaucuucugaguuggugacacuccaauuucuucucucuaacguuuccuuaagaguuguaauuggggccgggcgcgguggcucacgccuguaaucccagcacuuugggaggccgaggcgggcggaucaugaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuuacagugagccgagaucccgccacugcacuccagccugggcgacagagcgagacuccgucucaaaaaaaaaaaaaaaaaaaaaaaaaaaagaguuguaaucaaaggaugccuggguaagagcuggguuugguuuugguacuuaggucuuuugguaauuccauuuuagcaccacugaauuaucauuagugcuuuaaagagcugccuuuuguggauagaaugaauuauuauacauauucaucauuuuugucuuccuacugauacauuuaaggaguggagauacaauauuuucauccaauaggucacaaugcauauaauugcugacauuuuaaaugcaucuggaaaaauaaauguuacuauauuauuguagauuauagaguguccuucacuuuuuuacuuuuauuauuuccacuuuggagauucugucaauaaaagucaagugccauuccacccugugaggguacagggagaagaagcugucuuucaaucagaaaaugggcccucaccagacacuaaaucugcuuguacaugggucaugggcuucccaaucuccagaauugugagaaauaaaguuuuguuguuuagaagcccccaacucccucgaaaaaaaccaagucaagugguuucagcuguuucauguuuaaaucauuuaacaaaauguucugggcgcccagagcaugcagaauacucccccuaaagcagcuacagccgggccggcggcaaccccucauccugaccugaaaacuggguuagucauggaagaacacagggagugaaaaaguugaaauuucacagcaugcucugaaauaacggaauauaaagguacacacugcucccaucaaaggagaaaaggugugguuuuauuuccacauaccaucaauauuuuuagcauaaaaauaccuaaaucauuugaauaccaaaucccaucuuccauuuugucaaaaauaaugaccuuuauucuaaauugccaagaguuucauuaguucuagagagagcagaaaugcuuagugcagcaccaaugacuccugcucagaagccuaaggaagagaaaugccuuaugaggacaauaaccugauuuuauuucacuugggaacaaggcuuuugagucucuuguugcuucucacaguuaacguaauguauuuaucagaugcugcgaagcgauuacuucaucugcuccagucaucagaggcaaauaagauuaccaugugagacagcagagaaaggaacuuguuuuuucuaaccacauuaaagucacacagccuauguuguuuacaugaacaaaacacauaagaaacaaauaaaaaaaucagaaauuugauuaaauuucagaugaaccauguuaugaauacggaaacacauacauuuacuugaaauccauaucauugucaucaaaacaggacacaaauguauugacuugacugccagaggcuggaaguaagugauaagagcuggaauguguugcucagagugguuaacaaggaaauagaaacaauccaguagcaagcaagagaaggacacaaucuuccugagggcaaaagccauugcuaacuuauuuggacucacaucuagacaagugucaguuucuuaaaagugccuauuaaccaaucugggccacaucuuccuggggauaaucugcagacuggcagaaaauugacucuuuuggagauaaauguauaugcucuuccaaauuucagaggauuguuuagaaaauaacuauucaaggauuugacuuuacucccaaaucuguaaaaggaugauauuagauagcacuuuacucccaaaucuguaaaaggcugauauuagauagcagaaauacagauuuucacuuuugauaaacugcgaaaagucaagagaucaauguauuuccuggcuugaaggaaauuaaaccaaaaacaauucuucacaaaauauuaauauauugaauacaacaauauauaauuaggacaauauauuaugacaaagugggguuuaucccaguaaugcaaggcaauuaauguaauccaccauacuaauagauuuuugacaaagaugccaaggaaauuuaaugagagaagagauagacuuuuccacaaauggugauggaucagcuagauaucugcauggaaaaauacaaaagaaccucagacugcauucaaaaauuaaguuuaaaugaauuaugaaucucaacauaagagcuaaaauguuagaagaaaacacaggaaaaaacauuugugauauugaauuagacaaagauuucuuuuuuuuuuuuuugagacagagucuugcucuguagcccaggcuggagugcaauggcgugaucucggcucacugcaaacuccaucucccggguucaagccauucuccugccucagccucccaagaagcugggacuacaggcaugagccaccacgcccggcuaauuuuuuuuguauuuuuaguagaggugggguuucacuaugcuggccaggcuggucuugaacucuggaccucaagugauccgccagccucggccuccaaaacugcugggauuauagacgugagccacagcacuuggccaaauuagacaaagauuucuuaagcacaaauuauaaaagaaugauaaaauggauuuaucaaaaugaaaaaucuuauauuugaaaaaacacaguuaacaaaaauacaagcaacauacuaggagaaaaucuuugcaauacauauguccaacaaauagcuuguaucuacaauauacgaagaacucuuauaauucaagaagacaaucuaaaaaugagcaaaagauuugaacagacacugcacaaaagaagguauacaaaugggcaauaaguacaugaaaagaaguucaacaucacuaguuauuagggaaaugugaauugaaaucacaaugagauaucacuacacaccuacuagauuggcuacaguuggaaagguucacaauaccaagugcuggaaaggauguggagcaaguagaucucucauacauugcugguaaaaaugcaaaaucauacagguacuugggaaagcaguauagcaauuucuuacaauauuaaagguacauuuaccauaugacucugcaaucuauuccuguuugcgcaaaggcaaaaccacaaugacaaaaaucagguaugugguaaagggagaaggugacuuggugacuuuuuaagaugaggaaacuguuguauaucuugauagugguaguggcuaaacaauugaauagccaaaauuccucaggccacacccuuaaaauaggugaauuguauuguauaaauauacuuuaauaauaaauaaaaguaaaaauuacauaaauguuccuauuuauccacugccuguucauauagaaaagaacauagaaaauggccacagaguaacacagugaaauuaagauuuugagaaaagagugaucagaaauccagauccuaaaaugucaaguccagcccaaagaaacuaccuuucaccacuaugaauaucauccaggagcuuuuauuauauuuuugggaaaaguguuauuaccuguaagacaguaauaacagcugauucuggguacauucaauuacauaauggagaaauaguuucauccuguaacagauuuccaaugacaguuugccuuuaguaaaccuugaagaaggcgagagaaaaggaugggaggggaaaagaauggaagaaagagagcuaaagaggaaaaugagagaggaaugccaaccaggagaaagaacagcugaccaaaaaacaaaacaaaacaaagcaaaauaguagaaaaguacaggcuaagaaaagagguuacgggaaaaacaggggaagaacugagcaauacaaauggauacacaccuaggaaaacaagagaugugagaaagaauguugaggucaaugaaagcaagcaagccaggcgcgguggcucaugccuguaaucccagcacuuugggaggcugagguggguggaucacuugaggucagaaguucgagaccagccugggcuacauggcaaaacuccuucucuacaaaaaauacaaaaaaaugaaccagucaugggggccugcauguguaguugcagcuacucaggaggcugagaugggaggaucaccugaggccaugagaggcugcagugagccgugauugugccacugcacuccagccugggcaauacagcaauacccugccuaaaaaaaaaaaaaaaggcaagcagaguccaagucagacaccagguacaauggguggacagagaaaaaguaacuauaaaugaggaaagaaaaaaaaaagaggguuaggaaguccacauuuggaugggaacaugagacaugagagugccaauauuauuuuguuguaaaauuaaaauauuguaaggaaauaccgaagaaauaacuugaagaauuacuuuccagauguuuucaacacacuuuuuuuccuucuaugaacuguaaccuuccuggggccuuuuaaaaucuuacuuggcucucuuaaauguaaauaccucaauuuaaggcaugguuucccuuccaaggacuuuuaauuuauacauuuuaauaauucucuucaaggcuuucaaaaugcccaugaaaugacuucccacuaugaagcacagggacaagagggagauagauuauaaagaccugccuguguucugguuccaggucugucaguaauagcuggacaaguuccuuaauguguguguguguguguguguguguguguguguguguguguguguguucguguguauuguguauguguguuaacaaaccaguuuuccaguuccacuuauuucacucccuuuucuuucuucuuuacucuuuccuguuuuccuuccuuuccuuaauucuauuucaugguuuuuccuuucucucuccuucccuucuuuuucucccuuccaacaaaccugagaacaugcugcaggcugaucacugugccagcugccagggacacaaagccacaagcgguuccacccugcucaggaucugggcuggcuggaagguagcugacucgucaguaauuuucaauacuuuaacauuaaggagaaacaacuacugaccauucuauccuccaauauuaguccuugaaagcaagacuuucuuucccaugggaauuuaaaccuuugggauaugacauuuuucuugguuauacacucuuauuuaucuccccauucccuaaugucaugucuucgcaauucaguuuggaauuuuaaaacucagccugacaagacagccugagggucccgcaaaguugaagcuauaaacaugaucaugugaacuuagggauaaucauuuguggcaacaacaaaaacuccagcaaccugaaacauaaacaacuucagaaaaaugugccucauuuuagcaggguuuugauguguaagaaaucacuaaaaauagguuugaaaauauccuaacugguguugacauauuagcauaccuuacaacucuucuagauuuccacaauuauuacaaagaauguggaguaagaggaucuuuucuuuaaaaaaaaagauauaugucuuuguaucuuaaucccuccccuucuuaacuuaccuuacaaaauuuaauuaaugccuugaauaucuauagaaauuucucuucucaugcuaugacuaauugaucucugcaaauuagcaaguguuucaaccaaaaagcucacaccauacgaugcuuaguaguuuacuugauacaacccauaaaacaugacaggcucaagaaagagcaaagcucacauccaccuuaauacaaguuaagguucaagaauacaaugguuuauuaccuaaaguaagauaguuaaaagagcucugaucaaauuacucaauaagaacuccaauccuuuccuuagucucaagaggcgacacaacaagaaccaugguggaaaugguuaauuaugguggaaauauuaaaggugcuuuugacacaaccugggcauuggucuaagcuuauaagagaacagaaaacaacccaaacaagcagcuggcccaggauucacagcaucccuuucucagcaauucugaauuaugauuucuuaaagagaaauaguggguucuuucaaguuacuugguacagaacccagaacaugugugcauacuuaauaaacaguauuugaugacaaaacaaaugcaaacaguguuggcuauuuugagagucaugcuccuuaaugacuugaacuccuaacagaugcucuagguaggaguuaacuagcucccuuggagcagacauuucauuugcucuuugaaaauauuaauagggagaaaagacuugcucuguguuucugccagugcuuuaaaacaagacguccuuucaucugugcguguuuuuuucuuuuuuuccuuuccaacuuuuauuuuagguucagggggugcaugugcagguuuguuacauggguaaauuacgugucaugggaguuugguauacagauuauuuugugacccaggugauaagcauaauaccugauagguaguuuuucaauccucacccuccuacuacccuccacccucaaguaggccuaagugucuauuguuccccucuuuguguccauguuuacucaauguuuagcucucauuuagaggggagaacaugcaguauuugguuuuucuguucuugcauuaauucgcuuaggaugauggccuccagguccauccauguugcugcaaagaacaugaucuugucguuuuuauggcugcauaggaguccaugguguauauguaccacacuuucuuuaucuaggguaccacugaugggcauuuagguugauuccaugucuuugcuauugcgaauaguacugugaugaacacacgugugcaugugucuuuuuaguagaaugauuuauauuccuuuggguauauacgcaguaaugggauugcugggucaaaugguaauucucuuucaagcucuuugagaaaucuccaaacugcuuuccacaguggcugaacuaaucuccauucccaccagcaauguauaagcacuaucuguauaauguuuacugcuacauucacaagggcagguaggggaggaaucuaguuccacaguccacagacaaaccggagaacuuuaacaucaucacaaaucaucaccccuuaagcaaguuucuccugacagcugagacauuaucaaagaugauuuauauucagagaugcuaaggcuagucuaugcccaaaaggaaaaaaaaacaugaccuuuaacuaguuauaccuggggaagggaaccaaaaagggugaaggugaagggacagcugggaaagucaaaauaaaaaucuacccagaaaccugcugcugaaguauuugcauuaaacagucucagcccagcauacauugguacaucccauuggaauuucuucuucucuaaauaugagccuacuucaggcauuugccaugucaucaacuaucacuauuuuuuuaaauuccugaauucuuuaggguuagaaaucucucacaacaaagacaaaaaaguagacuaggauucacuuuaaaaaaaaaaugcccuguggcugagucugucaccugggaauguuucaaagucagcucucaucuuggggcagugcuuagcagagguggggcugacuauacugggucuccugccuccgacagguuccagucuccucucacugaacuacaaauuuucuaacucuuuauggacagagcagacacuuggcaacuaacucccuuucucuuauuaggucucucuucagaaaggcuggagaugacacugcuaacaccaccuuuagaagaagaggcagcucaacccucagaaacacuccccucuaaggauuuauuuaucaaaaugucaccacaauaauuguuacagccagccuugcuccuucaaaaccaugcugccuugauagacuacaguuaguuaaaauuccuuugcuuugguugcuuuuaaaaaaaaauguguguguuacuguaucucacacaccacagcuuuaggaaauguuagcaaacugcaaauaaucucucacucacauaauugucaagauguuuaaagucauuuccuucuacaaauauguccaaacucuguuauccuaucccuauaaaguuauauaucauucaagggcuuuuaaggaaaguacacaaaccuguauuaagcaacaaauaaaugccacagaccaggcuaugugcuauucauuacccucucacucugugaagugggcaguggacauuccugucucuguuuuacagauaagaaaacaaagccaggcaaguccaaagcaguagauggcagaggcaagaaucaaauucaagucugcgugauuccaaguuccagugaugugcuuuccuauguuauugugacccucaaaaagccucacgcauuuaaguuuugugggaacaaggugaaaauugccccugagaagcuuggauucauucuucgggauggggcugggggugcuggcaugguuaacuucaaggaaaaggcuuagucaaaccaggcuguaaucauacaaacucaugcucuccaguucuccaaaaagggugccaugaacauguucaggaaagaaaaguagcucccaagaaaaaccagcauccugagggaaccgcauggcuguagucuuccucuaccucacccauaaggcgaucucuggcagagacaggaaaugggcuucaucgcuauugccagcccagauugaaagacaguuggaaagauuccgggcuauggcaagaguacagaaucaacuagcaaaugcucauggcccucccuucauuuauauguuugguaugagucuggucaaauuauuucaacccuguaugacucaauuuccccuaccaucaacccuacaacuucuccccaaucaugaaaccauuuuguucauuguuaauuuauacacugugaaaacggagguggagaaagguacagccaaaaucuauagugaaucuuauuguguuuauucuacuaguuuuuauauaauuauuaaaaacugaucagugguagucuuagaagaauaauauugauuauaaaacuauucagcauaacaaaagaauauccaauauaaaauaaucuauucaaacuuuccuauuaauguauaucuugcauacaaagauuuauuugagguaggggcgaaggucauaguaccuuaaucuccagguaggugccuccgaaaguccaugagucccacuguagguguagaggcucuacaguuggaugagaaaagucugaauauuucagccacagacuuucaauuaggcaagugaggagagaaaagggcagggagguaugaaaucucauaguuuucauucuuuauaguggggaauucucuugcaguaauugauuuacugaggauuauguugcagcacacucaugcuauaauugguugcacgcaaguuaacaagcccugauuuguagacugcaaauaugacacacugcagacagucugcuauuccugcccaccucacuacagguuucuagauaugcaaauugagcaaaccuaacauauugaugcugauuagaaaugaaagcccuuauuauacagagguagcccuuguguugcuguugacaaggcuaugccagaauugaaauuuggagccauaacucauacauucuacauaaguaaaauaugcaaggcacagagggcauuguaaacuaaggagguacucaaaaaggugaguuuucaaguaggucugugacuuacauuucuuuuucauaagcucagcaauuaaacaguccaugaauuaggacucaaaagagugaugaguuaaaaaagucuucaguacagcauagaaacuccaugaggauggguggauuauauaauacuagaagugauauuugggggccaauuaaaucuuuccaaugauaauuuugauacaaaccaauaaauugaggugcugauggaaauagauccuauauaaaacagcaaaggauaaucauuucauauuugacccagaccaacaaagugaaaacagcuaaacagagaaggaaaucaaaugaaacugaagauaaacccauaaaaugaauaguuacuaaagacaauuaagauggaauuuggaaugaaccacaguaguuaacucuccaugagagaacacauguaaaaaacauauuuuaauaccaguccacuacaaaaaauguagagaagcucaaauccgcacuucuuuuauucuauuccaugaagucuauuaacuaacaguguagcuaaauauacuuuuauuuuuauaacauuugaaagacucaauguagauaaauuuaacuauugggggaaaaagcacagucuuuuuuuuuuuuuuuugucugaccuaacgucuugacuugcauuuugaauauuugguuacuauagaaauaaaguauaugaccuauuccagagaacugggaauuguguacuuguuucacuucuuaaucaauaacauacaaugggggaaaauauggccuuaacuguuauucagguuaauuauacugcaaugaaaucucagacucacauacugaagaaguccuucagauaauucaguguauauuauaucugggaguacugucuucuaauaggggcacuuauuagccaaagaagaacaaagagccaguaaucuucagggauggcagcugucaaacagcauaaaucagagaccacaauugauuaacuaacuugagcaguaaaaacagacuuacuugcuauggcaauaaagaaaaaauugaagauuugaucaccugagagauucuuuauucucaugggauuucagagaaaucagaaaccacaaagagaaaaugcccaccagcuuaucgauuguagucuuaaaauaauaauauucuguaauaacuuuucuuuugaaauguuaaaguggcuguaccaauacuaauuucuagagugacugagacugcuagcggcaugccaaccuaucauuaacaagacauucagcaaggugacuccuggacagaauaugaguuagagcuaaaaaauucuaggcucuugccugucucugugaccuccaaauaacucauuccccuaauuuaggaacuacuuuuccaauauauucagacauuucaaauuaugacuauucaauuaaugaaauuuuagguuuaaaaauuagacucccaccgucuucagaucauaucccaccaaacugccacccgcagugccgggcacccaauuccuaggggaagcguucagaguugagcaugucauauaaguagggcugcuugucuggaaaaggcaaacuggaaaaugacuuaaucaucuugucugaaaauauuugaaacguucaucuguaggaaaaagaagucucaaguccaucccacaugguuuacagggguagaauuucaggguggccucgcagaacagagguagcacauuauaaggauccuggcuuugaaugaacaugaagaaaacgaaaggaggcagcugcauggugagagagaguuccuuucacugcaaaagagucuagcagcagcuagcaaugaccuagcaagguguaugucuggaagauuuccuugcaccacucagaagacugaacuagagaggauggguggcggcuuccuccaccauacugugacugggauccuaaguguggcacuacuggguagaacguucauggucuucccuggagcccugcgcucuuggaaaaucacucccuucuugaaugccagccuuuggaguagaguggguuccucuucaugagagaacagccacuucggucuauucuucagcuaucuuucacuaggagaagagauuuggggacaugauuuaguaaaucuuaaaaacguucagccuaaauguuuggaucugaguuuguuuguuugauugauuuuucuaagguucucucaauauugccacauaauucuagauacucccagguagagaaaaauggaacacuaaggcacaaugagccaagaggggaagaggaauaucucccaauuuagauucaccuccacuugacaucagcaugaauucaaguugaaaaauauugauuaugcccugggcaaugcaaagacugcugcauguugugagaaaaucagggaugaauaugucucuguauugaaacuuugucauguuauauagaagauuugaagcaccuuaagaguauggcuacuacacaggucuugacuuuacaaaggucacagacuagaaagauccaauuaguaguuuggggcccuggcuuuagaaucagauggccaggucugaacuauuaaucagccaaugacaaauuaugugacucuagguaauuugaaauaccuucucauuuuauagcauuuacaaaagaaauuaaagccccugcucuucauucucauccccauauacaacaaggaauaaaugaggauauauuaauauagaagacuuugcacuucaucggcaaacaccuuucuaaccagauuuccuaagcauuuaccauaaaaugacacugcagaauaaauuacauuuguuuuucugauguagguuuuucuaaguaacuucagguaaguauaugucaaauauauaagagcuaaacauagaaauucuacaccaucauuauucaucuauuugcuuuguucuauaaagucuuacauuauuuuguauacauugaucuuuguuacuuagugauaaagugauaaaacacaugggugugccacgcgaauagaaaaacagacaaguucugauaaaauuagacaaggagcuacagcaaauaugauuccaauucacagagagaaccucaguuuauuauuuuccaucuucuuuguguccccaucuuacuguuccccuuaacugccguuauucaucuguuccccuuaacugcccuuauucaccuaugauucccaucuuucuucuaaauccuaagucuccugagucugggugccacgucuuauuuguguuuuugguaccaugccugacauauggaaagcauuucauacacauuugcugaaugagugaaugaaugaaucaaucuccucccaacuauuuucaacauucaucuuucauaauuuuugaaaggugucugcaaguccacaggguuaaggaauccucuugccuguguuggggcucagcaaacaauacccugaaauauggcccucugacaugcugaauuaaagaagcagccucaaggucucucuaaccaacccugcuccugucgcugacucuuucucuccaaaagcacuggauaaagcuguucucugaaguucccuuaucuaccuggaaacuagauccaccaaugagaaaugcaauuagcuuugauccccucccuaaaauuucauuaaucagagaagauuaaauucauaucauagaggaagagacuaaaaauuaaacaccacaccuagggcccaggugaacuuuguccccaaguauugucuguuuaaugcacaaaaagaauuauuuacuaaucauugucuggacauuuggcucauucacucccccuaaaaauuauuuacugcucuugaaauugccauauucuccccaucucaccuuucccuaugaagaaggguaaauaagcaucuggaccccauuggguuauugagugaucacuuucccgugauuuuuccccugugcacauugaauaaguuugugugccuuuucuauuuaucugcccauuguaagaucauuuucagggaagcuucaaaaaacagaggggaagccuuccucuuuugccccaugccugucaaauuaauauacuuguuccucuugguuccacauuucuuccauucaaugccaauaaaaucuuucucaaugguaccacuccacugcuaucuuuuucaccgaucuacauaaacucaagucuucacauuuauuuuacauaauguaaacccauugugaucugugcaagccuauguauuugauauuccuuuaaucuuuuucuccuaauuccuuucugaaaauucauuacuucuuuauucuuacuuauccucucauuuuucuauaauagaaaaugaacauuaaacaguucccuuuauagcuguuuuggaguaaucaugcauuuuuccuggcuuuaaucauuugaucccaaagaauaagcugggugugggcagcaggaacugugugcuuugauauccuuggugcuccaaucagcuggagaacaauuugguauugagcaguuccugaaaaaaaaaaugcuggcugauuuuuugaacugggccaagagccaugaaauaucuuaacauuucugucaguggcauaaugcuuccaugauguaucucuucauccuuggccauguccuaaaaguaaugucaugauuugcacucugaaauccaucaggauuauucauauccccaggaaauggucugaauacaccuuucugaucaaaaacaucuaauauuacccuuuuacauucucauuaacaaccacuuaugacuucucugcauaugauuacaauucucagaagaagccaagucuuggacuguuuuuaauguaucgaaaacucaaucuugauuucauaggggaauuaagguuauggucagcauccucauuucaccacuuauacagcuggaagaugccaaauguaagaaaaaaaaaaaaaccuguaucagguuugaauugcaacacuguaucaaguaaaccccaaagcauuguuucuaaugcuagaaauauuuuaacuaaguuaguaugccucaggcuagccuaacuguauaaggccuaggauagcaguaacuguuuuaggugaaaaaauaauccuauucacaaggauuuuaacuauaaggcaccagucaccaaagcaagacacuucuuaacucucuugccaguagagcugcccugaaaguacuucaagucacucuacuuuugucuccuggccucccaguagguuauuuuccuuuccuccccaccucucucgcacacggguaacccugcaacacaggcacugugugcugccagccacuuuguguucaaaaugcaucugagauugggauucuuguggccauucaguucauagcucuaucuccgcccucuccucugccaucggcaaacugcccaccaccacgcacuuucccucuuuaccaguguaguucaaauagcccugguuccuuuccuccuucaagguggcugauaucuuucuucauggcauuacacucacauccacuguggaauauaggcagcuccccugaugcuuuacaucaggcugcccacaccugggcaugacccccaaauccucccuaugacagcccuguuuccuugcucaccuugagggaaaacaaauggguuagugcucaggacugaaaauaaaucagaaaaaaaggucaucaagagcauacaguaaacucugucuuuagaaggccagacaggcucauggaauaaacuuguaguagauguuuguggguuuugauugaccaaguaagcuacauagagcuucucaacaaugugaaacauaaaaucaaaggauaauuagaguaauuucucaaagcauuugcugaacaucugcuggguacaaggcacuagggaaacaaaaaaugaaaaugcaauaugcugucucuuucuauaaggcuauuacaaccaguuguagucccagaggcagacagguacaaucacacugagauggcaucgcuacuacacuagagacacaggcaaagcacuagagggcugaaauuaccaguaauuacuuacaucucggaaaagacgaagaugugaaggaacaucaggaaaguacugcaagaagcaauauguaucugcagaacuuagagggcuugaauaauccagcuaaccauuucaucucuccacucgcuuaaaaaauauauauauauaagccacagaaagucaaaauaggcuagcuaaaauggaaaauuccuuugguaaaaccuuugcuaaacuaaauggucaagaggaacucuucuucaauauuucuucucuaucaaauauaauauuuugugcuggauauauucaaagaagugcaaaaacccccaaaucuaauauguuuaauuuguuaagaaagcucuugccaaauuuugagcaaaauuagcuucaauuuuaauuuaauaacauuuagcaauucauucuugguucauuuuuuuucacauuaucaacuuucuaaucauuauuauaugccaguuuuuauacgguaauuaaacacuggcuacuaagagcuaaauuaaaaagagaacuuuuuaaauuauaaacacagacaaaaaauuuaagaagucaagaugauuucuuuuauaugacuuaaauuauuuuauuuugggauguaauguaucgcauuucaucuaugcacacugcuucuaacuuacuaagcaaaggaaugaguacucccauaaauuaaucuuccauaauauauggauuaguuauuuauaauaaauaguuaauaacauagacaaacauguaaaacuacagaaaaaagccugauucuugguccaacaaauuucugaauuuggaaguuaacuuuuaaaagaauuugagugaaaaaaaccccacugauuucaaaacaaguuuaauaguaacucaaguuuuagauaaugcuuuucgauuuaucuaauguuauggagaauacuaaacauuuccauuagcggcccaucaucaccgugguuaccuccuucucccucucuccacuucagauauacaggcauuugcucaaucaauauucaguggacauccacagugaacaaaucucucuucuaggcaccaugaacuacauaguugaggaaaaccaugaacuacauaguugaggaagacggguuuugucugaaaggauuuagagaccagccagggagacagccaagaaaaucaacaaccaucaugcaguuaugguagaaauagaagcuggaugcuagcuacugcagcaucccagcagacugaggaagguuuguuggaggagaagaugccugcacugaauauagaaagacugaaggaugcaggaauguuggccagaggaggagagaaagcuacaucagacaaaggaggcaugaauuucuaucauuuccaccuuuccacccugagcacaucacugaagucuguccccuccuuuccauccucacugccauugcuuuauuucagaccuucaguauuuucuccuggaagauauuaaucaauuaauuuccuagaguguuuuagguaccaugauaagcggaggccaagugagagcagaaacaagaggguaaucccuuugcuguggcaggcagcuucuuuaaucacacacagcccaaccaggacauucuguaaaagugguugccguuaggucccaaucccucaaggaaucucugcauaccucucugucucccagugucauuucugaacccccacauacugauuuaccaagaauacauacagcuguguugcuaaguugaauuguaacuggcuuuauguuauccauugguacuuacacguguauuguaccacauguaucauguguaucauuagagaccaggauguucaaccuuguagagaaauuaaccaaggaacuagaauucauuuuuauggcauuugaauuuauucuuguaggaaaaagcuuuaaccucauguaaacaugauaaucauucccauuuauuguuauccuagaaaaauccaguuacuuuucacaaaaaaggaauucacccuaacauuuuuuucaacaacuaaucaccaaaugauucuuauccugucuccagaagaugguguggauaggauacauggaaugcauuuauucuuuucuaucuguuaucacaggaaagaaauaaauacuccagacagguauucccaaaauuacacaggaaacugugacagagcagagaccagaaccugagauuuucaccuccucuagcgcuccauucauuuuuuuccaucugaucucccugguccuagacguaguaguuuagaaacaugccuucuccuuguggcugagugugcauaucauuucccaaauauauacuacccggccauugcacaggagaaaggacucagacacuaacaaguaaaaaucacugauuccuuuccauccaauccgagaugccuuccccuucucacuuacuagcacucuuacaagucgcacuuccauucacucucuuaaaggcucuucuccuuggauguuuucaaggaagacaacuauaaugaguccaccaagugagguccacagaagugaaucugcguccuuucucauucucuuggugucuucauuguuacaggacuugugcucugaagucugaugaacaacauacagcuucuauuuguuuuauuuccuggggaauaugcccggguucagcugugagagcagggacuuucccucuuaauguauuugaaagguuucuuccccucuuuauuuuaucauuuuaauuaauuuuuuugugugugugauggagucucacucugucgcccaggcuggagugcaaugaugcaaucucggcucacuggaaccuccgccuccuggguucaagugauuuuccugccccagccuccggaguagcugggauuacagacacccgacaccacgcccagcuaacuuuuguauuuuuauuagagauaugggguuucaccagguuggccaggcuagucucgaacuccugaccucaggugguccacccgccuuggccucccaaauugcugggauuacaggcgugagccaccgugcccggcccccuucuuuauuaacaacaggccuucacuaguauaguccuuuccaaaacugcagcugaaaucccuugaauguaugagcccuucaauaauuuugcacugugaguggcaauuacagaguaaaccaggcagcugaagcaaagguggggcaugugucuccggauaauggagcacucacagaacccucaaaccacuaggugauagcuaugcaagcucggguuggaggguggagaugcagagugggaaacagguuuccauggaggccuccuuuuaagugagaguucuaaagauggccagguccucucuaucuacaccagccaccuuuugaugccgccuuacuugacuccuuugaacaggugugcuuuaagaaccaaaguucuccagagaaaugcccauuuauuccagaauaagaacagaagauacuagaucacacacaaacacacacacacaaacacaaauacauuuuguguuuacuaguccaauaugccaugcugagauauauuuuauaaaauaugcagggaaucacuggguaccuuagggacuccagagugaaagacugaaagccaacgguaguucaggugaaggauguggcauuuuuuuuuuccuccacagugcuauucagacuuaguuuaauuucuuccaauauaaauguguccaauuuuacuuauucugcuagauuauaagguuuuacauaauugagcacacucagaucuucuuucuuucggauacauugacaacagucccccucaguuucuacagaaguccuaccugagucacuuuaugugaaucugccacaaauaacccuuggccaauugcguuaccaaugacagggucucacagagacaaauuuauaauuagaugugucacuugaagugcuggcaaagagcaacuuuaagacugaauaaaaccaucaaugcuacuucagaaucuccuuuggauucuucuuguaugacuacaggacacauuaagucuaauuuauuucuucuucugcuccucuagagaaacaaaaagagaaaugaggaggaaaaagcucccagaaauaaaugaccauccaguaaauuuccaauuacauaaaauguccucaauauguuaggacagaguuuggggaaaggguaacuauucaauacagucauugauucgaggccaaugcugggugguuuaucuuccuaaauaaaauugcaauugcaacaccaaaagaauucugacacaaagccucugcuaacagauauuuuauggguaugccuuuuuuaugacccuguauuaaauauucuguagcuucuggucugugaaaauguaauacaaaauguuuaagcaauaucacuuuggaaagaaaaggaacaaauugucuacuuguuguaauaauacagcuuuccuauuuuauggguuuguuuaacauaacaauacaaauuauuuuucaguuucaugaagagaauuucacuuguuuuuauuuuuccauuuucuuugaucugugucaauguucacuuuucacaugagaaauaaccuggcaugacaaauugguaacaaguuacuuuuauucauauuuagcuuuuaguucauaauuuaaaaauuaugauauuguuuuccccuucaacuguuuaaacaggaucucuuuuucaaaagaagaaaauguuuccucaccuuuuuucuuacccuuguagagucaaacuaugaagucauuaugacuuuaauuuaaaaauacucuuagguuaauguaaugccaugacacacuaauucugaauuggcaaugaacaaauuauaaacauuuauuaaacucugcuuuuuuuuuuaauaaggccuugagauaaguacuggacaaguggagcugucagaagaugucccaggccacagggagcucacggacccauggugggggcaggccaguaccacagacagcgaugcaucucacacaacacaugaggcuggaagaacaggaaggggaggagagaggagagacccuaacagcccauggggaguaggggagggccuucuagguggcagugguggaacugauucuucaaagaaggauguuguuugguagaucagugguuuucacauuuuagauugaacuuuuuaaacacagaguccaauacugcuuucccagagaauuauaagcagcguaucucagaugugacccagagccuguguuuugaauaagcuuccaucugaucuugauucaaguggucccaggaccacccucagagaaccacacagccgacagacagagcugaguaguggagcugggaggggcacaucaggcagaagaaccaucugugagaccagaguagggcagaaggcacaggcacagaaggaucgagaaacuggagggugacaaucuuagacaugcaggcagaugucugaucaugaaggccuugcuuaucauguguagaugcuuguacaugauccuaaucaguuuaacuauuuaaaacaaaugagaaauaagaucagaugugcuuaauaacuuucaauguuaguaacaaaaaauugagguaacaaauucuuuccauuugauuuacugcuccaucuuuuuuuuuuuggaaggaaggaagccaugaagaaacaaaaaacaccuuuuuguuguuguuuuuaaugcaggcacuaaugucagaauacaaugauuuaacaugcccaccaaaauugcaaggaugcugugguagcagcacaucuuguaacagacgaugccagguggcccauaaauacugcagacaccacccauagccacacacaagggggcuucccagacagcacccacauucucauuagcaccaugacaguuuugucaucacagcucugcggcccaggagagacuacugcugggagaugccaguguacacgagaaauagcaguaacaggaugccgugaucacagcacacccaaagaaacaucaguuaucgguuccaguaaaaagucuaaggaucacuacucucuaucccuccccaccguagagaaagcacaggcaaugauguguagcacuguagcuggcagugaagggcggagugucucccuauccccaagaagaucauccaacccaaggaaagagcuccacaaugaagggaauaaaaaauaauguagguaaugaguaugugcauauauuuguguccugacuauauauuagcaguaauuuuuuuuguuauuucaggugaacuaaaagaauuaauuaccuuuuccauaaacugaguauuuacuauuucuauaaaaacacaugauuaauauuguacuuaacccaaggaaacacauaucccauuuuucuuuuaguuuguaugaaaacaucuauuuguuuaauuuuaauuuguauuacuuauuuuuaauagagacugugucucgcuauguuacccagguuggucuuaaacuccugggcucaagcgauccuccugccuuggccucccaaagcgcugggauuacaggcaugagcaaccgcgcccagccugaaaacaucuauuuuuauuucagcacauguuaauuaaauuuaaaauaaaaauuugaacucuaaaaggaaaacuaaacucuaaauuaaauuacacagauacuauuugaauaaaggcuggcaccuaaaauaacauaacaugugccaaagaauuauuugguccuuggcauaaauucuuuuaguaaagaucuaguaacaauuugggaagguagcugagccuaaagagauucugcugaagguaaguaaaaauguuaauaaaaacugaauuaagggcaaagugcauucuuauugcauuuccucaagcuuccaauauaauuuauaucaacuacaacaucucuggaacauaagucugguaaaaagaaaauauugcaggucugaagaaucuguaaaccauauuuaccaagggacaccaacaauacuauuuaagaauguauguacucaauaaucuaaaaccugugaggagccuccucccuucaagaugauggcaaacagacucacaagcuuaaaagcagugucccaguuuaacaaaauauguggguuuuuggggccucauuaaaugggaggcccauugcuccagugcaaaguggggauauucugcauggucuuugugugauuacauaaagcgaauguuugaucagcuguugacaauauuugcaaauaguaacagauugaagauggguaguaaaacagagguuuugacauuuuauaaauucaaacucacuguccuucacucccuagcacucauucugugauuucugaaccuggucuucucccugugccacagauccaacccucccccaucucuagugacuuuaccucccccaggucccucugcugcaaccucuguuucugagcugaugaugcucuucaugcccagacuccuccuucgugacucugaagccuuuucuaacuauuccaucuuugucggguucucuccuuuccccaaaccacugcugcauauacagucagagcuacccuauuuggcugauagcacuuuaugcacuucugaaucucuguguaaguuucuugggagcagguacuuauucacaaguauuuuuagaauucuauuugcaucucuaccacaagaauuauagaauaucaugcuaagcacugaaaucuuuuuucaguagaacuugaucugcaaacauauucuuugucccaggaauaucuguaaagagcaacgugacccuguuacugaauccccugggugccugccuuuagauacugucaaggagaagagaguucuauguguuaaccaaggggcacuuuuagagcaugcgagaauucauccuucgauaaaacauaaugccuuuuguuugccagugaauaaccuguaucuccucccuacauaaggagauaaaacaugaugucuuuuguuugccagugaauaaccuguaucuacucccuagucaagugagaagagaauguaacuuuugggagaauaaaauaccacauaaauuuuugguucuaguuuuagcucuucguaugguuuaugucaagcaucuagaagcauaucauagagucaacagauagcuaauaaauaaugauggugucacugaguaugaaauaucuguauaucaguuuccacaaaugacaaucaugguuaaacuuauccaaaaagaaugugauacaauuagaagguuacaagccaaguuacugcuaauuuaacagcauccaucuggaaaccaauguccaguuuugagaagaauuaaaucaagaaaauguuccaaaaucaagacaguccucucauuuacaaaaucaagcuaaagccugaauaguguuuacugagcacuuacugugugcagcacuguucuagagacgagggggcagagaauuuucuaagaagugaggaucccugccuucaaggaguuaauacauuccaccuagagauuaauggaagcuaugacaagugauaucuaaauagauauuuucagauuuuccuuuuggaaaccagcacuauaaacauguuuugagucucuguggguugccaggcacugugcuaaauacuggaaauauaauaaugaguaaaauaacaguugaaagaacucacaaacuagaaaggaagcuagacaugagcacacaaacauuccuauauaguuugcauauugauagcacauuaaauguacuuuguauggauauagugucucucuuaaaucuagcuccauuauccaggugugauggcuaauuuuuugugucaacuugacugccccaggaagugcgcagauaaaacauuauuucuggguguaucuauggggcuguuucuggaugagauuagcauuugaaucagucaacucaguaaaauaaaguagauggcccuucccaggguggaugggcaucauccaauccauaagcaccuggauagagcaaaaaggcagagaaauaaguaauucaccccucuugcuuuuggucuauuugcaugagcuggaauauuggccuuuuccuguaacugccugggauuuacaugaucaacucccuugguucucaggccuuaggaauuggacugaaauuacaccaucagcuuuccuggguguccagcuugcagacagcagaucacaggacuucucagccuccauaaucacaugagccaacuccuuauaaugaaucucuuuauccauaauauaucgauaugucucuauauauaauauauacauauauauaaaaugagauuucuuuauuauauauaaugaagcaccaaugggagauagauauagauagauagauagauagauagauagauagauagauagauagauagacagacauagguugaucucuaccuaucuauccauccaucuaucuaucuaucuaucuaucuaucuaucuaucuaucuguauauauacaauucucuuucuuuggagcacucugacuaauacacuagguuuugagaggaucccaccuauaauggucaugaacagaguaacagcaagauggcacaaaugccuuuuuggaguaagugacaggaaauaacaauuccaaaaacaccuuuugaguacugggaaaacucuaggcagaaguuggcugagaagaacuuuuucuaaauucacagaggcagucucugaaacccuucuacagaggagcuccaucaccaugauguaagcaggcccugcaguucuuuccagaguggucuugggaucacugcaaagcugcugagugauaacaaugugaaacaaaaacacagagacaggaauaaagagaagaauaaaauaggaauagggaauagaaaagcaucaacaguaaugucagagaaaucauagcuaaauugauacuuaccagauuuuucuuuuggaaaucggcacuauaaacauguuuugagucuuuguggguugccagacauugugcuaaaugcuggaaauauaauaaugaguaaaauaacaguugaaagaacucacagacuagaaagggagcuagacauauaaacacacaagcauuuuuauauagucugcauacuaauagcaaacuaucagcuaaacucuguguagcugagucagaaaacauaguuuaaaggcagaucaacauugacagucuccaacaacugacaugaccauauuccuacuuacaagugccagggccggguguacccccgaacagccaagaaaccaguaaccugagucugagcauguuuacauacuauuucauagcgcgacuucuuuuuucgauccacauuauaaaauuggcauuuuuccauauuguuggaaacucugcaaacaauucaacaaacuagaaaauguagaaaaauauaugaaaacauaccacccauaacaccacaagcaugaauaacccccauuaauauuuuggcacagauucuuccaugugccaguuugaagaaggucuugucugagaaaaacaaaguguuagaaaagaacaagaagaaaacaaucugaaccuagaccuggacuaugagggagguacuguuaaccuccuggauaaaaguguuaauguauauuuaaaugaaagcacuuauuacucaaaacaagauaguugaauuugaauuuuauacuagcaucuugauacagaagcaucuauauaugaauauauuaauacaaauauguauaguucauagagagcaucuauuacuaaauuccuccucaacuggcccugucauuuguuuacuguugucccaagauaaaaguucucuucugauauuguaagaaggagauaccaaggcagaacccccugagauacaggccauuuacuguuaccccaaaagcaugugucuugauugguagcuugugaauaggucuuagagaaaaugccauaaugguaacaucuuugugugggcugcucaugucccucccucucauggggacuccuuggucuaagaggccacccuuuuuuacucaagaaaaacuuguguagaaaaggaaguaguaagucaaggcagaaucaggcaacuaugacauuauuauaccauaauuuuuaccauggcacagacacaacagugacugcaggcuugucuuuuaccaacaguauugaaagaacaaaucuuugaucuauagaauuugaaaucauuuuaaggucaaaaaaugguacauacuacaucaguauuuaauauugaaaaacuggaguuaacuaaaugaucauaagauacuaagugaauuaugacauauucauaagaacaaaacacaaguuacuaaaauuauauucauuagcaugcaaacuuaauguguuauauauuuauaagucuacagaugauggauuuuuggcaaauuauuaaugaauaucauggauugguuuucccccuuauuuuucucccuguauuuuuaaaguuugcccaauuaacuuguauuaguuuuauaauaaaaaauauugcuuaaaaugccuuaacaacacaggaaaauguuuaauuuuaugaugguaauugaaaaaacaucaggcaauaaaauacuauauaugacugaaauacaaugacuuaguucacaguaaacaaggauuagaggaaaauacuucaaacuguuuauuucauaaucacucaacccauacgaagcaccuauauucccugaguacagugugguaauuaaaacagacaagguugccacuuuccuggagguuacacucuaaauuaauaagauauaaugaucaaauaauuaaagaagaaagaccuuuucagaugcuacuaagugcugugaagaaaauacgauaggcauauguaauggaaagucauugugagguggggcuucuugacacuguacaaucagggauugcuucuuugagcaaagauaucugggauggagccuaaauaacacaggaaggccagcacaugaagauguaaggacauaaaggacuuuaaauaacagcaaagacaaagacaaagaccuccuagauucaaugagcucauugggacuguaacacaaaaaggaagggggcgggagacugauucaggaggcauccgcaggaacuggcaaggauccgaucaugcaaggccaggguaaugaguugacauuuuauuuuacuuaauaaaaauucauugcaagauuuucaacaggagugugauaucaucugaguacuugcugauggaguagaagugaaguuugagggaagaagagacaucaagcauggauugaaaguugagagcuggagcaguagagagaugauggugccugcucugaugacugcuaagagggaacagauuauagggugaaagaacauggauauggggaaucaaaaguucauuccggccauguuuuguuggauguaaagugcuuaguaggcaacuggcuauaugaaucugaagcugcuggguaaagaggauaggauuggugcaaaaguugcgaauuauugucauauggaugucauuuaaagcacuggauggaaucauauaaaaaguauaaauagccaccgggcacaguggcucaugccuguaaucccagcacuuugggaggcugagaugggcagaucauuugaggucaggaguuugagaccagccuggccaacauggcaaaaccucaucucuacugaaaauacaaaaacuggccuggcaugguggcacaugccuguaauccccacuacucaggaggcugaggcaggagaaucauuugaaccuagggguggagguuguggugagccaagaucgugccacugcacucaagccugggcuauagagcaagaccuuaucuuaaaaaaaaaaaaaauuaagaagaacagucuuacccaaauuaauaggucaagcacaggaagauaagaauagcuugugauuuaucaagaaacugauuggcauaaugucauagaagaugaacagaaagauuguugaggaaggagaaauaaucaaucgugucaaaugcugcagagagauauaguaaaguggacagagaauuaacuacuggauuuggcaaaacugaggucauagguaacuucaacaauggcaguuuuaggagaaugaugagaaggaauaccacuggaggaagagaguaagagggaagcacagacagcaaauaagaaaacucaacuguaugaaagcuaccaaagcaagaauaguuggaagggaagguagaguuucauuaaaggugggugauacaaaagaugaugaaaagaaaaggcauuagauacaggacucaaguggaggggcugcccuucacuguuguagcacaagguaaggcagaguacacaguacagaugcagguaaaauggaagacauugcaaaggauggauaaaggagcuuucaucuuuuaucuucccaguuuuaacagugaucucagaugcuguugguaaauuuuauuuuacuguugcaauacuuuuuuuguauuucccacuuugggaaauucuacagugaauauauauuauaaucauaauuuuaaaaacacuacuuuuugaaugaaacuuaaaaccacacuggaaacacauguggacauuuuaaaacuaguaauguuauacaagugauuuauuugaacuuacauuaaaaagaggaaaauuuuuuuguggcacagucucugcccuguuccagcuuucuagcugucaaaauguguacccuccuuggcuauuucuuucuaaggcuugugcuuggagcaaggacuugagaaacuguacuaauauuguaacuuuggagcuuaaccagaaaauggaaguuuucuuugcccccuaucucaagucuaacauaaaaaugucauauauacaaaaacaauuggccuagaauauuccaaacuccugucuuccucauuacaauuuuuuuuuuuuuuuuuuuuacaaaaccauuuccugcucuuuuucauccaauucugccucaggcaaagggcauucuaaugauaccaugaaacacacaguguuuugcuauagauuccuuuuccuuucauuuuuugaugaaauacuaaggcaguuuucuucauugguuucagaagcuaaguggaugcaauuuaggaguuuacagaagcaccaaaaucaaugcagagaggaagaagauggggccaugaauguaaauagcuuauugacugagcaacaggaagaggcuaaaauauucagccagcacuugcuugugauuaucugccacccucuuccuuccauggggagggaauggccuagucucacugagcucauauugcuuuuaacauguauaagagaccagacagauguuuaagguuuaaaaccuggcauuccauaaggagaaggauauuacugaucaggauuacaaguauuacuuuucuucuuaguugaauaaguuauuuuucuuaauuuaaaaagauucuguuggaagaggacaauucaccucaucuacauaaguauuggcucuucucaaauacucucuauuuacacuuccuaugugauuccauccagaucugugcuuucaaugccauucacgugacaaucauuuccaaguuuuuccccaauccuaucuucuccacccgguuucagauucacagagccaacugccuacaaaagcacuucauauccaacaaaguguggccggaaugaacuuuugauuccccauacccaugaucuuucacccuaaaauguguuccucucuuagcagucaucagaguaggcaccaccaucuauccacugcuccagugaauagaugucaugcuugccucaacuuuggagucaugcuugaggucucuuuaguuugcugcuguuguuagaaaauuuaaugagaggaaacccuggcugaacagagaaacucuuuuuuucaauaaacaugauccugauuuguaaacagugugaauucuccugggaaaaaucauccacugauggaaaauugacagcccuucccucucucuuuccuuugcuccccucccuuucuuuuuaucuacccuccuuuauguacaggaauaauuuauuuucucuuuugaaauccuuuccauuaaugagaaaucccucaggaaggaccaagcaucuacgcaggaggcuguagucaguugugagaauuuuaaguacuuggugguuuaagcuuucaccucaucuacauuuguaauaaaccacucugagaaauaucuuuuguuauaugcagugauucucacuugcggagggggaugaaugaggaggaggugagaaaugugugcaaaaugaggaggugcgaaccuguguguggcagaugaguuccccagagauuuguguaggugacugccuaccaucuuccuaaucuucagaaggacugauggacuuuuccccccuuccuugaauagccagaagaaacuuuuuuuuuauuuacagugaugaaaacaaaugccugaacagggcaguuuucaucuauagaagauucucauuuauccuguggauuuucuauggccuaguuucaauucuauaaaggucucuacuaaugcuuuauaaauuucaggcucacuuugcccucaugagucagugaccacucaggaaauacuacauuuaguaccagauuaagcaaacuauaaagagagauaaaucagcgggaaaaaucaugcugcauacaaaagacaaggagaaauguuuugggcuguaucucauagccuggauuaucaacaucacuauuuuccaacaaaacaaugccuuagaggcauuguaauacuuucugaaacuucuacuuguaucucagauucagagaaauggguucagccauuuugaaaguauuguacaauuaauuauguaauucauacaugauucaagagaaaucucuucuucuccuaucugauagccaucuuuaagucauuucacaagucauuagcaacccuaugggucaaugggaaagaaauagaaggaagauaaaggacaguucaguuuguugcuuacuagagcccugauagaauucugguaaaugcaagacuagagaagaaaacagaguaaaauaagguuucccagcauucuaccuuggaauuucaauuauuuaugugcuucuuggcuuccaccacuaugaauaaucaagagcuagccaauaugaaggcagcuaugaaaauaaguacauuuucagggaacaaaagaaaucaggguggaacuaaaggaaaggaugaaugagcccaauuuuucaaaucuagaaauuguagugaaagaaauuuaauuugcuuugaccuccuauaacauuuauacuuguaccaacgauuuugcacuuagcacacacugacuugugccauuauuauuguuaguaauaacaauaguaauggguauuaacugaucuuuuacuaaguucuagacuauccaaagcaccuugcaaacaagguuuccaauccuuucagcaaccuccaagauaaguauuaucauucgcauuuuacugagaaggaauccaaggcucaaggguaaauaaccugcucagggccacaaagucugcugggccaguaagggucgaaccuaagacuggcugaccccaaacccacuccacacaguuuugccaacaucugauagaaccauuugcaggucucacucucuuucuuaguaagacuguaagcauccacuggagaguggaaguggaauuucuagugggacaagaccuggaauuuccauauuucuacaucacugauuuccaguggaguacuuagugagucuccauuguaucaggagauuuuuguuuguuuucaugucauuuuuuuauuuccacagaagggcuagcugcagcaaggcaguuacuguguggagagauaguaauguuuuugcuaccaacaguauaggcugggucagcuaacacgguauuuaaaaaaauguauugcaacccugucuuagcacuuacaaaugggugguauacauacacaccuaucccagggagccccacaaaccugaaauauuugaggcaaauagugguuacuuauaggucaccaaugggagcagacacagggguguaaacuguaucaccccaagugguuacuauuaccgccaauaugaugacgauggucagggugucuucuuccacucuaaagacagauuuaccaguagaagaggcauugcaaccugucauuacaaagggaaguucaaucccaccagcuugaaaagcaggggucacuuugagccuccuuuuagaauaaaggaaaaugcuaaccuaucaggauaucuaaugucaaaagaaaaacaguguaguuccuugcuggauuacucugccucaauaauuuagaacaagugaguagcucuaaagaaaggauugaaauugugucuuugcuuaugaaaaauuacuaaaaaucauuugcauaucccuguuaauccauucaaugguacuuaaucagcacacaacagagacuucagcacaaaugcugcuaucuucugaggcagccacagcuugcacaagggucaaaacugaacucaaagaaauguaaauuuacccuuucuauccaaagaaagauguauuugacucacugauaaaugaaaugugagcuguuucucacaaacuacacauauaaucuuaaaaaucuuuuggaaaccauccaacagacaaaaucagcuacucuagaaagaauuucuuccaaaaauuguuaaaaauuauaaaugcacuaucagucaauuugggcaauauuacauaccccuccaauauuauucaagaaacaaauagagauaaaaaagaaauucuucaauucccaaaauuuuauagugccuuuuuggcuuaauuuuuaguagacaaaagagcaaacucucccuuuuuaauagauaaaggguugugcuucagccuacagcucuccuguccugcucuagccacaucaagggauuccuaagugaccuuggcuaaagcaguuaaccuuccugcauuuuaguguggccaacugugaaauaagaaagauaaugacaacaaaaauaauagggcucagcaucuauauaccucacugaaguguucuuacgaauuaaucauacugagcuuugaaagugguuuuaugcucuaaaagcauuugacaacaguuagcaaauucccacauuaauguacuauauaugguccauaggauuaugucagagacuuugcacgauacagugcauucagguuauuuuguggacaagacuuuaggugacauuaaaagaaauauguucucuaggccgggugcgguggcucacgccuguaaucccagcacuuugggaggcugagguucacaccuguaaucccagcacuuugggaggccgagauggguggagcaccugagguccggaguuucagaccagccugaccaacagggagaaacccuaucucugcuaaaaauauaaaauuagccgggcauggugguucucuaauugcuuuugcuauuuaccccagggaggaacaagaaaguuaauuuuaaaaauugcauccagugcuauggucugaauguugauguccccccaaaauuuauauguugaaaccuaacacccaauaagaugguauuaagaaguggggccuuugggagaugauuaggucauaagggccccaccuucaugaacgggauuaaugcccuuauaaaagaggcuccagggagcauauuacccgcauguaagggcacagugagaaggcaccaucugcaaggaaauaaccuucacuagacacagaaccugcuggcaccuugaucugggaauucccagccuccagaacugucagaaguaaauguuuguuguuuauaagccacccaguuuaagauauuuuuguuauagcaauccaaauggacuaagacaucuaguuuaguaagaauuauaaaaguaucuaaguaaaaggucaggccuugacaguuuaaaugugagcucugcgaacaggugauggauagcuugugaagugaggugacucucccuuuuaccccagcagucuguuccuuuuccauuccuguccuuuacaagggccuccucccuuacucuccacugaaucacauccuucucuccuaucaaaaaugcaacuucuaaggcagacuuuucugauuagacacacucuccucaccacgugaagaaauucuuacuaccaaaugaagcuauaauuguguuuaauuggaucauguaaugcauaauuauuaaucauuauaauguauuuuauaaucagcgccuaguagccaggcucaggacuccccuuccugaaaacaugaagcaaaguacaucgcucuucaguucuauggucacccaaugaauggugcuaauuagauuuaaaacaucuuuagauauuuaucauagauagcauaagacgucaaaaaucaauuguuaucaauacaucaauaaccaccucuuggauucaaccaugggacuuugcagauacagcuuuagauucuaucuccuucaucaugaacucagaggguguggacauaaaugccccaauagaaaaccgucugcuuuauguggcuccuuuccuucaucuguuggcuuucccgcuuuacuccaccucacaaaugaucugaacaauaucauuuaaggacucccaucucuccuguuuuacauaagaucuaccagcaaaauguucaguccugacauguucuuugacacacaguuuuguggcaucucauuaaguaguuguguuugauguccacaucaaaacuggugugcaagucacugaacaaugguaugagaaccuaaauacugaccguacugggaggucuaggaaccuugaggaauuguuuugcacagcugauacuuucuucuuuuucuagagugaaagaaucucuuugcuggagcacgaaccuggaagucagggggcccagguuccagucccagcacuguuccugaucaggagugcuuccuuggacaaggucuaucaguugucuacaccaaugcuucaucaaaaggguuagucuugaucaucucucagcuccuucuuaaucuuaaaauauauagaaaauaauaugauuccauggcuuuucauacacauguuuguguuaaagguauaucaaaggaauggagaaguaugcuguggcuuuuuuuuuggaggggagcgggggauagggucucgcucuguuacccaggcuggagugcaggggcaugaucucggcucacugcaacuuccaccucccaggcucaagggauccucaccucagccuuccaaauagcugggacuacaggcacgcaccaccaugcccggcuaauuuuuguauuuuuaguagagacgacguguuucacuauguugcccagcccagucucgaacuccugagcacaagugauccauccgccucagccucccaaagugcugggauuacagauguaagucaccaugccuggccuggcuuuuugaauuugaauuuacuauacaacuuuuggauuuacuacacaauuucuaaagggcuggaguaaaguuuagaccucuguuuaaagauccacaaaacuaacaguccccauaaacaagaaaagguaacagaugaaauuaaaagcaagcaccaauucaaaucaaauccaaacugcuauucuuuugccuacaguuggaaaccuggagacaacaaguaauaacagauuaaacaaacaaacaaaaaaaaaaacaggaaacgucacagaauuaagaagauccuauacagaacuucugcuucucuucuuccucuucacugagugcaaaacacgcaggaauugcuuggauucuaaaacacggaauuccgaaacacaagaauuccaaaacaugcaggaauugcaggaauuucuuaugcaggaaucucucucuuagagacaauagagccacaauacaagcgcaaaccaagagggagguaagucucuaaaagccugauaggggaacaaagcaggguagauaaaaaucauagucucuaaguggguguauggauaaaucagccuuagaggacacccaaaagagaacaguccugguuuagccaccgguaggcucgcucucagguacagcagucucuguguuaacuccaucuccacucuggaaaaaaucaugcuggaugcaaugaaugcagguuugcuggagucuuuaggaaaaagacagggcuacaguaagucaguagcuacuaaugcuacaucuguggccauguaaucagcuguacugcuaagcaucugccacaaaauugccacuaugacaugugaacugguaacaccacaauuagaacaauaacaucgcaaagucuaaaggaagcuuuaauuauucauuuaauuugaaaaguaaagcuggaggggacagcugcuaaggacacaguuuuucuuuacucauugcuacuuauuuggcuuugggauuuuucuauucuuaaugucacucucuucccauuuaaugaacccugauuuuccuggaaguccuauagaaacgagcaguauuaaauccaaguacuuccgauuauuucaagcaugugggcaaaacauuagcucucugcaacagaugaccaacucaaacuccacuggaaugagggucacucugcuauuuaaugcacucaaaugguguaauuaaaauaaagauagugacugcaaagugccucuaaguuuagacaacaaagauuugugagucuaccauggcacauauacacuacuccaagacuuuauaguauagaaaacgagaaacguauuugcaagaaguacaaggcaaaaugugaagcaaugaugccacauaagguuuacaaauuuggagccauuuacaaggaggaggaagggguaacuuaugauuggggaucaaagaaggacucauggcagaagugacaugugaaguaauuccuagucugggccaugagggaaaauagcauuucugacagcuggguucgcguaagggauaacucagaggcaagaaagagcggagggagcuucaaagauggggaaugguugcaacuagcugaagcagcagagagaaggccugaaagagaguggaaaauagguuuuagagggcucugaaggccugccucaagagucuacauuuuauuuggaagccaagagauaaaccaacaguuuuuaauuagaaagccauaaauucacgaugguucuuucaagauuaucuuucugaugaggaugugcaagauuaaauucaagggaaauaccuggaguucacuugggaagccacaauuaaauccucggaaggacucgguaaggacauggaguggggacaaggggaaaggagauaaucucuccuucuaaaguagggcuguccaauacaaauuucugcaaugugagccaccagccacaugcagcuacuaagcacuugaaguauggcuaguucaacagagaaaguaaauuuuuaauuuuauuuaacuuugauuaauuuuaauuuaaauagcuacaugugguuaguuacuacuauauuggacauacaguucucaaguaaaaaauauguacagguaagaagucaagaaaaucaggcaaaaugacauuaaagauguuuaaacaagagauggcagaaauuuacauuacuuuugauaguuucucaaaauguuuggcaugagccaagggccucuuaaaauacauuaagcugugaccuucuggcagaugggaacgguuuucauucaucuuucuaucuccuuaucucuaguacagugccaagcgcuauaaguacucaauacugugaaugacuaaaugaaugaguuaaugaaugaguacauugugaauaugaagucuagaacucaccauuaaagaauuacugauuuagggaaaucuguuuguaggugaagauagcaauugugggcugucuccauaaugucauucccugagugaccccaaaauaaaaacucuagagcauaugaacuaaacaggcugaaugauuagcauucacuuucuuaguaaaauagguaauguuauuuuuguucaagagcauuaaaauagccaaaagaauuuauacgaaugcuggaaccuuaacaucaacauacauuuauaguuaaaugcuuuuagaaaucaauuuucugauuauaaaaggaauacauauuucuuguagagacuuuggaauguauucaaauaaaagagcaaauaaaaauuaccuacaguuuuuaaaucaaagacauucauuguuauuguguuuccuuuaugccuuuuuuccuguguguauaauauacauauuuuuuccaaaaaaagguaaauuuuuauauuauaagcaaugucaauauucuuuuuuauuuuuauuuauuuauuuauuuugagauggaguuucacuccugucgcccaggcuggagugcaaugacaugaucucagcucacugcaaccuccgcuuaccucaaccucugccuccuggguucaagugauucuccugccucagccucccgaguagcugggauuacaggcaugcaccaccacguccagcuaauuuuguauuuuuaguagagauggaguuucucuaugcuggucaggcuugucuugaauucccgaccucaggugauccucccaccucggccucccaaagugcugggauuauaggugugagccacugcgcccggccucaauauucuucuaaaacaauuuuaauagcuguauaauguuccaucaugugaauaugcccuaauuucuauaaccauacuccugcuguuggucauucagguucaugccaaucuucuagaaugccauuuggugauuuauauuaagaaacuuaaaauacuuauagcauugaccuaggaucucacuuuuaggaacauauuauaagaaaauaggccaggcacaguggcucacaccuauaaucccagcacuuugggaggacaaggugggcagaucaccugaagucaggaguuugagaccagccuggccaacaugaugaaacuccaucucuacuaaaaaaaaaaaaaauagggaaaaagaaaagaaaagaaaaaaaagaaaagaauccucaaugggcaccaaagcauuauucguaauacaguaagacugcuaaaaggcuuuaacaucaaauaauaaaagaaucauaaauuaugucacgugaauuuuauaacacauguaaaaguuguuuaugaaaaaauugaaaugagauaggaaauacuuauaaaacaaaaacacacagaaccaacuuacacagauaggauaaucaccacuuuuuaagacaaaaccaaaaccuguugcauagagacagagaacaaaagccugggaauggcaaaauacuagcaaugguuguccuugacuaaaaaacuguaaaguaauuuuaucugcuucuaccccagccuucccacauaugaaaugcucuauaauagacgcaauuuucuguuagugaaucaagaguguccugguuaagaacacagggugcucugacccuaucaucaauguccucaggaaagacaucagggcucauggugauaucuaagaccuucucucuuauuguuuaggacaucaagagacaaguuucucucuauuuuuauauagaaaagcaaacaagcaugauuucuaagcaaagaaacacuucacaagaaguuugcacacuacauguuuucaucccucuucuuagaaggugcaaggugaccuagcuuuaaaccucagaccauagucaaagaauguuaaucucaucagcuccccacuagaaagaaaaacauuacauuuccaugucagucucaggccucauguaggggaaucugccaaggguaccccauaauaccauucaaauguccugggcaggugguguucauuuauagucaugaccauugugcugaagcaauuaccccugugaaaaggcaggaagcacugugaaagcacacuggccucaaaugccaucauuacauuugcaggacuauugcuagucgcagcucuuagcgcugcccauaaggaaggcacugugcuaagcaguucguggcauuuuuuaccauucauuuccccugugguagauagggaaauaaucauuaaggacuuguuaauaaccccauuucauaaaugggagauugaaggauacagaagguaaguggucugaggucccucacuuaaggagcaucagagaugggauuccaccuuggcagccugacuagguacacagccugacuccuggccaccccgcucacucccauacagcccaccaugcucauaaacucugcucugaauguuauuuauaaaaucagguuggaguuuauauccuuauuuuaugcaaacaguuucuagcuaaugugcaaaauuauccuaaucaugucaaaguaaaaggaaaauaauucacagaagccccuuucuauagcuacagcucacaaaacuacagcuucacuaggguauuuaacuggaauuaagcucuauagucauuuaagauuuaauuggaaucaaaugugccacacuuaccauacugacauagucacaagagaauagaauugugccgugccaaaauaaauguuucucugacugagauuaugggcauuccuuuucaaauuaauuaguucagaauuuuccauuuuuauuaacagauugcuuauacuaccgaucacaugagcuggcagcuggaaagucauuuaacugugugacugugagcugccuauacugccccaccacugcauacgccaaccucaggccuugaguuagaacaugaaaugacugcaccccacucucccaucucacuuucuccgugcucaccacauucauaucuauagguagaagguagcaaguggaaaacaagcaaacuugaucaacuuccaggcuuaggaaaacagaugugaaccaaacagggaaaagucuauuuuccaaguacauucgcuauguguugcuuugagaccuuguaacacauuuuauuaacaugaaaauaugccucaaauuaaugaaucuauucagauuucaggguacuggucuuucagaaccucuuuauuaggcuauauuugccauuuauagccucucucacgcugaccgguugauuucauuuaauaggauucagugagucuagucaaucauguauggaauuucucuuauaauucauuuuaugauaauaccuuucauuuguauuguacauuguaguucucaaaucauucauugagugaucacaauauuucaguuauaggcaucaaaagaaaucaugcccauuuuagaggcuagcagugaaaagauaaguugugguacugcauggagcaacucaguugauccaucuggauaucuuuccuuucaacgaccauacuaggcuuuuuuuuuuuuuguaaguauaugaucguguaauaacugaaacauuauagauuccuagauuguauuauuaucucucaaaacuguuguaguaaaucaauauguauaauaugccuacuaagugccagauaccaaccuugaagcuggggauaugagaagcuugggauguaacucaauaauuuuuuuuuuuuuuuuuuuuuuuuuaguaauucaccagauuauccugcugcauggccaggguugggaccagcaguguuguagaaagacuucaggcuucaggaauucaagggccugggcuuaaaucuggcucaacugcuagccagcuaggugaccaaggcaguuauuuuaccucucugagcuucaguuugucuagagucaagggaaauauggauaaaauaaaauaguggauauaaagggucuggcacauggcagguauucugucaaugguaacucuauggaaaagggagauuagagaagaagaaagaaaaaagacagcucagccaacuugaucccuugcaucuuugucugggcugcugugacaaaauaccauaccccgaguaacuuauaaacaacagaaauuuauuuagcacaauuccagagccugggaaguccaacaugaagguggauuugguauguggugagagccugucuucuuuuuguguucucccaugguggaagggguaagguagcucuuggaggccucuuuuauaagggaacuaaucccauucauaagggcucaacccucaugacuuaaucagcucuuaaaggccccaucuccaaauaucaucaccuucagaguaggauuucuauauaugaauggagaggggcacaaacauccagacgacagcaccuugagaccauaagacuaguuuuauaaaaugugauguaacaagacccuaaagaaggcucuuucaaaacccagcacuuacuucaaaaaugcaggcaugcaaugacauuuauacuucccaaaugcaaaggaccagaugucugagugucaaagaaaaacaucccuucuggagaaaacaggcuggauaauucaucaguagagagauauaaaagagcaugcagcuucaugaauggcuagaccaaaaauacucaccacaggaaggcaggaaaucuguuauuagugaaaaggcuaauuacaucucauuuuagagaauguuugcucuacuggccaccacagggauccagggguggcaggugccagaggcauuuccaaugaccaacugggagugaagugcugucaucauucuccaugauacccagggguauagcucagucacuaggagagaugaccacaguauuggccacaucucugaugugcaggcugcagguggcuccaugaaaccucuguacuaaaaucauaacacucugcaaucaaaaaugcagaagcuuaucccagaucuaacugcuggcuguaaauuguggagcuagaaaaacaaaauugaacuauuaccuucaguaaggaguauggauucaaugauagaucacuuugcucaucaucuugagcaaguaaacuacacucaaaaucuacuaaugcgcuuuaagccaacccccacuuauuacaaucuccacaacaggcagacugaaggcaugaugucagguuuuaugguaaugcuuagaaaaagugaguaaaaaaucggcuaucacaaagccacaagcacuguacuuaccggcauugacuuugaauaccaugagggaaaggucaaggugagagaggcaugaaagagcugauuuuauucucaauacaugagcucaaauuuaauaacuuugccauaauuaagggagagaaaugcagagagaacgcuccuauuuauagggacuaccgaauucccaguaggaauuucaugucaucucuggugcuacccucaugcuaagaggcacuuggaagaagaugccacuccuuagaacaaagugugcauuuuuaaaaacacucggcuaacauuuacuagcauaauuuauuccucucuagcaguaagauuuuucucuuuucauuuuguauagauaugggcaaaauuaauuuggaacuaaugaacugguaauauguguacaggagucaauaacugauaagccuuucugcuuugauuacauauuuaaucuucuggguuuaugauagcaauuccaaagaugggggggaggaacacacagcuguuuaacuuaggguuuauuuucuccucucucuuuauacuguugagagugccagagaugacaguaauagcauuaucugauuuaauuucaguagcaaucuuuuuaauuuaauaacucugaugucagcuucucugucauguugccaaguuuaauucccacuucuacacgauuaauacucuaaugaagacacugauuuuagugcuaguauacacuuguaaagcuuugcucuucuuagcuacaacugaagccucugcagcgaacuaugauaaauuaaccccaccuagagucccuaucagucacgagauuaaaaaccaucgaacauuuccauuuugcucuaaaacuuuauuaccauauggcacauuuaacauuuuaguaucucuuuaauuuccaaguauuuuacucugcuucuggugauuacucccaaaccacuccacaaaaaguaagugguccaguuucuaauuaaaccuccagagaacaagugacuuuccccuaagaccggacuuaccccaugcccaacucagaaucaacugaaaaccuuuuuuguuuccuagucaccuucuccauuaaaguaaagagcauuuaccaagcaccuacucuguagaggguugugcuaaaccuggcugacacaagcuaaucacauccuauuuguuaaaguacuucaaaugauuugcacguuuucuaucuacacauagaacaguaggggguaucaggauccuuuuuaauucuaaaaggcauauuggccccuuuuucucguucagauuuauuuaauacaaaguuuaaaaucagggagagaagaucaguagagacugaaagucugaauaauucaaguaugcagcugugguugggaaguccaaaacacagcccagcucucaaagcguaaagcuacauuaggaagagauaaacaagcccccaaauaucuaauuuaacaaagguaacaaaaaggcacugccagcucucugugcuaacaauucaaggauaaagggugcaaggagugaaguccauaguucuaccucucuguccacagagaugaacuaugcaccuuggaucucccaccagcaacuacaaaaaccucccauggugauauugugaggcuuugccuuuuccccaaacuucuuuuucuuuucuuuugugagacaaagccuugcucugccauccaggcuggagugcagugacgcgaucucagcucacugcaaccuccaccucccagguucgacugauucuccucccucagccccccagguagcugggauuacaggagcgcaccaccacguccggcuaaauuuuuuuguauuuuuguggagacgugguuuugccauguugaccaggcuggucuugaacuccugaccucaggugauccaccugccuaggccucccaaagugcuaagauuacaggcguguaccacgcacccggccugccuuuuccccaaacuucuuaaccucaugaugacuauuaagagcaccaaccaaucucuuuucuauacucaaggcauggcaaugagcuguuuuucuuuuauuaacccuguuagaagucauagugauuauuuguuuacagugauggucaaaguuuguccucuuggguuuuacagaaaugacuccaagccaggccuucauuacuuuguaccuggaucauggcagcagccuccuugcuggucuuccuuccucaguccucuccucccuucaccaucccuugagagaacagaccugcagcccaggcauccucagcgccucuuuucagauaaccacauuccuauuuaaaacagaaccagcccaugcccacucucaguccacgagguccagguguagauggcccuauacgccacccuuucaggagagacgugaaccuggucuagccugucugaaaccagaggcucaauucuaggacacuaccuggguuucugagaauuggauguaggccuggagcuucuagccaucagcuuagugcuggagaaaggcaccucccugagaaaggagcuggcacagagaugguaagaagagacccauaaaucgugacuuugccagagccccuggauccagcaggcugaaagccaggcuaucuuuggucuucaguaacuugagccaauaaauucuuuuuugauccaacuacuuugaauuggguuuuugucacgugcagcugaaacggucaugccugacacaaucacacacauuguugacaugacacucuuacuugagaauccuucuguugugcuauuuuguccaggauucuagaaaguuuccugcaaaauccaaaugaguuuauucuuuuuuuuuuuaaucaaacuccucucucuuaccaguuggguccuuuuuacccccagauaagccaguuucucucugucuugacccccaagguccugccucaguauguuucuucaaacccuucaucaucucacuuuccagguauaagcccuuugcauuuugcuuuuuuuauuuuauugggguuguuuguuuauuuuuuuuguuuguuuuauuuugagacagggucuugcucuguugcccaggcuggagugcagugguggugcaaucacagcucacugcagccucgaccuccugggcucaagauccuuccacuucagccucccaaguagcugggacuauaggugcaugccaucaugccuggcuaauuuuuuauuuugugucugggacuauaggugcaugccaccaugccuggauaaauuuuuauuuuguguagagaugaggucucucuauguggcccagacugcucucaaauuccugggcucaagcgauccucccaccucccagacucccaaaguucuggcauuauaggcauaagccaccgugcccggcccccaucucaauucuucuuucuacuuccaucggcacuagcucauuuccuguauuccuuauuaugcaccugcugauagauuaacaaggaugucauucccucaauuaaaucauaaauuucuuaagaaaaggcccaugaauuguauauuaaauguucucaaaccuuuuaaaauguauacuacgccucuugauaaguauaaaaauuugacaccucuuuuaauuucaaaauaaauuaaguauucugaccaaaagcaaacccaguauuucacauaguauuaaacauaaauuaaacuuggacaagaaauuuggauugugucucucagaccagugauuuucagauuugagugagcaugagaaucaccuggaaaacuuaggaaaacacagauugcugggcucuaccuccacaauuuguuuuucaguaagucugggguggggcgugacaaugugaauuucuaacacauucccaagugauguugaugcucuccuuuggggaccacugcccuggagucucauccuuuccucuaucuuaguuguugagaaaagugugggcaccuuugaggucuagauucagaagcccacaucauaggugcccgaucuguucuguuauucccgguguuguuauauuugcuguuagcaacaggaagucggugucuaaagcuggacuaguaagcaggccuuuugauucccaguccaggguucuuugaacucugccacaauaccuccuauguggauacaccauucaguauagugccagccucucacgcuauccuuucucguaucuuauucuauuacuuugcgcuacaguguuugaaauuaucuuucucuaaacagcccagaauuuuuuuuuacaucauagaauguauuuuuuccuucugccucccgaauucaauuaaaauucaauguuuagagagucugugcuuuaaaagaaauuagacaaugggcuuaaacuugcuccauuaccuuccccccuaacaauuauuuacaauuuuccuacaaaacauauugaggcuuccccccaggcucuaucuaugggauucucaacuuuauugacacuguugaggaugguuauuuguggcauuucacaaaaaaagagggguugggggugggugagguauggagaaacaagauucaugaguugaaauguuuucucuccauuuaccccauggagagggcaggcuggaaccccugcucuuaguguggucauggaguuucuaaagagacaucaaccauguguucaaaagcuugacaagaggcuggcccagagcgaaccagggcagagaagcaugaggcuaagaaaaagaggagccaagagucaagcaauuaacauuuuuuccaugcuucacuauaauuagccagaucaaaggggaccugggcucacagauuucaccaggccacaugacucucgcaggacagugagccaagggcccaggaggucugcaguacaacuaauuguucaugggcagaacucuguuuucuuguaaaucacucucuuguggauuccuuaucacuuguucugauucugaagugccacacuggggaaaauccccaggcccuacauggcucccauuuacaguguuugcugugugugucacagauggugcacaaacaccucaaaauggccuugccaggaaggcucugaggcuagagguuaaguagcuuggccaaugccugacugcuaggaaguggcagaaacugaacucagauuuuucaaaaaaucagugauucgcaaaugcuccuccugaucauacaagagucaacucagcagcauauuaaaaauacacauuuuggccaggcacaauggcucacaccuguaaucgcagcacuuugagaggccaaugcggcaggaucgcuugagcccaggaguucgagaccagccugggaaacauggugagacuccgucucuacaaaaaauuaaaaaaaaaaaaaaauaggcaugguggcgcgccugugguuccagcuacucaggaggcugaggugggugggucacuugagcucaggagcuugaggcuccagugagccaugaucaagccacugcacuccagucagagcaagaccuugucucuaaaacacacacacacauacguuuugagcuaguaaguccagggugagggugaagcuggaacacaggaucuuuaaaaagccccaagugauucuauuuucccucagguuugguaaaccaguaucaaaaguuaaaagaccauuuguggaacucccaacauacuaaacacagaaacuccauuuaaugggacuuuuacagauuccuuaacaugacagucucuucuagucuuuuccagaguaauaaauacauuuucuuuuuuaaauuuguauuuauuauuguuguaucuuauuuauuuauuuuagagacaaggucuugcucugucacccagguuugagggcaguggugcgaucauagcuuauggcagacucaaacuacuggguucaagcaguccucccaccuuggccuuccaaagugcugggauuacagccacaagccaccacaccuagccaauaaaugcauuuucaauuacaauccauacauaugugaguccuaugcccagaacucugggugguuccaagcugcacucagaacagccagaaugcuuacagugacuuauaaaugcuaccugacccggcacccucaaccacuggacacaucgcucccucccucauuccucacaaaggcacuagccucccagccauucuacagacauucuaggaauucccaccuuugugccuuugcacugacuguucccucugccucuaacacguuucuuccagauauccacauggucaacucucuugccuccugucucugaucaaacagcagcucaauaaggccuaccugaccauuuuauuaauaucuaaaauugcaaccaucccccccacauacuaccauaacucccaauccccuccugccacuuuguuucuuuuugccauagcacaaucagcuucuaacauaccacacaauuuacuuauugugcuaauuauuauuuaucuuucccacuacagagaaagcuccaugaggccaaggauuuuugucagucuaaugauguaucccaagcaccuagaacagugcuugguaugcaguaggugcucaauauuuguugaauuaaugaauauaauugaaagaaauuuuacacaauacguaaccuuacuaugucuguacacugauauucucuauccaauucuauucaaauuuacuuuauuaagucuuggcugcaacucacuaguaggucacccacaguuugacaagcagacuuauuuugccaauaacuugcugaaugccuauuuagggcccagaucaauuucccagaaugugccuuuugacaagucaaauacaaaaagcuuccuccaaaaguucuugaagagucuaacaauuaaacaugcuggcagaccauguauaaauaagaaagaugauaacaugguaaaauuagaaguuuugguauaucauuccauugccaaaaauguuagcuuugauagugccaucacuuuuaauggcaaaaauugcuuuugcaccaaccuaaauaauaaauauaugacuguggugaggcaaggcaucagugagucaccggaaggaucacuaacauguuuuaaauuauauuaauauaucuguagcacagaauaauguuuuaaagcauauaguuuaaucacaauguuuuauaaauuuuccuuucaaaacuuaaaugggaaggacugguauuauuucagauuaauaaauccagaugaauaagauuaguagauccaacauuaucauuaaugaccaaauauuuguaguuauaucuuaugggaucuuaaaucuuuucuuuaaucuuaauucgacugcauauuucagaauuuaaauuagaagauuuccucgcuguauuaguuuacuagagcucacauaugaaguaucacacacuggguggcuuaaacaacaaacauucuuuucccacaguucuggaggcuggaaguccaagaucaagaugcuggcagguuugguuucuccggaggccucucuccuuggcuggcauugcaggugguccccuucuugcucauccuacaugguccuucccucuguacuugucuguauccuacucuccucuucuacuaaggacaccaguuacauuggauuaaggcccucucuaaugacuucauuuuaacuuaauuaacuuuuuaaagacuaucugcaaauacagucacauucugagguacugaagguuagugcugucacacaugaaacuggggaggaaaccccacacuucuaauucuaguacuuaugcucaggaauaagcauauuccccuacaucuuugccugcugucauauaugcugccaaaaccgcagaggaaauuguauaaugucauuuucaauguacaugaccuuccugaaauaaauaaaaaugaccuggcucauuacauaaaugaaugaauuaaaaugaauuuaacuacaacuacaauuucuaguuuuuuccaucaacuaggaaagaugaaaggacuuguauguucccccaaagcuuaggcuucuuuccuagaucuuucauuuuagauucauuuacacaaacacaccuuuuucucuuaaacauucuucucugggaauugaugcaaacgcaaaagagaaaggaagggaggaccagucaaccauuccaggaggaaacgugaggucaagagaaugguuuaacaucaaucagguauagauguuaucagcaugaaaacauccucagaaucacugcuauuuccacauucuagagagcggaaucggaguagaagacaguugucaguagaaucucaguggaacucagaacauaauugaugucaggaaucugucaacucaaacauucacugaaggccuacuaugcauaaggaauugcgcaagaccccagaggagguugagugacaaacuacugaaagaaaugaggauuauguuacuugguggaggaaaagagaacuucagaggagauacgagaacugucuaaaaaaaaaaaacacaugaagggcuuccuggcagaaacagauuugauuuauccucagaggcuccagaaggcagaguuuaaucaacuaguucaauuccugagaggcugauuuuggcuaaaagaaggaugaauuuucugauauaacuauccaguaacagugagguagcaaguuccuucucaccgaaugugucaaacaagguuugggggugcuguggagggauucacaggugagacagagaauagcugacucucuugguuccuucuaaagcugagaaacuucauuaggucuguacccacuacagauuuccagugauagagugaaggguauuauccacuuuuauacauuuucuaaaugacauuuugucuauauuacaaaugaaaauauuauccucuaaacaaggaugcauuaucuuacugccacagaggagcuaucaauaauuucucaguccucaucauuuauuauaaaggaucugcggaacaucucuccuuuuaaccucuaaccacucaacucagauaaagccugcauucaaaacugaucaccuugucaugcaggugaucaagcaagaacuaucucuuuuuacagacaaaacagccccaaguauaauaauaugguuuuauacuacacuaugaucuuuuacauuacuuccuuacaauaacaguuucuagggaacaauaugauuuccaauauucagcucuggcuucuguggacguaauauucugugaucaacagugcgguuaauagaugugauuaggaaaacaagaagaggcuaccauaaaaauguaugugaaagagcaccugagggucccgcugcuaauuccuuggccaaguucuuaacaaggggugaggauccuaaugguguucagugaugaauacgaagaccaacugugagaaaggaccucagagaagauaguaaacauuugucaaaguugagucccaugggauuucacgcucuucugagcaguggaaaccaaaaucaccuaauuuucuauccagccaggcuaggaugaugauccacagugagaaacauuucacacuaaagucauuuauuuuauuuuauuucauuucauuuuuugcuugugaccccuaaauuaauaagggccaccgccacucagcagcuuaaucaacagagcuccaucauucugucagcuccuuaagaagcauaagaaagcaagucagggugggaaaggguugaauggcagagaaggaaggaggugggauagggaggugggggggaagguguggaaaaauaaugugagaucucacauauaagcuaaagcugaggcagcuauguaauuauaaagcuagcuuuucuuucacuugacagcacaagaaaaggaggugaagauaagcuuuuaaaugaaacaugacauucccuuauuaaauucugauuucuauuuuaaauggcuuagugcuuugaguuuacuuccacacucugagcuagccaagaaggagauguuuaauggaaagaaaaacugcaaauuuuuuugaacagugcaugcauguuucuaaacaaguuuguauaaacacguuugugcuuauaaaagcuguucggguuauccaagcaauaguuggccaccuuuugguaaacauaaaugcauucuagcuuacugggaaaaugcaagguaugccuuuuguuuaaaaauaacaugaugcguaaugugugcaaugcauuaagaauuuauugcccauuucugcuucaguuccucuccaucacggguagccaacagaagcuacacguccuuacaagcagugcucuguggcccacaugaaaucaggccauugcaugcuaggaccuguagaccccagacaggagggaagcugcagugcauuuccugugccgucagaggucuagcaaguuugggguuuuauuuucccucucacagaaaaagauaaacauucuugcugcuucucucuacaucacauccacuuuaacacccccucccaucucaaaggacugcaggcauuucuccccaaaguaugugggaaaugccccaaauugcugcaguuuguaucugcuugucaaauaccaucaguaauauucauaauaaugccaaauauugaaauugcugcaguuuguaucugcuugucaaauaccaucaguaauauucauaauaaugccaaauauugaaauugcugcaguuuguaucugcuugucaaauaccaucaguaauauucauaauaauaccaaauauuuuuugagcaaucugcauauagaaaaauaguuuuaccuacaguaucugaguaugugguagauauuauuaacuucauuuuacagaaaagaaaaacugaguucagagaggcuaugcaguuuauccacagguacacagcaaguaaaugauaaauccaagauuugucucugauuucaaguccaggcuuuaucuugccuccccucccuuccuuccuuccucccuucuuuccuucccucccucccucccauuucuuucucuuuuccuuccuucccuuuuuuucuccccuccccuuucuuuucccucuuuuucuuuuuaauaguguuauuaaguuguaauuuacuuuuuuuuuuuugaggcagagucacgcucuguugcccaggcuagagugcaauggcgccaucucggcucacugcaaucaauuuccgccucccagguucaagugauucuccugccucagccucccgaguagcugggauuacaggugugcacaaccacgccuggcuaauuuuuguauuuuuaguaaaggugggguuucaccauguuggccaggcuggucuugaacuccugaccucaggugauccacccgccugggccucccaaagugcugggauuauaggcaugagccacugccccaggccauaauuuacauauaauuacauuaacauaccugaaguacacaauugauaaauuuugaugcacauacaauggcaaaaccaucaccacaauuaagauaauaaguauaucuauuaccugaucacauuuccucauacuacuuuguaauuucuuccuccccgauuccauucuauacuccccauccuagaaaaccauccaucugcuuucuuucacaauugaucuguuugaauuuucaagaauuuuauauuaauggaaucauacaguauguacucuuuuuguuuugcuucuuucacucagcauaauuauuuugagauuuaucugcauuguugcauguauuauaaauucauuccuuuucacugguaaauaauauuccaguguauggauauaucccaauauuguuuaucaguucaccuacugauggacaucuucauuguuuccaguuuggggcuaauagcauuccuagaaauauagcaacuaacaaaacucauacacaacucuuuauaugaauacaugcucucauuucucuuuaguagauaccuaugaauggacuggcucggguaauacaguauauauguauuuaacuuuuuaaagaaguugccaaauuguuuucuaaaaugguuguaccauuuuacauugccaccagcaguguaugaaacucccaguugauccacauucucauuuaugcuucguaugguuagucuuuuuaacuuuagucauucuaguaagcacugaaugguaucucacggugguuuuaauuugcauuuccuaaaugauaaaugauggugaacaucuuuuuaugugguuauuugccauccaugaaacgauggugaacaucuucucauguggguauuugccauccauauauuuguccaaacauuuugcccauuuuuaauugcauuguuuucuuauuaucaaguuuugaauauuuuuaaauaauuuggauacaaauccuuuaucggguaugugauuugcaaauagucauucauuuuuuuuucuuuuauccaucacaccuuuaaugucauaucuaagaaaucuuagccuaacacgaggucauaaauauuuccuuuuucucuuuucuucuagaaguuuuauaguugggguuugagauuuaggaacauacuacgguucagauuaacucuggauuaagguaugugcugaaguugguuuaagguaugcgcugaaguuuuuuuuuguauaugccuauuuuuaaauuugauuuuuuuauuuugcuauuuuauauuucuuuuaaaaaauuuuuuggacuauuuuaaagcuuucuucuauuccaguauuaucaaugcuuuuucuuuaggaaugccaaaaugaccaauaaagaaggggcuuuaaaauaaagauggggccaggcacaguggcucacgccuguaaucccagcacuguaggaggcugaggagggaggaucccuugaguccagaaauuugagaccagccugagcaauauagcaagaccucaucuguacaaaaauuuaaaaaauuagccaggcaggguggcaugugccuguagucccagcuacuugggaggcugagaggaagggugaggcugcagucagccaugacugugccucugcacuccagccugggugacagagugagaccuggucucaaaaaaauaaaauaaaaauacuacaacuggcaugaaccagacgauauaaaaguaacaauuuacagauuacaagaaauaaaauaggcucuaagacagaaacucacggugcucaaagagaauccugcaggaagacugaaucccacucaauugcccaucugcugaugguuacugacugcucugcagaugguaacaaugaggcguaaugauaaauaugcauugcucuggaguccuauacaaucaaagcacuucacgugagaguaaaaacuaauuaaacauugcagcaccacccacugaagguagaguuaaaucugucaaauuauauauucugagcagcacugguuuauaagaaagauucaccaaguuuccuuuauuuuuuuguccuuaauuauaaaaccuguuuucaccugacacuuuuccagcaguguaacuuuugcccuggggcaaacugagguggcgaugucuguaguaacugccaagagagcuguuuguuucuccccagggguaggucauuagaaacugaaaguccagaaccaauuuucuccagcugcugcagguguuuuacuuuuagcauugugggguggggauagcagaugccugagaaacuauaguguuuuacauaagucugaaaucauuggaucuauaaccucaguucuucaacaaaccuuaugucaaucaagagaucagaacacaucuuucuagaaagagaaaacacacacacacacaauggagaagcagguagaaagucaggaguuacagaacuagcuaaauggaaauauuacagaaauuuacagaaguggacaacuuugcuuccugagugaaaaaguuauauaaaacaaaauaaaacaaaaaauaauugaagaggaaaacuacaguuugaaauauacaacuuaaaccugaaauuaaauuacugguauuuguaaucauuacuuuaaauuuuuuuuuuuucuuuugagagggaguuucgcucuuauugcccaggcuggaguacaguggcaccaucucagcucacugcaaccuccgccucccagguucaagcgauucuccugcaucagcuucccgaguaggugaaauuacaggugcccaccaccacgcccagcuaauuuuuguauuuuugguagagacggaguuucaccauguuggccaggcuguucucaaacuccugaccucaggugauccguccaccucagccucccaaagugcugagauuacaggcgugagccaccgcaccuagccaaaauauuuucuuacgcagucuuucaaauggacaaaaaaaaagucauggguauuuaauguaauggcuacuucuguauccacuuuccaauuuuucaaaucuuaacauuuugucaaauuuguuuauuucuuaaaguaauacaauauuauacauacagucauuuuuggcuaaaaaauugcaaaugaggaugaacuagaaggcauaaaaaauaacauauuuccucccauuuuggcugacaucaguaaucaaucacagcauucuuuguuccuaaccccugucaauugauuuaaauucuuaaaaaaaaaaaaaaaagacagaaaagagauacauucgccaccucugaugaauaccuaacagcaguaaacaaaggauucaacuaaagucagggguaaaaauuaagcauuccaggccaacuagcuugauuuuaugaacaaagaauauucuagaauauacuauuaacaauuacagaaguuuuccuuuaugaaaaaugaauaaccccaggccacuaauuuucuuuuuggaaucaaucaccaauuuaaagucuacuuuucucucgaucaagaauuagccugaaaagauaccugcuauguauuuuucuguagcuggugcucuacaguaagauuacaccuguuuuuagguaucugcuuuguggagcaaaaacaaguacagagcuauccuugagaaaugcucuugauaauaauccucacauaggcacccuccauuguagcuuccuaucauucacucaggauuuuccaacaccuucugaaaguuauauuucuuacccaucccaguaaaugccucgaaacauuuucugacaggcaguucacaaguauccaugagacgaccuauuaacaccuagaauuuucugguucugaagugggauggaugguuaaaauggguuuuuaauacuuuauuuguaauuuaaagacuuuuaagguauaaagauaaugucaagucuuaaacaugugccuacuguuucaacagcuucccaagccuuaccuucuucuuccugcuuaacacugauuuccuguucucucucaucucaccgucauucugcagcucuaugugaaacguuuucuugacuaaaacccaaguaaugccuuuccuuccuuauuuucaaaacaggucaaacauacaagaaaucagaccaggcugggugcgguggcucacgccuguaaucccagcacuuugggaggcggaggcguguggaucacgaggucaggugaucgagaccauccuggcuaacacggugaaaccccgucucuacuaaaaauacaaaaaauuagccgggcaugguggcgggccccuguagucccagcuacucgggaggcugaggcaggagaauggcgugaaccugggaggcggagcuugcagugagccgagauugcgccacugcacuccagccugggcaacagagcgagccuccgucucaaaaaaaaaaaaaagaaaagaaaaagaaaucagaccaaauuucucuuccaucaguuacagaaugauuagccaguucuguucccuucuuaaauuguucugcuguguaguuguuuuggaaaauauucaugauguauucagacaauucuucaauucuaaaagcagguaggacagcuugaccaggccuggcaugcuuggaaucugggagaagacaagauaaguaucuauuaagagagucucucucucugccaguuuugugcuaaggcccauuccuggccguuggagaggugagauggcaggcuugaaagacgugcccaggcacgcgcgacacugucugccuuucauuccucugcuauuggccacugucaugacugaugaccacgcuguccuggguguuauuagagaagaacauccucuccauuugcuagcuguguaucuguaccuuuucccaacucccauuuccuguccuuuggaagcaucaaaugggcauuuucugaauaauagcaaauaaccuuaaaauuuuacuaacuggaaacaguuguugugagagguuuuguccuaaguuacaugggaucauuuuagagcaaaucaaauaacuaguuagaagaacuguuuuaguuguucuuuuaaaacaguuaaaagagcugcuuaacugaauaagaagggcauggcccuucuuauaaaauuacaugggauucugaccuaaaacaauuauuguguucuaaucaucaggauaaaguuuucucagccuucaucucuuauacucccaaguuuguauuaucuucuacauucagucuuacuuuuggcuucuuuuccuauccuaugccuuccaguggccuuuauuugaauuuuuuucccaaaauauucucuggaaaucuugaaggcuaaaacuauacaaagauagaaaguucagaaaguaaagaaauaagucuacauguucuagagggugcuuacuaaucuaagccauggagaaaugucaaaauaagaaaaguaaacugcauuuuauugaguaccuacuauauuccaguuacuauaucaggagcuuuuauauguuaccauaguuauuccucacaauaagucuauaaaguagguauuauuuccuuuuuacaguugggaagcuacacuucagagaggauaaguuucauuguccaagguuauauaucuuuucaagauccaaacacaggccuuuaugauccuacaacauguauaugacccucauuaguucacauaaugucuuucuauuuauuaguguguauagugugaucccuaccguacuggauauuuuaugagauaaauaauacacacaauucagucccuucuaacucugagaaccagucaaaaaaauugaugagcccauccucagcccacucugcaacuugacucuggaaacccaacaauuauuccuaaucccugcuccuggucacugugcucaucucagggagaaccugagugauggagucaaagaagguuuuagcugaggaucacgagacccauguucugguuuagucccagcuacugaucauuuaaacuggccaaacuaaaguaacuggguucacucccuucauauguaaacuaaauaaucagaagggacuaaagucucuuagagcuucagaauuuuacaauuccuucuuauuucccugguuaugaaugaauuaacaagcagagaagggcggggucacaagugacaaagcucuaaguccaagggucucuuccgaaagcacacaaugaaagccccaaccccucuccacauccagagcucagcagugcaaugacuggaagucuguucucuugaugaugagggauuaguguacucacuguuuacaccaauaaaggaaaagugcucuggcaucaacacaggucccuaggcaguagguauuguaccugcucugaaaagcagcuuaucauucugauccagucacgaaugagcaccacaauaaucuaggcaggaacaccaagcuacccaugaacacaaaauucacugaagaaaugugagccccaaacuccaccugggcagugcauuauuacccagccaaaguuaacugagugccaggggaugagaggcgggcaagguuacauccccaaccugagcacagcuccaaaaacaggaacagggaaagggaagcaaaacacugaauucaacgugaaugcauuucugcacuuacauauaaaagaaagaguuuaauauucucaaaguggaagaagccaaccaaggacaugauugacguagaaacuuuaauuccagccagccaaaacccagaagaaaaauagcgaagugcuaaaggcagggacucuaucccccacguaaugccacauauuggaaaacaagcuccaagaauguguaagaugaacaugugaguuuucuaggcauucgcaggaauagaucaauucaauaaauaacucccaaaucagcccuacacauuccuuugaggaccauccgagccacugcuauugaacugcguucauuggauccugaugagaccugaauccccuuuaaguggaguggcuguaccucuaacagcucugcccacuucaccuggcaaagaaccugacucuauuuuacacuuuaugguauuucugacaagacacugucccugccuguuaguuccacucacaaagcaauccaagccagggaugagcugcgcugccuucaagaagcaaugcgccuucagaccucugcagcuacuucagguuugccacuuucccaucaaggguugaggauuuuuucaugaaagaaaauaaagcuugaagcacaucaagcuauaaaucagcaucaggaaacaaggucaugcauuuuacaacauaugauccaaacacgcugcaccaaauuggccuuuagucacuugaauugacauaaagugugccugggcugacacuuuauucuuaccauuugcccuuauugcuagauaaaggcugucgccuuucuccuuccuggggauuucucuucggcuuaacagcuugcuaaaugcuugccuuuguuugauaaucauucuaaggcauugguuuaaaucaucauucucccuuucuaauuuaucucugcccgacagcaaagcagcucccagcuaucugugcugggguaggugauuaacuggcucgcugauugcccuuauauuaacauuaacauugucuucccugccauacagaugugugcgugaugaugagagacagaagaaaagagacacaaauuacaggaauugcuuaaaauaaaaagcauuauuaacuaagagaggaggccaauaauaaaaacuauuuguuuucauuaaaaaagaaaauuacuauggaaauacaguuucaccagggagaaaaaaacauagcuugaauguaguuuuagaugaauucauaccucaagaguuauacauaauuacaguauacccuucucuuuauucaugguacucaacuugauauauuuaaauuaaauuucaacccaggaauuuuucaaaguauuuugcauucuagcauauccuauaagacucaggacuguggaggcuaauuacgaguuccuauugucugauccuucuggaauagucuccuagcuggauuucuguacgcuucacauucuguaucugggcagacaaagcccucaagcaacaaaaaucuaacagcuaugccacacuuccaguagccucuaggaaaugaaugccaaacauuucuauccuggcaaaggcuucaugccccuaaaaugaaguaauuuauuugcaggccauccugccuucuaccaugccagcuucaaauaccagucuaugacuuaucauuccacuccgcucaagcguccaaguggugagccgagcagccccuggcuugauuuugcugucaugggguaacaaaucccucgagagcugcaucugccaugcaggagauuaucauaauugaucucuauauguuucucguuuucagauaaaagauaaugccuggacaugcagacuucccauaaaucccacugguguggagaacccuuaaacacagccaguucauaaggagagcaacaaggaugacuggauguuaauuaccagacugaugaauauauaaugcaggaaucaacagggacugaaagaaaacucgucugagcuaagauauuaacaugcucgauaaccuuggccaaggcacuuggccucuguacgccucaauuagccaaacaguaaagcugaauaaaauaaaaaucuugaugaaaauuagauguggauuuacucugaugagcuuuccugaguaauuuacagucccaaagacaacagucaaaacacaaagcaaacauccaaagugccaacaguggagggagucguaccaaugcagcugaucaacuuauuauacaaagccucuuaaaucagcucauguagcauucuauuaauuuaaugcacgccacaugauggugauuaaaucuuccacguuggaagcagaaugugcuauauaguuucagaagaagagguuaaacaaaaauucugaucuccccacaugacccaaaaauaauaccuuuucuagaaguugcuuuaaagaaacccaccaugguacuaaagggaaaggguugccaaaucucuaaagguuugaaagaaaaauacuguggaccguagggggguaaugagaacuucugaauuauauaauuaguuccugaguacccaagacuauuuaaaaugcaauuugcugauuggaaagaaaagaaauaaugaaguacaaagaggauaaaugaagacaccacacguuaagccagugaacuuucauaguaugggagaaaagaaagaaggacaaacccugucuguucacguucuaagcauucaugauuuucaagaggaucagaugaacaauacuuuuuugcucugguuuuacaaauagguacaggauccuuggcucucuccuucuuaucccaauucuuaaaugaauguaauuaauccagacaucauccuuuaucacuauugucuauacugaagaucccaaauacaugucuucagcccauuuuuccugagcuccagauacaaauuucuguccagcuuuccucaacuccuugaaaaaucccuagaaguuguccuuguucucuccacauuuagcaccauuauaugucccuguuugucugagacaguuuccauguacaccuuuuguccugggguuauuauuauaauuuuuuaaaaauugagauagggucucucuauguugccaaggcuggucuugaacuccugggcucaaggauccuuuugccucagccucccauggcacugggauuauaggcaugagccaccauguccagccugcuguuacuauuaauuguacuucccuuuacucucacaguaguccagauuuagaagauaaauuauguggagaucauuuccacaacucccaccuucucuguuccacccacccccagccaugggugggccugugccaucuucucuagcucagacugcugaaauaagcuacuggcugggauuccaaucuccacacugcccuucccuuccucuaauucauccauucccgcuaggugaucuuucucaggugaaaaucucaucaggucacccccugcuucgauggcuuccccugcuuucagaauaaaguuuaaacacuuucgaauagcgacgcucaaagaccucagagaccuccauaauuucacuucauccaauaaaucucccauuagauguuugucuaacucaacuguacugguaccucccuauuaauaauaauaaugcaaacuuaaaguuaguuuucccagaucccaaaauauuaaaguaccaacacuuuaggucucaaacaacuucuuuucugggaaaauauaagaggucugagacauccuggcuacuuuccccaguuagauguguuucaaaaaacuguaugucaaucuuguauuuuuuaacaccuuauauuuuuuaaucaacuuauauguagaaugugcuagagacucuauuugaaauagcccaguagaaaauccuucuuacugguaaauaauucuacuauaauguauauuuuuucuuuguuaacuucauauguuuguaaguuucuaaaucuuuccaaaacuuuuugacacuucacacugaaucaaccuauaaggaaacucaggguuggaagcaucucuaaaggccacaccuguguauuuguauccuucuacaauaguauuucucagcuuuugcaucuacuagaaccaccuggaaagcuucugaaaaaugcagacacucaggccccuacucccaucccccgccaucccccugccaugauuuaaucaaucaaaaacuucagagaugaggcccaaacacgugucuacugauguucccugaaguuggacaauuaauggguagcauccaguccacgauggaacacgucgaagugagaaugaguuaauaagccagauauuaagcaaaguagcugcuucaaaacucagagcccagggcuaggcaugguggcucacaccuguaauuccagaacuuugggagguugaggugguagaucacuugaggucaggaguuugagaccagccuggccagcauggcaaaaccucgucucuacuaaaaauacaaaaauuagcagggcgugguggugagcgccuguaaucccagcuacucgggaggcugaggcagaagaacugcuugaacucgggaaguagaggcugcaaugggccgagaccaggccacugcacuccagccugggugacaagagcaaaacucugucucaaaaaauaaaaauaaaaaaaaaaucagagccaaguaagugagauacaacuuguauaaauacacuugaggaauuugcuuacaguagaaauucuauaguaaauccaccuauuugacuuaaauuugacuuuugaacauaauuuuucaaggcagcucauagggacaucuuccucaaauaaugcugaugcugaccaggucagcauuaaugucccagaucacugaguguuaaaaacguuacacgcauuaguuugucucccucuucaucucucccucagucugcaauuuauuucagaucaauuagaccagggaaaugaucuaauuuccugguuuuaacaacaaacaaaaucuucaauuauugaacacuaauagauuuuuuucuuuuucuuuuaagacagcuaaaauugugaagcuaaauaugacacacaagaaauauguaauccaggccgagaauaaaaguuacaaucuauucuuucucucugaccuuuagguaagccccaugcuuucuccuuccauaucaauaaaagagugggcaccugcaaauccuaauucccagacuucuagaagacaaaugagguaauagaugaaacacucuggguauuacuaaccaaggggggaaaaaaauaaugagguuaaaucuacccaaagcaaaucuuuaacauucaagccacuguuugcagacauauaguccccugguucacacacuaaccaccggagccaccagauguagggauucauaggauugguccacacaagaaaggcuuccuagacguguacauuagugaugucaguaggaagugggauguuucaggauccucagaagguucugauccacccuccaucugggagcccagugcccagcagccuggucuucagaaucgguucaucugaaucaacaccuuuugucauguaaaaggcuguguaagauuuggugaccuacaguuagggcagauguagacaugaagggccuguaucaagaaccacacccagccucuacacuggaacaaacacugggaaaaacagaacgggacccagccagaaacgcagcaggucaagucaaccagcacaaagcuacccugagaauguggcccucggugauugcucugaccagcccuccuaucagggacacccaacccaaacaacccaaacaagaguguguccuaggaggaggaauacugaaagcaggcauucaggaagagugcuguauggaacuuucaguuagcacaggacauucuaguagcaauucaucaagcaaggcuucaauccccauauguaaaaaauaaaaaagaguccaagucuuccagacugugacgaacugggcaaauuaacaaguuguggaauuggccacaggaaaagaaagcaggacuccuguuaucagaacuguggucaaaggugggauuugagucuuugacgcugguagagaaaugagcuaucaaauaguggagccaugucacggccagacaacaacagcgauggcaucgcugagcugaagagcauucaccucaaucuccugaaaucucuccugccugagguacaagcagucucuagagcagagacuuucaacccugacugcacauuagaaucacugaugccuggauccccuccccauuuaauuagaucagaaucucugggugugggucuggacguugguauuuuuccagugcccaaggugauuucauugugcaaccaagguugagaaugacuacaggacugggaagggacuacugaugggucauggacagccucaguucugggaagaaggcaacuggaaaugcuggcaccaggcaugaucugaaaacacagguccaugucaaauucuacauaauucuaaaauuaugacuacuuggacaacaauuauucuccuuucuuuuaacauagguccuaccuucauaggucugagguagcauaagguaccugcagccuuuaagacagaucauuccgacaaaucagaaauggagauaaaggccauuccucacagcuucaaucaguacuucuuccaaguuugaaguagacuaccuauuuuuaaacuaccucgcuauccaggguugcauguuacaauaccuaugugaucuuucaucuugaauugaaucuuagcaagcagaacuucacaguguccugaaauagccauuauuauauauaaccaaguucuacuguuaaccuaucauuugcuguaugugcauuacauguacauuucaugugcugaaagggagauuagugguuuaagauuagaauuagauuuccucuaacauauuuggagaacuucuggcuugauuaucagguuuauauugauuggucaguagcagcuaaaaauuuuuauauagcaauagggcugcugauaagauauccaacggguuggguuuguuguuguuguugucauuguguguauguguguguguguuuauuaaccacaccuacagagaaagcaaugaauuguaugcuuuccucagauuacagaaguaaaauguagucacgauaaagagucauuaucuauccaaauuuucaacaacaugucuuaccaugccuauugcacagcaucugaaagauccuugcuuugcagauuacuuuuuggcuugcuuugcagauuauuauuggcuugcucugcagauuacuuuuuucaaaaggcagaagggagcaaaaagagagcuugugaccagccaaaaaggaaaaccaauuagugacgugaaaguuaauggaaucccgaaugaaaguggcccugucacuauucucuuuuacauccugcccauuccauuggcuucccgauugcuuucacuacaacccuugccucaccccaaaccccuaguacacacacagccucuuacuaauccacuaugugcacuaccccugccaugacugcuuugauuuccaacuuuugucacaucacuuuccucucccaaagacaaaaaucuaucuucuccuuaacaagcacuuagcacuuaccauaugccaggcacugugcaagugcuuaacaaauauuaauccaguaaacccucacaaaaaucuuaagaggcaguugauauuuuaacuucauuuugcagacagauaagcugaggcacagguuuuaguaaauuaccuaagguaccuaagauuacacagcuaguaaguggcacagcaggauuuaaacucgcguagucuggcuccagaguccaugcuccuaaccaguacacuguuguuagcauggccaaguccaaguuuuaaacccaacucuccaauauuauuguguacugcacucuccaaagcauccaugcuguggugauagccaauaacuuacuguuccacacacacagccugcaccagucccgcuccacgcacucagcugacaaucucauggccugcacagccuuccacaucccuuuuaagguucagcuugcacacugccauuaagauacagacuuccuauuuccccaaacaagaucuauuucuucccaguucaaauuucucuuggucuguauauauuggagagaaaauucaucaugguuuauacauaaugaucuguauauuuguuuguucccuccucccagacaggcaaccacaagaagaaaccacaccaaaaaaaguguuuuguucuucuugucaucugcacaggaucuaauauagugucucgcucuugauuucaguugcauuaaauucguauggacaguguagaaauaugagcagaaugagcacaugauuagauggauucauagcugguaaaucaaccuuaaagaauggguugaaacuaacaugguuggaauaccauaugaguagguaucugaaaucagcaauauucaaauguaagaugagggaaauacuacucaaaagucuuuguaggaaaaaaagaaccauuugccucaacucucccuaauuguaugaccuuagacaauuuacauaaccacuuugggccuuuauuucauccuuuauauaauauuaugcuuuacgacugauacauguaaugugccgguuuaugcagaaagcauguggucucuguuaacucuuauuauuaucccuauuauggaggguuagauuucugaaaacucaguaaacaccgacaaugugacacaacuacuaaaaaguuagugcaggccaggcgcgguggcucacgccuguaaucccagcacuuugggaggccgaggcgggcggaucacgaggucaggagauggagaccauccuggcuaacacggugaaaccccgucucuacuaaaaauacaaaaaauuaaccgggcgagguggcgggcgccuguagucccagcuacucgggaggcugaggcaggagaauggcgugaacccguggggcggagccugcagugagccgagaucacagcgagacuccgucucaaaaggaaaaaaaaaaaaaaaaaaaaugguaguguaggcuuaagcccaacagauaugaagacccaggucauaagaagaaugauccaacuggacucuucacuggcaguuccagagaacuuugcaaugagauguaacagccugagaaaucuuagguacagaauuuacuauuuuaucauugccuaccaccacuacugcucugcucucuaacuagguauaucaauacaacacccauuuauuuuacaaaagauuuaaaagugaguaaaacuuccagaaucaaggcugguauuagaauaaauaagacaagaaagacggaaaagagguuaauugcauagacguuaagagcuaaagaaagauuccauaaauaagcuggcgagcuucaaaggaaaguuaacauuaucuuaacauuaaaaagaaaaaaaaugaagauuuguauuauggagcaauaggaaaagauggcagaguaccaauaaaagauaaugaaaagcaaugcccaaugccagcaugguuaaaauacaaauaggucauacuuuaaagagguaaagaaagcacagaugauaaagauuaugaaauagaagccuagauaaagggaagaaaggggcuaagggacauaggaaugccacugcgcucaagaaguaaauauucaacaaauaucaauuuaguauguauuuugagaaaaagccagucuauacucauuuccuauagacuggauuacacucaguguaagcaugguuuaaucagcaggguuuuggggguuuuguuuuuguuuuuaggaaagaggugacucacucacagguaaggccuagaaaaaaaaaaaaggaugagggaaacggagcugucucuaaguggguccauaaaaaccacauuuauuuauacaccuuucaagauuaauuacaauuucuaucacauaacuugcaggaacuagaucuauuugaagcugguaugaauguauggcucaaaggcucacugaaagagaagggaacaaggucuugauucaacccucuauaauauuuugcagguaucuuuugaucugcaggagguauauugugcaaagggaagagguauccggucauuuauaaaaccccugucuucuuuuagugaaagcacuuugaaagaauggcaccaauaucaaccaugcuugauugcuuugcuccaaaccaacuauguagcaguggacuuaggggaacaugagacaaauaggccuccugcuauuacagaauuuacaggccacuaggggagauggacuuuaacaaaacuaagugcagaaauaauuaacuacuuuugugcuaaauguuaugaggaaauagaaaauugcacuaaaauugcauauaacugaggguucuaaccaagucugggguauagggaugaugagaauauaaaaucagcaaaggaaauaaaacuuacugaauuauuccauuuucugccaggagugacaacuuugucaugcugcugaugaaaaaauggcaagaaaauaagcucaucugacauaaauggaagagaacaugucuggcagaaaaagaaaaauguauuugagggccaccuaugauaaaugcucagggcguuugaguucgauacaaaggaaccagagaagacacacacaguccacgggcagaagguggcaagaggugcugccaauugcuuucuuuccaaucucgauguccuauuccuaacucucagauucguuuaagagucauuuucauuacagacucuaaucauggguuuuguuucugaggucuccgccugagaaagacuauugucuuuuuuaacacucaggcuucaauaaugaaaagcauugugacauaguucuccuucugacuuaaaguuuauacugaagagauaaugaaauaacuaauuuucauaaaaauaucuuuugucguaauaucguauuacuggaaagauauuaucuaacuuggcaauaaaucucucugcauuuaauauuauuuuaagacuucaugugagugguaauaaauguaacgucacucacuaauuuaagaucaacugcuaaaggguuaauguaaauagcaugaggccacuggaaauggaaggugaccaguaaauucacuuaaggaccugcauagccuugcaucuucuuuuugaccuugaggaacagugacaauaaaaaaaaaaauacuaaggauggccaagccaaagaaauguggccaaaagccauaucaugaauucaaggagcuuuucccuuuuuuaagcucauccacuaggaaauguucauaacuguaugcugaaaaccagugcaugcaaaaggcauuuauuaucaaacacaguaaaaucauaauccucauaaaaagucuugagguuacagauaauuuuuccuuuuuuuuuucuuuuuuaccuaaaacucaguggacaaacuaaaacucagaaggucaaaaagaaauaaucagucacagaaacagaauguuaucuaauaggcacuaacccauaacaaaagcaacaucuuagacagaaccaaguccucccaguuaaaaugaaggcucucaccuuccuccuacuaacauuguuucauaauauuauugugugaugguuaggaauaaauacaugcauuaucauauccccaaauagauagaaacccaaaaauaaucuuguucaauagacaguaacccuauauugacugauguaagccccaggaacuuauucacuguuauaucccaagccccugguacagggauuagcauacaggguacucaauaaauucuaguugaucugaaacgaacugaacuaccuuguaaauaguaggcauugauaguagacaggaauguagauacagauauacaugauacagauauacauggcagggguuggagggagaaacucguuuuuguaccagaaagaagaaaacaaaaaucaagcuacacuaaaaaugacacaaauaccaauguuuuagaaauagauggaguuaacgcauaaucaugauuuuaaaauauugcaauugcaaccaauaacaaaaguaaaucuacaccuaacaaaaugaagaugcagauaauucacuggacuugcaaucuagguucuuuccaccggucuagugcucugauguguuacucugcauucggccagccauuucaaguuaguguucagcaucagaugggcugauuccacacgacaagguuacagacuagaacagcaucuccugaagucaaagauucauucauccugccgcagcucacucagccuucagacacaucgagcuaccuccagaguaggaauuauagcuacugacaucacgugcaaccucauuuuacaucuguaauuucgaaggcuuuaagugacgcuucacuuaggcagaaacugaaauguugaaaugcacaucaaucuugaauucugaauacccucaagaaucaaacaguagacucugagaaaacuuugacuugacuuacuuuuguucagaaaaaucaaccuucgaauuacauauuuauuccaguuucaaaaugacauaauuaacaaggucaaaaaucuguuaaaugguacuacagguuuugcacauccucuacuuuuagagagcagccuuuaugacuccgucucuguaagugcugguacuuaccuugcucagugacuucugauacacuaaaaaaguaaaaaucacuagaaauuugcauucuagguuaaagggcguuuauguuuuccuuuguccagucauaaagauuucuuacugaaugaugacuguaagaugcuugcauucuccuucaugucuuuuuuuccuuagcugguccccaacccaccacacuuucacauacaucccugagaaagaggccuuuggcccucaugugucaccuaaggugaugugcuucaacuaacaucaagaaaauaucaugugauaagcaaggugaccucuguggaccacuagcacaguccucaggagaacagacagcugcaguuggagcugacuucagguugauagauuucugucuccuguccaucuuugaacaaccgacaacaugguuccaucuguuguccagaaaaaaaaaaaaaaagcguuuucuacaaucuaaugaaaccaugucagguuucaagucuugcacugaacccaagaacuuccugauaugggaaucaaacugaguguuccuucugguuauauacucaucauuuuuuuguuuccucguuacuuagcuuuuauaguaccugggcuccuucugguuauauacucaucauuuuuuuguuuccuuguuacuuagcuuuuacaguuguuuuuaaccuucucaaauagacuacaaaauuggcuggacaaggaaaaacucucauacuucuguuauuuuuuaaucacagaaacuuuucugcauaugccagggauuuaaccaaguugucagaaguauacauuugagaacuucuagcaacuucuauuucuaacuuaaucuuaaaucuuuaauuucuaaguuaacuauguuucuauaagauucaugaucauaaaacuuuaagcuagaaauaugcuauuuuaucugaccugacuccuaguuuuuagauuugguagcucaugaacuaguacuaaaucaauauagaaucucaucuccuuccgcuucauaugacccucacaagaagggcuuuugcugguuuuugcuaagaaaagagaucuacugauucacacuaugauucaugccagcucaaacagauggaaucucuggcacauuccucacucuggaucucagcgcccaggccagcuccauacacacuaauauguucuaguccucuaccgucuccccaaaccaggcugcaucugccucugaauggggaugcuuacuguccacuccucaacucuauccuuccucuccccucugacugaaaaaaaacuagauaucuguauuugcacaagccaacuuagaaagagaaauuaaagcucaucuaauaaggucccauggucaccuccuagagaauuuaaaagcagccuggagaccccaaagaggaacagcaaugacaagcucagcagcaucccaaagagcuccagugccaagcuguagggcaucccucucucccagaggccagcugcuaaaauaggccagugucccugugaaugcuugcucaccauagugccacuuuuacaaauaaacuuccacguuucccaucucgcucuaugauacuaaaaaugauuuccauuuuagggaaaguggcaggcaagauaaaacauaguggaaaauagaauuuaugaguugcuucccgcacaucugggcuacaauucuuacacuugucaccccuguugacaagcuuaaaauaaaaccaugauuuuuauuuuuaggucccaagauauucuuccaggaauucccuguaaauucauuuuuccccucuggcaggaaaaauuaacacaacccagaaugaauaauacauuuauuuauuuuguugcuuagacacuuucgaaggaaaaaaauguauauggcuugauuuucgaagaauuacucuaucuugucaaaagacagaaagaugguuaaggcagugcaagucagcuucuguuuaagacagcuggagggcaaguuuacucuuucccaggacccacugugcagagauaccacugccaaaaaauaauguacaaaauucaugccaauucccuuauuucuuuuuuuuuuccuucuucuugaggcagagucccacucuguugcccaggcuggagugcaguggcaugaucuuggcucacuguaaccuccaccucccagguucaagugauucuccugcuucagucuucugaguagcugggauuacaggcacccgccaccaugccuggcuaauuuuuguauuuuuaauagagacaggguuucuccaugguggccaggcuggucucgaacuccugaucucaggugauccacccaccuuggccucccaaagugcugggauuacaggcaugagccaucacaccuggcccaauucccuuauuucuaucuaaauauauuuaaugacagagaucuugagugcauuuauuuaauagauauucaugaguuccuacuauguucaaaguccuaggcaggggauauaaagaaggcuacuaauggaugaacaccuuaguagguucauacuuaguguguaagacacuguacugcaaauauacaaauauguucucauuuaaagucuacagacacaguaagagcaaagaauaaacuuuguugggcugauuuuguuggauauucuuaccuccaacacacaaauggggaaucugggauuuagaaaaauuaauuaacuugcccacuaguaggaggagaugcuucaaagucuauucuacuugcacuuuugcuguuuccaauuuacugagcuguuuguugggaagcaaauaaaaagguuuuggacuugcauuuauaauccaaaaggaggaaacacacggauaaaguaaucaacaacaacacaaugcgaaagaaaaaagugauaauguaaaagaaguuuugcacgaagugucaagaagaaaaagguuuuaugaaagagaaaauuuuauucugaaguucauccaaugauuaauuuauccaauccaaaacuacaaaugggcacugugugcuuaguucaaugcauugugcauaguagguacucaguaaauaacugcugaauauuggaugaauguguaggguucuuugagugaacauaaagugggaaaaggaauacuaaagaagagaguaacuagcugggugcaguggugcacaccuguaauuccagcuacucaggaggcuuaaaaaagaggaucccuugagcccagggacaagccagccugggcgacaaagugagaccuuguuucaaaaaaaaaaaaaaguauuaaaaaaaaaaagaaaagaguagcauauguaaagacauggggacauccaagaugcccagaucccauuccaugaacugaaacagagugcggaggggaguaggaagagaggugccuggagguaugagcgggggcaaacuggagcaccauaucugccucuacuuaagggcuugaacuuaauuccacuggguaugaggagacguucuguuaccggagaguuuccagugcagguaaacaagaucagugucaucacacugcacaaauucaaagggcaccagccucuuuauauucuaaaugaauagugucacccuggaacugcacaacucguaaguccuaaaaacuuggauuggauaaaauaaccauuggaugaaccucagaauaaaacuacguguuucauaaaaccuuuuccuucuugacacuuuguacaaaaugucuuuuacauuaucacuuuuuuucuuuugcauugugcugugguugcuuauuucaccugugauaaggcaaaugaaugauauugcauauccgugacugaaccuggggaagcagcauauggaaaaggaccuaaaauuagccaugagauuccaaacucccaacuacauaacaucauggacaaaaaaaaauuccccagaggauguucauugucaaagcuacaaugcugguuacagaaucaagcagaaacuccaccgagaucacuaccuccagcuugcuacagauaggggagauauuugguuaagaauuguaacaaaggugacauucaugaggugucuacacuaauacaagcaauacacacuuaacuggcucuacuuuucacagaguaauuauuugcaaguuaacucaugccaaggucaugaauuacagcuaauaaacaaacuucagcuuuuuccaaugauucguuccuaugacaaaaguuuuuuggcagaacuuaagaguaaguauuaaaagcaaucugaauguagaccauacccuagugacaugacuauuaggaaacauccuuuucugaauauauugcaugucauuguaacagaaaaaucggcugugcugguggaaauggcuuuuaugcagaugagaauuaaugagccucauugucucccuguagauagccaugcuuacauuuuguuacccuuuggacacauaaaauuuuaaagacaauaaaaaaauuagggugugcuuaaauaaaagggaagagguuauuuuaaauuaacaaaauguacuuugggggucucaugagauuccagacaaugcaagccaaacuauucuggggccaccaaagccuauacgcuuggaaauaaaaggguacagaaguaccaaauuuaaacugggaauuccaaugguugagcauuagguuguaaaagcuccucagacuucagguagauuccuucuaagauccgcagcuucccaucagccccugaacgcuagauguggguggcccagaugcuguaaaaaucuccugacagaagugugaccaccgcauuaagagcauagacaauucaacuaaagaguaaauaccuuuugcuggauaaauaucauauuacagaacauaauugcauaacucaacccuucugccacaaguaagcugaagaaaggagagucaugggggaaaaggucacgugauauaugccaacacccugaaaagcauuucagggugucaaaagcagccacgagacagguuuggcuuucguguuuucaaguauaguucaugugcuucuaauuuuucauuuucuguuauugguuuaugcuuccaaaagccacauuucagcuguaugcaaacuauaaugccaacagcaggaauguaaaacagaaagucuggaaauuaccccugaaucaucuucccuucguuccucucccuggguguuagugaccuccugccuaauaauccugcuucccuccagcauucaccuacccuaaacccuuuucuguccugcugucagaaucucauucugaaagaacaacacuaauccuacuccugcccuaacugcugcucaaaaacccuuagugguucccaagugccuaccaaauggaguggacauucacagcccuccacaaaacagccccaacugauguuuuccaucucacaaccaccaccacuccucgacaaacaccaacuuuuugacuuauuuuuugacuuauuuuuguggcuguaucacuauuuuuuccaguaaaauccuacccauaguccaaauaauucaaagcagauaaaaaugguucccuauuagaauguuauuucauauauucaaauuuauaucauuuuauuuucauaaagaaaauaucaguccuuuuuacuuguaccauguauauaucccaugggaccaaauaugccauauuccucuagaccuuuaaaauaaacauggugucuucuaugaguuaaaguuugaaucaaucaaaauagaugagauauagucauccuuaauagagacagaauguuuucuagacuaguaaaauacaauauaauuguaacccuauaaugcugucauuccaacuuauguuuagaagaacacuaggauuccacaaaacauuacuaaguguuccaaagaaagagauucauggccaaauuauauuggaccacauugcaugcuguauccucccacuggaagauuaggguauucauuucccacuagaggcucugaagaaacuaguuaaaguuauaugacccguuauuuuucaaacauacugucuucaaaucaucucccacaccuuuuuuggaagaauucccauuaauauauguuuucugaaaagcacuuuggaaaauacugcuaucaccaacuuuacacuaaccagucccauuuuaagccauagacauuucucaagcacagacuuaaauaaaggaaacaagagaauacauugcaaccuuggacucuagacugcucuaaaacuagucauuuguaucuccaauauuugauuccagaagauaguuaaaacauguggguggcccaaguccuuacccauaucuggguauguggguauauuuguuaggacacaaucuaagcugcugaaacaaagaauacccccaauauacaggggcuuaaaugagacaauaguuuauuucucucucaaggaauauuccagggugguaggauggcucagcuaucuucaacauguggcuucccucuugaauccaagauggcagcuccuguuucuaccaucacaugcaugucugaauagagaaaaggaaacagcaaaggaacucacaccuuucuucuaaagguauggccgggaagugccccacaucgcuuucacccaaaccucauugaccagaacuugguuagcuacuacacuuagcugcaaaggaggcugauauaaacucccuagcuuggaugcugauggaaaaccacucaucucugcuaccacaucucuggcaaacauauaaccaagugaaauggaagggaguccuccccaccacuggaguccaugccaagaacagaggucuucuagugugcuuucagaaggacucaucuacccuauuucuauggcagauuggaagacacguggucuuccauauuuccaugucugaagcaagacaauaaugcuacagauacuuaccaacuccuuugccaccauacacaacauuccacacauuucuaauucccagcugucaaguugccagugaagaacccguauuugaaugguggguggggggugacagucauaguaauuuuaggguagaacauuggguuguacaugugauuggcucacauccucaguauaaaauacauauguacucuuguuguugccauccuaguuaggaacguucagaaauaucaaaaacagacugcuuuccuggcauaaguucuguagaaagaaaaauuagaucuauaacaccaaagaaaugauguuuuucaaugaugacaaguaaaaaacaagagauaaguuuuuuaccaugaaacuaaccuugaggcaauuuggcaguauuuggaacuacauauauaaauuuacuuuuuuguuuuuuaggagccuacagcaaaaauggaacuugauccuguuccaauagcaaacauuucuuuuuauguucuuuaggcaaaggaaauugaagcuuucuuguuaauccuccugcccucacccaagauagauuaaauaaaauauguaagccauuuugcauaguaccuagcaauggcaguuuucaaaaugcagugguguuaagcaucccauauaugauugugugguacacuaacaacggaaacuagaagaaggcaauuacugggcuucauauauaggucaaauuuaaaucuucccuauuacaaaauagcuguguaaguguuaauauucccaaaucucaaaauauauuguaagugaaaagucaagauccaaaauguguaaauagcacauugcuacuuauuaaggagagaugggaaaggaagguggaaauuauuaaaugcuuauaaaugcauugcacacuuuuugagugauacucaagaaaauggcuaagagugguggagaccuggggaggugggggaaaauguaguaacagagaugcuuuuacuauauacccuuuuaugccuuuauaauuguggaccauaucuaugcauuaccaauuuacauaaauugaaauuaauaauuauaagcauuuucuucucauugccaccugugcaaccaucacccucucacuacccauuuuauuuuccuagggcuucuauaacaaaguaccauaaacuggguguuuuaaaacaacaaaaauuuguucccucacugcuuuggaggcuagaagucugaaaucaggauguuggcagggccaugcucucagccaagccucuagaggaugaucuuuccuuuccuugacuagcuucucacacccccgggccuuucuugauuuguagcagcauaacugcaaucucuacuucuguuuucaugcagcauuuucucugcguaucucuguccaaauuuccuucuucuuauaaggacauccaucauauauuggagaagggcccacccuaaugacuuuaucuuaacuugauuacaucuaaacaaggucaaauucacagguaccugaagguaggacuuuaacauguuuuugugagaggcaauucaaccuauaacacuaacauaacccacaucaucacacacaacauuuuauagaacuuguuucucugucuccucuuuuugcuccaagcucaacacagcagaguggcugggugaucccaaugaucacuuaucuuauuccaaauuucauuaaggaauaacuauuacauuauuaaguacaacaauuuuaaagauuaauggcuggcauuguaaaaaaaauuaaaaugcauuuuuugguggaagaaacuuagauaaaaauucaaaagaacagaaaguggcuauuuuuguaggaaaucaaggucaucacauaucaccaaacaggaauuucaggcacugauccaggauguucuaugaauucagggacaguguacacauucugcuuuacuagcuaucauuuuuuaccugguugaaguugaccuacauagacaugugugcuauuacauuuuauagcuaaauuaaagcaaauaagaaauuaacuugaagauuuguuagagacaaaaccaucauucuucugcugugauuuuaccucuucuuuugagagucauaaucaccuguuccuaguuauuauagugaauaaacaaucaagcucaggacauaaaugagcauggggucuggcagagaccauuagcauucuaaauaaauaacucaagcaaggagagaucagaauaaauguaaucaaccacucaugaagccuauuugauuaccugcuucagcuuucuauuugacacuacauaggaaaggaaaaaugagacacacuaaccucaccccauucaacuuauacauucaauguguuuucauuaucuaguugguaaaauaucuguuugccaggucacagcuccaaguucacaagcagcaaguaguaagcuuucaguaucaaaauauuuuuccuauagagcaaguucuaaaauuuuaaagaaauguacauugcaaggcaccacucuuugacauucaaacacucuuauucaauuuaauuacacaucaagugauugcuaugaagguaggggaaaaagaaugcagagaaggaggagucauaccacuugcuuuugauggccacggaguuguaccacucagaucucccuucgagaggggagcaguuaacagagugggcaucaguugcuacaucuccaggcucucugcacuccuaccaaagccgugccucuuccaagaugcucccagccaaugacugagcacugugaggucacuagauucagccuuccugcccaacucauggcucuccuaacgcgcagcuccugcccagggacuccugguggccuggcugagaucuuuucagaaccacacugaagucuggagcucuuccugcccaacuuucuucuuuccuucucuccuuccacaggucucagacuauuguccaguccagcagcucucccuaucuuuuccgauccuucccccuuuaucuuucaucaguauuucccucuccucacccaaaugucuugcacaucuaaccagcagaaugcaauuaaaauucuacuugaacuaguuuaauagugaaucagucaguaauuaauccaguucugauuuaccucuugucuacuuaagaccucaagggcaaauaauagguaguuuccuuuuaagcagucauuuuuccuaaagcaaugaagcaugauuuguuauuuuucaacuccugacccuuagcugucuccucucuguaccuauucuaauacauccauauccaaaagaagcucagacauuucccugagguauuacgaagcuguugagaacguucccuccauggggccuguuccucugccccugucauuuugauuaacugucuuccuacugauggcaacccuucaagccuugugggaauuuuuaaaguucauucaugguucucuguuugcagugucuuccugccuuucacucuagcgcuccucuugcaaaggccuuaaacacauuccugccugagaauaauggaaccgguugggcuacuggcagcucuaaguucacaguccucggcacgcacaccacacaaguccacguggcuuuauggaugaugcaucaaaaccuagaccuuggguauaaaacacaaguuuaugaaccaaggaaauaauagguauaaagcaaaagaggaaacuuagacuaacacaacaaaaguccauuuuagaaggucacaggucccagcaugugucugccucuggcagauuuauccuuacagcuccggaauauuucaugccagggaaguagacuacaaccauccacacuaggaaauuucagggcuuuaaaacugcauucaaauuuuuuaauggugauaauuaccuaaauguacuuguuaacuuacagcgugggguuuucuauuuaagucucaauaauuacaaguccuucagauuucuuucaugucucauuaucaagcuuuaccaucuuuaaucauuuuguugcuuuuugcugauauuccucuacuuaaaaggaaagaaaugcaacaaaaacaaaacccucaacaaucacagaacccaaacaaagcacaauuaucaggaaaauaggccuacccccauucugcuaagccgcuacaaaauuucauggaguaagaauauacuucaggcacagaaccacuaagaaagcaauggagagucaagaucagguuaccacacagucuagagggcacccuggaacaaaaaagggagcaagaaaucaacgucagguggcuaguucaacuucuagcucuuuacuucucauacccugaaugccauuuuucuuucuuucuuucuuucuuuuuuuuuuuuuuuugagacggagucuuacucugucgcccaggcuggagugcaguggcgggaucucagcucacugcaaccuccgccucccagguucaagcgauucuccugccucagcccccaaguagaugggacaacaggugcacaccaccacagcuggcuaauuuuuguauuuuuaguagagacgggguuucaccauguugggcaggcuggucucgaacuccugaccucaggugaucuacccaccuuggcaucccaaagugcugagauuacagacgugagccaccacgcccagcccauuuuucuuaucuuuaaaauaauuuguugacuaagcuaauggucaaauuuagugucacuaauagugacacaaaucuucagaucugaugcagauuuuaggaucccuuugcacgauuucuugccaaccauguuuaaccugaauucaauugagaucuaacuuccaguuuaaguaaauccgggucagagagcaacauacuagaugacaccacucaaaagcaaucaaauauauuucagacauauucuaugggacaaauggcauggccuuuucaggagucagugucaugacgaaagguacauaucuugauuaaaggagacuuuggugacacagacaccaaaugcaaggaauaauccugaauuagauccugacuuggagaaaccaguuguaaauaauauuuuggaggcaauugaaauuuuuauaugacuugauaucaaauuucauuaaggaaaaacuauuacuuuauuaaguauaacgauuucaauuugguuauacagcaacauuauuuuugagauauucaauaaagaaauuagaaguaaaauguaaggauaccugcaauuuacacuaaaauaucuuaauauaaaaugugauuuauucaucuaccauggaguuauucaucuacuccagauggcaaacuuuuuaggguaagaguaaauauuuuaggcuucgcgggccauauggauuccauugcaauuacucaacuuuaccauuguggcaugaaagcaaccauagacaauacagaaaugaaugugcauggcuguguuucaguaaugcuuuauuuauaaacacagagggacucacaggccauaguuuucccaccccuaaucggcccuuucaauuaaaaaauagaagcugggcuuaugacaaauacaguccuuggccccaguuaacagcauggcauuaccuuagccuuuuaguucuuuuucuuuugcauuucgaaaagcaggaacauaugguuucauauuaucugccaaguguuuucuugcacagcuagucuuuucucuaucaugugacuugcagauuuuauuuuaaaaaaaaaaagcaacaugcuuauaaaaugaaauaaccauaugagcaggaaauggaacucuucaaagccucuuucauccaaugaaccaaaucaccagugaucucugguccuggagcugauuaguacuugaacagcuuuugacgauaaguggacgauugggcccuucaccucauuuuaccacugcaacccagcucauucuuucaaguccucuggauacuggcuauucagcaaaucaguauuuuccugaacaauaugcugcacaugcacgugacugggagaauaaacacaggugccacuggggaaaaugaacucaauuaaucagcguaaggcauaggugaggucaguaucucuuaccaagcaggugcagauucaauuaaaauguguguuugucugucuggaugcucauaaaugagcaauccuuuaagaaugauuuccacaaacccagacugcucuucaagaugacauuagaaauagagaagucaguauuaaauauuuagaggauuaauuaaguugccccuuugguucagacugccuauuaaaaguuuaccuauaauagaaagcuuucaucaauucaguuuugugcucugccauuaaaacugcauguaauacacuuuuauagaauauggcauaucaugaaacccaaacagacuuaguucuuaaaagaguuucacacggaugauaaguaaaaacugagagaaaauucauguuauauagauucucuguuaauaaaaagaaagcuaaaucaugauucagauuuuuuaaaaacccacaguguuaagauagccuauaaauucuuuggaacugaaggguaaggguggaggggugaaacuccugccaaguuucaaggucauaaaagcaguugaaauagaauauaaagcuauauaaagagccacaauuuucaugauaauauauuuuaugguucaaacuaggcaguaaaguaggauacucacgaaaaaauaccauauuagagucuucuaauuauuuauguauuaguuaggagucuuaauuuaaauugaccagaaaugauauaagaaaaaauugcuaauuuuaagucuuguuagaaaguuguuuacagaaacauuauguauuuuuaccugcuuuuaagaaucuuauccaccucgggacacaauauguauauuacuagauauacuacuguauuucuacaguaauuugugccaugaaauguaugcuaauuugacaagagaaggggaaauuuaucucuccucuaacauagcagaaaggauuuucugauggaauauuaggaauaucuguaaucugcuuaccauaacaaguauuuaacccacuguguaaguuuuggggggcuaacaauuaauauuauaauuauaaaauagucuuaugcuucuguaaaauaggcuuccauuggacaauacuucccuaagaguugaaacaacuauuuuagugagaaaauaauagaaacacacuccuuucaaaguauuuuaaguugccaaaccucuguuuagcuaaauugggaauaccucuuucuuuauuaacuuggauaaagaacaguuuaccaaagagcaaaaacaaaugcauuuagaaacauuuuuucucucaaacauuuagaacacguuaacagagagaaaacuauaaaauguacauuucaguguugaagagaaguuuaaaaugaaacaagaauaguuaauacuuaacaaguacacugucaccaagaaacaauuauacuagacauauacuuucuauacaagagaaguaagccugacaagauuaguaaagguuuauuucuccagaaauguagccaguguuuuguuaaugauaaccaucagaguacacagcaugggaacauaagccaccucugggaagcccaguauugcuccugaaaacauccuccaucucuccacuccagcugggccacuacugaguaaauggaucucauggacaccccaaaggagaagagcuugguuuggguugcuuuaaagacauaguuugaacaccaaugaaguccauuuuuccauguuugcucuuuaugaaaaaauucaggcaaaaaaauaagcaaaacucaauucugcagacauacugccccauccuaguguucaaagcucuccacaggcccuccccuagcugugcgacauuaugucauugaugaugcagccaggcacccuccauaaccuggugcagggauuguucuugccauuagccuucacucccuaccugcaggccucauccucuaacucugcuucuguaaaucuuauuauccuucaggacccaacuaaaguccagugcacagacuuuacuaauuacuccagcucaugaggauugucucuauucacucucacugaccuuaaacacacaucuguuggaguauuuagcccuuucuuuuucuaugugucuauuccaucucugagcuaugauaugcuacagagcagggaucaccguauuuauuuuugugucugauccaaugccuagaacauugccugacacguagcagaaucucauuuaaaaugcaugggacagguuggcugggugcaguggcucacgccuguaaucccagcacuuugggaggccgagguggguggaucacgagaucaggagaucgagaccauccuggcuaacacagugaaaccccgucucuacuaaaaauacaaaaaaaauuagccaggcaugguggcaggcaccuguagccccagcuacucgggaggcugaggcaggagaauggcgugaacccgggaggcagagcuugcagugagccgagaucaugccacugcacuccagccugggcaacagauagagacucuaucucaaaaauauaauaauaauaauaauaauaauaauaauaauaauaaaauaaaaaugcaugggacagguuaccaaaggcaugugagggaggcugaacagaaggaaggauuagggagacuccugggaugcugacaauauucuguaucuucaccugaauaauaguuauguguguguuugcauaguuaaaauguauugagcuguggaaaaaaauuguggaagaaaugaaagaaugaacuagugacagaaauuacccaaacuaauaaacguuggaaauguggccacacgcucacuguuguuucagguagcacaaugccagcuucaccauuuaguaauaaugaaauauucaaguuacaaugacaauauaagcacagaugcacacacagacacacacaccauagaaugucuuucccauuuggcucaucgcuccacugugccucuucugcaccugccaccagcccagaccaucuaagaaggcuccagcccugacuuuguaagacuguuuaacaagccacuccacugucaggaugccaaaccucugggagaaucuuuuugccauugugggaauccacccugccugaguaagcugaaauccccaauucucugcaacccccaacaugauuuaaucaacuuucucuucaguuccuuguccucuggcacuugguucaauucagaguucaacaaauacuugucgagcccguuaugugcuaagucgcaugggucauaaugaugaacaggacgugucuccaaguuuuuguguguauguggcaaaauauacguaacauaaaauuuaccauuuaaaccauuuuaaguauaaauuuuaguggcauuaaguauguccacgaugguguacaaccaucaccacuauccauuuccagaacuuuuucaucuucccaaauggaaacucuguaccaguuaaacaugaacuccaaguuccccucuuccuccagccccugguaagcaccauucuccuuucugucucuaugaauuuaccuauucuagggaccccauauaaaugaaaccauaugauauuuguccuucagugucugguuuauuucauuuaauguuuucaaggugcauccauguugaagcacuuaucagaauuuuauuucuuuuuaaggcugaaaaauauuccacuguauguauauaucacauuuuccuuagccauucacucuuuccuauuuuggaggaauuuacugucuagcaaaggaaagcaugccaguucuugcccacuaguuugcagaccuuaguccagaaucuguuuucucaaaccuagaaccuuccaccaacauucuuuguguuugguuuuugcagggaacacaugugacucuccaacuuuuuaucccaccaucugucauggugcuggcacauaauaagcacccaauuaacagccguuuauuagugcaugaaggacguucccugggguuuucugagaaguaucuuucugaaguuucuuuuacuucgucauaguccuuacuuuugaccugccauucauuuucccugcauaagacuaauggaucuggccccccgcagacaaaaauuuuuaccaaacuccucagcucagagaaaagaguaucuacaagaaauuauaaguacaaauagugcuggauugggagucaagagaugugaauuucagucccagcuuuacuaugacauaacuaugccaagucacaagcuccucaggucucaggaaucuacgacuguagccuaaaauaaagguguuaacugguccuguucaguuauaaaauugcauaaugccaauuuguguaaagcagacaaagcaguaucuugaugacaugucucagacacaucuggaaaauguccaaaaagauuccuaaaaagucuugcgauuaugaaaacaguuuaccuacagcuucuuuagcaauucugcuguguccuuucuuuuauauuucgacuaguuggaaaacuaucauagacuuuuauuucaaugggcaagagagguauaauuuccaguuggaacuaggcuauuuagcuauuaucauugaagaguagaagaaaaugaaggaaaauaauauucauuuugucuaaaaacuuaaagaauggaaugaagauauuaccucucuuuuggcaaaaagagggggaaauugauaacaaguacaauuugaaagaaaauugucugggcucguucacugaggaagaauuuguuuugcagucaucuuuggcuaguacauuuugccgcuauauaauuuuuugcaguucuagaaacuucucugaauucaugagcaggaaauuagcucauuugacaccuuucuagcucguacaaugcuauuucagcuauuugcaggcaacagauaugaacugagaauaucugaaaguggggaacaaaaaucaaaaggcuaaugaauagaagauagccucccaaugauacagaacuaccacuugucuucacuaagcucucccuuaacccaaggagcuccaaguggcaauccugagaguacacuuguucuccucaguaggugaugacaacgagauaaucauugccaacaaaaguaaugcaacuuaaaugaacagaaacccucucagacuacauugaaugggaaugauucuuuccuuauaaaguaagaaacauuaauaauucacaugcgaaggacaaagaaaccuacaagaaucugguaaaaguagacauacuaaaauagaacuaucaaugggaaaaguccuaaggaaugaacuggauggcaaaaacuguuacaguacaaaaaguuucaaguauucuuucauggcuaauuuugcauuguucauugaauuaauuauauaaagguuauuuaauaaauaacaccaaacuuacuacaaauaggcaaacauccaacuuaauuuucaaaccaagauuacuaaaaaggaauaaaaagugaccaagggggccgggcacaguggcucacaccuguaaucccagcacuuugggaggcugaggcaggcagaucacgaggucaggagaucgagaccauccuggcuaacauggugaaaccccugucucuacuaaaaauacaaaaagaaauuagcugggcguggggacgggcgccuguagucccagcuacucgggaggccgaggcaggagaauggugugaacccaggagguggagcuugcagugagccgagaucacaccacugcacuccagccugggugacagagcgagacuccgucucaaaaaaaaaaaaaaaaaaaaaagugacuaaggguaaguggucagaaaucuaacagaacaagugcagagggaaggaauccuaguugguauuggcucucucaccaccucccuccagccauaccauauuguguccauuccuaaaaugcaucacuuuuacacccuugaaugcuguccaccacacagacaguaaguggcucugaagccacugaaggcaaucacagauaaauaagaacccacuuacuagcucugggaucuugggcaaauuacuaaccucucucaguuucaucaccuugacaacggaaauaauaauaguaguacagucaucccuccccauccaugggggauugguuacaggauccuugcagauaccaaaaucuggggauguugaaguccuugauaugaaauggcauacuauuugaauauacccuacauacauccucuuguauacuuuaaaucauaucuacauuacuuauaauauguaauauaauguaaaugcuaccuaaauaguuauuauacuguauuuuaaaaauuuguaguauuuuuaggcugggcaagguggcucacaccuguaaucccaacacuuuggaaggcugagacaggaagaucacuugaggccaggaguuugagaucugcccuaucaacauagugaggcugcuucucugcaaacaaacaaaugaauuaauuaaauuaaaacuguauuauuuuuauuguuguauuguuauauuuuauuguuuuucuuuucccuaauauuuucuauccaagauuguuugaauccacagauguggaaccuauggauaugaaggggcaacucuaucucuuuuguaaaguuuggcaagcuuuaaauaaaauugcauauuguaaaaugauuagagaaugccuagcccaugguaagcccccaauaaauaauagcuauuagacuaugaaaucucaugaugagauuagauauaagaaauuuggggccagaugaccuagcuaguaauacacaccuaacucacgccauagaccgacccuuaaucuaaauguugcuuaaaauguggccuauguucucaucagcauuacaaaccacuucugauccuuuauaaaaauguagauuccugggcaaugccuacaaauuggaacucaauuaguuuuagggcaugagaaucuacuuucuuaaauaaacacucuagcagauuccgauagacauuuuaauuugagaaccaauaauccaguuguucucaaguuuugguaucugcaucacuugagaucuuguuagaaaugcaaauucuuggguccaccugaccuagugaaucagaaacuuuaggauaaaccagccaucuggguuuuacaacccuccagcuggguuuuacaacugcacuaaucuguaccuucccauucagauacagccagagacccagacacgagagccagcaaucagggucacccuugacuccaccccaucucuauuccucacuuauggcagccaaucaaccaccaaguauugucuauuuuauuuuguccucuuugcaucccaaccucuauuucucuauuccaugucuuuguccacugcuuuuuuacugccacaaaggacuccuaccaaauuucucugcuuccagucaugucacucucaaaucccgugcugcaccuaaauugcaaaucugacacuaucacucuccugcuuagcacccuucagcaaauucccauugcuuugaagacuaaagauccuuaauauggcuuauaaguccuuucagacucugccucugccucuuccuaguaugcugguuucgcuaauaaccacccccugccuccaauuuucugcccuaacagcaugaagccucucagaauuuuccuccacaaauucuauuucccaccugcaaacuuuagcuccugcugcuccuuuccuuccacauuucacucuccccauuccagugcccuggcuaaauuuuacuaguucuaauuuuaauuuauuuacuuauuuuauggggaaaaaaaucccaagcccuuuuuaccuuucucccaagauagaguuacagcccauucagugguuuccaacacauugccucaucucugguugccugcuuccuuaugucuauuucacccacucauugcuccauucaucuuguauccccaauaccuagcaaggggcuuugucacagaaagaaaucaaaaucaauuugcugaaccuuuuaauccaccaguaacaagauuuacuauguuguuggcugagaucaggguuguggucugcagccagguaauuuucuguguagugagucuuuccaaggaacuggucuuaaauucaugauuauuauucucaaauuaacuaaauuagaaugcagacacuauauucugaacauuuugcaaaacagugagauauugcagcaaaucugaucuggaccagcuccugagaauugaggauucugugcugcaugcugcuaaaccucagacagaagggcucagccaauuuuaaaucauacacuuuuuacaaaucaaagaccauacuuaauguuuccaagcucuuuaaaaaauuuauuccuuuuuuucauauuguaaggaaugauuuuccuuauaauaauuuucauaauauuguaaggaaugaaguguuauucugauauauauuauguauuuaaaugaucagaaucaguaaguuaaguggagcugaaaugccccaaagugaagaauguuagguaauguuauaccuuagaugcaaacuuaagucacuuucuuuuaggaacacaauggauuuauguaccuuaucccacucccuggaaaaucaacaaaauuuaaaggucguaaaacucagugggaccacauuguucuacgucaaagacaaaauaauuaccauggcaagauaagaaagacuaggagauguucacaaaguauuauaaaggacugcuuccaaaagaauacauauauguaauaaaacuaaguuaaacagaauauuaugaaaacauaauauuucccagguaauaccugggaaauuaccuccuuccaaagauuuaauaauagaauaugcauugggaauucaaagcagacauuccuccccaaaggcaaauuuaggaaucagagacuguguccccuuaugguuguuguuacucuggcaaggugaaagaaaaucuuuuaaaaacaauagauucuaauucaaauuaaagaaccaccuggaugucuguaaaauguggaaaagacuagugaccuuuucuguuguagucucacuauuugggcaacaacauaacucccgauggucagcagcugccguagacuaggcaugggacacauggagaucugucuucaaacaacucagaguuacugaugaugagcuuuuucccuuauuauuucuugguuuaaaaaaaaaucauauuaccuaccuucagaaucaaacucauguccaaaaucauaaugcagaaugacucauaagucuauggugcauguuaaggcagaaaagagauagaaaaaguuuuucaaaauucucccuccuuaauaccaugccucaguaaaagaaaccgggguuuguccauagaaauggcugauuccaggguaaggcagggaaaguguaaagugaggccuggaacaccuuguuguucuagaaaaugaggaaguacuugaauaaaaagaugggauugugucauggaaaugcaggagccacucuggaagcaucaaaagcauaauccacaaagguaaauauugauaacuuagacuugaucaaaaucaaaacuucugcucuuugaaagacacuguucagaaaaagaugaaaaaacaaguuacagacugagaaaauauuugcaaaaggcaugucuuaucaaguaacauauccaggauauuuaaggaacucucagaacuuaaucauauuaaaacaacccuauuacaaaaugaucaaaagauuuugaagagaugcuucaucaaagaagauggauggauggcaaacaggcauaugaaauaauguucacugaccaucaggaaaaaaaaaauugaaaucacauauauguucaacugauuuucaacgaaagugcaaaggcaguucuauggugaaaggacaguuuuuacaacaaauaauguuggaacaaucguacauccauaugcaaagaaaacaaaacagacaaaaaacaaccuugacuucuagcauauacagaaaauagaccaauauguaaaaucuaaagcaauuaaacugcuagaaaaaaguaugcuagaaaucuuugugacccugagugaaauaacgauuuccuagauacaacacaaaaaccacaaugaaauaccauuauacauagauaagaauagcuaaaauuaaaaagacagacuauacaaaauguuggcaaggaugucaagcaacuacaauugucauauacugcugguagaaacaaaaaaugguacagccacuuuggaacacaguuuggguuauaaaguucagcauacauagaccauauaacccagcagucuuaauccuagucauuuacccaggagaaaugaaaacuuaaguucacccgaaucuuucaaacaaaauguuuaugguagcuuuauucauaaucacuauaaacugaaaagaaaauagaacaaauguccuucaacugacacauaugauaccaaaaaugugauauagccaugcaaugguauacuacucagcaauaaaaggaaacaaaauaaugucauacacaacaacauggaugaaucucaaaugcaucauccugaguaaaagaggccagacucauaaggcuacauuagacacagaaaguagauuaguggcuuccugaggcugggagguugggagaaaauggggaaaugagaaugccaauaaauggguguugaguuucuuucugaagugaugaaaauguucucaaauugugaaaaaaacugcaugauuuugugaauauaccaaaaaccauugaauuauauauuuuaaaggggaaauuguaugauacauaaauuuuaucucaagaaagcucuuuuuaauaaaaaaguuacauauugcaugauuccauuuauauggcuuucuggaaaagggaaaacuauaggcacagaaaacaggucacugauugucagagcagguggaaggguugacuagaaaggacuugagggaacugucugggagugauggauccauguuauaucuugguugugguggggguuacacauuuguacgugcuugucaaaacucaacuauuauaaacaggauuaaauuuacugcaaguaaauaauaccucaaugaacuugacuuuuaaauaucuguauacacauuuuccaucagaaaaacuguguuuugcuuuaugguuuuaauuuguauauuggagugauaagacuauucaccaacccucccccaccaauacuguauuagugcacaaucauaauaccuuugaauucaugaugucauuccauuuuuuaccaugaaaguaguuccauuccacuuuuuaaauuguuuugaauaaacauaagagguaaugcagacaugugcauuuccagucacaauuauaaagcuauuaacuagaccugaauccauuuauuuuggcuuuaugaauaagagaaauucaguuuacauacgcuuauuauuaaguuaacaaugggcuuuacauucugaaaaagcaugugccuaauuaagagaaacauuccaaaauuuaauuauuucagucuugaaugcuuuuaaagaguauguuagguuuuucuacuaggaaaguuguauuuuuuuaaaucagaaaaauugugaaauacagaaaguuugcaagaaucagaauaguauaaagaauuucuaaauaacauuuacccagauucacugaccuuuuacccacauguugucauuugcucucuuuuauauguauggggcuaguucugugcuuucuagucuguuccauugaucuauccuuugucuauucuuuugcuaauagcaacugacccugauuaaugcaacaguccauaaaucuuugucuuaguccauuuucuguugcucuagcagaaugccacagaguggguaauuuauagagaacaggugccuauucagcucauggcucuggaggcuggcaaguccaagagcauggugcuggcaucugauaagcaucaucccaugggggacugguggguggcagaagugagugagacagggcaaagcaccagggaccagauucacuuuauaacaacccacucuugaguuaacuaacccacuccugugguaauggcauuaauccauuccugagggcucuacucuccugacccaauuaccuuuuauuuggccccaccucccaacacuguugcauuggggauuaaauuuccaacacaugaacuuuuggagaacacaugcaaaacauagcaauuuugaaaucagguaguaugguuuuccaacuuuguccuucuuuuucaaaacugcuuuuacuauccuagcuccacugccuucccuuuuaaguuucugagucaucuugucaaccucuacaaaaaguccagcugaagucugauugggaaugcauugaaucuauaaauccacuagagaagaauugauuuuaacaauauugacgacuuccaugcaaggacacaguaucucucuccacuuauucagauacuuaauuuuuuucuaaggaaaaaauuaguuuuuauuucuggcaucuucuuuuucaccccugccuaucccucacucaauucuucaaagucaaguuucgacaucugaaagaaugugcuuaaaacagggacaaaaguaauauuuuuauauuuuuagguuuucaguuacuaacauauuaauagcccucuguaucuaaaaguuucgacugaauaaugacucagaauaucuuggcuaacuuccuuaauuaugagugaauuagcuauauacugcuggccuauucuuuuuuauuaaacaaugguaauuauuucaaacaucagaaaauaaucaugagaacauaaaaucuaacaaaucagcacccucugugccagauagcauucccuucauggaucagaaauuguaugugauuaucucauucacaagguucaaaauaaauugcauacauggauaaucuaaccccaguaucaacaggucaguuuaaacacauacccuugaagccuguaacagaggcaggggucagcauuaauauaaggagaaucuauuaacugagaagaacacacacaaccauauucaaagacuaugauugugacagcaauugguaaacugacuauuuuucaaaaagucucuuuguucuuaauggcacauaaaccauuguuggacagugacagugacacacugucacugucaugaacagcaggagugaguacuggugcaugcaagggaucaaaggcugugaugaaaggguccguaauuaauaauaauugcuucccaagugucuauuuuacauaaagauuccacuucauaagggacacauucaagaccacuggauaggcguaauauuuucacugugggugguccuuucuuggaaugauauucaaaggcucugcaugggacuagcaaaacaucauuaauaagaaugauagagaagaacuguagggaccaagcacaccuugccaagggcaacaucuugcaaugcaccagcaacagugaaaaaacagcccaugaagcuucugaagugaaggucuccacccaaagacaaugaaggcacaguuacauauuuagccaguuuuuuuaauuuaaugggugccuuuuuggagguggugaccaagaaugaggaugaugcuuugggauaccuuacuugcaggauuuguuguauacuuauucuggagguggugaccaagaaugaggaugaugcuuugggauaccuuacuugcaggauuuguuguacacuuauucuggagguaauucugaauaaaagagaaaaaaacuuuauuaaugcuuuuaaaugaaguuaaacuuaaaaauguaaagcaucaggaacccugcaaagagcaaccagaauaauaucccacaaaaugagaaaauugaaauaugucaauacauuuaagcuaauauuagaaaaucauucauuuuagucuucaugggaaagcacagaaauacaauuaauggaauacaauuuagaaauuauuuugauaaucaucuaauaauuaugaaucacugugguagacuaauuacagcaaaaaccccauucuucaaccuuuccuauacccaacucccuggaauguaaauuugcagcuucaccccaugaauuuggacaggcuuugaaacuuccuuuggccagagaaaaugcaguggaagugacacuaugucagucuugagacuggauuucaaaacuucaggcacggccaggcaugcaggcucacaccucuuaucacaauacuuggggaggcgaagauaugaggaucccuugagcucaggaguucaagaccagccugagcaacauagugagacuucaucucuacaaaaaaaaauauuuuuuuuaauuagccagcaugguggucugugccuguagucccagcuacucaggaagcugagguggcacuugagcccagcagugugaggcugcagugaacuaugauugcgccacugcgcuacagccugggugacagagcaagaccuugucucaaaaaauaauaaaauaaauaaaaaaggccaggugcacguuggaauccugacccacugucaugaaaacaaacuuuaccuagccugcuggaugaacagaaacagauaguggaacaucauuccagcugaggccauccuaaaccagccagccaccugccaauuucccugccgauggcagacaaucagugaaaaaaaggucagacuaaccuaagccagcccagaccugaugaaccaccccaccaacccaucagcucacaagcuuaauuaauauaugguugucguuuuaagcuaugaaauuuugagguggcuuguuauaccuuaugaaaggcucaucuaccuuucaaaguugcuccuuggauuucauucuauaacuuucuuuuuaacucuccuuguguuuucucagcuaccaauaacaccauuacuuguccuaugacucuggauuaagcaaucuacuuugacuucucccucuccuguacuuccuauaaucaaucacuuaaucuggcagcuucuauacagauguagaucucaaaguuaucuaccagucuccauuuuuucugccauaccacaaguaaaagucuucaucauuugucuucuaaaaggucuccuuuccucauucuuuugccucuuuaauauacucuuuaaucgcuaaagaggaauaauuuucuuacuaaaucaaaaucauuguuuuauuaaaaugcaugucaggacauaucaucccauaaaugcaagucagacacuuuaacaacccccaguuuccuacagaauguucugaacaguugagcauggaauucaagauguuucauuaucugaucccaauuuuuccuucuaguuguuucgccugcaucccugcauacuucuacagucacaucacaccagaaucaaugcccaaacagaccagacuuuuucacaucuccguguuuucaaauguuguugucuucccccuccuccccacccacugaacuuucaacaagcugauucaacuacugacaacuuucugacugucuucuccaauaggcguguguccccccagccauucacauccccaucuacugcccuuggguagaucuguccuuuucccugaacaccuugaauaugccuccauuguuauaguaaaguuuucauuaaaguuuaaccucuacuuagucaaguacuaaagguuguaaauuuuugacagcauggcauaugaaccuuugcaucccucauacaacaguacaaugcuugauaggcuaaaugcaauguguuguggaucuggggucuuagaagugggaggaacucuucagaaaaaauuuucuuuucuagccagaagucaaguccagauguggugcaaauaaauacucuugcuccauuaucaaaaauaaaagauuacgaacaaggccaaguaagcuuuuggcuccuucaaaauucuaacaauauuacaauacagcaucagcuacuucacuccuacucggaaacugacaaauaugacuauguuaaauucaauuagaaucaggacccagaggugcuccaaucccuuuguauucucauccuugucugucugacauauugggcagaaucaaauaagugaaagguggcuucugaauacaguaaaacuuugaaaaacagagcucuccccgcccuuuuuuuuuuuuuuuugcauucugcugugaaauuaagaaagaaaauaaggugcuaccagaacucaugcgauagcgcuuucuuuuaggcacauauuauagcauucagaugaaaguucuguaaucacacacacacugugccucuaacaacaaacacggugacucugagcaaagucucucaauuucucugggucacuauuuccucaucuguaaaaugaauggcugaggcuaacuuagcacuaaacuuuagugagcuuauuaagcaucaguuuauugaaacugguguucacaauaauaaacauaagugaaggcaagauauuuaguaacaaaaauuuaaguauuaaauuauacauagcauauaacacguuuauaaagauagcaaaagaagccaacauaauuuugaaagauuuuuaacaaaacugauaaauauuuucauggccuucaacaagaaauuucaauuaauaaggacauuccauccauacaugauaugguuuggauaucuguccccuccaaaucucauguugaagauguugcaggugggaccuagugggaaguacuggaucaugggggcaggucucucaugaauggcuuaguaccauccccuuggugguaagugaguucucacucaauuaguucacaugagaucugguuguuuaaaagagucugggaccucccccuucacucucucacucccacucuugccaugugacacaccugcucccccuuugccuuccaccaagauuaggagcuuccugaagcccacaccagaagcugagcagaugucagcgccauguuuccuguacagccagcagaaccgugagucaauaaaacgucuuuauuaaugauccagcugcagguauuucuuuauagccauacaagaacagacuaacacagaaaauuggcacuaaggaguggggugcugaaaaugugaaagcagcuuuggaacuugguaauggccagagguuggaggaguuuggaggucaaagaagaagacaggaagaugagggaaaguuuggaacuucuuagagacugguuaaaugguugugaccaaaacgcugauagaaauauggaaagugaaguccagacugagaucucagauggaaauaaggaaguuauugggaacuagaguaauggucaccccuguuacacccuggcgaagaacuuggcuguacuguguuuaugcccuagggauguguggaaguuugcacuucagagugaugaccuaggguaucuggcagaagaaauuucuaagcaguaagacauucaagaaguggccuaguggcuucuaacagcuuauaaucagauaacgggaccaaagaaaugacuucaaauuggaauuuauauuuaaagagaaagcagugacuggacaugguggcucaugcuauaaacccagcaauuugggaagcugaggugggaagauuguuugaacccaggaguuugggacuagaccuggcaacauagugacacuccaucucuacaaaaaaauaaaaaucagccagccaugauggcacaucccuguagucccagcuacucaagaggcugaggcuggaggaucucuugagcccagaagauugaagcugcagugagccaugaucacaccacugcaguccagccugagugacagggcaagauccugucccuaaauaaauaauaaauaaauaauaggagcagagcauaaaagucuggaaaacuugcagccuggcccuguggucgagaaggauuccaagcacacuaaggagcaaccaccugcuagagagauuacuaugacuaaaagggugccaaguguuacuauccaagacaacaagaaaaaggccuagaaagcauuucagaaaucuuugaggcagccacucccaucacaaacccagaagccuagaaggagaaagcaguuucaggggccaggcccagggccccaccacccugaucagccuuaggauacugcuccccacauucuggcucaggacaccacuuuagacggggcgagccaucagccuugguggccgccaugugguguuaagccuguaggccuauggaaugcaagagcgaagggggcuugguggcuuccacacggauuucagaggauguaugggaaagccugagcguccagacagagccugcugcacagccucuacuagggcaguguggagggaaaaugugggguuggaaccccaguacacaguccccaccagggcacuaccuaguggagcuguggcaagggggcugccgcccucuagucccaccugcaguagauacgguggcagaucuacuacuaaaaaaggaugauuguguuuuacaacgugagaaggacaugagaucugugggggccacaugcagaaagauauuguuuggauaucugaccccugcauaucucauguugagaugugauccccaguguuggagaugaggccucaugggaggugucggauaguaacacuugauacccuauuagucauaguaaucucucugacagguguugcuccucagcgugcuuggaagcccucaugaacggcucagccccaaccccuugaugaugagugaguucuugcccaguuaguuuaugcaagaugugguuguuuaagagucuuggagcucccccuuugcucucucauuccugcucuggccaugacacaccugcucccccuuugucuucugccaugauuggaagcuuccugaggcccucaccagaagcugagcagaugcuggcaccaugcuuuccguacggccugcagaacaaugagccaauuaaaccucucuucauaaacuacccagccuuaggcauuucuuaauguaaugcaagagcagaccaacacacuaucacaccguucaguuaaucaagguacuacugugaauauuaaaauauuacacuagucucacagaguguagaauaguaacagacuuuguagaugagcuguggggccuuggacaggucaccuaaccuccaauucauuacaugaaaaauaggaauaauuccugccucgcgguagggaacagauaagguuauaaagauugaaugagauaacauacaugcaaugccuauaauauagcaguuacuaaauaaauauuagguguuaauuacccuuucuccaccaucuccagcaaaguucaauaggacauuuugacaacacauaauuggaaguuaccucucaacuguauaaugcgcuucuuuauuuuucaucauucaauguucucucauaaugaugaaauauuuuuucaccaauagaacuugcuucaaagucacuuacuuccucugcuuaccagaugacacgaugaugauaucauuuuuaaaaggccacuacaaauauauucauuaaagcaguucugacacaaguuuuggccuaaguuguaugcuggcguauaaaauaaaaucagggauaucugacaaugacuuugggaagcagaaaugcuauagagaggagaagcccuugaccugccuacucucuccccagcaccaggcaggauacccuauuuuaggaagggaaaucuaucauuuucuuaaauaaugcuuuccaaucuuuaaauaccacucuguuugcauauauuuaaguaaagcugaccuuuuuaaaauccuuacuggaaaugaugaauaucguuagaaaauuccauucuaugaaauucuuguucauuucaugaaaucacgccuuuggucuuggcccauucaaguuuaaaugaacaaagcagaguaggaggggcuagagccuccccgauggagaggugcugagagacagguucuguugcaggcacugaaauaagcccagucuaucagaccaaaggcaacauccaaggagacaacagcagacagcuggcggaagucucacugaccgccaagagucagggaagauaccaguuuugaggccaagggaggacucagugccucuccuccagggacagguagagauguccucacccaaaggccacauucagcagacaugggagaggcccacaggcuccauucuuuaggcugggauucagaggcagcggcuagugucaaaggaugggaguugaucagaggagacaaaguguuuauucucaugugacugaccuaaugaacaggaagcaugaugcggaggcagacaggguuaaagaggggcacuucgaucucaaaaauaauauccaaaguagggcacagagucagaauugacuaauuaacaaggacacugcagauccccagagugaugacgcggagcuccguaagccccacuuccuccagugccauuccuuucuaccaaggauaacauagcucagagaauaaguguguagauaaaagcauuuagugaaagccaacgaugugccucugcuccaggcagugggaaaccaaagauaaaaagacaacugucugccucaagaagcucaaaucuagaagaacgggugaaaaguacggauuauauuaaaugugaggagugccaggcugcaaauggccacugcaugcuguagcacagagaaggccaccuaaccuacaugugguuaugucaggaaaaucuucucaacuauauuauuaauaauguguuuuauugaauuaaauccuuggggaguacuacggcagucccccauuuucccuccucuaaagagaaaacauuuauuugucuuuuuuuauuuuuaaacauuuaagaaaauccuucccacccuuuacugaaugaacgcccucucaauucucucacagcauugcugaaucagacaacuggugcagcaugccacccacaagaccaacugagcuuccagcugaugauggcaucagaaccccacacaugagaaaaggcacuuggcaaucuaucaacaugguaacuauccgaucuaccaggucauuuccuaggcaaaaauucaugggagcuccaaaucaacauuaauaauaaguuaacaaauaccuccuguuaucaacaaacugcaugcuuugccaaaauguagugcuucaaugaauuaaaugaaugacuuccucuucacaauucuuugaugagacaggauuuauugcauccuuucuacaggugagaaaacuaagauucagaaaguuaauuaauuuucuugagguuauauagcuagaaagcagggaaccagaaaucaauuucuguucuguuugucucccaagccuguggaagucuaaaaaccugccucucaacuacagucuuacuccuuugcagauuauucacugccugggaguguucaagcacaaucuccuuuggguuaugcaaauucucuuuuuuuuuuuuuuuuuuuucuuuuuuugagacggcgucucccucugucgcccaggcuggagugcaguggcgcgaucucggcucacugcaagccccgccucccggguucacgccauucuccuaccucagccucccguguagcuggaacuacaggugcccgcccccacgcccggcuaauuucuuuuuguauuuuuaguagagacgguuucaccguguuagccaggauggucucuaucuccugaccucaugauccgcccaccucggccucccaaagugcuaggauuacaggcgugagccaccgcgcccugcuggguuaugcaaauucucuaacaugauguaguauuggcuauuuucaaagcaguuugucauguccacuauaaccagaccucuaugaaaccucaagacucccugcugacuggagucuuaggucuuaccauggcaaacagagcugacccuucaccauccagacccuggugagcuuuccagccuccucucuggccaucgucccaucaccuuccucugcauucuucacucuaugcaggagccagccgggguccacauccauggugcucccucugaccaaaggccuuuccuacuuuucugcuugguaaauugacucaccuauucagggcccaagucacucacuucuaggaggcuuugccugccuccuccccacuccccauaccccucucugucucacucugcuuuuagaaugccaguagagcaguacucacccacccugcauuauuacuugucaaccucucccuaaacccuuucuauccaagccguggcccauggaccagcagcauugaugucuccagggaaucuugagucgucuucaaaccuacagcaucagaaucaucauuguuaauaagauccccacaacuuaaugugcauuuuggacuuugacgagaaccucucucagugucugaguuuugggaagagagaaguggcauuugguuuguuaguucugaauauuuuuaagagauggggucuuguucugucacccaggcuggagugcaguggugcaauuuugcagccucaaacuccugggcucaagugauccuccugccucagccucccaaguagcuggaaucauaggcacaagccgccaugucugcuuuguuuguuugguaaaaacaggaucuugcuaugaugcccaggcuggucuugaacucuuggccguaagugauccucccaccuaggccucccaaagugcuggggauuacaggugugaaccauggcaccaggccaggaguggcaucuuauuuauucucagaacuuaccccagggccuaacacugagugacuacucuguaaauguuuguugaaucagagugaauaugggcuuucacuugauucucacaacaauccucugaguuagaaacuauuaucucuauguaauagaugagaaaacugaagcuagagacuuuuuaaaaaauuuccuaaaacucauacauagucaauaauuagcaggaugagggccaaaucuucuaauuucaaguucuguauucuuuucauuucucuaaacuauuucccaugaguuauaaauaagaacaaauauuuaugcaauaacuccuacaauaugcauuuuagcauaagaauauugccccaggcaggauuagcagccacucugcuuucauguucaggaagugaauguacccuuucauuccucuagguaggaauaucuauccagcaugaauggugcauugugugcaguacuaaacauggagaggaaaaugaaucgaaucagcuccugcccucauggagacaccaacaaauaaagaguaauccucuuccagugugagaagaaccauguucugaguguguguguguguauauauauacauauauauacauauacauauauacauauauacauauacauauauauacauauauacacauauacacauauacauauauacauauauacauauauacacauauauacauauauacacauauacacauauacauauauacacauauacauauauacauauauacauauauacacauauacacauauauacacauauacauauauacacauacauauacacauacauauauacacauauauacauauauacacauauacauauauacacauauauacacacauauauauacacauauauacacacauauacacauauauacacacauauauacacacacacacacacauauauauauauacacacacacacuacguguauagaauaaagagaaaaacaugaggaacggcacuuuacccaaccaauagcaccugcugcaaaacaaaaucuaguaagguaagacacagaaaaagacccaccagagcgccauucaguuuucaaugcuucaaagauuuacacacucuuccuauuaucauuaauggcuauuaugaacauaaucuguccccaugcaccaaggggagaauaaauuccucacagaggggaaauagaggguauucaaagaaaaaaaauauuuuaugcagaaagcugaugccugcuaguugauaaugaaugcaguaggaguaauaguaauuuguuuaaauuccucauuaaaugagucauaaaggucauggggcaauacuagaaacacacacacacacacacacacacacacacacacacacacacacacacagcaucucugaauuauccagcaaagcaacaauguuaaaaaugucuuuuuaaaaaaauuagagcuaauuaaauuaaaaauaaaaaucaggauuaaacuaaaaauaaaagggagcuggaauuccaauaacuuuaaauuauauagaucauauaaaagcagaaaaguagaagaauggaucaaacaagaaaaccccucugugacaguccaugcugccccaagucacuaaaucugcagaugacagaaacaaaauagagagauacaucuugugcacaggaaaaaagcaagcauauuccuaagugacuagaauacaugagucugguggguugauaagugacuuauacagaucaaauagguguuagauaaugaggcaagggagcaaaaauauucuuagaggguaaaagcucacaagucagcaguauagaggcauucucaagagcagaaucauugcauauuuuaacgccuucuuggcuaauaagaauaaaacaggcaggcaaaguggaaauaugggacucagaacauaauuucuacuucccugggagcagcauuucuuagggugauugggagguuuuugcuccucaucagaucuuuauuaauccauugucaugucucuguguuuuauuauuccugccaggguaacagauucuauucaugcuuucaggucauaaaguguaccagcuaacucaggggacugaaaacaaaauuaagaaugagguauggcacguuccuuuucuucucagagccucggcuuuuuccccugaaaaugaggcuaauagacacuauccccuagggcgguuaugugagagaauagacacuuguuguauaucccccaaaggugauaaaaaugguguaagucuccccguaucacguugagcccauggugaacacucaguaaacauggacugcuauuaucauugcacuggaaggcuucccaccaucgagagucauuaaauccaggagauugggagcuguuuuccucuggagcauuuuauuuuuguucaaaagaaauacagcacagauuuggccaaauccgcagacaaauugucaaggccaggaauaaagucuguuuaguacacucugaauauagcaccuaacacacaauuauaaauauagagugcuuaauggggaguauuugauuuaaaaaaugguaaaaucuauugccaagauuaaaugagaugaccucuuuggaguccuuccacuagaggcaauaaagaauaaaaaugaacauuaaauauguaugugcucucuaucucaaacccaucuggccuaugauaucaauacugggccagagcaacaaauaugugcaucuucauauuucuaaacuucaaaaaauggcccaugcaguacaaaacccaagagcauuaaaaauggccuuugacucugcuugugaugcaccacccguagccaccauacccagaggugaacuguagaucaaaaagaauuacuauggugccaaagagacucccauaaaauugcacuacgcuauuauaccauuuugguugccuuugggaaauauguaagucaaaaguaucuaaccauggguaaauaaagucaguuugcacuuaagaaaauagaaaagcugauggaagaauuaaguuugcuuauuuaaguagccuuuuauguaaaaggguuaagaacacuacuuccaccuucugccaaugagcuauguucuucugaaaauuggagcaguauacuaacucugaugugacaaaauuugaaaaugcuaauggggcaagguucuguaaacucugucucuauaccuuauuauaucuugcuauuguauaguggacaucguucaauaagaaguaaaguaaauauaaagggcaacaaaucaaagauuguauucucacagaggaguggcucuggaugaguggcaaucccaaggcauaaacaucucuucuacauuccaaugcucuaagaauggaagaccgaucuccaaagaucaaaaugaccauuguuguuuaaaaacuaccauuugcuuagaauaaaaaacaaacuguccugaaauaagcuugccaucuauaucaucuuauauccaggaggacaauaagccaagaaagauaaaacagagaaaaagcaguugaauuaguugaauuacaguauauuucaucauagaaugauaguguacccuuaaaaaaaaaaauccaguacaguucaaagagaacaucauuucuaaacauuacaggcaaaaagaaagguuuuuuaaauuucauuuuguguucaaguuuacugcaaauuacauacgacaauacaguucuuaaauaguacaaaaugaagcuccaacuucaauuuuggugcugugguuuuuauauuuguguaguuguuaaaauaagauggaauguuggcauaacuaucagacagcagaaaacaagcugcugaaugaggaggaaagaaccaaagaaacaguggagaagggaauuguaguuugaauggaauuuuggugcaaaugguggcgaucuguuguacagucugcauuaauuggguuauuucugaaugaacauuugauuauuauaacagaacauucuauguauaaucucguaaaacuguaaauuccuggcagagucacuuugaaaguaugaggcugacaagcccuucuuuugaaaaacugagaacuauuugcaugagaauuaucacucugaagcaagcaaauuccagugcuguugacucacugccucagccaccuacacuggggcucccaggcagaauggguuccaacccacuguacguggggauuccaggacccaccaguucacgggagucacaugagaaauaacaacaggaagaaacuuugcugccaaauaaaaagagaccaaaucaacagaaaaacaguaaggacauuuuguuuuaugguuuaauuggauuuuuaaauuauuaugcccuaggaucuaucugaaacauagacucaaacaaaugaagaaaggacuuuuaggaacuugaaaaaccauguauacuuauuauggcaaguaugugccucucaaguucaacaugucaaacacaugauuuuauccuguuggaacaaaaacagaaaaaggagguagaagucuucauacagaacucucagccccucauuaagaaguuggaaauuguauuuagcuguacagaacagaggaauacaugacugcuaauuuucuaacucauucauuuuuguuaaguucuaauaaggcaacuggauuuuucuacuugcuaggcaucaagcaucauuuugaaauauuaauaaauccuuagaaagcagaaaccaugucugaaugacucaguauacauuguccguuguggcaucacuuacaaaagguuacugagauugacgaaguaauaaaugaugaguucagcugggcgcuguggcucucaccuguaauccuaacacucugggaggcugagacagguggaucacuagagccuaggaguuugagacgagccuaggcaacacagggagacgcggucucuacaaaaaauuagcugggcaugguggcguguaccuguagucccagguacucaggaggcugaggugagaggaucaccugagcccaggaaguccaggcugcagugagcugagauugcacuacugcauuccaaccugggcaacagagcaagacccugucuaaaaaaaaaaaaaaaaaaaaaaaaaaaaauuugcuuuaaagggcauuguaggaaaauugaaagugaccucuacuuggcggaacuccucuaaaaccuagguuaaaccccauuucuaccacuaucuggcuguuaauccuggacaaauaauaauacuuaauuucucugugucuugaucucuucagccuuaaaaccagguuuauaaucacacaugccucccagaauagugagaaaauaauguuaaaagcauuuagcauggugccuuucacauaguuaagcacugaauaaauguuagccaggguuuuuuuuuuuuuuucauuuuuguuuuuguuuuuugcuaacaucaaacaacguuacaauuauugaaaagguuuuagcauagcuagagcauucucugucccaaacacagaucagaagacuccaaaguucaggcacagaauuaagcaggaacacauccuuguuucuuauauucccacuuaaaaacauuuucaagacaagagaauaauauacauuuucaaaauuucuuauaaaaucucaaauuucaaaagaauaaagugacacagaaagcaaucaguauuuuuucugauagccaauacauuaccaaaauuuuaaauucuguauuuuaucugacuaauaaacuuacuugcuucauauuacgaagacuauaagcauaggaaaauagaaaaugagcacaaaaucaaauccguaaguugaaauuaucaaggaaguuacaaguaaacaaucucucagagcaagaucuaacagacuuuuuccauagagguccaaauggucaacuuuuacgcuuugugggccacauaagguuuucuuccucuucuuccucuuccuauuucucucccuuccucuccucuucuaccuuuuccuuccucuccucuucccucuccuccuuuaacaacucuuugaaaacacauaaaccauuccuagcucuguggccaaacaaaaacaggcuucaggcuggauuuggcccuggggcauaguuuccuacucuuuuuauagagcagggaugggcaaacuacagaacacaggcuaaaugcugcccacagccuauuuuuguaaauaaaguuuuauuggaacacagccauucccauucauuuacaaagugucuacugcugcuuucccaccccaaagacagaguugagcaguuuuaacagagacccuauggcccacgaagccaaaaguauauaccaucuggcccuuuacagaaaaauguuugccaaucucuguucuagaguaaugagaauacuuuguuacuaucacucuucucuaucucuuuccacuacaggaagaacuagaacaaguggucuuaguuacuucauugggaguuauuuuuucuugccaauguuaaauaccauagaaaccaaacaucauaaauuuuauaugugaaaguguuagguagagaaaacuuccagacauccaccuguuucuuuaaaugaguugcauguauuuucauagucuuuguaacagcagagaauaggaaauacuacuucuuacaaaauguugaaagagaacaauauaaaguggaaauauccagaaaaaaaaaacagaauaugauauagaauauaaacuuaagcaggaaaaacacccuuuugugguauaugaauauugggugagcuugcauggugccugagagaacacaguggcucauuuuauucaggacaaugaccaauucugaaaauauugcuucuaccuauccauuucaauuuaguauauaaaaagguauaaagcuauguaaacagagcaaaacaccauauauaucugccuauauaaauaaaaaaaccuaacccaaauaaaaucauuuccaaaagucauauuucucaauuagcuuucucucaauucuguaagcagaauauucauucuagaaauuaaacuuggaaagcacugugaaauuguuuuuauauguauuuacauuucacuuuuucucugcaugaugcauaacucaaaaacuccuuccugcccaucucagaagcuccaggcucuggcuccuuucaccccuacauccucuaauguucacacuguccaguuuagguggaggccagugcuaccuccagagauggacucuugcuuugcuuuccagcagcagaccagaauuugaguugaucauauccagugaccucaacccuagaguucaggauucgacaaacacagagggauuucuauugaacuuucacccacacuccucaaucauccauccuucaaccugagcaguuaacccuuuucauuggugcuuaaaaccauuucccauauugguuugcauuacugcuuggaaauugaaaauccuagcagaauaagacccgugagggcagcgaucaugucagcccugcucaucaauguaucuuuggccuuagcucaguuucuggcacacaauagaggcuuaguaaacacggauggauggauggauggauggacggacggauggauggauggauggauggauggauggauggauugauggacagauauaaacugcaaacaucagaauuguuauugguuucuaaaccauacagagcuuauccgcaaaugucuuugcaaaccuauuugaauaguugaaacauagugguucuggaguucauaaauguaagggaucuauuagcaauuaaugaugacaaggacuucagcaagcauaaauaggcuagauagccaggucuuggaacccaucaaucuauuggucucauuuucaaaaggagaaaauguuaguuuuuggaaauacaggucaauaauuuuauguugagaaccugaaaaaauugcaaaugguauuauuaaccagauguccuaaaaaacuuacucaagaaaaaguagauuaccagcaagcaauacuauaucaccaagaauaaacgguguuaaauuuaccucaacuuugguuuugacgagaaaauacuacagguauaaagugucuugauuuuuguaagauauuugaugaauuaauauucuuuaugaucaaaauggaaaagucaaguuuggaugacaggacaguaagguguauucaaacuauugaaaaauuaucacuaaagggugcuauuaauaaauuaauaucuucacuuucuuacauauacagagugcccaacuagaacuagcagaaaugagcaggaggcacaagcucauuuggaaaauuaugaaaaugcuaacaauucgaaacguuuuaaaauggaugaaacaacuuuuggagucuuuaagcaccuguucaagcacauggugacucugacuguccagaaggaaugauuuagaaugguggaagaaaaggaaauucuuacauucuuuucacuucaaaauucugagagucuaugaaauaucuauauacaagggaaacaauggccugaggaaaagucauaugggcagguucugacuccaaguuagcuuuucaagcuuaaucuuucuuuacucuuuuuaaauuuauuuuauuguauuuauuuauuuuuagaaacagggucuugcucugucacccaggcuggaguucaguggcacaaccauagucacuguaaccuggaacuccuggauucaggcaaucucucaucucagccuccugaauagccaggacuauagaagugagccaucacuuuaaauuuuaaaaucuuuacaucuuuaguagagacagggucucacuauguuggccagguuggucucaaacuccugggcucaagcaucuuccagccuugcugucccaaagugcugagauuacaggcauaagccaccacgccuggcuaauuuauguaauuuuuaaauauccagaaggauucauuaaaaacauggcaagaaaagaggaugugggaguaaaauaauagaguaauauauaauagaauaauaauauaaaauaaaaugauaaucuuauauaauacaauauauaauguauauauuagaaugauauauagaaugauaaucaaagaacuaaguaagaagauugccaugcaauuaccauuugcagcaacaaugauuuaaucaugauuauagcucugguagauauaaaauaguuguacuuuaaguauuaacacuaucaacggucaguauggggcaacagugugugcaugugagugcgugugagugaaugugugugugugcaugggcaugccacguguguguuuuucuccuaaauauuuaaggcaaaagccuaaagcaaaugaggcuauuucuugaagaugaauguucaaaguaagaagaacccuguaauuucuuuuacccauggauaacauucuuuaucuccccauccagucagauucaguaagcgagaauccuuaauuuccauuaaucuaaccacuacuagauugaaagugugaaaaacaacaauaaacuaaccacuucauguaguucagauuuuaggcaagcuuauucuuuuuaggaaaugcugaaagaugccucaaaccacaaaucaggcuuuauuucaauaaauguuugugaccacauauugauaaugauaggaggcagccaaaugccuagacagauagggcaggucccuggugaaaccccaccuccaagccaaagacaguuuaaagccugaaagccaagcuacaaguuaaauccuccgaccagauugagaacuugucuuccuguucgaugcgcuuuccucuuauugauccccacccuucaccuauuuuacauaucccuacccuuuccuaauuggucuucuacaccgucauauccaacuuugaguggugucuuugccucaaccuuuugccuauaaagaccccagacucagucaguagaggaggagacgaccugacuucagggaggugacagccugacaucagggaagaugaccugcccuucucuuccccucuccagcugagaacuguuuucaucacucaauaaaacuacccaccuucaccauccuucaacuaucugugugaccucauucuuccuggaugccggacaagagcucgggacccacugauugcggguauccaguaaggcugucacaccggcccuuugcccuugacggcggagggcagccaccccacacaacaaggcaagaggccaacugagcugcuaacacaccgcuguccguggacaguggaauuuaaggagcacuguaacauccucucuggggcuuuggggucaugggcacccucacaggggcgccaccacauuccccucaaggugacaugccuggucuggccacgggcccugcauggagcuugcuucugugucagcacccagaguggcuggccggauccuacgcucgcuugcucaugugcugccuccugcaagggguugagugugacgagccaaguagagggggcuccccugccgugaguuggugaaggggcugagaaaaauccugcaucaauauguccaagguuauaaaugugacaauuaaaucaggggcaaaggacaugaacuggccaaggauacuguaucacaggacaagaaucuccuagaauuguacuuguguccuacauaaguagcaaucagauagcaacguaguaagcuuucauaaaaauaaagacaccuaauauugcauacaaucaaauauaaaauaaagcauuuaagauagaaaaaucuaaagaguuagucauuuauggcucagagccgugguaguauauuuuuuaaacucugugugugugugugugugugugugugugugugugugugugugacaguccccagugagaaucagucugagaccucuuuccagaaacauauacacguacacaaaugcagggcccagacauagaucuucuaugaauauauguauaaagccauaauucagagguuccaguccgauucucaauaaaggguauuauacaguacauccaucuccuauuacucaaaaaccucucuuuaagaaguaaaagcuuuaucccuaauuguuacagcuuuugaaaaggaaaacacaccacaguccaauuuucuacgcaaaguaggcuuggccaccuaucuuccuucugcucauaacuaaaauguguuggcgguucugugucuccuccacucuugcugccugccucuccuguccucuauuuccuuuaaucgucaccuuccacuuuaagacucagcuguugcacaaauagccagaucuuaaccuucugaguuugcauacccaagccaucaaaaacugguagaaaaagccaucuuucuccuaaguggaaggauucuggauuugugaaauaccagucaaugaccauuagcuucuccuccaagucagccagucacauggucuuugggucacaaggcugagggcaaggggaucagaauucauaggaaaguaaugaauaauguuauugagguuaaaggugagauacgcaaucuaauaucugaugauggcaaauuuccuagcuuauuuccacguaaagaagaaacaaccaggauugaaacuaaauguaccgcauacuguuuuuuaaccuagccaaugccguaacuucuauuguguuuugaagauuuguaaaaauguaugguauaggacuccagauacaacaguauuuuagguacaaaacacauuugauagagauuuuccccuaucaaaauaggugaaaauguggaauagagauucauucuugccuaaauacuccuauuucuacuaagcaaaaaaaacuaggugaaacaaauuaacuccugaaauagauuuuacaauuuaaaugaguauguaucaauaggucuuagccuucgaaaggaaggcaucuuuuuuuaauguauguuuuuaaaaagaaccguucacauggaguuuguucugggaccagaaaaauaauuggaagaucuuaaugaaaauauagaauaaagaaaacuauuuuaauagaacaauaaucaucaaaauagauuaaaauuuaugaaugcauaucuccaccuaaggaaaagcagccauaguuguaaauagaaaauuuucugagcuugaagguuagaacuuuaaaugcccuucuuuuacaugguauaacuuuuuacaaaauacuuucgguuuaacaucacaaguuuuuuaauuacaguguuaucuuuauucuacuuugccccacacaaaagggacuggaaauaaucuugcaucuaggaaaaauaacuaaagaaaaaaaaagaaauaauauugcaucuaguaaauuccuuccaauauuaauauuuaugaguaggcuaauaguuaaucacuuugaaacuuuauaggaaauaauuauaaaacauaaaaaggaagcuugaaauauuuuuccucuguuuauuauuuuugaaauauuuuuccucuaucauuuuugcaaaccauauaucgccagguuuacauacggguccaaggcaccuucucucaucauuccagagaaaaaugaaguaucucccaacagaaaguauauagcuucacuauaauucaucugugugcgagacagggaaggggcauauuauaaugggaaggaacagauuuugacgcaccugauccauauuugaauuccagcucagccaguagccugcugcauacuccugacuucucuaaaccucggcuuucacaucugugaaacagggcccacacuaucuuagaaagauauaguaaagauuacaaacaaggccgggcgcgguggcucacgccuguaaucccagcacuuugggaggccgaggcgggcggaucacaaggucaggagaacaagaucauccuggcuaacauggugaaaccccgucucuacuaaaaauacaaaaaauuagccagaugugguggugggcaccuguagucccagcuacucaggaggcugaggcagcagaauggcgugaaccccaagaggcggagcuugcagugagcugagaucgugccacugcacuccagccugggugacagaucaagacuccgucucaaaaaaaaaaaaaaaaaagauuacaaauaaacauguuccacccaugguguguaaauaauaggucauauuucauauuauuuggacuauucauuaauugauuauucaacgauuuuugcguguuaaaaucuuguucuccuagcugcacugcagagcaaggucucgcauccauaguuagcuggaugaugacauacugagauuucugcaaauugauauggauguacaagaggcuggaugugcaaggcaaguguacuggcaaguguaccagcaagaaugaggcagugugauuccuucaucaaaaaacagguggggccaggagugguggcucacgccuauaaucuuagcacuuugggaggccgagauggguggauuacccgaggucaggaguuggagaccagucuggccaucauggugaaacccugucucuacuaaaaaucaaaaaucagcugggugugguggugcacgccgguaaucccagcuacucagguggcugaggcaugagaaucacuugaaucugggaggcagagguugcagugagccgagauagcgcuacugcacuuuggccucgcgacagagcaaacuccaucucaagaaaaaaaaaaauacaggugggucuaagaaauuuccauucuauuccccgccugucccucucugucuuuguuacaggauaccucaucaaaugaaaacacaaugaugaccacauacacggguaaccagagcuauacuaccuuuccugggaauagcagagcacagauguaaagacugaaagaugacguguuauauuuugguuugugauucugcuaauacccccaggacaaucauuucugaaacuauuuguacccuuacuuguauuucagacuuuagcgcacaguuaaggaacgauuuuuaauacauuuuccuccagacuacuagcauuucuuuaucuauauuaaaauuaaagauuaguguuaaaauuaaaaacuaguaucaugaaaauccacaaauagucauaagauaucauuuuagucacaacuccuugcuaauuuacuaugacaucucuauguuucaaaauuaagaaguccaaguggccagauuuauuuuuagcuucauuuuaauucuaaaagcccuagcuuuuaguaacaagugauaacgcugugaaucaggcagucaacuaaaggaaaagaagcagcaaagaacugggguagcaauuugccggucaaaaaguucaaaauuccgaagugggaaggacauggggacagcuguggaguggggagcuccuuccgcugugggguccgguucgcuucugcccgggugugcacgguuucuccuuaugucucacuucuaaccacaggacagcccuggugcagacucuagccugcuccuaucuucagauugacguucagcagcugaaggauuaucugugcugacacgucugauuagaaauuaccaguuuacuuucaaauguguggagaccacagaggggccaacauuuacuuucuauucagguuuaucuaccuugcaaggagcccuagaggaggcaucucuuccuucugcuuuauuacaauucaauuuuacuuguaaacgaaaccuaccccaggggauuucuuaaaugugaagguuucgcuuaccucuuccugggaccaguggcucuuuggcaauuccauuugggacuuguuccuaugucuccaaaaguagaggaaauaagcccauuuuucacugcucuaauuuaaaaucauuuuaacagaguucauacagacuagguuugggucaaaaugauuuacuaguacagcacaguuaaagucaguaaaaauacuggggccaugaaugagaauagauugcuuagguugguagaguuuacugcuuuaaauuuugugcuaagaaaacugguggaggcugacaucaaagaugguaaauuaagcauuaguuccaauuuguggugugacagguacuaguauuaaauagcuguucucccuauuucacuaggaagcaaagaagcaaagcuuucauacuauuaacuggaaaacaaagaauaaaguaugcuuacuucacaagcaaaaauaaaaaaugggaauucaaaucucuggcuuuuuucugcauuacaaaagaguggcuucaugauuucugacccgugcagcuccagagggucacacuuguucugcugucaucaucuugaaauucuuaauaauuuuuuuugagacagggucucacuccauugcccaggcuggagugcaguggggugaucauggcucacugcagccucgacuuccuagguucaagugauccucacaacucggccuccugaguagcuaggacuacaggcaugcaccaucaugcccagccaauuuaaacaaauuuuuuuucuagagacaaugucucauuacguugcuugggcucuuaauaauuuuugaacaaggagcccugcauuuucauuuuguauucagucucccaaauuauaucaccaguccugcauuagauauaugaacauuauuauucuauuacccuuaccuucuuaccaacagaauguguuuauucauucauucacccaauguccuaaucuguugagaccuacugugugcuaaagaugcaaaacgcuccaauaagacagauaaacucacgaucuucauggaguuaaaaaugaaaagaaaaaacaaaacagugaaaaaugauaacacuuagaaaaauacuuaagugcuaaugugaccuuuaaaacuuuaacaaaaauuucacugggcaguuaagaagguuacaguauuccuaaauugaacaaauauaccugauuuugcugcuccuccuggucuuccagagcacccccgccuucucuccaacaggcuacacccuaagugagaaagcaguguuccuccaaggaaaauugaaguagcaaguacuugagggccaaguguacgcauuucaggaaacugcuuuucaaauuuggaaagguuagcauuuuagaaaggagcauaugugcuuccaaguacaaguuaaaagaaugaaacucaaugugcacacacauucaagagcuccacuugucucuaaguaucaagcucuaagcaccccagugagcuauuaucccauuagauguauuuggaucaucuaugagaggcagucuggugugauggucuuaaugaaaaacacaacaucugcauuaauugguggcuuaugaguaucuuuccaacaacucaauuuuuuuuuuuaagacagagucucacucugucgcccacgcuagaauguaguggcgcuaucuuggcucgcugcaaccuccgccucccagguucaagugauucuccugcuucagccucccaagggugggacuagcuacaggugcaugccaccauauccagcuaauuucuguacuuuuuuuuuuuaguagagacggaguuucaccauguuggccaggcuggucucaaacuccugaccucuagcaaucugcccaccucagccacccaaagugcugggauuacaagcauaagccuguaaucccaugagcccagccccaacaacucaauauuaaugcugacauuugauaauauuuuaaaauagaaaugucugguagcacacaaacaagcauguccuggcagcuugccagaaaagacacguuauccaucaaccaagacugaauugaagagaaguguucucagugcauucaccaccuuuaaaauacacacgggcagcaugucucaacccauaucacuggaaauuucucuuuuccuuuccaggaaaagagcaaccaaguuaguuguuaucuaaaguaaaugguugaaucaaucaucauggagugauaggacaaaagcacccuacuaaagaccccugacagaaaugauuaaaucagcauaaagcaacagccgcggacuaccucacaguaacauguucaacuguugggcauuucugugcugucuguaugagugcaacuaaaguaggaacagauauaagaaaaucgucuuuugaaauuaacuugaccagagauauauacauuuaaacagaauuuuauuuuaagcauucagucauuggcauccaagacagaaaacugcauagaaucugcauugugccaugaggugugagagugauggacacaagaagugacuuagccaaaggaaggaaggaaauuaccagcacaacacagaggacacggggcaagcaagucaugaaccccaaaucaguaucuugcucagguaaacaccugaauucaaaaguuuccagaauacguuucaacaagucaucauucaaaugcauauaaaaauugugacagguacagguuaugcuaagaggccacagucgggggccaggggagcugacagucaucugugguagauggugcucucccaaauccccaccaaaaacauugcucauaaaguuucccaggagcucaggaaagagaagauucccuccagcugggcaaucagaggagacuucauggauaagucaacauucaaaccaggccuuaaaaggcaaauagguuuggggucugugaagagaggagagaaaggugaagggaacagcguucagcaaaggcacaacaauguuauucuaaucuuauguaaccucucguguaacuagugcacaagaaacaucagaagauucaguguggcuaaaguagaauaaacaagaccggggugaauggaugguaauauguccaguagugccugggguaacacuguaggaggucuuuaucuuacagggagcagccaagguauuuugagcaugaaagggccaugcucacacccaagaggauuacucuggcagcaacaugaggcugcauaggagugaggcaggcaugcaggaagggagcccaggccaagggcagauacucuccacccaccacaagucuucugagccauuuugaaacaaaugugauagugcaucaggacacuaaacgagaacaauauuuaaugccagaaggcuuuuuaaauggucacccagcaggucaugacccagcaggacaugacucuuguaacagcaugcuuccaugacauagagguauauacuacauuaaguaacucucuuauaguaaauucaagacaaugaaauuucuugucauucuaucagauucagcuucuaguuucagauuaauucaguuuuacagcacauucuucugucccauuucugacaucaauuucaaaaauuuuuuuaucuuuuucuaauaauauacuuguuacaguuuuuaaagaauuauauacaaccaucaaagauauuauuuucuuuuuauuuugcucaauucccccgaggaucagaaaugaaagcuccgaaaccccucaauugagcccuaaucuuagaaaauaucacuucaacauacaccugcaaauaucacuggcaaguuucauuuugugaagauagaauaacgaucuagcaauauaacaugauacugaagcuugcuguugguagaauaacaauggcaucuuucugaggaaaagagucuacugaccaaagcaaugaauuuauaaacuccucagggucacagcccuguaguacauuuacuucuuuguucccauaguaccuaucacaguuucaagcacaaagcugcagcagaaucuuaagauuaaaugagaaaauguauauaaacauuuauuguauauuacgaagugccauauuaaaagcagcuggcauuaguugacuuagaacucuaaagaacuaauuguacuuuuaauuggucucagugguuaugcaaaagagauaaaaauacaaauuuaugaacagguaguaaucagacuauaaacacaugaaagcauaugggaagagagauggggaauuaaagauggggucucacagaagggacagaugauauuuaaaaugccaucagaaguaagaaaacccauuauguggugacagguguuaaaaaaaaaacuuguccagacacugagaacaugcauaaggauaucugcauggcaucucaaauuaugaucuguggaggucaaauauaucuaguaacacaguauauuuaccacguccugaauaagaagucaccuacuaauaagaauauuacaaguccaaaaaucagcuagcuaaggaaaugcagugggaaagcaauagaaaacuaaaaguagaugaaaauagaaccaaaguccuuucuuuguaguucuuccuuuacaguucuuuauaauucuuuacuguucuuucuuagucugcuucuguucauuacguuacccccaauaucuagaauguuuccuggcacagagcaggauucaauaaauauuuauguaaccaacuguugguaauagcgaccauuuauugggaaucuacuuuaucaugccugauauuagguaacuuacauguuuuuaaacuucacaaaaauucaaagaguuaauauuacuauuaggaccuaauauuacuauuacauccuguaaacaaaggaccugaggccaagagucuguaacuuguccagaaccaggaaacugaugaacagcagaauuuaacccugucuguccagauccucuguucauuugcuuugcacgacaacacauggccauagaguaaugugaacacacgaauaaaggugguacuuuaagacuugcuaauacaagaaaaaaguacuaacacuucauuuuacuuacagacuugaggaaacaguuuuuucuggaaucugacugcauguaaaauccuaaagcaucccacauggggggaaaauguuauucuaaucccaugcuguaaguaaugcuacagaaacaaucugccaaacccuacaagccuaacaagcuaaauaaggaaaguauagagaaaugaaaauauuucccugguccaauauuuuccaccaucuuagaaucccaucagauucagaguuccagaucugccucaucuggacugcaagauuauuaugguaaaaccacuccacacaaaguacaauugucugaaauuacacugaagucaaauguacaucaaaaggugccacacagggaagaagagcucaccgcuguguaauuuaaugaaaccuacugagcaccaagggcacagacagccaaauugaauuuuaaauguuuccuaccaggaggcuauaaucaggauagccaccaguggguggaugagauaaacgaacugacuuucuuccaccaggcgaucaaaauagaauaccaucuuuaugcaugagacaaaaaaaaaaaaaaagaagaagaagaagaaauuaaaauauucagcuuucacaaucucucucucucuuuuuuuuuuuucuaacuacauggucacuucuagauucugcuuucccccaagguaucuuuuguuaaugaacaucauaauuguuuuccuacuuugauuuuuauugcaaucuauuccagaccaaaaacaaaccaaaaaaaagugcuauuccuauaaaguacaaacuucuccaucauccugguccaccagcguaguaacuguuaagcagcuggcacuaucugaggggaggcuuaaaauuaugauuaaaguagacacagcuaggagcuugccuuucaaccagcacaaucaaauguaaaagaaaaugucaaaauucaaaagccauguguuuuuaagaguaaaugaaguaguaucuacccacgugaagguuuucaaaacacuguuuucauaaaucuauguauuuuacccugaucuuucucaugagcucuaugcccaguguuuccaacuguccauuuggccuuccaccuuaaagucccugcagaacuugaaccaaaagcuguccagaacucaacucauccccuugcuuccuaaaucaggccuccuguagacacaucagucuccaaaagcagcggccucauucuacgaggcucauggacuugaaaagagagagcugcuacugaugcauaaucucacaugacaaucaguugccaagucacgucgacugcauuucucaucccaucuuucaucucgcucucuuucugucuuacaugucccagaguccagggucucauucugcaaaucgcuaagaagaggguaacaagacccaaccaugugaauuguaguccagugagacuuuuaucaaacugggguauuuggaggguaaggccauuaaggaaaucaaugcagagccaauccuacaaagcaggaucaggggagaggauggaaauguaaugaucauguggcuaccacagcuaacccgcaaccaaugggaaggcauuucacaaugcaggaauuugaucaguagcaaaauauucaagagaucugaacguacccuugccuggcccuuuugugggggugugguuuuaauggcaaugcugaaaauucaggagaaaggauucagggucugcagcugaguuuggcuaagacagacagacgaugaccuuguuccauagcuuacccaauauguguaucuuacaggaucuugaggauaucaaccaaacagcaaucaucuuagcagcugcaucauucaucuguacaauuccacacaccagauuuugagccuccugaagacagacaucgucauauuuaagucauuauucaacacaaggccuagcaucugccauucugcaaaguagaaauuggaucaaaagcugcaaaauugaacuggguuaaaaguauauauacaacagcuuuucaaggaggccauauuauauuaagucucagguggagagcaaacuauuauugcauucucugucaggcacuuugguaggcucuggaaauagugcggugauuaaaacagaccucugaccuuggggaguuacaaucagagaagaaagauauuauacaccuaauugcaaaaauuaaguuaucacaagcauacaauauuuuaugaagaaaauguacaggaugccaaauucuuuuuuuuuuuuuuuuuuuuuuaagacaggguccugcucugucacccaggcuggagugcagugcacaaucucagcucacugcaaccucugccucccaggcucaagugauccuccccccucagcccccugaguagcugggaucacaggcacaugccaccaugccuggauaauuuuuauguauuuuuuguagaaacaggguuuugccauguugcccaggcuggucuugaacuccugggcucaagcaauucacuggccucagccuuccaaagugguaggauuacaggugugagcuaccacauacggcugggugcaaaacucuaacaguuguaccucccaaucaaauaccuagacaccaguguuaacuuacacauucaaauaauauguagagaaauuccagaaugacauuuucucuuuccaaauuacaauaaugguuaccucuaccucacaaggacuagcauaagugaaagaauccaggugccuuccagccaacaaaccuucaaguuaacucuuccacgguuugccuaaaugaacaaauuucucaugcaagcaaguauagggauaaacagcaacuccugguucauaccucuucaccucuucauuggcuuuuaaucucaucaauauccugaacaaauccucaaugcaaguccuucuggccacugccucccucuccagcuucaccugacccauccucccucguguccuccggucuagugugccucgaaggcaacuugcucccucacacccaagcgccucgucuugucccugcuguucccucucugagaggcucccuccccuccuccuccgugucaggccucgacuccagccugacuuccuuaggaaugucuuccuuggcacccuucuaggucaugccugccugugacauauuuucucuuucuaauguuuaucaugucuguaauuuuacuuucauuuuggggagaauuugauuaauguuugucucucuugcuagauuuagauuauuaguaggcaagauccagacuuuucugagcagcaauguaucuccaaggccuagagcagagccugacaccuaaaauacauuuguugaauaagugaauaaaaacaaagaaccaauggccgggcacgguggcucacaccuguaaucccagcacuuugggaggcugaggcaggcagaucaccugagguggccugaugaacauggagaaaccccgucucuaccaaaaauacaaaaauuagcugggcgugguggcacaugccuguaaucccagcuacucaggaggcugaggcaggagaaucacuugaaccugggaggcggaaguugcggugagcugagagcgccauugcacuccagccugggcaacaacagugaaacucugucucaaaaaaaaaaaaaaaaaaaccauuaauuuuuuucuuuauguuuuuauaucuaguguguaccaggguaacuuccuuuaagacuagaguuaauauucuucuuuggaguaauuuuaugguaguaauauucuuacguagaccugacuauagagucuauaaaggaacaggcuuaaugucuaggauuauaauuuucccuuuagauuggguaaugcaaacccaaguaagaagggcaaaacaacaaaaacaacauuccaacauauaccaaacugcagaaaauaaugacuccauuguaguucccuucuagacaugaagagaacauggaaaaccucauacuuuuacccaagacaacugugcacacacagccaggaagaagaaauaauacagggagcuuggauuguuauggggagccaaaucuugccaagaacgagaagucuauggugacucugaccauguaccuagauucccacuuucuagccacacacauguugaaaugacauaguccuguaaggaguccacugcuuuaugugugugcccaauugcaccccacagcaccccaauacacccauauggaaggugcauuaguagauuacugagagggcaaacaggauaaucucaucauaagauggcauuagaggcaugugcuuuaauucaacuucuagagcuugagggaauacacagaaacaacuaggaaauccaugccucauacauagugagucuugcuaaggagcacaauaucaaaugaggauuauauuuuaucacagaaucauaacauuuacagcuugcaggcacauugcuuuucccaaaaaugugauauggcaaauauaugagaacuauaaauuacacuagauugacaagaguacguuuugugugucacggccuucaaugcaauuggcucuugggacauaccaugagcauuaacucauagacaacaaucaagggauagcuaguuuauuugcuuuacucuaauacguagcuguaacacaaauaacauaagcugugaaagcaaucuauuaggucuccagacuaaaagaucaauuuacuacaggugacugacagcaauuuucaaugguaaacagguugauaaauaacauucauuuauuucuuuauaaguaaaauauaaguauaauuuaaaauaucaaauuauugaucaagcuguuucuguaccucacuuccguuucugucuaugaaugcucccugcccaccuguuugcccaaugggacucucuuagccuccuuugguucugagggcugccugauuagagaaucauucuuugcucaaauaagcuauucaauucaauuugucaaaaguuuuucuuuucauaguauuauguaucacguguuaugagacauccuucuugggcaaaaaggaagccauuaaugguuauugcaggaugcuuaaccuaauaaaauuuaggacauuuuaacuuuagcuaugauuaaaaucuacuagauuuuucucaaaaaaauauauggggcacccucaccccauaccuugugguaaaucuguuuccauucccugaacucccaucagaucucuagacuaauaaaauaagaauagauucauuaaaacauggagggaaaaaaagaaaacgccaaauuguuuaugaaaaugagauguauaaaaucacucuuacaucuaauuauuguguguauauauauauauauacacauacacagcauuuccugcauuuuuaggaagaaaaaaagagugucuuuuugugugaagcagugaaguucagugacacugucagcugcuuuaguugucaucaguauuccccuuuuaagcccccaggugugcuggacaguuaguaacacaugcuuacaugcagaccaauaugcaaaugauucuaaaaucagagauaugcacauuguaacacuguaugauaaaccacaucuacauaccaugguaacgacaauauuuacuacuuuaaaaaauaacccacugaaagccaaaacaguuguaauuuauuguauuuucuuucccccuuuucauuaacuuuugaggaacuagaaagaaaaaaagaaaaugcuggcuacuuauauaaacagagauauaaaauuacugagauauucauucauucaucuauucaucuaaaaauauucauugugacagcaggucuugacucuacuucagaaaauucuucaaaauccuuuucuuucuauucccacagcuucacugagauucucaccaucgcuggccaacauugcuauaacaggccuguaacugccuuuccugcuuuugguguuccccaagccaauccucacugcuacuagacuauauaguuccuaagucaggugcacccauagccacugaaaagcuucaauuuaguuaaguacauaauccucagcuuggggccaggcacgguggcucacgccuguaauccuagcacuuugggaggccgagguggguagaucgccugaggucaggaguucaagaccagccugaccagcauagugaaacccugucucuccuaaaaauacaaaaauuagcuaggcaugguggcaugcgccuguaaucccagcuacucaggaggcugcagcaggagaauugcuuuaacccagguggcagagguugcagugagccgagauugcaucaccucacuccagccugggcaauaagagugaaacuccgucucaaaaaaaaaaaagaauccucagcuuggaacauaaaucagggccuucauaaccugacuccaucuguccucuccacguuagucccuaucacaucacucucaccucauaccuuguaguaaaucuauuaccauucccugaacucccaucagaucucuuuacaauuccuuggcuuugaggacuugauguuccccugucugaaggcugaggaggcugucugcucaccagacccaggucaacuagcaccucugcugugacgccuugccagucacaaugucacuccugcccugcacaccugcagcauuuuguucauacucuaguggacccuggacauuccuagauuaaacaucugugauuuuggucuagucaccaaaaauccuauaaguucauagcaagacacaauccuccauacugccuuggcagcaguaugaauuugaauuauguauuguguuucacccaggauccauccagggaagccgaaaccauccuagauauuucaaacacagagaauuuuguacaagaaauugguucuacagaugacgaagagcuaaaaggccaaacaggagcuaaagaggcaacccagaaaguagcaucaacagaaaacuauugcuguccauuagauaggagugauauugacagaagauggcauuacuagugaugagaggacugggcuuccugacuaggguaggaucauguugugauuuucugaugagagcugggaucaugaagggcagggcuuucuaggaggaggaaccaugcccacgaaacugcacaaggaaaagcaagagaaggagaaauaaccuggauucucccagucuccuucugucuucuaaaagugccucccacuggcuggauauccagaugccagaugcuaagucuuccaggaaacguaguccuugugauuuacagccaagcagggaaaggucgggauggaaaaugaguggcacacagugugugaggcugcugagccccucacguggcugccgagugagccucaccagcugaucaccgucugagcaaaacacagaagugugugugcuacauaucaugaguccuuggacuguaauuauaccuugcauguugguuuccucuauaagacugugagcucagcaacagcaggaacccaauuuuuaucccaacacguagcacauuauuugacauacagugggcacucgauaaguaaaugcccuuaaccaccaauccccuggauuuacaacauacuugaacuugguauuucccaaaguuuguucuguugaccauuaauucaaagagauguuaaugcauauuacaaguaaauagggcccugccauucccaaauaaguuugugaaacaaaguguuaaauaaacuuaagcugguuuguuuauugcagaauuauucagagcuuuuaaaaugugcuugaagagggaacuguaguaugacacaccaucguuucaacaugcaugacgacuaaauacuuuuuccaaagaacuaacauuaugcaggaaccucaguucuaaggggacauugcuuaaauaucuucacauugguagcauuacuuccuuuuaucuuugaaauauucccaugagguacagaagaauaaggucacaucuuguagauagaaguguugcuaauaaauaauuaaaucuaaagaauacaucaaguauuaauuggauauauaaagugucauuuacuauucuagucacugcagcauuagaauaaaaauauaagucaucguuccuacccuauuugaagagauaagaaaaacagagaaccauaaaaugaaacuuucuuuuuuauccaacaauauuuuuauacaugcuuuguacaucaagauacauggugcuauuugauuauuaaaaaucugagacccauggaggguaauuauuuacugaagugauaagcaggucagcucuggagcuuacaauuucaauuucaugaauucuaacagcaaaucacuaacuggaaugacaucuaccagauaaauuuuuuuuuauuuuuuugagauagagucuugcccaggguggagugcaguggcgccaccucgguucacugcagccucugccucccggguuuaagcgauucuccugccucagccuccugaguagccgagauuacaggcgcaugccaccacaccuggcuaauuuuuguauuuuuaguaaagaugggguuucaccauguuggucaggcuggucucgaacuccugaccucacgaucugcccaccucggccucccaaagugcugggauuaauuacagaugugagucaccgcacccagcccagauaaagaaaauuuuuuaaaaacuagauccccaauaauaacuuaaccaauauuaaugaccagaacugagcaauguuguauccaacccgacgaaccucuaaaaaugaccauuuaaaaaucucugagaaauuccuggacuuuuuuuuauuaugauauagcuaaaauuuccauuuguuucuacauuuuauugauccagauugauaaaguaggacauuauccuucauuuuuaaagacagacacaaagccuuugguuuuguuauuuaagaaauauguccuuuggaauuaauauuaucauuaaccuuaauaaaggauuauuacaaaggcuuccaacaaugggugucuacacuagaaaauuuagccagcacacgaucgucuguuaaauaauuuuuaaaagacaguaugcuugcuuuggucagauauuuuggcauucuccccaaauggccucucuauuacauauuacauuauuaauauuaacauguaauacaauuuuugaauauuggcaaaaaguuacuauaucauauuaccaauauuucuaucauaccagaagcauaaacugagggccaaagagacaauaagaauauucccuuauguugagacuuauucauggugaacaaaaauucugauuucuaaauauaauauaaaguagaaguuuaaucaacacuuuuaauauuauggugauaguauucauagccuaaucaguaacuaaugggauaacuuugguuuucaugcucuaaaauucaguguucucagcuguuaaaaaaaaauuaaucaccugcuucacugaggugaaaugaaaacugaauaaguucuacagaucaagggucccuucagggugcaggacccaaauaaauuaggaaaauauugaauccuauauuccuccccauuuuaucugggagauuggcaauaugcaucaacacaccaaaagcucugugaaguucugccgcaaugaaucuauuaacuuuccaaaaccaagugcuucucaaacauacuugucccuaaaacuuguuuuucuuuuuccugguagcaccuauugguacacccaggaauuaauguuccucagaacucacuuaaggcugaugcuucaagggagcaacaagaucaauucuugugacauccaagaauaaaaguuuugaguugcugcuuuuauucuuucugauuauaaccaacacccacaauaagacacccuugccaaccuggagaguucaaauacagaguguguaacagugaugacuuuguguggagugcaaauuguaugcaucucacgauauuuacauugaaucauguaaguaucauugauauguaaguaugauaugauacacagaaugauguaaagaucucuugagugugguuuuugaguucuuucuauggaaauguuuaugaauuuacauuccucaguugguuuccuuugugacuaacaauuuguuuucacaagauaggucaacaauuugcauuucagucuguuagugagguuaacuaauccauacugaccauggccucagggguaucuggcuacggcuguguuugcuggugaaacuaagggaaguaaguuaaaaaucaaacaacucucuuagaaagacucuacucugccuaaaguaaauggagaacugaaccaggucaaaaauaaauaauucuagcgaaaaaguguugcauagcugcuaauaaguccaaguauaauggaaaacucuauaucccacuauuuuaagacuuacuaugauuauuauuuuuacuucaaaaauacaaaguuaaaaaguaaaaaauaguaacucaaaacggggaaaaacugauaaauuuggcaaaaaagaaacuagaucugagccuacucuaccagaacauguagcagcaacaucacauuguugcaggacgaaggaggaaaaacacagcauugggaaugauggugggguuugcaauuuguagcuggagucauacaucaaaauaugguccucaucuaaguauagcauggaaaauauuucauucuuuuuuaugaguguauauacaaggcuaaccaucaccuaaggucagcaagcaauauaaaagcaaaaccaacaauaaaugcaucuguuccuacaccaguucugauguucugcagcucaaaucacaucacccccaaaaugaccacugcagagguaacaaugauucacucuaagcuuaacagugguguaagucuacaugccaauacuaguacaauaugagguuuuaggcaaauaaaauugguuuguauuucuccaaauauggucuguggaccaucugugucuagaacacguggggaguuuguucaaagugcucccugggccccacccagaccuucccagcagucucucuggggcuaggccuuggacuguuuacauggaauaagcucucuggugauuuuuaagccuacuagaaagcuaaaagaauauuguauugagguugggugcaguggcugacaccugucaucccagcacuuugggagacugaggcggguggauuaccuaaagucaggaguucaagaccagccuggccaacaaggugaaacaccgucucuacuaaaaauacaaaaauuagccaggcaugauggcaggcgccuguaaucccaguuacuaaggaggccaaggcgggagaaucgcuugaaccuacgaggcagaguuugcagugagccgagaucacaccauugcacuccagccuggacgacaaaagcaaaacuccgucucaaaaaaaaaaaaagaauauuccauugaauccugauauggagaacuuagaaacuucacaggaaagcaucaaaacaauaaaaaucuuucccacguuaaggcuuagaaaacaagcuuuuuagaaaaaaaaaguauguaaaaaacuaaacuggugaccaugacaauuuggaaacaucauuuaaaaacauuauuagauaucaccaccgaucccacagaaauacaaacuaccaucagagaauacuguaaacaccuccacacaaauaaacuagaaaaucuagaagaaauggauaaauuccucaacacauacacccucccaagaugaaaccaggaagaaguugaaucccugaauagaccaauaacaggcucugaaauugaggcaauaauuaauagcuuaccaaccaaaaaaaguccaggaccagauggaugcacagccgaauucuaccagagguacaaggaggagcugguaccauuccuucugaaacuauuccaaucaauagaaaaagagggaauccucccuaacucauuuuaugaggccagcaucauccugauaucaaagccuggcagagacacgacaaaaaaagagaauuuuagaccaauaucccugaugaacauagaugcaaaauuccucaacaaaauacuggcaagcugaauccagcagcacaucaaaaagcuuauccaccaugaucaagugggcuucaucccugggaugcaaggcugguucaacauaugcaaaucaauaaacguaauccagcauauaaacagaaccaaagacaaaaaccguaugauuaucuccauagaugcaggaaaggccuuugaaaaaauucaacaacccuucaugcuaaaaacucucaauaaauuagguauugauggacguaucucaaaauaauaagagcuaucuaugacaaacccacagccuauaucauacugaaugggcaaaaacuggaagcauucccuuugaaaacuggcacaagacagggaugcccucucuuaccacuccuaaucaacauaguguuggaaguucuggccaggacaaucaggcaggagaaggaaauaaaggguauucaauuaggaaaagaggaagucaaauugucccuguuugcagaugauaugauuguauaucuagaaaagcccauugucucagcccaaaaucuccuuaagcugauaggcaacuucagcaaagugucaggauacaaaaucaaugugcaaaaaucacaagcauucuuauacaccaauaacagagagccaaaucaugagugaacucccauucacaauugcuucaaagagaauaaaauaccuaggaauccaacucacaagggacgugaaggaccucuucaaggagaacuacaaaccacugcucaaugaaauaaaagaggauacaaacaaauggaagaacauuccaugcucauggguaggaagaaucaauaucgugaaaauggccauacugcccaagguaauuuauagauucaaugccauccccaucaagcuaccaaugacuuucuucacagaauuggaaaaaacuacuuuaaaguucauauggaaccaaaaaaagagcccacauugccaagucaaucccaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaacgccgcauaucuacaacuaucugaucuuugacaaaccugacaaaaaugagaaauggggaaaggauucgcuauuuaauaaauggugcuaggaagacuggcuagccauauguaaaaagcugaaacuggaucccuuccuuacaccuuauacaaaaaucaauucaagauggauuaaagacuuaaacguuagaccuaaaaccauaaaaacccuagaagaaaacuuaggcauuaccauucaggacauaggcaugggcaaggacuucaugucuaaaacaccaaaagcaauggcaacaaaagccaaaauugacaaacgggaucuaauuaaacuaaagaacuucugcacagccaaagaaacuaccaucagagugaacaggcaaucuacaaaaugggagaaaauuuucgcaaccuacucaucugacaaagggcuaauauccagaaucuacagugaacucaaacaaauuuacaagaaaaaaccacacaaccccaucaaaaagugggcgaaggacaugaacagacacuucucaaaagaagacauuuaugcagccaaaaaacacaaggaaaaaugcucaccaucacuggccaucagagaaaugcaaaucaaaaccacaaugagauaucaucucauaccaguuagaauggcaaucauuaaaaagucaggaaacaacaggugcuggagaggauguggagaaauaggaacaguuuuacacuguuggugggacuguaaacuaguucaaccauuguggacgucgguguggcgauuccucagggaucuagaacuagaaauaccauuugacccagccaucccauuacuggguauauacccaaaggauuauaaaacaugcugcuauaaagacacaugcacacauauguuuaucacagcacuauucacaaaagcaaagacuuggaaccaacccaaauguccaacaaugauagacuggauuaagaaaauguggcacauauacaccauggaauacuaugcagccauaaaaaaugaugaguuccuguccuuuguagggacauggaugaagcuggaaaccaucauucucagcaaacgaucgcaaggacaaaaaaccaaacaccgcauguucucacucauaggugggaauugaacaaugagaacacacggacacaggaaggggaacaucacauaccggggccuauugugggguggguggagggaggagggauagcauuaggagauauaccuaauguuaaaugacgaguuaaugggugcagcacaccaacauggcacauguauacauagguaacaaaccugcacguugugcacauguacccuaaaacuuaaaguauaauaaaauaaauaaauaaauaaauaaaaauaaaaacauuauuagauacaaacauauaaaauuuuguguucucuauauuauaaaagauuuauuaauuccucaacauccuugcuuuuaauaaauccugagcuuagagugcaugcucucacuggugcucacugucagccgccuguaguguaucuuccuuucuuuccuuuuuuuugagacagagucuugcucugucacccaggcugcaguggcacaaucucggcucacugcaaucucagccuccuggguucaagcgauucucaugccucagccuccagauuagcuggaacuacaggcacacgccaccacaucugacuaauuuucguauuuuuaguggagccaggguuuugucauguugggcaggcuggucucgagcuccuggccucaggugaucggccugccuuggccucccaaagugcugggauuaugggugugagccaccgcgcccagcaugcaucucccuuucauuccuuccuggcuggcaaagccccacucccacuguuucaccauguaggccuccaucugaagcuugcuccuuuauauuaucaguguucgugguugugaugaaaggcauggucuguggcccuaaaaaguaugaccacugagcaagaguuucucaucuucuuccccaaaggugcugaagaccaggagaucuuuucauuagucaaagcugauuuaagugccauucuaccuugcaggagaaauucagaaggacuggcuccuagugugcccuucuggccuaaucauucuauguuuccaagauguacaugacuguacagaguuggccaagggacguccaggaccaucccugugaucuauaguacggucuuccuaucuuucaauuaacaauuucuuacugaaaauccacugcaugcaaacuucagaaguuguauuaaggucuuauuuugaauacuucauauccaaaaucuugugucugguauaaaaaaugauaaauaaaaggaaauguuauauauaauucauauauuauaacauauauauguauguaucuauauauaauaugcacugagagagaacugcagacaauuuguugugacaagaacuaagagaaauggaacaagaaugugcuaaaucaauaccaaacuacagcagcagacccccuuuauagcucaauuuuagagagguuuauagcagauuaugacacaacuacacuuuaacucaguucugaaaguaagccaucuaccagaagucucaucuucuuaaauaggaaaugguuaacucagaacaugguuuucaaggugucaucucugaaccagcagcagcagcaucaccugaaaacauguuagacgugcaaacuaucagguacuccaccaaaucuacugacagaaauucugcaauccguguuuuaaaaggucccacaggugauucugaugcauacuagaguuuaaaaacugcuggcuaaaaacucaagacaacucaccuggaccuucuaucauagguuagagugagccaaauaaaacaagaguaguuauuauaguaaucuauaaggcauaauuuaaaaaaaaaaaaagagcccugccugcuuccccaagugaccuaagaagaagucucuacauuucuuuaaauuagagcaacuguuuucaguuaagacacugucacagaaagccacuaugcccauuaauaugccaacacucauuauuuagcuuauuacucagcugucacuuggcagagagcuuggauauaaagaaaagcauaacguggcauaucauaugacaggucagguuuacaguaaagcaagggaacaagagucccaagcagucucccucaagucaugaaagacaggcccagguggaacucuacaguaaggagacucugaaaaggcaaugacgcuuucauaacauagagcaagggaugcucaaagaaacauucugacaucauuacugucuucagcagcacuuaacugucuauuaguugagaugaucuccggcuucuuagaacagaacagugucuaagcaggaaagguaaugguuuacugcugauuagcauuccacacgcauuucauauguauauaugacuaacgaucaaacuaaacauggaauaauauaaauaugggacucucuuugguacuuccucauuacugcaccagcaguuucuuaagaugaaauguacacauucagauucugacauuugcaagcaccaccugacagaacuuaacaaauacgcuuaauaugucuuuacaacauucuuacguguaucauuugcagggcauguaaaucuuacuaauacgugcaccaaaaaguuugauauuaauuuuuuaaaauucuguuaaaguccuuaaugacuaaaacgguauuugaaagcacacaauuuuauauucaccaaucaaaaacauuaaagccucuauuuucuccuagcauccuuaccacacuauauacauguuaacauuuuuauuuuacauuguauuuccccacagccuuucuacaugccuuuuaaaaacucaguugaggguaacucaacccacacugguucuuuaaaguuagacauaaacauaccuuauaauaugaaauggagaugguggcaauuaaaguuucuguacagauuaccacaggaaaagugauagucacugacuccuugagguauuccuacuauagguagaaaauauccauguauggcagccccauuuuacauugcucuaucaguugacagcugacauuuuaaccucuaaccaaccauagcaagaagauucagaauuaaguuugacaauuuguccuuuaacuuguuccaaaguacugcagggguuuuacugccugauguuauaccauauguacaaacucuagacacagcaggcgggguuaagcaggaugccucuguauuuugccauucuccuguuuccuguuguuuuuggagcagccuaacuuuagcuaaacauaacccuccugggcauaucauuuuuagcaggagaaucugccucauagcaaaguucccuguauguugauuacauuucugaagcauggcagucuaugagauucauagaacucacugguuuggcauucugccgagucuuuaugaaacccaacucaucauaggaaaaauuuauugaaauaaaauuacuuacugcauaaguuuuugugaauaaaaacccaaacaauuaugaaaugaacaagcuaccuagggaauucuuuuugaaacuuuuuuuuuuuuggucaucuggucuccauuaaguaacagugauaaacagcagauucuuuaaaacuuuuuccauauuucaaguuauuuuuuaauucuaaauuuacuguuaucuuugguaauggguauguuuacuugugcccucgagaggugagauucuguaaaacccucuuagauuuuacauccagaauuauuuuugccaguaugagaaauauuuuugagaaauuagagaauaucagcugcuacuaacaaauuuuauuuaucuuuauuuauuuuauuuauuuauuuugagacagagucuugcucugucgcccaggcuggaguguaguggcccaaucucagcucacugcaagcuccaccuccuggguucacgccauucuccugccucagccuccgaaguagcagggacuacaggcgcccaccaccacgccuggcuaauuuuuuuguauuuuuuaguggagaccggguuucaccguguuagccaggauggucucgaucuccugaccucgugauccaccugccuuggccucccaaagugcugggauugcaggcgugagccaccgcacccggccagcugcuacuaacaaacuauacucuuagcuuaaugucaguaacucuuaccaagccagaguucaugaaaaguacucacaaagaaaaaaacaugguucuuuaaaaauauauauaauuuccccaauugucuguccccuuggguauucuguaaaguagaacauuuagcucuauauaauucaaaaaaaaucuauacauagcuuagggaaggaaccauaaaucucaugggucucagauucacuuccuguugccuuccuucauuacacguuuaaagauaaucaauaaaaacugauuucucuuuguaagcauuuuccuguucugccagaaauaauagcaggcccugcccuaaaaugaaggaaaaauggaaagcaauauuuaccauaagaggagaaaaugaaacugcuuaagcauuuuuccugagccaagugaaacacaaacagcagaccaacuuuauucuuacagaaaaaaauuuuaaauacucuuggcauuaauucuauucuuaaaaucuauucuuaaaauuuguaaguuuucaaacucugaauuuacauuuccacuuucaaugacaacuucuuuagguuuccuaauaguuuuaaguacauaccuguguaaauauacauaucacaugcaagacuuuugucaguguuaaacauugaagcuguaaagagaugacagguaggucccccacacugccucccgggagggacuaaggugcaaacccaaugggaaaaaacccaaaugagaacaaaguuacaucaguaaggaaagaauggacaauucuaucucacuuuaaaacaaaacuuucuaucucauuucaaaacacaaaacuuugccacuugcauuuucagcacaagaauuaaacuuuacugaaaauguuacuugaaaguuuuauauuaaauacucugaaauaauccauugggguucucuaauauggggagacugucucacaacuacucauuuuuaauucauuuuucuucuucuggauucuucacaaaagacuguaagaaaacaccaaaugagggaguaacagaccuuuacuuuguaaugaaguuccaaauacauuguauaaguuuuccaggcuuccuauuucccuucacucugcacuaucuauggagguugucauauuucaccaggguggacuguaaaucagacaaguucagccagucagguugaagaauggaggugaaaagcacaguggaaaauacauaaaguacaauuaaaaccauaugaccaaagauauugaagcaauacuugcuggagggaauccaaguaaaaaucaaaccuuuucuggcguuagugaaacuauccaguccaucugggacaagcacacaucauuugcuaaauaucccuuuucuuuuuuuccacagcaagagcacccaggaaaguuaagaccuaacaagguaauuaaguggauagcuaucucuguagaauaguuaaguucauaguuguuauauaaaacugaucucucauuuaaaauaguuaacauuuauuuagaaauagaguuuaagauugggcaagaguaaauuuugcauccaccaaaguguauuagagguucaugauaacaauguugaaucaaaaaccuuuuccacuuuucugugaaaucuuuaccuuuaaagacccgaggauuccaugaagacaaagauaaucuaauugucuauuguuuaacauaacgaacaagaagcuauaaaauccaaacugucgccccuacuacaccucaaacaaccuagauguuacuguuucacauagguggcacuuagcaggccagugauguauauguacagaaauuaagaacucuugaaguuguaaagcagcaauucugacaauaaucuugacuuuggcaaccuaucaucaaagccauuccaaaucuauuucucuuaugcauuccaggugucauuuauaauaaucucaguagacaacugaaacauaacuuuuaauacugcuuugggauuccaguaaacaacucaagcucagcaagucacuuacccccaagaaacugaauuccuccagccacucuucccacuguccuggagaugaggucggaaacacagcaacccaugagggcagugagcgccaccaggaggaggaggccacaacccaggccggucacuauggugcagauccuccauucugcgcuggggaugcccuggaaggaggcauagcgcccacauuccuccaccaucaccaucaucugccgacucucaucaugcacaggauaugagcaccuccggaagguaccgaaggacacaggcuugcccagcugugauccccagagccaguaaggcauaaagaaccccacgcaggagguggcagcacaaagaaaagacagcaaagcccagauuacuccaguacaagucaggcuggaugccaucuuucaccagauagggcaaugaggaccccaaguaaguguucagggacugcaggagugaaugaaggugugaaaucaccagggacccacagauaauccacaguuccguaaugcagaauggaucuucagucuuacugggcaucaacuuuccauccucugcacuaaagaugauggucccugguaaaacaacaggaaacauuaaaaauuaaaggcauuaaaagaagugauaacacuguuucagcuagucuacaauuuucaauuaauaaacauugagacuugccucaacacuuuaaaagugggaagaacuaauucucucuaugagcuucauaacucgauuuuugucaaaccagcucaaagcuuuuucaugucuuuaucuuccguaaauauuuccaaauuaacucugacagcuauuuacuuaaagaaacgcccgauuuuuauuugacaggccaaugaauucauucuauauauuauauacucacauuaaaaguaauguagcacuuucacugggcaauaaacaauuaaaauaaaaugaaccaugccaugauuuccauuuuuuggcuugcaaguucaugcucauaguuuguugcaacuuuucuaugucccuuuaagggugcauuaacucucugcaugagccaaacaaacuaauuaggauaauuuuucacaauugcagaguaccauaaauuuaacaagcauuauggucugcggaggcacccacaguacagaacuauuaccagacacucuuuguacucauucagcagcauuucagaauuucuuuagucuuaacaucuucuaguguaaaagaaugccuguguaugacuuauuuugagucugcaguuuugauucauugauuccaacaguucuauugcaaucauuucucccacugaaugauugucuaauuugaacagcaauccauacuucccaguaugcuacaucaaaccccagucauccaaaugguuccaggggcaucuacuuccaccccagccuuucaaaaagaguuccuuaaccauuucucacacuuuccauaaagaaaugaauacagaagcacagagcccauccacccuagaauuccacccccaggaccccuaacuccagcuuucaggguccauagcaaauuucccccuuucuucaccucgccccuacccguuuuuuucucuaaccaccgcccauuuucaguucuggaugucacucaaacgggaggucggcuacuacuuuuuuuucuaaucuugucaacugcagucagggcugaaguugaucuaucugggccacgaggcuggggaagaccagcaggggguggccugcgggcagggggcccccaucuccaacugcggugaggcgcccucgccaagacaagcccauauuuagcccccugccauugccucaccgagccacuccacccauggagacacacaaugaucccuccauucuaaaagggggcaagaggcauuuuccagccggcucuggacgaagggaggggauaaggaugggaaggcagcaccccccggaggcagacgccaagagcggacgcggcuggcaggcagagccgacggauccgccgagcucaggaaguccggagcccgggagcagcccaacuccggcuccggggcagagagggagcccgggagaaagcagcggagcccacgcccacggggcagccgagugauuuacuuacauggcuggcgggcggcggccaccuucccucccgcgucccgggcgcacacacaacuugcugucuuucucgggcgggaacauccacgggaaaccggaccguccugcccuucuuugccucugucccuaacagccgcagaaccccggggcccgaccuggaagagcagggguuggcaggaggcggagggucuccagaagcgggcuggcaccagcggagacccccacucccggcgaguccgcggcggcagcucuggcggagcgcugugggcgcgcgcgggcgccggggaucgcacgcagaggagcggaucucccuuuggcaggcgaggcacgcaccgccuccu

SEQ ID NO: 191295 - RNA, 27948 nt, Homo sapiens
accacuuccugaagcgcgaggcaggaaguuauaugcuuuuucuggaguccuguagagaaagugcucucugccgcauugauagcagcgagagcuggagguguugggucgggagaccagccguucgaucccgccgcagguaggagcugguuuccauccuggcaccacggcacacaccuccagccucgagcccggcgcugcugcccgggggucuccuucaggcucuuugacgccguuccagggggcaccuauccaggcauccucugggccucuagccagaggacuggcucccggcuucagcacuccgggcugcaguaagaagugcccuuaucgcucugagcccugccaccaucccgugaaccaccgaaacccugguccagcgcgacagccuuggaccugggacuggacggauccaaaacgcucagccucggccccccacagacggggcucugcaucgucucugauaugucacccaccaucucccacaaggacagcagccggcaacggcggccagggaauuucagucacucucuggauaugaagagcgguccccugccgccaggcgguugggaugacagucauuuggacucagcgggccgggaaggggacagagaagcucuucugggggauaccggcacuggcgacuucuuaaaagccccacagagcuuccgggccgaacuaagcagcauuuugcuacuacucuuucuuuacgugcuucaggguauuccccugggcuuggcgggaagcaucccacucauuuugcaaagcaaaaauguuagcuauacagaccaagcuuucuucaguuuugucuuuuggcccuucagucucaaauuacucugggccccguugguugaugcggucuacguuaagaacuucggucgucgcaaaucuuggcuugucccgacacaguauauacuaggacucuucaugaucuauuuauccacucagguggaccguuugcuugggaauaccgaugacagaacacccgacgugauugcucucacuguggcguucuuuuuguuugaauucuuggccgccacucaggacauugccgucgaugguugggcguuaacuauguuauccagggaaaauguggguuaugcuucuacuugcaauucggugggccaaacagcggguuacuuuuugggcaauguuuuguuuuuggcccuugaaucugccgacuuuuguaacaaauauuugcgguuucagccucaacccagaggaaucguuacucuuucagguaguguauuuaagcuauuaugguguuagguuuauuuauccuuuugaaagagugugugacguuggagggaagcucauuaauuuacuggaaaucauuguaugggagauaacucaagguaaguuuucuguuucguccaaaugagcuucuuugaaauauuaaagccaaaaugaaugauauuagagcaaucaaaugaucacuaugcgguuaacagggagaggcaacccaucaaauaacacaaccgaguccagggauucaugccacuugcuuaauacacaaaugcacacuuuuaaaaaguguggcucauaugguucacauuuuuccuuuugucuuguugguuuuagguuucuagcucuauacuuucuaauccauuucuaccccuaccguuguacccagaauccagccuucuagugaauggaacaggguuuauucguucaaacauuauugaaccagcuaagggacgggauucuaaggccucuaaugaauaaggcagaguucugcacucaagaaauaaggaagaugaacauuuuaggagaguucagaguugccaguuaguaacugccuuugggagucaggcuucacauugcagauaacauuugacuuuguucuugaauaagauuccacgaggccaggaaauggcacaccagaaugcacaacacaaaguaaaagugcacugaggcaggaaaguacaaaaaaguacaggacauugccuaaauuguggaacuggguuugggaaaucgugcugagaaaggcugugacuaaauuaguaagauuuucuuuaauuacuaugggaaaagaguuuaaaguuuguccuguaaguaauggaggguaaguucuaaaaaauuucccuguuucucugcaugaguaaaacacauguaaguuuuucucuuuuuucuuuuuucuucuuuuuuuuaauugagauaguugggggucgggggggcugucucacuauguuggccaggcuggucuugaacuccuggccucaggugauucucccccuccuuggccucccaaaguacugggaauuauaagugugaaccaccccaccuggccuaagcuuuuuuguuuguuuguuuguuuuuaacuuuuguaacaacuagaaaacaaguaaaaugaccaauaucaggaauaacaaugucaggaauauagugaaauucuucauucugucagugaugaugaauuuaggggauucuguuuugaaauuuaagcaacugaacuucucagcuucugugcuaccuuggaaauucacaguagaguaaauguccagguaugugguggugguaggaggugucacaacuacacuauuuuccugcaaucuuauucucacagacaucuaaccuuauguacaccuccucaaacugcuaaugagugagccacuauuacuggugaaaugauggugauaguacuuuuuccucaguuguuugguugagagauaauugcuuugcacccagguagauuugucucaguguucugggguuccacuccugcuuuaugaauaauucacugcuggccgggcacaguggcucacaccuguaaucccagcacuuugggaggcugaggugggaggaucacuugaggucaggaguuugagaccagccuggccagcauggcgaaaccccauuuuugagacucugucucaaaaauaaauaaauaaauaaaauaaaaaauaagucacgacugggcacaguggcucacaccuguuaucccagcacuuugggagucugaggugggaggacugcuugagcugaggagguagagccagcuugggcaauacagcaagaccucaucucuacuaaaaauuaaaaaaaaaaaaaaaauagcuggguguuuugcgaaggccuguaacccuagcuacucaggaggcugaggcaggaggauugcuucagcccgggagauuguggcuucagugagcuaugauccaaucauugcaccccagccuggucaacagagugcaacccugucuuaaaauuauauauauguauuuuuuauauggagucucccucugacacuagacuggagugcaguggcaggaccucagcucacugcgauuuccacuucucuaguucaagccauucuccugccucagccuccugaguagugggauuacaggcaugugccaccacacccagcuaauuuuuguauuuuuaguacagacaagguuucacuguguuggccaggauggucucgaucuccugaucuugugauccgcccaccucggccucccaaaguguugggauuacaggcguaagccacugcgcccagccaaaauaaauuaauuaauuaaaaauaaaauuaaaauaaagaagucaaggcuggugcaguggcucacgccuguaaucccagcacuuugggaggcugagguggacagaucaccugagaucaggaguuugagaccaaccuggccaacauggcaaaaccccuucucuauuaaaaauacaaaaauuagguggaagugguggcauucacuuguaaucccagcuacucaggaggcuggguggggagaaucgcuugaacccaggaagcagagguugcagugaaccgagaucgcaccauugcauuccagucuaggcggcagagcaaggcuccaucucaaaaaaaaaaaaagaauaagucaguguaaauuaaaauccaguggcauaauuuugauccauuagggaacaguuguggcuaagggaguauaaauauaauaacucuugaacucauaacauuauucucuggaaugauguuuuaccaaucacucuuacauuaagagaaaguuccaauuuagcuaauuagcaauuuaguuuccauggccucuuaaaccuugauuucacugaggcuuucucaucuuaaguaacaucaucuccuuaauccucuguggugauauaaacagcagucucaggacaaaaugaaaagcagacacauaaaaagcaacaaacuggcugggcgcguuggcucacgccuguaaucccaacacuuugggaggccaaggcaggaggaucacaaggucaggagaucaagaccauccuggccaacauggugaaaccuugucucuucuaaaaauacaaaaauuagcccggugugauggcaugcaccuguagucucagcuacucaggaggcugaggcaggggaaucgcuucaaccugggaggcggagguugcagugagcugagaucgcgccacugcacuccagccugggcgacagagaaagacuccaucucaaaaaagaaaaaagcaacaaacugauaacagacaguaugcauucacagaguauuucuaggcagugaauuguuauuauuauuauuauuauuauuauuauuauuauuauuauuauuauucugagauggagucucgcucugucgcccaggguagagugcagugguaugaucucagcucacugcaacuucccccuccagggcucaagcuauucugcugccucagccucccuaguagcugggauuauaagcgugugccaccaugccuggcuaauuuuuguauuuuugguagagaugggguuucgccauguuggccaggcuggucuugaacuccugaccucaagugaucugcucaccucggcuucccaaagugcugggauuacaagugugagccacugugccuggcugucacuuguuauuuugaauugccccuuuuuuuuuuuuuccuguggaauuugaacuuuguucugcaguagauucuauaacuagcuuacuuuuuaauucaacuguuuauaucuguaguggacugcuguuucugguucaaacauuuuaguugaaaguuagaauuccuauaguuucauucuccuuuuuaugacugaacauaccacauuuauaacauuguucuuucuggaacuuauuaauaggauaagaaaaaccagugguuuugaaaaaguuauauagcacaggaagaauuauaugauggaaauauaauugcuuaggugauuaaagaggagcuaaacacugaggcaauguuuagaaaaucugaguauuaaaaggaagcguaauuguuuucuuuuuuuaauucuaaaauauguucuggccaggugcagcggcucacaccuguaauccuagcacuuugggaggcugaggugggcagauugcuugagcucagaaguucaagaccacucugggcaacauggugaaaccccagcucuacuaaaaauacaaaaaauuagccgggugugguggcgcauaccugugaucccagcuacucagggaggcuaaggcacuagaaucacuugaacuggggagguggaggcugcaguaagccgagaucacaccacugcacuccagccugggugacagagcaagacugcaucuccaaaaauauaaauaaauaaaaaauaaaugaaauacuaucuguaauuaacaguuuugauuguuacagauaaauggagauggaauauauuggguagauagauaauguaaaugagucaucugaguuggaggggacagagauaauuugagaaauccaugccccucuaaaggugaggagcgucaacucuaguaaguuguaguuuugugacaauaggaucccaagauugcuagaucuucuuuuuuuguuguuguugagacagagucucacuuuguugcccaggcuggaaugcaguggugcgaucucugcucacugcaagcuccaccuccaggguucacaccauucuccugccucagccucccgaguagcugggacuacaggcgcccaccaccaugcccugcuaauuuuuuguauuuuuaguagagacaggguugcaccauguuagccaggauggucucaauccccugaccuugugaucugccugccucggccucccaaagugcuuggauuacaggugggagccaccaugcccggcaagauugcuagaucuuaggcauauucaagagaaacuagaaauuccuuuuuuauuuccuaauuuuacaaacacuucuuaggcucauauaaaaacaugucuuuagcugagcacaguggcacgcaucuguaguuccugccacuugacaggcugagaugggaagaucauuugaggccaggaguucgaggcugcaaugcguuauaauagugucugugaauaaccacugcacugcagccugggcaacauagcaagacccaucuuuaaaaaaaucugucucaucuaucaucucucuaucugucaucuaucuaaucuaugucuucaggccagaucuagccuguaaacugguaauugaggcccucuccucuagcagcaguaguaacaauuagaagugauuggaauagggagcaguguauuuggguuuaggagcagggagcaagacgguuuaaugacagagaaggaagcuaaagauauuagaguuuauaaaucaguuuguuuauaaauaggcacgcacauacaggaauaaaugagagaaaguguugcuuugaaaaaguugaugcuauaaguaugaaucuaaccaaacuaaugacaauaaaaacaguauuuguaagacauugaugcuuuauuuauuuauuuauuuauuuauuuauuuauuuuuugagacggaguuuugcacuugucacccaggcuggagugcaguggcgugaucucggcucacugcaacuucugccucccagguucaagcgauucuccugccucagccucccaaguagcugggauuacaggcacacgccacaaugcccaccuaauuuuuuuuguauuuuuaguagagaugggguuucaccauguuggucaggcuggucucgaacuccugaccucaggugauccgcccaccucagcuucccaaagugcugggauuacaagcaugagccaccgugcccagcgacauugaugcuuuaaauuagaaagcaggacuauuaauuccuaccugaugacaaauuucuuuguccugcuuucagaacacauaauuuauaugacucaaaaugccuguuagaauuuggaaaagacuaauugacccauuucuagauagaccagguauucuuacauaggcuauaauacauucuuuagcauucaugucuaggcuuaaaauguuacccuacauucucagaaaaacaaacuguauuccuuuuuuauuuuuuugagacagcgucuugccaugucauccaggcuggaguguaguggcacaaucucggcucgcugcaaccucugccuccuggauucaagcgauucucaugccucagauucccaaguagcugggauuacaggcaugugccaccaugccugguuacuuuuuguauuuuuaguagagacaggguuucaccauguuggcaaggcuggucuugaacuccugaccucaagugauccaccugccucugacuuccaaagugcugggauuacaggcaugagccaccacgcccagccuauuuauucucauuaaaguaaucucccuauaauuuauugaauaaaaugaauucuuuaggaagacacaccaaguuuguuuauccugugcauuugaauuuccuuuggcauaucaccauauggggagacagaggugagaagggggaauacaaguagucaguuuaaagaagugagggagccaggcacgguggcucaugccuguaaucccagcacuuugggaggccgagguggguggaucaccugaggucaggaguucaagaccagccugaccaacauggagaaaccccgucucuacuaaaaauacaaaaauuagcugggguaguggugcaugccuauaaucccagcuacuugggaggcugaggcaggagaaucacuugaaccugggagguggagguugcggugagcugagauugugccauugcacuccagccugggcaaaaagagcgaaacucagucucaaaaaaaaaaaaaaaaggaagugugggaaaauaucuauguuccagaccucaugguuggagcuaaaauaugaaccuuuuuucucagugguguccaguugauagaaaagagagcuuacuugcuguggguguaucugaguaucuggaugacauaauggaaaacauuucuugcuuuagaacuagaccgcaguuugaaugccauuucuggcacuuucuggcuugugauucuguuuccuuguauauaaaguaggaguaauaaugccuaucuuggaaagugauuuugggauuuaaaugagauguccucuguuuuuucccagaucuuauaauagacacucaggugcgagcuauuguaccuuuauugguuacuaaugaauuguuacaugcucuuaauuucugcauucgugaaagcacuggacaagaucuugcagccacuucagaauauuuagucuguuuuuuaggucuuuacucggaaaucauguuuaugaaacuugaacaucagcuuugauaucuugaucauacauuuauauaccauguaugcuuaaguuuauaaaauacacaaaucaaaauuaaccaaaauauuaauaaugaaauauuuccauauuuuugguaauaaugauaaaauacauaaaucaaaauuaaccaaaauguuaauaaugaaauauuuccauguuuuugguaguaauguuucuuuaugguuguuggcauaacaggcuauggaugucucuagcaucaaagcaauguuaauaagucuaauaagacuacuggcuaucaucuaucaacauuggucugauuugugauaauuguguucauaaaacuucuuaauauauuuccuggccucucugaacuauuggcuuuuucauucuucugcaugugcgagagauggaaacccuuugaauuagggcuuugugacugacccauugucacuacuuccuucuuuuuauguauuuucuccucaaagcacaaagaaauuagaaauauccuugucuggguaccguggcucacaccuguaaucucaacauuuugggaggcugaggcaaaaggaucacuugagccuaggaggucaaggcugcagugagccaaguuugcaccacugcacugcagcuugggugacagagugagacccugucucaaaaaaagaaaaaaagaaauaaucuuaucugcaaacauugcugaaaccuguguaguuucuucuucuuuuuucucuugguauugguaucaaggaauuuaaauuuuagauggacuguguuuauuaaaauugguagacuaugcuaaacaaauuuacaauucuuuugccuagaaaaauggaacuacuuaagucuuauauaacuggaaaacuuuuacuuuucgcuuaacauuaauuggaauuuuggugacagugaaaauuauuuuuuuuucagggcuuguuaaacaacuguuuuaaaacagaugaugaccaaaacccugcucaaugagaauaguauuguacgugaaacucuaaagaagucauuauucaucucauuuugcagauggaauuaagaaugcaaaaauaguggacaugccaagugaaugcuguuaauaauauguaaaauuauuugauuaaacauuuauuacuuaaaaaaaaguggacauuagccucacuuauaaggauaauguuauuaauacauuauuguucauuccuuucgaaccagauuccaaaaugcuagaaauuauguuaagauguuauuuuauacugggcgugguggcucacacccgugauccuggcucuuugggaggccaaggcagacagaucauuugaggucaggaguucgagaccagccuggcuaacauggugaaaccccgucucuacugaaaauacaaaaauuagcuggguaaaguggcacacaugccuguaaucucagcuacuacagaggccgaggcaggagaaucacuugaacccgagagguggagguugcaguaagcugagauugcaccacugcacaccagccugacaagagugagacuccgucucaaaaaaaaaaaaaaaaaaaaaaaaaaaaauauauauauauauauauauauauauauauauaccuuuauguaggcaguguaaaauuaugaaaagaauguaagacucaacuucaggagguugagauucaaguucugccucugccucugccucuuagugauuuuuaccuuugguaaauauuuaaguauucugaguuucuuuuccucgucuguauuuaauaauaacacaugcuuagccuauccuguuugcuaugagaaucaaaugagauaacauauaagaaaggaauauuuaaauaccaaggcgaaauugaucuaaacaaauaaugcugucuuucugccucguaagugagguucaaacuguagugaucaccuucagugagcacagcagcaagagcaagauucaaucuaaggaaaaacccugacugaagaauauucuaauuguuuuugagaagaggugacuuaggguccuugaucaguugugccacauacaccauaaaauaaaaaguaaaagcaucuaaaauggagcacaagucuagaauguuugagcuauaaugcaaggauuuucuagccaaaucuucuuuuacagaugaagaaacugagacaggguuaucuaauaaguuuucuaguggcaaacugaaaugcaauucucagggugguuaaugagauacaaguuuugaaauuaguuguacuuauaaggugugaaaucacaauuuuaccacugacuuagaauguaacuuggacagcuugacuucccuaagccuuaguuuguucaccuguaaauuugggcuggugaaguaaaggaucuauugggcuguagaaguaaaggaguugauacauguaaaaugcuuagcauauuuuugucacguuguaugcacucaauaaaugauaccuccauuauuacuauuauuuuuagcuguuuagcagaaucuuccagaccauuauuuacucccuccacuaaauuuguucaaggugauagcuaauggcucaacuaucuuucacugaaacaacccagacaguacucuucauggguccucauucugcaccuacgagugugagcaaaugccuuuuauaucauauuauugagaugagaagguuauucuuaaacagauugaaagcauuagaaaguuuaaaaauauaagguagaaaaucugauguaaauaaucaccuguugucaaauuuaauaaagaacugaaaaggcuuggguauauaagaaauguaacugauggaucuuaggggauaugaaaaucauuucccaccccuagcacuuuccuugaauaaagugacaugauaggcuuuuguucauucaacucaguuguacacuaaauguaaugucucaccacccccugccuuuuugguuguuguugucaccuauuuugggucucuacguuuaagagucaggacuguuuuguucauuugcugugccugguacaaugccuugaauauaauaaagagguaccuaaauguugacuuuuuuuuuuuuuuuuuuuuuuuagacaaggucucacucuauuggccaugccagagugcagugguacaaucacagcucacugcagccuccacuuccugggcucagguaguccucagccucccagguggcugggacuacagaugugcaccaccaagccuggcuaauuucuuauuuuuuguagggauagggucccacuauguugcccaggcuggucuugaauuucugaguucaaguaauccucccaccuuggccucccaaagugcuaggauuacaggcaugagcaccuguacuuggcuaauuuuuuaaauaacauuuuaauugaaaguuauuguauauagaauuauuuaguaucaaugaaauuauguaauuuuaaaaauuaauuauagauuuaaaacauuuucagauuuccuuuuuuucuggggaacuguauuuuuaauaacaacaacauugguugcccuucugaaaaaagaaaacgaaguaucaguaguaaaagaagaaacacaagggaucacagauacuuacaagcugcuuuuugcaauuauaaaaaugccagcaguucugacauuuugccuucugauucuaacugcaaagguaagagauuuauaaaucaaauuuaucauuuucuuauaaguaucaauaucauggaauacuuacaaugccuuuuucauaucacaggucccuuuccacuaccauuagaauuuaacaaugaaaaacaauauuuucuguuuauuaaauguauuugaaaagauguaaugauaucaacuuuaauuuuaaaguaagcuaaaugucuuggaguauuguaaagaauuauguccauuggagaacuguuaguaaaugugaaccuuaaugauauuaaugcuuggaauggagauuaauaucuuuaaaaaucaauagcucugucuucuuauaaugaguauacauuuaauguuguaguaauacaauuauuuacuaagagugugacguaaaaagauauagggccaggugugguggcucaagccuguaaucucagcacuuugggaggccgaggcagguggauuaccggaggucaggaguucaagaccagccuggcuaacauggugaaaccuugucucuacuaaaaauacaagaaucagccggucaugguggcacgugccuuuagucccagcuacuugggagacugaggcaggagaaucacuugaacccaggacguagagguugcagugagccgagauagcaccacggcacucuagcuggagcgacagagcgagacucugucucaaaauaauaaauaaauaaauaaauaaauaaaaagauauagaaguauaugaguauuagaagucaauuuuuuaaaaauccauugaauuauuuaaguacugaaaggaaaauuauacgagaaacggggauuacuggugacuuuuauucuauauuaaggugucucaauuuuauaguucuaaaaauauuuuuaacauguuaggcuagaauaagguaaguauauuuuguuacagugaacuauugcuaguguuggaguuaauauuucugaaaucugcaaucuuauaggauuuucauuuuauauacuuaaaucuauguauauaaacacuuugcaccuaucuuuugacaguuuugaaggaaccauuagccucauuguuuucauuuuaaauagugaguguuuuuuccucuuaaugauagaaagaaggccagaugugcuggcucaugccugugaucccagcacuuugggaagccaagguaggaggaucucuugagcucaggaguucaagaccagccugaauauggcaaaacaaaaaauaaaaaaacuaucuggguaugguggcaugugccuggagugcuagcugcuugggaagcugaaguaggaagacagcuugagccugggagguggaguuugcagugagccauggcuaugccucugcacuccagccugggcaacagagccaggggucugucuuucucuugagacaggggucucaagaaaaaaaaaaagaauggaaaguucagaaaauaugaaaaguucaaggagcauaacaauauauauauauauuuuuuuugagacaaagucucgcucugucacccaggcugggagcaguggcacaaucucagcucacugcaaccucugccuccuggguucaagcgauucuccugccucagucucccgggcagcugggaccacagugugcaccaccaugcccagcuaauuuuuuuguauuuguuuauuuugagauggaguuucacucuuauugcccaggcuggagugcaauggcccuaucucggcuuacugcaaccuccaccucccggguucaagcgguucuccugccucagccucccaaguagcugggauuacaggcacaugccaccaggcccagcuaauuuuguauuuuuaguagagaugggguuucuccauguaggucaggcuggucuugaacuccugaccucaggugaucuauccuuggccucccaaagugcugggauuacaggcaugagccaccgcgccuggcaauuuuuuuguacuuuuaaugaagagaggguuucacccuguugaccaggccguucuugaacuacugaccucaggugauccacccaccuggccaaacaauauuaucuaauuauaugauuuaauaauuuuucauuuaagauaaacaguauuugcuggaggugguggcucacgccuuuaaucccagcacuuugggaggccaaggugggcugaucacuugaggccaggaguucgagaccagccuggccaacauggugaaaccccgucuuuacuaaaaauacaaaaauuagcuggguguggugccaggcgccuguaagcccagcuacucgggaggaugaggcaggagaaucgcuggaacccgggaggcggagguugcagugagccgagaucacgcacugcacuccagccugggugacagagugagacuccauccccaaaauaaauaaauaaauuaauuaaaaaaaaacaguauugaccuucuugguauauuuccuuugaaacucccuuuuuucccuauauaugugugugugcauguauguguguauacguauacuucauauauuuauuuacucauauacuuuauuuuauuuuauuuugagacugagucucacucuguugccuaggcuggaguacaguggcgcgaucucugcucacugcaaccucugccucccuuguucaaacaauucugccucagccucccgaguagcugggauuacaggcacacaccaucauacccagcuaaguuuuguauucuuagaagagacgggguuucacuaugucggccaggcuggucucaaacuccugaccucaagugauccaccugccuagacucccgaaguccugggauuacaugugugagccaccaugcccggccuacuuauuuauuuacuuuaaaagugaaauugaaucauauauaauuuuuuaucuucucuuugucuuauaccaaacauuucuauagcauuacauauuugaaaacauacuuguuaguagcuacaugauauaguuaguguguuaaauuuaaauuuuccguaaucucauuuuucuguugucuauuuugcuuauguuuuuaaauuauaaaaaugcacuagcaaauauuuuugugcauaagucugugauuuucuggauauuuccuuccaguagacuuuuuuuuuuuuuuuuuuuuuuuuugagacagagucucgcuuuguugcccaggcuggagugaaaugguuaauuuuuuuuuuuuuuuuuuuuuuuuuuugaggcggaguuucacuuguuucccaggcuggagugcaauggcaugaucuuggcucacugcauccucugccuccuggauucaagcgauuuuccugccucagccuccugaguagcugggacuacaggcaugcaccaccaugccuggcuaauuauuuuuauuuucauuuuuauuuuuaguagagaugggguuucuccauguugaucaggcuggugucaaacucccgacuucaggugaucugcccgucucggccucccaaagugcugggauuacaggugugagccacugcaccuggccuaauuuuuguauuuuuaguagagacagaguuucaccauguuggccaggcuggucuugaacuacugaccucaggugggugaucuguucaccucagccucccaaagugcuaguauuacaggcgugagccaccgcacccggccuauuuuuuauuuuuuuuaagaugaggucuugcucugucgucuagacuggagugcuguggcauggucauaacucaguguaaucucaaacuccugugcuuaagccagacucccaccucagccucucaaguaguuagaacuauagcugcuugccaccucacccagcuaauuuuuuuuuuuuuuuuuuuugagacagagucucucucuguugcccaagcuggagugcaguggugggaucucugcucacugcaaccuccuccucccggguucaagcaauucuccugccucagccuccggaguagcugggauuacaggugugcaccaccacacccggcuaauuuuuguauuuuugguagagacaggguuuuaccauuuuggucaggcuggucucgaacuccugagcucaggcaaucugcccgccuuugccucccaaagugcugggauuauaggcgugagccaccacgccugacccacccagcuaauuuuuacauuuucuguagagaugggggucucauuuugcuauacaggcuggccaauagauuuuuuuuuuuuaaguuuuuuuuuuugagauggauuuuugcucuuguugcccaggcuggagugcaauggcaugaucucagcucaccacaaccccugccuccgggguucaagagauucuccugccucagccucccaaguagcugggauuacaggcgugcaccaccaugcccggcuaauuuuguauuuuuaguagggacaggguuucuccauguuugucaggcuagucucgaacucccgaccucaggugaucugcccaccucggccuucccaaagugcugggauuacaggugugagccacugcaccuggccagccaauagauuauuaagcaggcaauuagugggucaaugaauguaauaugauugcugaauugcuuuucaaaagguuauacuaauuuauacugucuccagcaauauauaaggagguacuucaauuacaaagucuauaauacuguuuucuucuuuuaaacuuccccccuaauaacauaucuccuaacuuuuaauacuacagauuaauuuucuuuccuuuugaauuauauauuaauggacuauacaauauauauuuuuauguuugaugcauauguucuuuugcuuaauauuauauuuguggaauuuauccauauuuuuauuuauagcaauaguuuguuuaucucauuacuguauaguauuccguuguauggauaugccacaauuuauccauucuaucaacagauuuuuagagcuauuauguguaguguuucuacaaacauucacauacgugacuuuuggugaagauaggugcacauuucucauugguaaauauauaggaauagaauugcugguucauagaagaugcauaguauuuuguacugccaaauaguuuuccaaagugguuguuccaauuuucccuaccaccagcaguguaagagaguucugauuuuaaggaguuucacauccuugaaaacacauauauuaucuuuuuuuuuuuuuuuuuuuuugagacggagucucgcucugucccccaggcuggagugcaguggcgcgaucucggcucacugcaagcucugccuccuggguucacaccauucuccugccucagccucccaaguagcugggacuacaggcacccaccaccacgcccagcuaauuuuguguauuuuuaguagagacgggguuucaccuagccaggauggucucgaucuccugaccuugugauccacccaccuuggccucccaaagugcuaggauuacaggcgugagccacugcaccugguguauaucaucuuuuuaauuuuagccuuucuggugguuguguaauggcaucuuguuauugccauaauuugaauuucccuaaugacaaaagaaauugagcaucuuuucaugugauuauugaccauuugaauauccaaaguugcccuuuucuuuaaauuuguaaaguuguuguuucuguuuagauuucguuguuugagaugaggucucugucaccuaggcuggagugcaguggcaccaucacagcucauugcagcccugaccuccugggcucaagugauccuccaaccucagucacccaaguacaggcaugugccaccaccacgcccaguaaauuaaaaaaaauauuuuguagaaaagaguucuuacuaugauguccagacuggucuugagcuucugggcugaagcaauccucccgccucauccucccaaagugcugugcuuacaggcaugagccacugugccagaccaaacuuuuuaaaauauauuuugaauuugagucuuuuauuagauauguguauuacaaauaucuccuacuauauaacuuuuaagacuuuuuuaacauuuuaagauuaaacauuaaagucaguuuguaugucuuauuuuuacaaagggaaugaguaaaauguaagugaaauuauuuucuggacuuaagugaaauauauguuaccuuuaauuuuuuuuauggugaaauuuucuuuggcucuauuccaagaaguuaccguguauacuauuuauaauuuuucuuucuuucuuuuuuucuuucuuuccuuuuuuuuuuuuuuuuuuuuuuuuuuuuuuuuugacagagucucacucugucaccaggcuggagugcaguggcgcgaucuuggcucacugcaacuuccaccucccagguucaagcgauucugcugccucagccuccugaguagcugggacuacaggcguauaccaccacaccuggcuaguuuuuguauuuuuaguggagaugggguuucaccauguuggccaggauggucucaaaucuccugaccucgugauccacccaccuuggccucccaaagugcuggaauuacaggcaugagccaccgcgucuggccuuauaauuucuuuaaaaaaaaaaaaauugugugauauugaaguggccuuguggucuaggguaguaccugagguuugcugucucacagccacagagaucaaggacguggacacacaaagagugagguuaacagcagaaguuuaguaggugagagagagaauagcucugugcuacagagagguguccuggaaaaauguguugccagaucuguggugaaaugcaagggguuuuuuagaugagcuaguggggaggcagugucuguuuuaaauagggcaugaaaaaccgguaagguccaggugcaccauuuauauagggcaugaauuucuggcagcccccacccuaauuuuuuaucaugcaggcagguucucugccugagcugcaccauguugcccauuuuuuuacuguacacaugcuaacaaaaaagagaagguggagcuuucaugguggacaugccuggcucccagguagcccuuuucuguugguucagcugcuggcauucccccgugcaagcuuccagcuugcuuaucuauguuugcaacucaaguuuuucaggcugcucuucguuagaaaagaaaugauuuugggggccgcuuuuuguuagaagggaagcucugccgaggucucuuuugcccucacuaucugccuaaauaauuucuuucugccuacuguaucgauauaacuucacacuucuugaaaauguauuaguagaacuccuuuauauccuuuauccagauuaucuaauuauuaacguuuagcuacacuuuccuuauucuguagauguucucuuucuauguauauccauuacauaugucuucugaaauacuuuagaguaauuuguacacauuaugcacuuuuauccauaaguaccuuaaguauguauuuccuaagaacaaguuuucugcuuacaaaaccacaacucaauauugggaaauuuuaaauugauauaauauuauugucuaauuauaguccauauccaaauuuuacacaauaacaguccuuauaacuuuaauuuuuuucuuguuggggaucuaaucuaggaucacacauugcauucaguugguauggccuuucauuguccuuaauauccuugacauuuuugaagaauacaggccaauuaugcuguagaaugggcuucuaguuacauuucucucauguuucuucuuguuuggguugagguuauucagguauauaagacaggaagaucaaagaaguaauguuuugaugucugcagggaauuauacugaaagccauaucaugucucuuuaucccuuuaacugcuguuuuuaacuuuaauugcuuugcuaaucuauuguaaaaguacuauuuuuucuuuuguaauuaaaaacugacucauggggagauacuuugaggcuaucuaaauaaucuuaauuuaauucuuacucuuuuuugugcuguuuuaaagaauuaaucuaacuauacuuuaucccuuucauuuuauucaaucucucagauacguuuucccagaauuacuuuugaaacauuagaugaacuuaggaaauuuuauuauggucagucagaaaucauuaaaaauguauauauauauuggcaguuaugcuucauuuuaaccagauugauuugggucaauuaaaggcuuaaguucuuuuaaaccuaaaacuuucaaauugguaaauuuggauuuuugaccccguuuacuauaacacauuggacuuuuugaaguggaaauuuaguuguauuuauagccaucuaccaucccuaccaguacugaauuuucaguuguuuucacuuaauauuauuagaaaaccauaaggcaaaauguaccucguauaacuugacuguuguaccagguauaauaauaugaugcucacuuguaacugucaugggucaguaauaaaauugagguucuugaagaacuuacauaugcauggaggaaaauauuucauaagucacgaauuaaaauacuuuuuuguuuuuauauugcagauugguuuuucagcagcagaugcuguaacaggacugaaauugguagaagagggaguacccaaagaacauuuagccuuauuggcaguuccaaugguuccuuugcagauaauacugccucugauuaucagcaaauacacugcagguccccagccauuaaacacauuuuacaaagccaugcccuacagguaaaaaugaaauaaaaccuuacuaaauaagaaaggguaaaaugaggaacauucaucaauaccacuaauaucugagcguagaauuauauauauggaaaaagauuugaaaagcaucuuuuuucaauauuauuuauaugcacuuuuaucuuuuuaaccuccuaacagguuuagauacagcuucuuucauaugguaggcacacggauuucuguuuuuguuguuguuguuauuuaagcuaaaauggaagucaacucaauguuucuuucucuauagauuauugcuuggguuagaauaugcccuacugguuugguggacuccuaaaguagaacaucaagggggauucccuauauauuacuauaucguaguccugcugaguuaugcuuuacaucagguaagcuugcagugguuuucucaggaaauaaacuguucuguguaaaauaaggaagacagcuuucuacaguugucuuaaaauaaugauaauaaauuuuaagcaugaaucugacacugaagaaauuauugauggugcgcuuuaaacuuuaugacuuuucacuuaaugaguucugcuguucauagaaagagacuuuuuuauuuauuuauuuauuuuuuucccaagaugaagucuugcucugucacccaggcuggggugcaguggugcagucucggcucacugcaaccuccaccuccuagguucaagcauuucuccugccucagccuccugaguagcuaggauuacaggcacgugccaccacgccuggcuaauuuuuguauuuuuaguagagauaggguuccacuauauuggccaggcuggucuugacuccugacuuugugauccaccugucucagccucccaaaaugcugggaaugcaggugcaagccacugcgcccggcugaaagagacuuucuuauucauucauucauuaaaaaaaaaauuauucaacaaguauuuguuacauuuuagaauugauuccaaagccagcaaauucuacucuugcuaaauauuucucaguuuaucccuagguuucaguucauucuuucuugaauuccuaauaucuuuucuuucugaaaguauugagaaauaguauuggucuuaguuucuggcuuagcuucugcuuuuuuuuuuuuuuuuuuuuuuuuugagacagagucuggcuugcuugcccacugcccacgcccggcuaauuaucuguauuuuuaguagagacagaguuucaccauauuggccaggcuggucuugaauuccugaccucaagugauccgcccaccucggccucccaaagugcugggauuacaggcaugagccaccauacccggcccuggcuuagcuucuauauugaaaguuuugacuuauucuuuaugauuuugaaagcugugucaagcugcuuuuucuuucuuuguuaaauauguuuguaauccuuaaaagaaggaauccccacuuugcucuagccuaagcugcuguugcagaaugagauuuuuuuuuuuugagacagaguuuuguucuuguugcccaggcuggagugcaauggcacgaucucaggucaccgcaaccuccgccuccaggguucaagcaauucuccugccucagccuccaaguagcugggauuacaggcauguaccaccaugcccggcucauuuuguauuuuuuuaguagagacgggguuucuccauguugguuaggcuggucuagaacucccaaccucaggugauccacccgccucagccucccagagugcugggauuacaggcaugagccaccgcgccuggcccagaaugagauuuuuuuguucuggaugcaagugauucaaguaaauggcaaaggcccagaaguaaccuuugggacuuaacugcaguuauugcuaaugcauauuucugagucacuuuggauuuuucuagcuuauauccuuugaaaguuauauuugcuaauguaugaauuaauuuuuaacugaaacguaaaaauaugacuaccagguaaucucaguaguuuugugcauacaguaaaucauuuaggagaaaucuguaguggauccugucagacuaaauucuaugcuuauaaaauuauugaggccaaacugucaaauauaauuuuuuuuucuguuuugcacaugcuuaguuaaggcuagauauguaauagaagguuaaagaaauacuuuaacuagucaaugcuucaguauuucugucgguauguuauagcccaaaaaaaguauuuauuuagcuuuggauuucauuugagaauuuccugaaguguaaucacugaaacucagauaaccagaugcuuuaugggggaaaaaagguacaagaccaaauaaauucgagaaaugauguaugacauaagccuucuguaaguagugccuuaaugauuccuucaacaaauuuuuuuuuuuuuuuuuuuuuuuuuuuuuuuuuugagacagagucucacucuguugcccaggcuggagugcaguggcacaaucucggcucacugugauaccuccaccucccggguucaagugauucuccugcuucugccucccaaguagcugggauuacagaugagcaccaccucacccagcugauuuuuguauuuuuaguagagacggguuuuaccacauuggccaggcuggucuugaacuccugaccucaggugauccgcccaccucggccuuccaaagugcugggauuauaggugugagccaccgcacccagcuucuucaacaaauauuaagugaacaccuauucccugccagaaaccauucugaguacugaaauauaacuuaauaaaucaugcccaaaucccugcccucaaggaguguauguuguaaauauuucaaaaggcauacaaugaaaggaaccuuuucaauuuuguguaaguuagugucuuucagucuuauuugacuuuggaacuccuuuuucugugaacacccccaaaaacacuauucaaaggaauaccauuauugaaacacaguuuguuuccaucuuucuaaauuaaagguuaauucuugccuuuuaaguacuuuuugccucuuaaggauguuuuucuccaguuugucacauaaauuuugaaauacuuuucuuguguauauguaggagaaaaauauauauauuccuauuucuuuaaauauuugaguauuuauauauguaauaaaugcauacauauaaauauguauauauacacaugcaauauaugauacauauuuagguacaguacaaauaugagguuuugcauuuugcuguaugcauuauguauccuuuagugccaccucaucuaacauuuucuccguggagucuuucuugacuacuugugguagaauuaaucucucauuuaucuuuaugccccaguaacacaaugugugcacuucuauuuacaguacuuccuguauuuauaauuauuuauuccccauuuuccagccuagaauaaauucuucaaugucacagaaggaccaaggucacaucuuuguauugcugggaucuuuuuuuuuauuuauuuauuuuuauuuauuuauuuuuuuugagacugagucucccucugucgcccaggcuggagugcaguggugcgaucucagcucacugcaagcuccgccucccggguucacgccauucuccugccucagccucccaaguagcugggacuacaggcgccugccaccacauccggcuauuuuuuuuuuuuuuuuguauuuuucaguagagacaggguuucaccguguuagccaggauggucucgaucuccugaccuugugauccgcccgccuuggccucccaaagugcuggaauuacaggcaugagccaccgcgcccggccuguauugcugugaucuuaaagccuggccuauaguaggugcuugauaaguauuuguugaauugaguucaauaaauaccaugaaaauuaauuucagguuuaugacuuugauguucuuaauuuagacuguagcuuuauaagcuuuauaaucauacuaaagauguuuuacauuuuuccguagguuacaguguacagcauguauguuucuauaauggcuuucaaugcaaagguuagugauccacuuauuggaggaacauacaugacccuuuuaaauaccguguccaaucugggaggaaacuggccuucuacaguagcucuuuggcuuguagauccccucacaguaaaagaguguguaggagcaucaaaccagaauugucgaacaccugaugcuguugagguaaguauguuuuaauuuuagauaacauuaagcuaauacuaagauauuaauaucuuuguuuugucucuagaaguacuauaucuuuuuuaaaaaucauaucuguccauagguucugguuuagaaaucuacauauauauuuucuuucacaucaaggcugaggguuauaaucauucaaaucagcaagacuaguucccuuaaaggcguuucucaguaaaggagaggcgaucucucuuucccccaccuugacgaucacuguccuacacagcaggcacuauauaaaugcauaauuaauagcuuaaguuuuguagugauagaaaaagggaauguccauuggcuauuccuauaacagugauaacuaaaccuguauagugagugguuuguugauaaauucuuucaaagugguauuugucuacuucuagaguagauggacuggaaauuucuucacauuuccgaaugugaaagcugcaucgugaaaauagauaaucgggccaggugcaguggcucacgccuguauucuuagcacuuugggaggcuaaggcggguggauugccugagcucaggaguuugacaccagccugggcaacacggugaaaccccaucucuacuaaaauacaaaaaauuagccgggcgggguggugugugccuguagucccaacuacucaggaggcugagacaggagaauugcuagaacugggaggcggagguugcagugagcugagaucgcgccccuguacuccagccugggcgacagaacaagacuccgucucuuaaaaaaaaaaaaaaaaaaaaaacauauucggcuggguaugguggcucacacccguaauuccagcauuuugagaggcugaagcaggcagauugcuugagcccaggaguucaagaccacccugggccacauggugaagcaccaucucuacaaaaaauguagaaauuaauggggcaugguggugcacgccuguggucuuaucuacucacaaggcugaggugggaggauugcuugagcccaggagccagagaccgcagugagccauuaucacaccacugcauuucagccggggccacaagugagaccgugucucaaaaaagaaaaugaguauuguuuacagcaagaacugaaaauuguuuuuaauccuguuaguagcauuagagagauuaagauacauuaacauauuuugucauuggaauucagugaaauacugaaauguuuuaagaaaaauauauuuuuauucuuuauaaaguagaagcauguuaauugcuaaauacuuucauuuugaaauuguggaguauuuauuauaguuuuauuuuuacagcuuugcaaaaaacuggguggcucauguguuacagcccuggaugguuauuauguggaguccauuauuuguguuuucauuggauuugguuggugguucuuucuugguccaaaauuuaaaaaguuacaggaugaaggaucaucuucguggaaaugcaaaaggaacaauuaauauauaugcuacuggacauucuagcaagguaauuguaguuuaguuuuaauucggagagcaaugauaaucagugcacaggaguauaaaauauuauuuuaaacagcgaaauuaauaauauaaaaugccaaaugguugaaaaaauagaaaccuuucuguauauuugaucauauuuuuuuuuugccuugucaauguauuuaaaguuuacuuaaggucaggaaauucuaaaacaacuuuucuggccuuguuauuugauguauaucuuuuaaauuuacugaccaaagcauguuuuaagcugcaaugcaguagucacgggugguaaccauguagucagguauuguuauuaguaccuaucacugcugagcuguauuuaaaauuuugguacaauauauaaaauggagaagagcuugauauucagguacuaaccacaacuagucugacauuguuggcaguuaaaaucuuauuuugaauuguaaauuaguuaaauuuuauguggaauuugcugagaaaagaauauagacuacugaaaugucauuuuaguuauuuuucuuaugaccacauuguacaaaugaaucuguguuaaaaagacuauuuuaaauguauuuccugcuuuuguaagcauuaaagauuuauaagaaaauuauucaaacuauuuuuuauaaaaugaaaguuaugauuuuuaaacuuauugauuccucuugccccuacccccucuuuuuggaagauauuuugauuccuuauaaacuuuuacccuaagcuuauauauguuuucugucacaagugcuuccuggcacacagacagccaauggaggggaucaaauucaguguuguauguauguuuauggcaacauuuugaaaauaaaaauuaaauguuuuucuucaaguaguuuuuuuuuaauugcugagagaaaaaaacaguaaagcuuucugauuaaguaaaauuuaaaugggcaguaccauaauuuaaaaaacuaauacuuuaaagagagagacaaagauauuuugugccuuugacaaauuaaaucuaauaguggaaaaauguuucuuaauuaagcacuuuacuagugaaaaagaucucacaauuuaugccaaaucagguacuguauuuucauguauuaacacauaaccuuuuguuugaauacuauaguuuucaguggacaguugcuauuccaagaaaauuaagcuuuugaguacuuuagcaauucccagcguauuacauacacccagugauaagguucuuugcauguuuuguguuauguauuacucugacucuuuagagauuauauaaauccuccaaaaguuagacgaaacaagauaguacauuaugagucuuaauuuuaucauuguggaaaaauguguacuaacuccugauuuuguuaauuuuauaacauagguugaauuuuagagugggguuuuuauaaguaauggaggauaaaaugggugggagaaaauggcacacagcaccugaagaaagauggggcagugaccucuagaacucaugcauugccauuggaaagccuguguugggcaucgaugucagauccugaagaaucaccuggaaaaaaucccauccuagaggcaaggaggcuacaccaaaccauacacuacaguacuuugucacaugguuguccauuaucauguauuagagucuaaaugauuacuugaauaaagaaaaaaaaccacuuaacucuuacauaugaa

SEQ ID NO: 191296 - RNA, 67196 nt, Homo sapiens
gagggccggccgguuuggcggcggcugcggaggguaucugaggcucggcugccaagccgaacgggcucuggcuccucccaguggccggccggggcggaagcaggaggcgggggcagcgugcgcgcugcuggucuucucucccgcggcgcuggggcccgcgcuccgcugcuguugcuccauucggcgcuuuucuggcggcuggcuccucuccgcugccggcugcuccucgaccaggccuccuucucaaccucagcccgcggcgccgacccuuccggcacccucccgccccgucucguacugucgccgucaccgccgcggcuccggcccuggccccgauggcucugugcaacggagacuccaaggucagcgugggggucccugcagcaccgcaucccggcggaggcgaggcucccggaccggggagccaccccgcgaggcccuuccccacccccuucccccagcccguccgcgcagcccugcgccccgggcagccacgcgucguagagucccuggucggggccuguggcauguuuuaucucgggagcggcgaugcuuuguugaucuugucugcgugucgagguccgggcgucggggagggcaucagcuccccgcggccgcgucgcuggcccccgccucccccgcgccgcuguggggcgcagagcccgcgagcgcggcgcgaggguggggguagggcggcgagcgggcuugugugucugcgugucggggugggggcuuccucggcucccaccccgucccucugggaggcugggggcccguuguggcgaucccggggcccgccgaaggcagggcagggucggggccuccugugcggcguuggagcugggccggccucuggucuucccgccaccccguuucccgccugcccucggcgaggcccgcuccauuccccccgccagccuugggcuccgcggcgguuaggccgguucuggacgaaccccucggagcugcacugucuucccccucccccaacgccccugcaggcccgcgugagggcugguggccccagggucgcgcacuccguucucccuccccgcuuccuucucagagaggaaaggguguguguccaggucccgcccccguccagcuugcucccugucgagcuugcugguuugcgggguaacccgcuuccccgccuuuggggucccuccccgggacgcgagccgugccagcucgcccgaggccugggcaguccggaguuccggagugcuggaaaaguugccgccuugacguacccggcggggagagcacguuugaccgcugcugcucaucucuccuccaacucacuuuucuuagaccguuccucuuacuuucgucccgcuuuugaauugggcaccuucgcuuucaccucuguauuaaaauuuucauuggccuggaguucuuucugaccuucacuaagucaguuuugccagcgggaaaccgugcaguuuugaauugcgauuuacuucauuaagauacaccuccucuguacgcuguugagggccuagcuuuaggaaaaaacuuaauuaaauuucauucggggggugggauuguauacuucgagguggauuuggugcucuacgucagauaguagugccuuguucaggcagaauuuuaacauucuuuuuaaaaggugcugcucaagggucacaucuuaggagguccucuugaaugguugcuuagcacccgguaaucauucaaaaaguauuugucgaacaaugaguaaaagauuauaagguagcugauuuuaacucuuuuaaaccaaggcaccaguggugcuuagguccagggagcuguuaagacacacaaaccuuuaguuucugaccuaaggagcaaauguaaaccccauuguccagcucuuucccgauuacuagucgacuugcaaagcauuuuucugccuaguuuugagucuuacaacucauuggaaagauucaucuuuaugcugauagaugaaauaacugguguuagaaggacugaaauuuaauuuaugggcuuugaaaaauauauagugcauuugagaggaguauuuucacaaaacuaagugacagaaaaguauaagauuuguuuccagaguauauaagaggauuuuucuuuuuccuaacugguauuuuuucuuuguuuugcucuaguuggaaugacaaagauaaucuuaucaguuugcuauauuugagccuagggugaauuaauuuuauuucaagguucuuuauguuuuauagcauaauuaaacauuuuaaaaacuauguuaacaauuaguuguggacugaauuggaagcauuuucaagaggaacaucuggagaauuaauauauuucaucaaaucuaugauuauuguauguaccccugaggaagaaaguccugacaaaccauaacaugccagugaucauaaacauuuuaaguaaagagauauuaaauauggggaaauaccuuauaucaccuacuuuauuaugcauauuucuaagaggcccaccuggaaauaaguaggagucuuauuuuccauagccuaccacugaaccaccuuucccuugggaggaaaggcuuacuuuguacauugauugggccuuggcuguguguaucuuaguucauaaauuaaaaguugggcaagagcugguuuugauuccuguuucugguacauuucaguuaucaggauuuucuaaaacggcguuuuugcaugauagaaacuggagaggggccuaaaagcuaugaaagcauuuggguuauuuuaauuauuuuuuauacacaauauuuuauuuaauuuuuaauuuauauuauuuuuuugagacaggaucuugcucugucacccaagcuggagugcaguggugugaucacagcucacugcugccuugacuucuuuagccuccugaguagcuggaaguacaggcguggaucaccccgcccugcuaauuuuuauuuuuuguagagacaguucucgcuguguugcucaggcuggucuggaacuccugggcucaagcuauccucccacuuuagcgucccaaagugcugggauuacaguagugagccacugugccuggccaguauuuuauuuauuuaaauuuuuuauuuccguauguuauuggggagcaggugucguuagguuacaugaguaaguucuuuuuuuuuuuuuugagauggagucuagcucugucgcccaggcuggagugcaguggugugaucucggcucacugcaagcucugccuccuagguucacgcaguucuccugccucagccucccaaguagcuggaacuacaggcgcccgccaccaugccuagcuaauuuuuuuguauuuuuaguagagacaggguuucacuguguuagccaggauggucuugaucuccuggccucgugauccaccugccucagccucccaaagugcugggauuacaggcgugagccaccaugcccagccaugagcaaauucuuuaguggugauuugugagauuuuggugcacccaucacccgaacgguauacacaacacccaguauguagucuuuuaucccucacccgcuuccuacccuuucccccugagucuccaaaguccauugugucauucuuaugccuuugcauccucacagcauaggugaucagcuuuucuuuaaaaacuuuuuauuauggcagggguguauuugacauaguaacuugaguuuuauuaaggcagcauuaucagaguaaugcuuugggugacuugucaaguuuccuacucuuuuccccugucuaagggugaaacucuugguuggaguaaaggugguaccuguccuaucauugagagguuaugacuagguuauaucauacuuggaugaaagauguuuuauaaacucucccuuagugauugcaugugauacagaaucuuuaauggcauuuaauaauguuaauuuuaaguuuggaauuuccaaauuuaagauuuugaauggaaugggaauauaacuugggauuuuuaucugggauguacugagaauuaaacaacuauaucaccuuuugucacaacuuaguaaauuuuuuucuuagauaaaaguuagauuuuucagauuuuauuccguuaggauauucauuuagaguggaagaacugcugcagacaaaaggaaugguuuuuaguguaguguguucuuagaccugaaagguuuugaaauuccuccaggaaucucggaugacauugccuuuagcgugggccaacuugucacuuaaggaaaauaauucagucuuuuaagaauuuuuacaaaaaguauagacuugucuuauacuuguacaaauguauuugauacuuuuuuaagguuaaugaauuacauuccaaaggauguuguuugaaguaaugaauaauuauuugcuacccagaauaaucaaauuuugcuguuguaguacauucuuaaacuuuguuuucuuuuuuuuuuuuuuuuuuuuuuuugagacagagucuggcucuguugcccaggcuggaguacaguggcaugaucucggcucacugcaauguccgccucccugguucaagugauccuugugugauccuuguaccucagccacccgaguagcugggauuacaggcgugugccaccacauacggcuaauuuuauauuuuuaguagagacaggguuucaccauguuggccaggcuggucucuaacccuugaccucaagugagucgcucaccuuggccucccaaagucgugggauuacaagugugaaccacugugccuggccuuaaauccuguguuuuguuuuguuuguuuuugagacaaagucuugcucugucacccaggcuggagugcaguggcaugaucuccccucauugcaaccuccgccucccaggcucaaggaauucuccugacucagccuccugaguagcugggacuaaaugcgcaugccgccgugccuggcuaacuuuuguauuuuuaguagagaugggguuucaccauguugcccaggcuggucucgaacuccugggcucaggugauccaccggccucaccucccaaagugcuaagaugauaggcgugagccauuguguccggcccuggccuuaaacuuuguuuuuaugccucuuucuaaccuaaaccauauuuagaugcugaaaaugaaugaaagugucaggguuaaugcauaauucugaagcacuuugugaaucaacagaaaaauaauuguuucauagaauuuuaaaucuuuguguggcauauacaauucuggguugcguagaauauuauuuuuuucaugcuuauuguggaauagagaugcuucuguauuugcucaagaaggacggugguuaaaaaaauugcuuuauuauaguaaaaacauaacagucaauugguuuucuuguugguggacccuugcuauggcuucagguucaugguuuugaggaccuaggagauuauauaguuaagucuauacacucauuaagauuguuauaaugugaaagggaauaagaucucuaaacuggggcacaugagcauaaaaaaagaagguguggaaaauuuaaauuuauaauaauugcugcaaaauaaaauauuacauacaaaaaaauuguagauuuacacaauacaauuaguaaguaaauggcaaaacuccuguggcaagaguguucagauuacugucuucuguacauuauacacagggacauauaacaucucuuuccugcauguguuacacaaauaccccauauuucccagugacccagcuuauaauggccucgaggcuccugugcaucuugcaaggugaggaguggcuguaacacaacugggagguacacugaguagccggcaggaauagcaacuucagauauuucuccugucaucacccaagacuagauagaguuagcuauccuuaauugccuguguccaagaguacuugauuuuauuagaaaagaguaaggaaggauguguuaccaguauuuggcauucagacugaacgagaaguuaaaaaugagaacuguuuacuaugcuugcaacccacacaacacuagacaaagccauagccgaaggugguauuagauauaaggugaaaguuuaacaaacccguccuauuuuacuuuaaggcaguuauucauaguauguuguuaaaaagaaaaaucugagacaaauguuaagcugggugggauaucggacuaacagauguacaucaggagaguccugggcagacuggaccauauggucacuccauuuauagagcacauauuguucugaguuuggcucugauuucuccccagugauguguauuuaaaauuuggcuaaaauuuaagucuaguguguauacauuagcauuauuuuucugaguuaauuauauaauaagaguauuauucuaaaauucuugaaaacugagugucauuaauuaccuguguuuuaaaaguggugugagccagcagcacugaaccugacccuaagguaaaauaaucuucucuagucugccauaacacuugcaagggauguuucccaaaccuuuaaagcugccuggacaugugaaguuuucuguuuaguuacucccguuugucacuggaaaaacaguaaccuuuuaaucucaaaacucacagcgguccauguaaauuuaauuucuaccucauuugcaauuuggagaacgagucucaguaauucuucugaauccuauuaugaauguaaauuuaggacuccagauuucuaaaauucugcuuuggacaaauuuuggaucaacgaucucugauuaauuugggaaauuuuagaugaacaaaaguaccuguagauauaucauuauuuugauguuauugguagcaguagaacuucauuauacuuauuauuuggcaagcaaauuaaaagaaauuuuagucaacauccauguccucaaucuggauucuaccauuuacuuuuccuaaaaaaauuuuuauaacagcuuuauugagauauaauugacauaccauguacucugcuuaaaguauccaaccccauaguucuuaguguauucacagauuuguacaaccaucaccccccauuuguacagucaaaaaaacauucucaucccuccucccaaaaaaaaaccucuacccuucagcaaggguccccauuuuccugcaaccaccgcucccucccaguccuagucaaccacaaauucauuuucugucuguagauuugccaauugucuuagucuguuggggccgcuaaaacaaaauaccagaaacugaguggcuuaugaacaacaaaaauuucucacaauucugaacgcugagaaguucaaaaucaagggaccugcagauucagugccuggugagggcccacuuccugggucauagaagugcuugaugcuguguccucaccuuggggccuuuuuuuuuuuuuuuuuugagacagagucucgcuaguacaguggcgcgaucucagcucacugcaaccuccaccuccuggauucaagccauucuucuucuucagccucccgaguagcugggcaugcgccaccaugcccagcuaauuuuuguauuuuuaguagcaacgggguuuugcuauguugaccaggcuggucaugagcuccugaccucaggugauccgccugccuuggccucccaaaguguuagaauuacaggcaugagccaccgugcccagccccuagggccucuuuuauaaggguacuaauccuauccgugugggcucugcccucaugcucuaaccaccucccaaagaccucaccucuuaauauuaucacauuggugauuagguuucaacauaugaauuuuagggggacacaaacauucagaccguagcaccuauuuuggacauuuugugacuagaaucuuaaaauauaugguguuuuguggcuuucacuuagcauaaugcuuucaagguucaucuuguagcauguauaaguacuuuauuccuuuuuauuaccugcuaauauuccauuguauguauaccaccuuauauuuauccacuuaucaguugaugaacauuggguuguuuucacucugaauauuaugaauaaugcugccauggacauuucuguauaaguuuuuaucuagacaaaaguuuucaugcucuugaguauaaaccuaggaguggaauuucugggucauagagugacuccguuuaaccuuuuagugaacugucagacuguuuuccaaagcagcugcaacauuuuauauuuuugucugcuguguggcaguuuaugucaggauucuccagaaaaacaguaggcuauagauagagaaauagauaauagauauauauauagagagauauaugagaggaaauuuguuaggggaauuggcugacgcgauuauggaggcugagaagucccacgauagacugucugcaggcuggagaaccuaccaagcugguagcauuacuuaguguaaguccaaagaccugagaaucgggaguccaugguguaauucucagugugagucugaaggccugagaaccuuggugggagagggauggggggagggugaugggagaguggcugcuggugcaaguccuggaauccgaaggccauauccugaaauucuuauauacaagggcagaagguguccuagcuccagaagggagauaauuugacuuuccccugccuugacuuuguucugcccuagccucagcuauuggauaaugccugcucacauuggaugaggguggaucuuccuuucugugucuacugauucaaaugccagucucuccuggaaacacccucagagacauacccagaaauaauccuuuacuagcuaucuggguauuauuagucuggucaaguucguaccugaaauuagccaucacaauuucuccacauccuuuucugcacuugucuuuuuuuuuuuuuuuuuuuuuccugagacagagucucugucgcccaggcuggacugcaguggugcuaucucagcucacugcaaccuccaccuccccaguucaaacgauucucccaccucagccucccaaguagcugggauuacaggcaugcgccaccacacuggcuaauuuuuguacuuuuaguagaguugaaguuuucccacguuggucaggcuggccucgaacuccugaucucaggugaucugccugccuuggccucucaaagugcugggauuacaggcaugagcuaccacgccugacccacuugucuuuuugauuauagccaucagaguagcugugaagugggaucucauuuuggcuaugauuugcauuucccuaaugacugguuaugugcauuuuuucaugugcuuauuggccauuucuguauuuucuuuggagaaaugucuguucaggucuuuuuugcccuuuuuuuuuuuuuuuuuugaggcggagucucgcacuguuccccgggcuggagugcaguggugugaucucagcucacugcaaccuccaccuccuggguucaagcaauucuccugccucagccuccugaguagcugggauuucaggcgccugccaccaugcccagcuaauucuuuugcccauuuuaaaauuggauuauuuuucuuuuuuauugaguuuuaagaguuuuuuuuuuuuaagucuagagauguuucuuaucaauaugauuugcgauuauuuucugccauucuguagauuaucuuuuuacacuuucuuaaugguguucuuugaagcaccaaaaccuuuaauuuugaggcuuaauuuauuucuucuuuugucacuuuuguuuuuggugucaucuaaaaaacuguuggccucauucaauacauaucacaaagauuuguguaauuaccuauguuuucuuauaaaaguuuuguaguuuuugcucuuauuuaugucuuuguuucauuuugagauaauuuuuguaucuuuucuaagguggguuuaaucugacuuaggguuuuuuaacagacuggcucuuagauuuggaugauuguuggccuuguuauugaccauggcagagcuugaccaugagugccccugaaggcugaggguaacaguugcucauugugguaguaucuuuuuguaucaguuuuguaucuuuagugucaguuuguggagagaggugguaguuuaaaaaacucacuaauagguguuuuguuuugcuuguuuuuauugugguaaaauguacaugcagugaagugcauagaucuuuaaguauguaguugaguuuugacauauauauguacucauguaaccaucaccccaaucaagauauagaacauuucugucacucacaacauucccuugaacaauaaauagaaucagaagcacucuggauuuaacaaaguuguuuuuaaaaaaugcaaacuugguauuggugcaguauuuuuaaguuaaaacuuuuuucaguuauuaagaaaaucucugucgguuugucuguuaggcauauuaucuugccuaaggugguacaucuuggguuaaccacgucuggcucucuagagguuaauagugcuucucagugguuucuuuucucugaugucuuuccuucauuaguuacccucuuauuaaaaagaaaaaaauaagugugcguuuguauuuuaaugucuaaagccaaagaaucaguguaauguuuaucauaaagacaaagucaccgagagaugaccauaauuauagacauuugguacaguuuuacuuacauucuuauguauuucuguuagcaaaggcagaaucaaaauauguuauuaauauuuauuguauauauuuaugggguacaaugugauguuuugacaaaguauguuaauaauuaagagccugcuauggaugcuuugauauuaguuuuuuuuuuuuuuuuuuuuuuuuugagacggaguuuugcuauuguugcccagggcggaaugcaauggcaugaucucggcucaccacaaccucugcaucccggguucaagcgauucuccugcuucagccucccaaguagcugggauuacaggcgugugccaccaugcccggcuaauuuuguauuuuuaguacagacaggguuucuccauguuggucaggcuggucucaaacucccaaccuuaggugaucugcccuccuuggcuucccaaagugcugggguuacaggcgugagccacugcuccuggcuugauauuaguuuuuuaaauguuacuuaagcuggugguagaaacaucuucacaaaggcauaugaugauacuaauuuuuaaaauuguacuguggcauuucaguuagcuauugccacgguaaugguaauuaacaaucacaaaauguaaguggcauacaaacauaagcacuuauuuuuuguucgugaguuugugggucagcugacauugcucagcuccacuugaucuuguccuuuuccugagacuaguacacucaugauguucucaugguggcagaagucuaagaggcaaguagaaacauuaagacugcuuaaagcagcagggccugguggcucacaccugcaaucccagcacuuugggaggcugagguggguauaucacuugagcucaggaguuuagaacagccugggcaacaugaggaaauccugucucuacuaaaaauacagaacauuagccaggcaugguggugcaugcauggguggucccagccaccugggagacugagcugggaggauugcuugagccugggaagcagagguugcagugagcugaggucgcaccaccgcacuccaaccugggugacagagugagacccugucugaaaaaaaauaaaaauaaaugaagacugauuaagacuugguguacuaugacuucugcccucauuauauuggccaaagcaagucuugugcuugagcccagugacaaaggugaggaaguauguucuaucuauaauaggacaagcugcagacuuaagugauaaaaucauggauacagggaaugaugaagaauuagggccaacgauguuauauauggaaaauugaaaacauuugcauaaguacagugaagaauauaaugaucccucaggucccuauccaguucagcaguuaucaacaugugaccagucuuucauucauguuuauguagugcaucacaguaagagaguuacauaugucugguugucuguuuuuguauguuaagcugcauuaguugauucagauguuaccagcuuauccgucauuaucagguuucucauuaaccuuuuacuuaaugguuuuaauagccaccguucagugcuuaucaaacaucugcaaugaagaccauuuaaaaaacauuuccaguacugaggacugcuacuuuuguaaaauacaguaaauuucuagacaaaugaaaauuuaaaauccaauauauuuuaaaagcccccaauuuuuauuauagaugcaacagaaauaaaauuacuuugucaacuuguuaugcaaauuuauggaugcuuauauaaaacuuauggauucuuuuuuugucaugaacugguaacaguuugcuuaaaaacguuccuucacuaacuaugugguuacccugguaaagucagaauacaugcuugauucauucucauuauuaauacuauuuuaccaauuuuguaaauaguuuuuucagauuuuauucauuauuuccaauggugcaauuaauguaugcuguauaauagaaagggucguauguagaaaagagacuggguuuaugaaguacagaaacaucuugaaaaauagaccacauacuaccacauacuaaauacuugugaaauugugacacucuauuacuugaaguuuaauuuuuuuucuuuuucuguuugagacagagucucacucugucgcccaggcuggagugcaguggcacuaucucagcucacugcagcuucugccuccuagguucaagccauucucaugccucaggcucccgaguaacuaaaacuguaggugugcgccaccacgccuagcuaauuuuuuuuguauuuuuaguagagaugggguuucaccauguugcccaggcuggucucaaacuccugagcucaagugauccacucgccucagucuuccaaagugcuaggauuacaggcaugagccacugugccuagccuaauuuauuucuuaaggaaaaaaaauguauaaauguguuaauauuuuaggaauagugaucacgugauaaucaaaauugagaguguucacaaauucaguauauuuagaaaaauacagcccuuugauuaucuuucaucucuucauaaaaacugucucguauuuuaaggucaucuuuauuaguacauugauaguauggggagacaaacugaagagaacgagucagaguuuggguauccaucuguauuguuuucauuucuucgcuucuuugcaagaugccuuugguucuucaugcaaacaggcuauacaugugcacauacuuaaaaucaccuucaaaaguaauuuuuguuaaaauacuagaucucagucuccucaggaaugcagagugagucaagacaacuaaaggugaauguaagaaaaaacccaaggaguuuaacagaacaacuaaucagacugaacauaguucagaacuuuuccuucuaauauuuugauaguuugacaacaguuuuuacugaauguuuacccuuuucaaaauuguguauguugccagcuuuaggaaacaagcagguugauucgggcugauugauacugguuuaaaccuacgcaaagauaaccuuguuccucaguuggcuaaugcuuguuauugaauagaaaaacuagcuauaauaaagauuuuaaucuuuauuauauuaauaauauauuaauauuaaaaggauuuaaauaucaugaggcaggcugggcauggugguuaacaccuguaaucccagcacuuugggaggcugaggcggguggaucaccugaggucaggaguucaagaccaaccuggccaacauggugaaaccccgucucuacuaaaaauacaaaaauuagcugggcaugguggugcacuccuguaaucccagcuacuugggagguugaggcaggacaaucacuugaaccugggaggcagagguugcagugagccaagaucgcaccacugcacuccacccugggcaacagagcgagacucugccuccagaaaaaaaaaaaaaagaaaaaaaaaucacgaggcaaagaacaguauacuuucauuuuagucaacagugccaacuuuucguaguuauuugagaacuggucacauacguauauugugucaacaaaauaguauugccuuaacuuucuggaaagacaagucuuaggauaauugaaacucgaggggaaaauuggcguuguuuucaaagguuaaaaaaucagauuagaaauuguggcccuggaccaacuuuaaauuuccccucaaauuagaagaaaaagauaauagagaauuguucuauuuucuuaccccuaguguucauaaugugcagauuacauacaguagaacuguauucaguuuaccugagaagauagaauucaucaacccaauuccaugauuaggguauguguaugggguucuggcugucuuuaggugggugcuagaacugguaacuaaguugaagcuaaauugcuuuuuaguucauugauuuagauaguacauucagcuguucauuauauucugggaaggugcccacaugaacuugaaaggagcuauuggccccuuguagauaggguagaagagagucuggacuacuuugaaaaucuaagagauguguuugguuagcaaaagaagaugaagcugcagucagagguacaaacugguucaguuaaggaggaaaaauaauugaauuugaaacaauauacguaacacguagaaacuaaauagucuuuaaugaauaccuacuagcuugaaaucucauuagggaaaagaguuuuuucaauguaugaaguuauuaaccaagagcagugaaaagcugacauaacauaugucaguagagacuuguauuucccaaaucuaucgaacauugaaaacuuaaacauaguaauuuauugaaggcacucccauagaauccuaucuguuguguacucagauuaaaggagguagugaaaaugaacucagaugaauuaagugauugaaauuuuuguuuauauuuaauaucuacacauuuguuaauauaagacuaauggaacaaaaguuagugaucauaauuuaggcaacaugaaacaguugguaauugguaaacauuguuuauaugaccaaauguagaucuaauauuguacauuauugcaucaggguaugucuugugacuuccagauuuuucucagguauaaacacaguuuucuaaaggcauuuuauacauuuguuaccuaaaaugaacaacuguguaacugucagcuauaccuagaauuuuuuaucagaaguauuuuagauuuuggauuuuggaguauuuguauuauacuuacuguuugagugccacuaauccaaaaauccaaaauguuucagauuuuuggauuaaggauguuuaaccuguauauagaaagagacuuauuuagacaaacuugaaagacucauguacuacuuacacauaggguuuuguuuuguuuuguucuauguuuugagagaaucucgcucugucacagcccaggcuggagugcaguggcaugaucuuggcucacugcagcuuccgccucauggguucaagugauucuagugccucagccuccgguguagcugggauuacagacaugugcuaccaugccuggcuaauuuuucuauuuuuaguagagaugagguuuugccacguugcccaggcuggucucaaacuccuggccucaagugauccucccaucucagccucccaaagugcugggauuacaggugugagcuauggcgcucagccuucaguugguuuuuaaauguuuugcugacuaaaauauuaagggauugcacuuguccauucauaauuguaggaauaauaaguugcuacacuuuucuagggaucuuacucaacuguucacagaauacauagagaaauggcaaacuuggugaguuauauaaaaaucuagcaugucuggcugagugcgguagcucacaccuguaaucccagcacuuugggaggccgaggcggguggaucaugaggucagguguuugagaccagcccagccaacauagugaaaccccgucucuacuaaaaauaugaaaaauuagccgggcgugguggcaggugccuguaaucccagcucaucggaaggcugaggcaagagaauugcagugagcugagagguugcagugagcugagaucgcgccacugcacucuagcccgggcuacaguacaagaguccaucucaaaaaaaaaaaaaaaaaaaucuagcaugucuauuccugaugacuuuuuuuuuuuuuuuuuuuuuuuuuuugacacagagucuugcucugucacccaggcuggagugcagugaugugaucuccacucacuggguuucaucauguuagccagguuggucucgaucuccugaccuugugauccacccgccucagccucccaaagugcugggauuacaggcgugagccaccgugcccggccuccugaugacuuagcugggcucaccucuguuucuucccuugaagccuugggaugucuuccuguucuaugagaaauuccuugagacacacugggaaucccuuucccuuaaggaaaagcuuuucugcaacuuuaugugacucaauaugaauuaacauaauauuaacaauggcaaugauaguugugucauuggacuaguggaauuuuaagauauuaauauuuaagauauauuguaauuucagagaugcguggcuucuuucacuuggcaaguuugaaaugauucauuuauguuuuggggauuuuucagccagaaaggacagcauaccacucuggagcaauagagaauuuuaaaagagcaguuuggcuaaagaguaggccagguucuuauaggucuugggaaauauuuugagcuuuauugaacagucuaaggggaagucacuguaagguuuugagcaaaggaagauuugaaucugauuuuuuuuuucuuucuuuuaagcacacuggcauguuauccaaacucaguaucaccaguaauggaacaaaaugacauugugucuuugcauuguaucauaucaagaggaggcaugauaacauuaccaauguaaauuucuugucaaauguuuaucuagaaucugaucaugauacaacaaagagauccagugugggacauucuacaaaaagcuggucugaucuuuaaaaaaggucaaugccauaaaagacuauaaaaaggugaggaggugaauaguugaaggagacaauguaugacaauguguguacugugugugugguccuugauagauuauggaauuuuuuaaaaaccauaaacaccuuguuuuugacaauuggggaaacuuauauguagauaauuaucaauguuaacuuucuuggaugugauaaugauauuguaguuacauaggagauugucccuguuuguaggagaugcaugcugaaaagguuuugggggagugaaagguauacaguuuaagucguucagguggaaaaaguguauguagauggaaauaaagcaaauacagcaaaauguuacugaucauugauauagaugaagagugguguuuauuguaccaaacuuucaacuuuucuuuagguuaaaaaauuuaaaaauaaaaagggauaggguagaacaacagaacuacagagucuuacuuuuugauuuaacauuuuaguuuagguuccaacuucauucaguguuaugugagaugauggccucuuaugaaaaaccucaguaaaauugaccaacauuccuuuauuuuaauuauuaaaaauuuuuuuuaagagauagggucuugcugcauugcccagacuagucuccaauuccugggcucaaguaauccccccuccuuagccuaaaaaauuaugugugcuuuuaaucuaaaauacccaaaggcuuuuuuuuuuuuuuuuuaauccaguaauuuuguuggaguauguuuuaggguuggucguucugaguucauagacuaauuuugauucauguucucucuugccuuguguaauuuuaaaaguaucuuuuagcuacuauagaaauaguacauucuaguuuugagcugaggaugucuuucuugcuuauucucauagagacaucauucuguucuuuauucccucuauuuuuuauuuuuauuuuuuugagacaggaucucacucugucacccaggcuggagugcaguggcaugauuaugacucacuguggccucaaccuccugggcuccucucaccucugccucccgaguagcuaggaccacaggcacgugcacccacucccagcuaauuuuuuuuuuuuuuuuugagauggaguuucacucuuauucaggcuggggugcaauggugugaucucagcucgcugcaaccuucaccuccaagguuugagcaauucuccugccucagccucccaaguagcugggaucacaggcaugcaccaccacacccagauaauuuuguauuuuuaguagaaaugggguuuuaccacguuagccaggcuggucucgaacuccugaccucagaugcuucacccucuuuggccucccaaagugcugggauuacaggugugagccacggcaccuggccuaauuuuuguauuuuuuguagagacaggauuucuuuauguuacccaggcuggucucgaacucaugggcucaagcgaucugccucccuccacuaccgccucccaaagugcugguauuacaggcuuuagucacagggaccuggccucccuuuuuuuuacuuuuaguaacuuuguaugggauuuaacuucuauacuuuguuuccuuuuuaugugaauuuaguuuuccucaacuuuuagaaggaagcuagucaagauaacguuucuaacuucauacaacuuccucuucuguuaaaaaauuauggcacuuguuuccuaagaauuccuggcucugucccugugccccauguuagucuguuccuucucccuuuuuccuguccuguuaguuuuggucaucucccagcaguggcucuucauagcaggcccucuccuggaaaggaucucugacugguuagugucaaggguucauggggguuaaacucuccuggccccuuuaugucuuaccuuggguucccugccacuuguguacuauuggugugggcaaaccuccuccuagcgcgcugcgguucucuaauugggugcugugccuucugggucguaccucuuggguguugggaauucuccuguuuucagguccuuuaauaaggcuggauugcuucccacguaggugcuguagcacuaggguuuguggcugugguaguuugucaccaccaacuuguauuuugggguucuuguaaaugucuuugcuaucuaguuguucaguaauuaugugggauccaagaaaaucacaaaacauuuccauaaacauuuccaucuccacuuuuccagaaucugcuagaucuucuuacccuauucuuaaagaguuugcuguauaugguuuaauuuuuuccuuaauauuuuuucuugauaucuuaaaauauaucuaugaauauugcuuauuuuauuaugaugcacucagggcagugagggauauucaccuuaagucuuuaggcauuugucuuuuuaauagcuuuauguaaauagauaugguagauuuuucuaucuugugaugcugaauuuuauuugucucugcauugaugugacuaaguuucuuuuuucucauuaggaugguuuuucuaauaucucgaaucuaauuaucaaacuuuacaacugugugugaagugugagcaaauaaaugccagguuuugagggagaggaacuuugcuuuuacuagugggagccuuuuuguuuucuccugaauugucaaagcugugacaguugcugcauaggcaaggucauacccacaguagaaggaaauagggcaaggauucaguuucuucaguaaucucuugugucacagaauugaacauuuauugcuaaggaaacaggaaaauucuuuuaaaauacauuuuuugaguaaagauuaguuuacuuaaauaaauacaggcaguccuugcuaugcaggauaaguaaaacagcuaaaaauaauaaugcaagcugaaaccaugcaaagcaauuuuaauagucagugggaaaauuacaauuguuuugugaucuuuaaaaauuuuuguuaaaucacuaaaaacuuuugucaauuacaaaaguguagggaaauaaaaaaauaguaaaacuacuguuuacuacaguauaauuuaaaauacuaggaacauugagaauuaaaguauuuuauuucuuuguaaaaagcuuaucaauaguaguuuaaacagcacuucucugugucguuucugugccuugguugcuuccaacauuuuauccuuugcaguuuuaaugucaugaaauaucuccuagaguugcuuuaaugugaaguauuuuccuggagucacuuccuuugggacguugccauucuuuccaucacaaccaguuuccucacugauguugguaaguucuguggcuguauaucuagaggcucucaaacccugucagccuugccacagucagcauuuucuucuguaacuccauauauucaaauuucacuccagcauuaucacuuuucauuucuuugcugcauuuucaucuuuguuggccagccccguuuggauuaucuguauuuguaaaaaguccuuugggguuuaucaguguaagacaggcaacacacugcacucuggcuguuuguuguccauugaccaaucaccaauagaaugaaagaagggaggugauuggucacugauccugauguucaucuguuauuuacauggugguuuguggacugaagagcuggcaaugaaguuuguccuuuauauaauuacucacaguaauguaugauaacugaaauuugagccauguuguuggggacugguaauuaacuaaaccuugguauaaaccaugguaauugaaauuugugcauauuaggauuaugcaaggcaggaacucugccuguaauguaaaaaagcauacuuagauuugguaaaaaugguaaagauaauaaugggacugagucugagaaauuuaugcaauaauguaguguuuaaaaauauuuuuuaaaaaguuaagauuaaggaauuauagagaaaauccaugaagggguguguguauguguauacauuaauacuaaggguaaaggucugaaaggacaaaguuguaguuuguucugugauuucacuuuucuacgguauugaauauucauaugaccagaaccuucauuucuaugaccugaguaauuucuucuggcaccggauuggcucccucucacaaauccuccucuguagaugacugauuuguuuguuacuuuuuuuuuuuuuuuuuuugagauggaguuuugcucuuguugcccaggcugaagugcaauggcgugaucuuggcucacggcaacuuccgccuccuggguucaagugauucuccugccucagccucccgaguagcugggauuauaggugcccaccacaaugccuggcuaauuuuguguuuuuaguagaggcaggguuuuuccauguuggucaggcuggucuugaacuccugaccucaggugauccaccugccucggccucccaaagugcugcgauuacagcugugagccaccaugccugaacgcuuguucguuuuugcagcagacggaauagugguguuguagguuaggccugcauuuauuuuuugcagauaaauggagaagggaggaaugguggaaaagauuacacaaguggcuaaaggacugacuuaagguuuuuaucugcaaauuuuacaacuagagggagaaaaccucccuaaauauguuuauuguaaacauuuaggacauauugaagaguauaaagaaauaaaaauauaaaaucacuuauaguuccauuacuuagaugaacuacuucaucacucuuaauauuuugguguauggccagccauacucuuccuuuuuuauacaugcauacagacuuuugcacuuuuauauaagacacauugaaguggcauuauacuguacaugcuuccuauaaguggauuuccaggguacacacaaacuuuuaaagcguuucuuuauguaaaauuuaaaauauacaaacaaacaaaaaagcaaacaaaaaaaacccccaggauagaaaccagacgaguacaaugaacuuaauguaccuaucacccaacuucagugauuucaguacacgggcagucuuguuucauccauagccaccuacuuuugcauuauuuugaagcaucuuccagguaaguauuuugguauauuucaguuaaaaacuugacauuuugccaaauuaaccuuucagaaaaguguuauccauguauaccugacagcaaucagauuuaaaaagucuuuuuauuuuuauuuauuuuugagacagaauuuugcucuuguugcccaggcuggagugcaauggcaugauaucagcucacugcaaccuccgccuccgggguucaagcgauucuccugccucagccuccccaguagcugggauuacagugcccgccaccaugcccaacuaauuuuuuguauuuuuaguagagacaggauuucaccauguuggccaggcuggucuugaacucgugaccucagguaauccaccugccuuggccucccaaagugcugggauuacaggcgugagccaccgcgcccggccuaaaaggccuuuuaaaaaucuuaguguuaugaguuagaugcauauauaucauuuuccucagauaauacaaaaaaaauccuaacagugaauuuggccaugcuuauacucuagugucaaacuucuaguuuccccaucaguauauaucccucauaaaaauguugugccuauugauagggugaccgaauaacuuauuguccaaacugggacacuuugagauugaaaggaugcacuguuaauaauaaugcccauguaauaaacauaaaccaggacuauauuuuggcgcagcuggauugugugcucauccuaccauuagaucaugcauguaagauauauauacacaugaucacuauauuacauagucaauaagugguaagauuuauuaaguuuaaguguuuaauauaugcccaugcauggauauauauuaaaaucuucccuuuaaaagggguauuuugaauugguaacucagaaaguccuaaguuuucauuccuauguguuuuuggagcugacagugaucauuaauuuuuuuuuaaguacuguagcuuuaauuuucauaauuaagacuuuguauuuguauugauauuugcagcuggagaaugcuggaggagaccuuaaggauggccaccaccacuaugaaggagcuguugucauucuggaugcuggugcucaguacgggaaagucauagaccgaagagugagggaacuguucgugcagucugaaauuuuccccuuggaaacaccagcauuugcuauaaaggaacaaggauuccgguagacuuuucacuaaucuuuucaugaggagauugaacuuagauuguggaauauuuuauuauuaauuuucuugagcacugaauuuuucuacgaaaauaagauauggaaugguuuuaugagaaauuucccauggcucugauuuggggagaaaaaggaaaaauuuaagcuuucaguuuaaaaagauuaauuuuaauuguacaguuaaaagaacuuaucauuugaguauuuuauguuuuauaggauuugugggucagaguuagauguagcuguuguggccauucauucauuuacuuaaaagcauuucaucaaaggaaaguaggaaguuggcuagaauacuccaaagagaagaaaucuguguacaauaaguguuuuugcuuccuaucccaauagacuaguuucuaaaguauggagauuucuuaaaucuaauauaugggcuaauuuugacagcuuguacccuuagaacuagucaaaauaacagccagcuuauguaguuucuuccuuuaacaacuauuuuugguuaaugucaugcuuucuuuuuuuuugaggcggagucucacuugguuacccaggcugaagugcagcggcacgauuuuggcucacugcaaccuccaccucccagguucaggugaugcuccugccucagccucucgaguagcuggaaguacaggcggaugccaccacaccuggcuaauuuuuguauuuuuaguacagaacggguuucaccauguuguccaggcuggucucgaacuccugacuucaggugauccaccuaccuaggucucccauagugcugggauuaccggcgugagccaccgugcccggccagugucaugcuuuuuaaugcuuuuuuuuuuauuguuguuuuuucuuagauuaagacuguuacguagaagcaagcaacuguaguuuauguccuuaauuggcucuuaaacucuaauauuagauguacuaugcuucucccaaaauuuaaaauuuuauuuuucuuaaaagaauugucuuuccagugugaaagugguuaaaagaacuuuuaaagacuucacagacaugugugcauuauccuguguuuuguugguucugaaguagagugaauuagaaauuauaaaaggcgggcuuaaauuuaacucugcucugguguuaggauacagauaacaaaugacucuuuuaaacuauggaauuuuagaguaauaagggacccuugaguuuaucuaauucagcugauuuuauuuaccagcaagaacuaguuuuuuagagggaucaaaaaacucugugauaaaucugaaugccucucugucaaaucagagcuccaucauuccccucacccaaaacaaacaaaaaauccccagcaaacuaacagacuaaacagauacuagaauaggauagcugaauacuuggcaagagaaaucuaaugguguuucaugucacuugaucauaaacagugucuagguucagcuuguaccuagaauuucccuuauguaguaggagaauagaaacuauacugcuguggcuuuuauuacuguaauccuuucuguagaaauaacuauuugaccaccccuuuucuagaacauuuugugacaugagagacaucuuaaccuaccuauuuuuauuuuuuuuuuauuauuuuuuugagauggagucucacucugucgcucaggcuggaaugcaguggugcgaucuuggcucacugcagccucugccucgcagguucaaccuggcagauucuccugccucagccuccggaguagcugggauuacaggcaugugcugccaugccugguuaauuuuuuuauuuuuaggagagaugagguuucgccauguuggccagucuggucuugaacuccugagcuaagguaaucugcccguuucagccucccaaagugcugggauuacaggcuugagccaccccucgcggcccaccuauuuuuagaagcuugaucugccugauacauaaaauugguauuuggaaugaauuacggcuuauugggccuugugauugcagguuacuuucagaauagcaggauagaaauggaaggcucaaagagugauuagcuuuuaaagauuuguugaaauaagacuuucuuaauugguuuaaguacuacuugaguuuuauccuuaacuaaguccaugacuuuuuuguuuuuuuaauagcacuaagaaucuuauauccuagaguucuuuagcagauuaagggguacugggcagucccauggugguuauccuuugugaaacuaaauauaauauaauagaaucuagaggucuugauuauucaguauguguuuuauagaauuuuagcuucuguuuuuuuuguuuuuguuuuuguuuuuuuuuuuugagacggagucucgcucugucacccaggcuggagugcaguggugugaucucugcucacugcaagcuccgccucccagguucacaccauucuccugccucagccuccuaaguggcugggacuacaggugcccaccaccaugcccggcuaauuuuuuguauuuuuaguagagacaggguuuugccauguuagccaggauggucucgaucuccugaccucgugauccacgcaccucggccucccaaagugcugggauuacaggugugagccaccaugccuggcguuagcuucuguauuuuuaaggaguuagguuauagaucuacccuuagggguaaccccaucccccuuuagaauuguuaucuuaaauaucauuuuuaucaucugaguagcuugucuuccaucucucuuuugcaggacacacacuaacaaauguuuaccacaucucagguugcccauacaaaguucaaaaggugcuuuugagcucauugaaguugcuguuuuuuuaaaaaaugaucuagcuugcugaguauuuuuuuuuucucucacuguuuugguuuuuauuuuuuuaaauuuuuuguagacaugggguuuugccacauugcccaggcuggucucgagcuccugggcucaagcaaucugcccgucucuguuucccaaagugcugugauuacagguuugagcauccaugcccagccuuacugagauuuuuuuuuuuuuuuuuuuuuuuauaaauuugacuuauguuguauuguucuucuggauguauuauaaaucuagcaauauacuuuguauauuuuuauaugacagggaaucacuauuuaaaaaguguguugcaguccaaauuuguaaguaaguuuuuauuagauuuuacaaugccuuuuucuuugaaauacagauaagucagauuuaucugcaaacucaaagugaguuagagaguaccuuaaauugaauaaagggccuaaguauaccuucauugugugagugggcauguguggcaaacuggagagcaugugcagcuugaaggugcaagccacuuuaugauuccaauugguuguaguuaugcaggagugaaggcccaguguuuccagauuuuuuuuucccugaagaaauuccagaaaucugaauuuuugugaaauucuugauauuaaaauguuuaaguuuuuuugagugaauacucauggccaguguagauguauuaguggccaggagaggaacauaggccucaguuugcaguuuucccuuauuauaguaguuugacucccaaguuaacccaugcucugcaaauuauaagauagcuaaauuauacuacugaccugauuucugagagcagggcaugugggggcagaaguguuacuagcucccuuuccugggcucagggaaaauuguuggggaugguggaugcuguaaacaggcaaaguuggguaauguauacuuucuauucugccgucuuuuguuguagaguauuuugcucugagccauccagggccuucauaauaccuucaguuguuguucuuugaccugcuaggcucugagaagaccuguauuuucaccaucucuagaauucuuacguacuucuuccauugauaaggaaacaaguaaaacaaauccaugcuaaguaucacagauagaaacauugguauuaucuauuuggaaguuugugcuuauuaacaaguaaaugcugaauugauagacuucuaaacauugcaguaaaguacaguaaaaauaauuaaaccacguaggaugacaauucgcugugauauaauuagaauuugcuacauucuaccaaaaacaacgcaauuucuggaucuguguuguuucccucagugguacaagggagagagggcauagaccuuguauaaaaauuaacagagauucuucacugauuguuccuuaaaucacagugcuauuaucaucucuggaggaccuaauucuguguaugcugaagaugcucccugguuugauccagcaauauucacuauuggcaagccuguucuuggaauuugcuaugguaugcagguaugucagcaaauuuguuuugaaagcuuacuuauauuuuauucuguuugugagucauacuguauuaguauuuucucucuuuaggauauuuaggauacuuaguuggaugagauaacuugugcauguuacaacuaugugaauugccacacuaguauggcagaacuggccugauagggaaucuauuuucaaaguaguaaguacacuguuucauguaacaaaacacuauccauuuaaaaaaaccuuggacaugcaaauuuacauaaaauuuucagaaauaguacauagagcuccuguauaccuuuacccaguacuccaguuguugacauuuuugaaccauuugaaaguugcacacgugaugcccuguuacuuauauuuccuaaauauuaggacacucuuacugcauaaccacaguacaacuauccaggucagaaaaguuaacauuuacucauuguuagaaucuaauccacagacuccuucacauuucacaguuugucucauuaauaucccuuauaggccacagaucagucaggacuauguguuguuuuuaguuguuguuucuuuagacucuuucagucugaaauaguuccucaguguuuccuucucuuucaugagcuugaaaguauuuuuaaaaaguacguguuaauuauuuuguagaacauuucccaacuuugguuucugugaugauuccucauuguuagauucagguuaugaacuuuuggcaggaguaucacagaauuggugcugugcuucucagagcaucuuaucaggaggcacacgguguggauuuguggcaugacaggugauguuaacuuggauuauuuggguaagaugguaucugucgggugucuccauuguaacauuaauuaauaaguauaugugccuugguuuuauaucaaaaguaagaauaggccaggcgugguggcucaugucuguaaucuuagcacuuugggaggccgaggcggguggaucaccugaagucaggaguucgagaccagccugaccaacauggggaaacccugucucuauuaaaaauaacaaaaguuuggccaggcgcaguggcucacgccugugaucccagcacuuugggaggccgaggcggguggaucaccugaggucgggaguucgagaccagccugaccaacauggagaaacccccgucucuacuaaaaauacaaaauuagcugggcgugguggcgcaugacuguaaucccagcuccuugggaggcugaggcaggagaaucacuuaaaccugggaggcggagguugcggugaguggagaucaugccguugcacuccagccucagugacaagagcaaaacuccuucucaaaaaaaaaaaguaagaauaaguagggacuuacugagaucuugagauaagauacucuucuuuucuuuuuuuuuuuucaauuacuuuguuuuuagagggguuuuagguucacagcaaaauuaagaagguauagaaauaucuuauauaccuccaaccucuacacaugcauagcuucuuccauuaucaacaucccacaccagagugauacauuugauauaacugaugaaccuacaucaacacaucauuauucccaaaguccuuaguuuagauuaguguucauucuugauuuuuguacauucuauuguuuuggacaaauguauaaugacauauaucuaccauuguaguauuauacauuuucgacugcccaauccuuugugcuuuaccuguucaucccccauauccuggcaaccacugauauuuuuuuaucgucuuuauaguuuugccuuuuucagcaugucauguagguggaaucauacaguauguagccuuuucagauuggcuucuuucacuuaguaaugugcauuuaaaguucuuccaugucuuuucagucuggguagcuaauuucuuuuuagcacugaauaauauuccauuguauggagguaucacaguucauucacucauucaguaagugacaguuuacuuauucaucuacuaacgucuuggugacuuccaaguuuugguaauuaugaauaaaggugcuaugaacauccauguacagguuuuuguguggacauaaauguucagcuuuuucaguauauucuaaggagaguaauuacuaaguuguuaagaguauguuuaguuuuguaagaaacugccaaaacuguguuccaaaguggguguacaauuuugcauuuuacaguaaaagccucuucuuuccuuucaaaguucuuugaaaaguguuugauuaugaguuugacuuggcaaaaagaaagauuuuuuuccaucuaguagucuuagaagagccugcacccugauugaguugaauauuggauauuggcuggcuucuuuuuuuuuuuugucccaagguguaauauauuuauauaauuuauugauuuucuuugucagaguacucaguguuaaucauauagcacaacuuauaguuauauuaaaugguuguuaguauauugagaggcuuuguaacauuuccuaaggaagaaucucacaagauauauuuuuaaggccuacuuauagugaaauacgucugaaaaaugcuccuuuaauuuaagagauaauggcuuaguguuuccccauuaugucaguuuccugauauaauuauaaggccaaauuguucugucauucacuaggauguuuuauagccaaagccaggccugcugauguuaaaugcauaacaauuuuugccuuuauuaucagcugaacuuuuguaguaagauaaugggauaugcugaucuugguuauuugggcagaauuuguccuuccauaaaauaaugauauagaugaugccgucuagcuaacguguguuuguaaaggacugccacuuagugacuagguuggguaauuuuaggaccuaaguguauaccuuugccccccaugacauucugaaauuugagcaauuucagugucuuauauaccaucuuuucccacuaacuggacucuccugucagaggcuuucuaauugcuuccuggugauucuuugcuuuagaagaaaaaugucuauacugcucccuuuauaucucuuaacugauuuacaucccccagccuaaaaaauagaauauugguagagcuuuugaaacuuuguaugucuccauucacauucuucucuuccuaucagaggugaccaacuuuccugaauuuuguuauucauucccuuucuuuuuuuuauggcuuuaugcauauguuuauauuccuaaauaauauauuaguuuugccgauugaccuauauauaagugaagucauacuaccuguauuauuuucaacuuugguuuugagauucauucauguuaguacauuuuauuguaaauuauucauuuucacuauugaauuuguuugaauauagcauguuacuuuuacauuccaguguucauaauguuggcuuucuaguuucuuucuauuauagacaauauugccaugaauauuuuuuuacuuguuuucugguguuauacauacacaaaauuuucucuaggguaacuggccguaggaaugcugggucauaauguacauuuucagcuucacuagguaaaugauauuuuuucccucaguuuauguucccacagcaauauauaaaaaaucuucugcucuauaucccugccaacccuugacaugauuagauuuuuuuuuuuuguauuuucuuaucugcaaagguauuaaaugggggucacguuguagucuuaaaguuaauuuuccuuguuauuguaagauucauacguuuauuugccauuuguguuuacuauagacacuuguucauuuuuauauuaaauugucuuuguuauuguguugugggagccuuuauauauucuggauacuaaacuuuucccaacuauauauauugcagauaccuucuggauugugacuugucucuucacucuuuaugguuucacuuggcuucuuuauauacucccacaagauuuugucaaauuauuuuuauugggcagaauuuccuucccuuucucccuucccaaucuaaaacuuauaaaacuuugacauauaagaaagauaagaggagaugaucugauuaggugguagaccuggaguacuauauggcuuucuuugaggcaguuagaaccuugggguuuauccaggaauccauacuggccacauacuuugcuagggcccuugggcugugaagagaccugaagacauggaggagagaacauagucuauuuugauaaucacuuuaguuugaauggacuggaguaggaaaugagggggaaggugaauccaaaaauuagacaagggccaaguaaggaagucuuguguuuaauauaaggaacuuggauuuuauccuguagaccaggcaucaguaagcuauggccuauagaccaaaucuggccuaccaccuguuuuugcaugaccugcaagcaaagaaugauuuuuuacauuguuaaaugauugggaaauugaauaaaaauuauauuuugugaugugugaaaaauaaaauucaagucuguguccaugauaagguuuuauugcaacagucacacccauuucuuuguaaguauugucuauggaugcuuuugagcugcaguggcaagagcuaaauaguugcuacagacacaguagggccugcagaggccaauauuuuucucuggcccuuuaagaaaauuuaccaacccuugcuguagaugcuagagggcuaaugaagaauuuaaucauagacuaacacaaucaucuuuauauuguaguagcuaacauugguaggucucuagaauauugcuggaagaugggcaagacuagagucaagggaaaugauuagacuguagcaauguuucuuaaauugcauauuaguuaaugugcuacagaagagaguuuuguuuuugagucuuuaguuugacaaauacuguguuaaacaagugcuagcaggugucuuuacugcuggagugaguucaaaccuuuauugugggacaguuuacugugaaugccuaagaggagaauguagagggcaccauuugcuaaugguuuugaagaauaugcuacucugaguuauaagaaugaacauuuauuuaagucaucugucuuauuuucugucaggggaugggucaaccugcauuacacauuguuaaggcagauaucuucugauaucuguuguggaacagaugcacuaagaugagugggaguguuuauaucacugcagaucuaauguuugcaaaaaucuucuguauauuuaucugauaugggaaguuuggagcauguaaaugauaaauaagaaaagaagauugauuaacaguggaggugcugaauugaagagaccauuugaaaucagucgauaagcguaugggacuugaacagaugagcuuaacugaaaggccagauuuucuugcuuaucccaucucuauagcacagccuucggcaggcuuucagacuguuccuuuggagccaaagacuaaauagcuuggaaaaauguauugucuaauucuuguucugguacaagguucuuguugucugcuguaucuuuuucuaaacucagaauaccuuuuaaaaugcuuuuaaaucaaacucagguguaaguaauuaagauaucucuauuuuuaagcagaugaauucauuaaaguacacuaaguggaaaaucugccaguguuugacagaaauuaacugcaggucaaauuuugaauccaauuuuguuuuauaacaaugccuguuaauaacuguauaguuauauauaacaauaccaaauggucuacauuuauuaaacuccuuuuauuuuggggauacagguauaucagguauucugaaaagaaauaauauaaauuauuaaaucaguauaacaaaauggguauuuuucuuuugauuucuauuaacauuaauuuuuuucuuugaacagaugaugaauaagguauuuggagguacugugcacaaaaaaagugucagagaagauggaguuuucaacauuaguguggauaauacauguucauuauucagguauuacauuuuuagaugaauaagaacaauaguaauuaacuaauuuaaaguugauacuauuauuuuuaacaauuggagauucuauaauucauaaacaaaauuaaggguauaguagugaccacaaguguaauugucauauuugccuuccaguugagugucaagacaguguggguugguggugauguuaauagggaauaaggaagguauuuaagaaauuugaaaacgccugugcaguuguggaacccuacuuggaaucguauauugugauaccaacauuuguauuuucccuuuucacucuuugaucuguuuuuaaagauuauuauuuuucuuuuucuuuuuuuuuuuucgagacggagucucccucugccaccugggcuggagugcaguggcaccaucucagcucacugcaacguccgccuccuggguucaagcgauucuucugccucagccucccgaguagcugggacuacaggcaugaaccaccacgcccggcuaauuuuuguauuuuuaguagagacagggugucacuauauuggccagauuagucucaaacuccuagaccucgugaucuguccaccucggccucccaaagugcugggauuacaggugugagccacugcacccugccgaagauuauuauuuuucaaaggaagauuaauaaaaaagccaagguugcucaaaauaauuuuuuaaacugaaguuacucauugucaaaaugaguuugaaauccagugcuuguucagcuucauaauggagagguguugacacuuacauucauccuuauuucaugugacucaucuugagaaacauuucaggaaucuuguaugugauauaccagaagaagcuuuaaacauaaagauuugguuaagauuugacauuuuucugucuuucuaguucuaaaauucugggacucuaucacaaccuauacuauuccuaaacaacaaugucaacaacaaaccccaaaauaucuuuuugacauuaauguacuuuaucuucuugcuuuauuuuuaauuuacauuuuuauuccuuaguauuauuuauuauuuauuuuguaauuuaauuuaauuuuuuuuuugagacggagucucacucugucgcacgcccaggcuggagugcaguggcaagaucucgacucacugcaaccuccaccucccggguucaagugauucucccaccucagucucccaaguaagugggauuacaggcaaaauuuuuuguguuuuuaguagagacggaguuucaccauauuggccaggcuggucuugaacucccgaucucaggugaucugccucggccuccgaaagugcugggauuacaggcaugagccaccgcgccuggccguuccuuauuauuauuuaauaucgaguucuuagucagauuuuccauaacguaaacaguauauuuuuaugguugauuuguuugaaucaggguccagagaaaguguacacauuacauuugauuaauguuacuuaagucucuuaaguaacacuuacuuaacuaaguuucauuaauuuguuuggcacuagagguccacauugguacuggguuguaauuguuucuaggacuuucagauaacagaguugggcaguaccuagucuuuuagaauugggaaacagaaucauuaguguauacuuauuuccaguuaaaaugaaagauuauaggguuuuuaccuaacucuuuugauuuuguaucucccuacucuuaagcugaaaauguugauuacuaauuauuuguuuuaaccuacaguaugccuguaucuauauuguacuuacaguuacaggauaacaguuucaguacuaaguccuauuacuacuuacauaagacuaccgaaugaaguguuaaggucuuugaaauaccucuguucuuaacauaaaucucaacagauauauaauguugaaauuauuguucuguaaucucuugaaauuauuccugugugucugguuauacuaccaacuucauauauuuauuuguucuaguuuccuuccaauuuuuauggauugccuuuuuuaaggucuaagguuuuuuauuggcuuuauuuguaauggacauaauauuugaauucuagcaguauuccauugucacuuuuuuuuuuucuguuuuucuaaucauguauggcaagcuuguguuucuaaaacaaaagaacccaugaaucauguuuuuaauuaagauauuuguguguuuuauuuuuuguauguuuaggggccuucagaaggaagaaguuguuuugcuuacacauggagauaguguagacaaaguagcugauggauucaagguuguggcacguucuggaaacauaguagcaggugaaaauucuaaaaauuuugcagaguucauuuaaaaaacuuuaucugaagaguaagcauaugcuucuguaugagguacucuuugauuuuuccuuuuucuucugauuuuucuucucuuuuuuuuaaagauaauaaugaauguaggauuaacuguuaugaagggaauuuaauaauaggaggauuauccagaagucucucacuuacugguuuacugguuugcuuugaaauacguugaaaaauguucauccuaauauaagcuuuucaaacauaaaacacuauacuuuuguaacucaggaaaaauuugagaacucgcugucuucauacuauacuauauucagaguuacuugucuuuuauuccuuucuuagguguacauagcccauagcacccaaauaaguacucaagacauuucccugaaccaggguuggcaaacugugacuugugggucaaaucuagucuuuugccuuuuuuuaauguccaggagcuaagaaugauuuuuacauuauuaaaggguuauaauaaaauacagggacuguguauguugcacagagcccaaacuauuuacucucuaguccuuugcagaaaguuugcugacccaugcucuuaaaccauuuuguucucuaauuuuuugaggaaggggaauugacuuucuggcuguuugggguuuugacuugcuuaccugaauaauguaaauggucacuaauauuccuggaaguuaguaaaagaaaaagguggguuuaucacuaaaguucucuuugagauaccacaccuaaauaauaaguugaaaaaaagauuugucauggacaugcugaauuuaguaaucugccugcuguuacuuaacagacauuagcauaauguaugcuaauauguuagcauaggaaugcccaagaaugguuuuauacuaaaaguuuuuuacuucauaaaaaaagaucaacagugguagauaagcuuguguauuuuuauucauccaacaaacauucgaguaccuauuaugugucaugcacaguucuaggugucaaggauuuagcaaugaauaaaauaggccaggugcgguggcucucaccuauaauuccagcaccuugggagacuggaaaguggauagcuugaggccaggaguucaauccagccugggcaccauagugagaccccaucucuacauaaaaauaauuuuaaaaaaauuagccagguguggugaugcacauuugcaguccuagcuacucaggaggcugaggugggagaaucauuuggcccuaagagaucaugacugcggugagcugugguugugccccuacacuccauccugggcaacagagcaagacccucucuccuaagaagaaaacaaaacccaaaaccaauauagcaaaaaugcuuguuuaacacuggaaaaagggaaaguaaacaauaaagaaauacagaauaugucagaaucagauaguguuuacauugaaaaaaugggggaagaggguauucuggaauaugugugauuaggguuguugcaauuuuauaggcuauucagggaaggcauuccuauaagaugacauuggacaugaagaaaauaagugcuaaccuuuuuggauauuuggggaaagaggaaacagcaguacagagauccuggguggggaccauauuugaggagcagcaggaauccaugugguuggagcagaguaagcaugguggggagagugaaagaaggugaaauuagagagguaguuggaugccagaacacaggaccuuugggccacugcaauacuuuggcuuuacucauagugaggugggguuuuaagugaaggagagaugugaucuaauuuaaggauuaagcugugaugaggagaaaagauacagggugaaagagaagcaagaagacaagcuaggaauuuauuguaguaaucaggagagagacagcguugucaggaucaggauaguagugauagaugcaggaggaagauaaaggggaggguaccuggagaaucucccaccagccugccuacugggagaacaggguggggccacaggaaguucucacccuuugcaggagggaggagccuggccuuuccuguuccuguguggugaccucggauucaaucugugagaugggggccuguuaacaggaagccuucucacuuugcugagaguuuuuuucccuuuuucucaauaaauuccauucccccuuacccuucaaagugucugcgugccuaacuuuuccuggucaugugaaaagaacccgguuuuuucuacagcaguagaagaggaaguuguuaggaccaggguggcagagauagaaguugucaggacuagggugauagagguagacauuguuaggagugauuggauuccacuguuuugaaggcagagacagaggauuugcuguuagauugaauauggaguggggaagaaaaaguagaaucaaguuuuagcucccaaguuuuuuugccugaggaaccaaaaggaagauguuucuauuuaccugauuggaaagaccucaggaguuugaguuugcauauuaaauucaagaugguuuauuaaacaucaaaacaaaggugcugaguaggcaguuguauauaugagccuggacuuuagaggagaaaacugggcuggagguauaaauuuggggguuuaccagcauacagacagaauuuuaaggugaugagaguaugagaucucuuagaauauuuagaaaagagauuuaagggcugaggacugaguaacuuccauguguagaggugggcaagaugaagaggaaccagcaaagagauucagaaggaauagacaguaaaauaagugaaccaagagagugguaugcugagagccaaauaaagugugaaguacugugguauaguagaaugaguaugaguuugggagccugucaggccugauuuaguuacuuaauuaccugagaguucauacaaguuucuugauaucucagagccauaaaauaggaguaacacaugcacauguaaaauaccuagccuaacaucuauugccccauagguaauauuugccagaaacacauuugucaaguaguugaauauauuuuugugguuaauaguagucaagaaagaaacaguauauucugacaagucuaauauaugagauucuuuuaauauaagaacuugguagcuguacaaugcauuugaaagccaugugcaacugagaaccaaaauugaauuaucaaugcacuagauagacaaggcaacugaaguaacuuggguggagaggugagaauacugugaaacaaucucuaugugggacuuaauguacguccuauaccucauuaauugcugugucaagaaagaccuuuauaaagaaagguuauagcaauguaguuuuugucuuuguuauguauuuccuauuccuauagcuaaaaaucuacugagacauaccaguuuuaacauuuauagaggaagaaggcugggugcaguggcgcacaccuguaaucccagcacuuugggaggccgaggcaggaggauuacuugagcccaggaguucaacaggcaacaagauaaaaccccaucucuucaaaauauuuaaaaauuagcugagugugguggcaugcaccuguuguuccagcuacucaggaggcugagguggaaggaucacuugagcccaggagaucgagacuauagugagcuaugauuacaccucugcacuccagccugggugacagagcaguaaauacccugucuaaaaaauaaaauaaaauaggccgggcgcaguggcucacgccuguaaucccagcacuuugggaggcugagaugggcggauuacaaggucaggagaucaagaccagccuggccaauauggugaaacccugucucuacuaaaaauauaaaagaaauaagccgagcgugguggcacacaccuguuguuccagcuacucgggaggcugaggcagaagaauaguuuggacauggaaggcagaggugacaagugagccaagaucgcaccgcugcacuccagccugggcaacagagcgagacuccgucucaaaacaaaacaaaacaaaaaacaaacaaacaaauaaaauuggcugggagcaguggcucaugccuguaauccuagcacuuugggaggcugaggcagguggaucacuugaggccaggaguuugaggccaccaggccaacauagugaaacccuaucucuacuagaaauacaaaaaaucagcugggcgugguggcacacgccuguaaugccagcuacuugggagccugaggcaugagaauugcuugaacccaggaggcagagguugcagugagccgagaucaugccacugcacuccagccugagcgacagagcaagacucugucucaaaaaaaaaaaaaaaaaaaaaaugaaaccauagaggcagagauugugagaaauuaauugugguuauugcuugagucuuuucagcaugaaaaaauuuuaauuugugacuauuuucucuauaaaggcauagcaaaugaaucuaaaaaguuauauggagcacaguuccacccugaaguuggccuuacagaaaauggaaaaguaauacugaagaauuuccuuuaugauauagcuggaugcaguggaaccuucaccgugcagaacagagaacuugaguguauucgagagaucaaagagagaguaggcacgucaaaaguuuugguaagcaaauuauuaucuggaagucuacaaauuuauaucaauaauauuggaauccaggaguuagaguccucaacacagcccuuaaauguucuacaguuuuagagugcuuuuccaguuaccauacauaucuuugguauaaauagcacuuuuagauaaagauuuaagccaauaguguuuauuuucuuuuugcuuguuuugcucauuuugauuuuucauuuuaccccguagguuuuacucagugguggaguagacucaacaguuuguacagcuuugcuaaaucgugcuuugaaccaagaacaagucauugcugugcacauugauaauggcuuuaugagaaaacgagaaagccagucuguugaagaggcccucaaaaagcuuggaauucaggucaaagguauugaagaaccucagaaaaguuaacuuacauguuaggacuuguuuaaucaaaucuagucuuaugguuuaaaugagcacaauuacaguuuucucaguaugcucaagguugaaaauguuuuuuauuuuuacaauuaccucugguguaagagaggucucaguauaaauuuuuaaacuauugauucugcuaauuuaauacauagauugauaaauuaacauuuucuagcuacuguucaguucucuucuagucauucacuuuuaaaauuaucuuuuccuggccaggcgcgguggcucacgccuauaaucccagcacuuagggagaucaagguggguggaucaccugaggucaggaguuuugagaucagccuggccaacaugaugaaaccccaucucuacuaaaaauacaaaaaauuagccagucuugguggugggcgccugugaucccagcuacucgagaggcugaggcaggagaaucacuugaaccugggagguggaggcugcaguaagcagagaucaugccacugcacuccagccugggcaacaagagcgaaacuccaucucaaaaaaaaaaaaaaaagaaauuaucuuuucccacucuauuuaaugauauuuauguacgaggcuacccaagcccuccucagguauggguauacagauuauuuugcaaacagaaaagcuuauugugggagagguaaagauucuauacuuuuuuuuuaaagggccacuaguaaacuucuuaguccuuaauaacauuuacuuuuguagauaccuuuuauacuuuuuaaaaacaaggugcaauugauaguuauaaugaaaugaggucaguaguuuaaugauaaaaguuauuguacauauuauggaauuaauuggaauugauaccaaaaggcugaauaaaaugaagacuuguagguaaguaugaugugaacaugagucuauuuuuuugaaacuucucuaaaauaacaguaaaagcauaaaacaguguaauaccuuaaggaugugggauagaggagaugacagaagacagaugguuucaauaaaguguuggaaaguggaaagcagauggguaaagguggauuuucucuguuuaagcuaggggggucucucccaacauccugggaagguccccaaugguaucuucacauggugauagguuuuugugaaauuugcaagauauuuugauaauuuguaguuguuuauuuucuuucaacucugacuuguuuucuguuagguggugcuggaauagcugugggcauuuugaaaucaggcuaagacaaagaugagcuggggaugugcuuaguauggguuuagugguauauaugugauuugcaauuauuucuguguauaguuaaguacuuguuagccaucccaguauaacuuaagauuuuuaguaucuuauuuguuauucugguucuugaaggaguccuucaaauuguaaaacuuggaucugucccugguaacugacauagcagaauggaggaauucacaaccuugggguggggugggaaggaagccaauaaaaagcaagcugauuugugcuguagacuucuggggaggcucaggaauuugaagcauuggguucuuuuugggacauuggucucuggguuagccuaaaacagggauuaguuaaaaaucugagaagcagauccuuuuccuuagcacaggagcaaacugugcucuccuuccccaucagaacacuguggauguauucucuagaggggcuaaacgagagguucugggcuugagccuacuaauaccaggcauaguugaggguggagguaagacucuacauuaagaacaggauuaaguaaaauucucuaugcugaauggugauucccucuuccuaccacuuccucuguuuaacugccagaaugccaauaggcaggagaguagauaugucuucucuggguaguugaccagguacaggaaagaccuacaaauucacuggcuuuuccacaaugaaauagccagcugccuugucaucuuacggugaaggccuccaguagcuaaguuuuauuagcaaauagagaucuuaguuuuuaguuucuugucauuaaauaaaaagccaaggauuguuaaauguauguucauaaauauuaguuuuacaagacacuagggugugauuccaacagcuuugacuccguuuaggagccggugcuuuugacuucuuuggggcuaagcuucuugcuguggcuucugcuuguugcucuggugaagcacugaagagagggaaaacaaucagcauaaauuuuuuuuuuuuuuuugagacagagucuuguucuguugcccagggcagaaugcaguggcacaaccucggcucacugcaaccucugccucccagguuuaagcaauucucuugccucagccucugaguagcugggauugcagacaugugccacuacgccccacuaauuuuuguguuuuuaguagagaugugguuuugccauuuuggccaggcuggucucacacugcugaccucaagugauccacccaacuuggccucccaaagugcugguauuacaggugugagccaccgugccggcccuaaucagcauaauuugugaugucauggcccuagaucuaaaugccaggagauucucacagaaacaaaauuuaaugagugccuguaucugaauucuguuacucaggauuuauugauaguucuuuuucuuuucuuauuuuuuuuuuggggauggagucucucucugucacccaggcuggagugcaguggcacaaucucugcucacugcaagcuccgccucccggguucacaccauucuccugccucggcuucccaaguagcugggacuacaggcacccgucaccacacccagcuaauuuuuuguauuuuuaguagugaugggauuucaccauguuagccaggauggucuugaucuccugaccucgugauccaccugucucggccucccaaagugcugggauuauaggcaugagccaccgggcccggccaauaauucuugaauauugauaguuuauugaaauuuguaggcagauuuaggggagaucaaaggacugcucuucagacugggaaagaaauagcuuuucuuucuguauuuugacuuguuauuuuugauuaaaaaacauguuauaccaauuuaaaacgcuucuccccuuuccuccagugauaaaugcugcucauucuuucuacaauggaacaacaacccuaccaauaucagaugaagauagaaccccacggaaaagaauuagcaaaacguuaaauaugaccacaaguccugaagagaaaagaaaaaucauuggggauacuuuuguuaagguaccuuuguuuuuaauauccucaacauguacuauuuuugaugugaaucuuaguauuuguuuuuccuugucacuauaucaaauaaccaaauuagcuaauuuuaauccuuuuucuuauguggcugagaguuuuauuguauauugucauuauauugaccaguagaaacuguuuuauguuuuuuuguuguuguuugguuuuuuuuuuguuuuuuugagacagagucuugcugugucaccaggcugggcuggagugcaguugcacgaucucggcucgcugcaaccucugccuucuggguucaagugauucuccugccucagccuccuaaguagcugggacuacaggggugcaccaucaugcccagcuaauuuuuguacuuuuaguagagacggggguuucaccauguuggccagguugguccggaucuccugaccucaugauccgcccgccucagccucccgaacuucugggauuacaggugugagccacuaugcccagccaacuguuuuauguuuuaauaaacauguuugccuacauugccaggcuauuauuuuaagaauagaugucuuuaagaguagauguauucagcuuaucauagacuuuaauucauugauuaucucaauggcuaauuucaagcucuugaauggaauguucacauaccuuuguuuuuguuuuuuuuuuuuuuuggaggcggaguuuuguucuugucacucaggcuggaguacaauggagcgaucuuggcucacggcaacuuucaccugcuggguucaagcgauucuccugccucagccucccgaguagcugggauuacaggcaugcaccaccaugcccagcuaauuuuuuucuuuuuuugagauggagucucacucugccgcccaggcuggaguguaguggugcaaucuuggcucacugcaaacuuugccuccaggguucaagcgauucuccugccucaacuuccugaguagcugggauuacaggcgugugccaccaugcccggcuaguuuuuguauuuuuaguagagacgggguuucaccauguuagucaggcuggucucaaacuccugaccuugugaucugccugccuugccucccaaagugcugggauuacaggcgugagccaccacaccuggccacuaauuuuguauauuuaguagagaugguguuucaucauguuggccaggcuggucucgaacuccuggccucaagugauccaccccacucagccucccaaagugcugggauuacaggcgugagccacuguguuuggccucauguaccuuuuugaaucguguuagaggacauguucauuaaggaguuuauuuuggagauugguggauuuuauuuucugaucaguauuucuaaaggacucuaagagauuuagcugaaaguauaaacuuuugcuuuuaaaaaaaguuaucucuuacaaggcuguuuuacuccuguugauuauagauugccaaugaaguaauuggagaaaugaacuugaaaccagaggagguuuuccuugcccaagguacuuuacggccugaucuaauugaaagugcaucccuuguugcaaguggcaaagcugaacucaucaaaacccaucacaaugacacagagcucaucagaaaguugagagaggagguaaaaguuuaugaaaacuuuuucauaaaguagauacauggaaagucuuccauucuucccuccucuucccucuaauauucacagaauugcauaaccaucaccacaucuaauuuuagaacauuuuccuuacccuaaaaaggaaccuuauacccauuagcagucacuccucguucuaccuguuguugucauugucauccugcccccaccccccagcuccuccuuuccuccuuucuugccagcccuaggcaauuaccaaccacuaauuuauuuucugucucuauagauuugcuuauuuugggcauuuuauauaaauggaaugguacaauauguggucuuuuaugacuggcuucuuuuacuuaccguaauguuuucaagguucauccauguugcugcauguaucagaacuuuauuccuauuuauugccagauaauauuccaucuuauggguauaaugcauuguauuuauccuuugaucagcugaugggcuuuuggguuauuuccacuuuuuggcuguuauaaguaaugccgccaugaauacuggucauaaguuuuuguggauauguguuuuuauuucuuuugguauaugccugggaguagaauugcuaggucuuaagguuuaacauuuugaugaauugccaaacuauuauuuaaaaugaugauacaauuuuacauucgcacuagcaaucuaugagauucaaauuuuuccacauccucaccaagacuuguuguuaucucuuuucuuauuguaaaaaacacauaacauaaagcuuaccaucuuaacucugauuuuuuuuuuuuuuugagacagagucucacucuauugcccaagcuggagagcagucaugcgaccucggcucacugcaaccucugccucccgguucaagagauucugcugccucagccucucaaguagcugggauuacaggcaugcgccacgaggcccggcuaauuuuguauuuuuaguagagaugggguuucacuauguuggccaggcuggucuucaacuccugaccucaggugauccgccugccucugccucccaaagugcugggauuacaggugugagccacugcauccagccucaucuuaacuauuuuuaaguauauaguucaguaguguuagguguauucacauuguuguaaaacagaucuucagaacuuuucaucuugcaaaacaaacucuauacccguuaaaaaacaacucucccuuuuuucuggcccccacccucugguaaccaccauucugcuuucuguuucuauguuucacuacuuuaaauaccucauauagguggaaucauacaguauugccuuuuugugacuugcuuauuucacuuagcauaauguccuuaagguucauucauguuguagcaugugacagaauuuccuucuuuuuuaagacugaaaaaugggccaggcacaguggcucaugccuagcgcuuugggaggcugaggcggguggaucaccuggggucgggaguuugagaccagccuggucaacaugaugaaaccccgucuuuacuaagaauacaaaaauuagccaggcgugauggcgggcaucuauaaugccagcuccuugggaggcugaggcaggagaauggcuugaacccuggaggcggagguugcaaugagccaagacugccauugcacucuagccugggcaacaagagugaaacucugucucaaaaaaacaaacaaacaaacaaaacagacugaguaauguacuacuauauguauauaacacauuuugccuauccauuuuuguuuaucuuuuggauauaugcccagaauugggauugcuggaucauaugguaguucucuuuuuaauuuuuuugaggaacuuauuguccauagcaauugcaccauuuuacaaucuaaccaaaaguacauaaugacuccaauuuuuccaaaugcuuacaauuuguuauuuucuauuuuuuuaugguuguguuaucugacuuuuaaaaauuuuagucaucuggcucagcacaguggcucaugccuauaaucccagcacuuugggaggcugaggcagguggaucacuugaagccaggaauuugagaccagccuggccaacauggugaaacccuguaucuacuaaaaauacaaaaaaauuagccagguuugguggugcaugccuguagucccagcuacucuggaggcugaggcaggagaauugcuugaaccugggaggcagagguugcagugagccaagauuaugccacugcacucccgccugagcgacagagcgagacucugucuuaaaaaaaaguaaauaaaaauguuagucauccuaguguauaugaagugguauaucucauuuugauuugcauuucccuaauagcuaaugauguugagcauuuuuucauguucuugcuuauuggccauuuguguaucuuggagaaaugucuauucguauccuuugcuccuuuuuuuaaaaaauaauuuuaaguucgaggauauaaguguagguuuguuacauagguaaacuugugucauagggguuuguuauacagauuauuucaucacccagguauuaggccuaguacccauuagcuuugcuuauuuuuuaauugacuuauuuauuuuuuuauuauugaguuguaaauguucuuuauauauucugguuacaagucuuuuaucagauauacgacuugcaaaugucuucucuaguucugugaguugucuucauuuucucaaugauaacauuuggagaauuauaauuuuggaacacuaguauauuuucuaauugcuuuguauucuaaugagaauuagaucagagaugauggauugguuuacccugauuuauuuauauuuaaaaagcuuauguuuaaaaugugcuucaaagagaaauaauacccauaagauauucgucuaauuccuuauaggcacuuaggaacaaauacuuuaaaagaugcauuuuuaguaauaaucuguuagucuaagaaaagugguaacaggaaaagccaauaauuuauuacgcuuuguuuuccaugucaucuugguuacuaguuuauauugguuggcuucuuuccucccuguagggaaaaguaauagaaccucugaaagauuuucauaaagaugaagugagaauuuugggcagagaacuuggacuuccagaagaguuaguuuccaggcauccauuuccagguaaaaauuagaacugaauuuuguuugauucaucuuuagaccuucauguugaagaaaaaucaauucagacaauucugaaauaaucugucaucucagggaauauguaacaugagagaaaggaaaggaugguuagggaauaauugaaaucuuuugaguaucuacuguauuuacuucauuuuauuaaauacucauuuuccauuguaucugcauuuaaguguuacauuauccuugggagucuggcaucugauguugccaucagaugagaaaaccaagacauaaagauauuuuaauaauauugccacacaguccuaguaguagagcuaggauuuguuauauuauuuguaccauaccgcagugcguuccauggaagaugugaggauuuaaauuuagcucuuuaaaauccuuguccuaugucugacuuguuugaauggaugaaccacuuauucugugcagagaauuccuggcacaauguaacuaauuccugaacaaauaauacuucauuugcugucauauagaaaaaaauuagaggugauacuuguuuaaaguuaggacugcaagucuuaaccuguuuuuguuacuaguucuugagagguugggcaagucuguacaucagguucuagcucacuguaauagugauuaggggaugauuugggagaaugaccuaauugaauugaaaagcauaauaauagccaacauuucuuaaguacuuucuaugugcuaggcacucugcuaaauacauuuuauugucuuauuuaaucuucacaguggaaacuacuauuauccuguuuuacagaugaagaaacuuagggacagcgacuaauuugccaaaaguuaugcagauugaaaggaguggagccagaaugauauccccaauaauuuuuaucucagaguuuauacucuuaaugaucauauuggcuccauaaacagcuuuacacauguauaaccuauguggugauuagcacuuguucucaaaucaaguaaucagauugagaucuuuagucccuaaccugcaugccggcgaagaauggucuguggaccggugugguggcucaugccuguaacccugagucuacuaaaaauagaaaaauuagccaggugugguggcaugugccuguaauucuagcuacucgggaggcugaggcaggagaaucgcuugaacccgggaggcagagguugcagugagacaagauuacaccacagcacuccaaccugggcaacagagcaugacuccaucuuaaaaaaaaaaaaaaagaaaaaaaaaaaagaaaagaaugaucugugaauguaauggagggaagccaaguguucuauguccuuggucauuauuucaucuagacucacuugauguuuuaaaaaucuauuuuguauguugaguuuucuauuauguaagacuucauuggcaaaaaugguuuuacugcuuuaaaaacuaucuuaaguaugcuguuuauucuaaagguaaagaauggacuagggaauuaauuggacauagcugagguuuugccuauaacuaggcaucucaagugaugccuuuucuguuguaguaaagcagcaggauccaguuuuccauagaucuaugcacaccuuguguuuuuaucaacuuuuaaguauuugguaaaauagagguuggguacaguggcucaugccuguaauuccagcacuuugggaggccuaggcaggcagaucacuugaggucaggaguuccagaccagccuggccaacgcggugaaacccgaucucuacuaaaaauacaaaaaauuagcugggcaugguggugcaugccuguacuagguacacugguggcugcuaggggaggguaaggcaggagaaucucuugaaccugggagguggaaguugcagugagcugagaucgugccacugcccuccagccugggugacagaaugagagucugucaaaauaaaauagaaauaccaguucacauuuuuugguauuaaaaacucacauuauuuauuagauuauguguauauuuuaacaguauaauaccauuccuaaaauuagauugauaguugaagcuggaugauaaguaagguaguuaauuauacuguccucuuuauguauauguuggaaaauucccuuauuaaaaacuuuggaugagcacauauguuauaaacuaaaaauauuuacuggauaauuuugugauacuuaauacauggacuguaaaaauaggauaggccaagugcagucaguggcucaugccuguaauuucagcauuuccagaagccgagcuucuggaguucaagaccagccugaacagcauagugaaaccccuaucuuuacugaaaaaauuagccaggcauggcugccggugcuuguaauccaagcuauuuaggaggcugaggugggaagacugcuugagcucaggaauuugaggcugcagugagcaauaauugcaccacugcacucuagccuuggugacagagcaagacucuaucucuuaaaaaaagggagauaggaaugauagggagagaauuaaacauacugucuuauuugagccucacaauggaaacuaugauaguauuacccuguuuuauagaugaagaaacuuagggacagagauuaauaugccaaaaaguuaugcagacuaaaacguaugcauaauuuaaauguugcagcauucuaaauguuacaacauuuuuagaauguugaagcauucuaaaaaaugcugaguugaaugggaaacuaauagcuacauuuggauacuuaugaugggcagauggauuuuaauuuuggaaagguuuuauguuuugaaacuaguggcauuuuuauauuagauuuuuauauuagaaauauaacauuaauguuaaauacuauuauuacuccuaccuuuagguccuggccuggcaaucagaguaauaugugcugaagaaccuuauauuuguaaggacuuuccugaaaccaacaauauuuugaaaauaguagcugauuuuucugcaaguguuaaaaagguaauauuugauacagcuaaucauuacaagaaauugaacggauucuuauuauauaccagcauuuauaaugaauuuuuuaggguuuuauuauuugaaaauuugguguaauauaaccuuugaaaugacuguggagaaaauauuccacagauauucuuauaugcauauuuuucuuuccagccaaacaagacuggauauccugagucucuaaaaaugucagauaaaguauuuuaaagcacucuuuuauguguauuucaagauaguaagggaaauccuuugagucaggaauuuauugggagcaucauuucaagaaaccaaagcugucugcuccucugaggacagcuacuaauccuuuguggucuaggauuuggguuuuuacaauuucauucauguacaggugucugaguaugagacuggguccaagaagggccagagauuggaucagauaucuucacacuaugcaacccuuuagcuccaaauugaagaugaauggaaaaauuccccagucuacuuuauucuacagauuugggguuuuaauuuauguaauguguguggucugaaaauugcaacgaaauaauuuuaaaguggaucuggguugguagugcuuaugggaguuaggcaaggaaaaaugcagauucucuuuagaauaucuucaccuaggucccaaaggauucucauagauagauuuccaacaaauaugagguuauaauaaaaaauacaaaucacauauagaaguauggcaccaugaaugagaaaggaaaaaacugucagaacaagacccucaagacuuuacuggaauuaacaagcaauauguaaaguaaauagaaauaagcuauucauaauaagaauaauguauaagagacuacuaaaaauaacugggcagauuugaaaauaaucuaaguucugggaaugaaaauaauaacugaaaaacagcugaaagagagaauuaaugaacuaaaagaaaguuguuuagagauuauccagaaauuaggacaaaucaucauaaagaaaauauggguagaaaagguuaagauggaaggauaaggcaagugcuaacauauguccagaaggaaauaauagaaaaaaauguauuaauuccuccacacugguaaaagacaugauggcucagauucaggaaauguaacacaucucaagcagaauaaagggaaagaauuugacaccuaguaagcacaucuuagagaaauuaaagacugccaaagacagagcagcugcggagaacagaucaauuaccuacccaggaaauuauacugaaacaguaaaggcaagacuucaaaauaccaagagaaaauaauuaacuguagugaacagcuaaacugucuuuuaaaaacaagggcaaaauaaaguuauuucgagauuaaauagaauuuacuaccaacagucccuuacugaagaaacuaaaggcaaugauuuucaacccuggcuguauguuagaaucaucuggggaagcuuuugaaguauacuauucuugacauauagcccuagaauuuaauuggucugagaugggaccugggcauuccaaguaauuugugcaguuaagguugagaaccauuguuuuuuuuuuuguuuguuuguuuuuugagauggaguuuugcucuuguugcccaggcuggagugcaauggcacgaucuuggcucacugcaaccuccgccucccagguuuaagcgauucuccugccucagccucccgaguagcugggauuacaggcaugugccaucacgcuuggcuaauuuuguauuuuuaguugagacgggguuucuccauguuggucaggcuagucucaaacucccgaccucaggugaucacccgccucggccucccaaagugcugggauuacaggcgugagccacugggcccggcugagaaccauuguuuuaaagaacugacuugaggagaagcagcaggaugccaggagaaagucaugagauacaagaaggaaugcuaagcaaggaaaaugguaaaugacuaaaacugaaacaaacauggacuguauaaaaugauaaaaaugauuauaaaaucgagaguagagguaaaaaugauaucuacuuguucuuguuuauuagaaaauguguaacaauguuuagcugaaguaacauguaagccacaaagggauugauuugagcuaaggaauucaaagaugucuguguuauuugccagaaggacagaagauugauuaucuuuuaaguauccuuguuaacacuuaaggacaacuacugcaagaauagaaauagaggauuuaacuucaaaaccgguaaagaggaaauaaaugagcugggagaaaucaccaguucaaaagacagcaagaaaggaguaagaguaaaaaauggguuaaauagauaauuacagaaaaagauuguagaaugaaauucaacuauauugauaaccuauaauuaauuaaaaggacuauaacauuccuaguuaagacauagacagucaaacuagauugaaaacuaaaaucugcuuaguauagaauaguagacaugaaagguauagucuauucacaacaggcauuacuaauaccuagggauaguaggagugaaaauuaaagaauggaaaaacauauaccagguaaauaaaaaaaaagaaauggcuaaagcuauauuaauuucagacaaaacugacuuuauggcaaaaagcauuaagauaauauuugacucagauaaggugcaucacuugcuggugacaggguacuaaagccugaauguauguaaauauaaucugcauuucuuauccuaagacuucuucauaguccuagcccucaggugugaauuucuggcauagugcauagcacacacaacucaaggagauaccaaauacaauccacugcuaaaaaccaguaaaauacauaagauaguaguagauaauaaaagagugaauaccuuauuucuuaaaacugaaaaaaugccucuuugguuuuucucagccacauacccuauuacagagagucaaagccugcacaacagaagaggaucaggagaagcugaugcaaauuaccagucugcauucacugaaugccuucuugcugccaauuaaaacuguaggugugcaggugaguugugugaauucauucaccagugauauacuuuuuuuuuuuuuucuuuucuugagacggagucucacuguguugcccaggcuggagcgcaguggcgugaucucagcucauugcaaccuccgccuccuggguucaagcacucuuucuacuaaucuugaaauaaggauuacuuaggaaaaugaaauaugugaguauauauaccaaguuuagagaaauaagguaauuuuuuauagaauguuuagggagugaauaguuaauggaacuaaauagucaggcugagauuuuguaguuuuggaacaucuaugaacucuaaccaaagguaaauauugaaagcaacccuuuccuauaggguuggcaugcuuacuucugccuuguagggcagggaucaagaggucauuuauccuaggugugaaauauacugugguuuuagaagucuuuaacugcaggaaggccuccagaugaguaaguuacaccauuuagguguuguucucagcuuguguauucccuguacuagggaacacauucuacugauguuguguuuauucugccuuucuaguuguaaaagaacaugagaauaauauaguucucaauuauaaaaugcuacuugcaaaaugacuaauaacuaauaagauaguauguuaauuucuccucuuuuuucuggagacagggucuugcccugucgcccaggcuggagugcagugaugugaucauggcguacuguagcccugaauuccuggguucaagcgacccuacuaccucagcuucccaaguagcugggacuacaggcaagcaccaucaugccuggcuaauuuuuaaauuuuuuuguagagauagggucucccuguguugcucaggcuggcuuugaaauucuggccucaagugauccuucacuuuggccucccaaaguguuaggauuggaagcaugagacacuguacccggccuucuuuauaugauccucaaaugaguuuuuggggagcaaaagugugggaggguagggaagagaaagguuauuuucuucuauuucaaguuugugguuaaauggagacacuagaagaggugucaguaguucaacucgaaaaugguauaagugccaguuauuggguuaauguguuuauaauguccucuuacaguaaaauuauguguagaauauacauauguaacuaaccugcacauugugcacauguacccuaaaacuuaaaguauaauaauaaaaaaauaaaaaauaaaaaaaaagaaauucuguuucagagauuauucuucuaaaaccuaauaagcauuuuuucuaaauauaugaaucugucaguuuaaauuccccuuugcucugaauucaugcaguucugccuguaaauaaaacaagauaaaaauugauuguugccaggcgcagugguucaugccuguaaucccagcacuuugggaggcugaggcaggcggaucaccugagguuggaaguucaagagcagccugaccaacaugcagaaaccccaucucuacuaauuagccgggugugguggugcaugccuguaaucccagcuagucgggaggcugaggcaggagaauugcuugaacccaggaggcggagguugcggugggccaagauugcgccauugcacuccagccugggcaacaagagugaaacuccuucuuaaaaaaaaaaaaaaauugauuguuauuuuuaaaguaaacuaaaauauuuuauuucaugaaagugauagagccagcuauuggguuaaggaacucuugccuucuuuuuaaaggccaaauguuguaagcugcuuauguuguuuuaaaaucacuauugaaauaaccuuacuuggaguuacugauacuuucuuucagugguuuauggauuaucucauucauacauaaauuuauuuugaaauuugcaaugauacuuacaggcaguauuacccuaauauauaaaaauagaauuguggacagguuauuuaauucuuaaaaguuucugaguuuuaaguagauuuguuauagagaacuucaacgucugugugcuaacugcugcuacaaagggaguugaaauaguuccccacucuucuuuuuagagaaguguuacaaaaaauagauacuugagauaaucugaugaaugagugauuucuuucuugaaaaugaaacuuauucaggcucuacuacuuuucccaccaaaauaaaauuuucuuuuguuauuggauaacugacuuuagucucuuacccuuugaagcuuagacccuugcaagcccagauaaaaaugaugguucauaguuaguauaacaaugcauuuuauuuucuaaauaccaaaguaaaccguauuuguaaaaaaugaaaauacauuaaaaaaaauucuuuguauuucuacucuccaguuaaguuuuguaugugucuuuccagaaacacuuuaaaaagaaaauaaaagaggggauuugggguacacauugucaacuuuuuucuuuuaacugaacaucaugaacuuaccuuucugugccuuuccaaguagaugguucuuaacuguucccucauauucuaugcauaccaucauuuauuuaacuauucuucuaaccaaugggcauuuaaacuguucuguuuuuuauuauuauaggcaucccaucaguuauccauguauuuauguaggaucauuuuaugugcaugugcauuuuacacuuuuuuuuuuuuuuuuuuuuuuuuugagauggagucuugcucugucacccaggcuggagcacaguggcuugaucucagcucauggcaaccuccaccuaccagguucaaacgauucuccuguugcagccuccuguguagcugggguuacaggcacacgccgccauaccuggauaauuuuuuguauuuuaguagagacgggguuucaccacguugcccagguuggucucgaacuccugagcucaggcaauccacccgccucggccucccaaaagugcuaggauuacaggcaugagcuaccacgcccagcccauuuuacacuuuuauagaugcuaucacauuagcauucacauauguugaauuuucacauucuuaguaccugccacuuugggcauuagguacuucucuaaucuguuacuuuuuaaaauugcuuuucauaaaaaaagcaaauuacuuggauuaaacaggacacaggaaaagagaauaaauuaucaguuuuauuuacuuauuuuaaaauuaacuuuuuuuuuuuauuauacuuuaaguuuuaggguacaugugcacauugugcagguuaguuacauauguauacaugugccaugcuggugcaccgcacccacuaacucgucauuuagcauuagguauaucucccaaugcuaucccuccccccuccccccaccccaccacaguccccagagugugauauuccccuuccuguguccaugugaucucauuguucaauucccaccuaugagugagaauaugcgguguuugguuuuuuguucuugcgauaguuuacugagaaugaugauuuccaauuucauccauguccuuacaaaggacaugaacucaucauuuuuuauggcugcauaguauuccaugguguauaugugccacauuuucuuaauccagucugucauuguuggacauuuggguugguuccaagucuuugcuauugugaauaaugccgcaauaaacauaugugugcaugugucuuuauagcagcaugauuuauagucguuuggguauauacccaguaaugggauggcugggucaaaugguauuucuagcucuagaucccugaggaaucgccacacugauuuccacaaugguugaacuaguuuacagucccaccaacaguguaaaaguguuccuauuucuccacauccucuccagcaccuguuguuuccugacuuuuuaaugauugccauucuaacuggugugagaugguaucucauagugguuuugauuugcauuucucugauggccagugaugaugagcauuuuuucauguguuuuuuggcugcauaaaugucuucuuuugagaaguauugaugggacauaucucaaaauaauaagagcuaucuaugacaaacccacagccaauaucauauugaaugggcaaaaacuggaagcauucccuuugaaaacuggcacaagacagggaugcccucucucaccacuccuauucaacauaguguuggaaguucuggccagggcaauuaggcaggagaaggaaauaaaggguauucaauuaggaaaagaggaagucaaguugucccuguuugcagacaacaugauuguauaucuagaaaaccccacugucucagcccaaaaucuccuuaagcugauaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauaucgugaaaauggccauacugcccaagguaauuuacagauucagugccauccccaucaagcuaccaaugacuuucuucacagaauuggaaaaaacuaaaguucauauggaaccaaaaaagagcccgcaucgccaagucaauccuaagccaaaagaacaaagcuggaggcaucacacuaccugacuucaaacuauacuacaacgcuacaguaaccaaaacagcaugguacugguaccaaaacagagauauagaucaauggaacagaacagagcccucagaaauaacgccacauaccuacaacuaucugaucuuugacaaaccugagaaaaacaagcaauggggaaaggauucccuauuuaauaaacggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcaugggcaaggacuucauguccaaaacaccaaaagcaauggcaacaaaagccaaaauugacaaaugggaucuaauuaaacuaaagagcuucugcacagcaaaagaaacuaccaucagagugaacaggcaaccuacaaaauggaagaaaauuuucgcaaccuacuuaucugacaaagggcuaauauccagaaucuacagugaacucaaacaaauuuacaagaacaaaacaaacaaccccauaaaauuaacuuuuaagcugauacuuaaacacguugauaaguaaauguuuaugaauuguuuuugucucccacuuaagaauucuuuauccacucaaaaaacacaggcagaucuugucugccaaauuauaauuuuucauaauuuuauuuuauuuuuuugagauggggucuuacucuguugcccaggcuagaguacaguggcaugaucacugcucacgauagccucgaccucguugggcucaggugauccuccuaucucagcuuccugaguagcagggacuacaggugcaugccaccacacugcccagcuaauuuuuguauauuuuguagagacaggguguugccauguuguccaggcuggucucaaacuucugggcucaacugacccacccaccucggccucccaaagugcuaggauuauaggugugagcuucuguaccuggccuugucugccaaauuaaauaugcugguuauccacaguugugcagguaaugggaauguugaauacuuuuuuuuuuuuugagacagaguuucacucugucacccaggcuggagugcagugauacgaucucucagcucacugcaaccuccaccucccaggaucaagcaguucuccugccucagccucccgaguagcugggacuacagguucaugccaccaugccuggcuaauuuuuguauuuuuaguagagaugggguuucaucauguuggccaggcuggucuugaacucaugaccucaggugaucugcccaccucggccucccaaagugcugggauuacaggcaugaaccacugugcccagccuaaauucuugauauuaccaugauacuuuauguaugucuuagcugauucagguaggauuuaauaugggauuuuaauuuggaauuuauuuauaccauuaaagaagcauuuaguauauacuuucauucaaaauuuccaaaaauccauuaauaaugucaccaugcauaagauauuuuucaaugcaucuuuucuuuuuuuuuuaaaaaaaaaaaaaagcuuugucaaguuaaacugguguaucuuuugacuauuaaaaauuauugauuaucuuuuuauuuucagggugacugucguuccuacaguuacguguguggaaucuccaguaaagaugaaccugacugggaaucacuuauuuuucuggcuaggcuuauaccucgcaugugucacaacguuaacagguguguuucacaggagcuagggugggggcuuguguaauggaaggauguauuucuuaagggcuuucaauuaauggaagaccaaaaggcucaaauguagauauagguaggucauguagauaagaguaaauggcuguguuuguaauucaaauaugcacauagguugcaguuaaguagauauuuaauauuaucuuguguuuugacucuucaucacaauguagucaucuguuaaaaauuauuuaaaggagaaagauuuuuauuuuaguguaaaauauuaaaggcagcuguaaaacaucuucuaaauuagugguuuauauuagcuguugguuuuaugguaacauguuuuauuccagaaggauugaaaaaaguauguccagguuacagaauuacaaauaaaguaacacacacacacacacacacacacacacacacacacaccccuacaaaacaaacaacccccacuccaaacaaaaauggagacuugguuaauuuaguaguaaccccaaggaaaaaaaucaaagaaaagaaauaggcaugugccagauagcauuaaaauaguuacauuuaaauauauaauuuacauuuagauuaauuucccuuuaauuugcauauuaacuucuuacauuggauauaucaacagcugauuuauaaucuauuucuaauccucaauuucaucguaccauauauaguucaaaaauucacuuauuuuguacuagauugcuaauuaaauguucuuacuucacaguuauucucucuguucaguuuucuucauggguguuaggcaguuaacaaccaaaaagaauuacuugagguuucauuuuacucaaauugcugcagaaaucagaagcuuaccuuuuaauguuaagcuagcagagucuguauaguucgagauaaggaguuacagggaagccauguuuuuaccgaugggaacaugcucauucaaaggcuuacucaaaugaacugaaaaccgucaaauacagaagcaucuuuaaaaugcugaaaaauagaauuauuacuaucuucaauaaugggggccaggcaugguggcucacgccuguaaucccaccacuuugagaggccaaggcgaguggaucacuugagcccaggaguuugagaccagccugggcaacauggugaaacuccaucucuacaaaaaauacaaaaauuagccaggcaugguggugugugccuguagucccagcuacucgggaggcugaggcagaagaauggugugaacccgggagacagagcuugcagugagcugagauugcaccacugcacucaagccugggcgacagagcgagacuucaucucaaaaaaaggaaaaagaaaaaaaaaagaaucuuggugaacuuuagauuuauuugcuggggucuuuuugaugaauuggaguuuaaaaauauucuucccuguuugccgguuuuuuuccuaauuuggauaagggaaucuuuguacagggagggacuguuccaguuuuacugucauauauaguguggguaaauaccugucccaguacacucuagugauuacuuuuguuuguaagaaaugagaaggugaaaagagcagguucauggcauucucuuaacuuucuccuguaaagaucuuuuaugaacuuuaggaacuguauuguuuagaaaaauuauaacuuacugucuauacgugggacaaaaaccuugcuucuguuguaguauguuuggaaggagacaauaaaguaguuggugauaccggugguuuugugcuaauaugguuuucuauuguguauuuuaccuaaguacauauuaagaaaagaagaaaaaacauuaaacuuuaccaugauaguuuccggggagauuuauuuucuuugcuaaaaacaggacuaacgaaaagugaauagggagaacuagcuaaguggcacucauaucucuacccugauucccucuuguuuucugggugaagauugugaaacagaucccuucaaaccaguggccagcuacacuucaaguuguuaaaauugucugauucuaauuuccucaaguuauguuccaaacuguacucucauuaacucaagauauuugugguguaucuucaugucuuucaaacagacauuuauauaaaacacuaaugaaucauuuuuuuggaaggaaguaguaggauacuaaguccuauuucaauggccuuuuuaaugaagugcaaaugagaaucucucuagaaugauuguuucucaaguagagaaaaaaagaugaguuuacuaauuuugggaaauucacuguaguuuccucuuggagauuuccagugcauguuagcauaguauauuaauaguuucugaagucuugucauaaagacaccuauuuuuaaauuuuaauuguguauuuguuuccuaggacuacccauaacaaaucaccacaaacuaggaggcuuaaaacaacagacauuuauucucucacaguuuaggaggccagaagucugaauucaguguuggcagggucauauucucucugaagacucuaggggaggauccuuccuugcuucuuccuacuaucgagugguggcagcauaguccagucugucuuuguguucacaugacccucauuccccuguggguaucuguguauccaaauuucccagcacuuggaaggauaccagucauuggauuagagcccauccuaauccaguauuacuucauuuuaacuugauuacauuugcaaagacccuuuuucuccccagagauucugggugggcaugaaguuuuggggauacucuucgacccaguacauuaagugaaaagagaguuguaauaaucacuuauaucuuugcacauucugagauacagaauauuccagagaacacacuuugaggaaaacacguagaacacagaccuuccuauaaucuuauaucuuguccuauccaucuggggaguugaagugggcaggagaagggccugaaacuaagugggaaauggaaagaauguuacuguucuaagugccuugcuucucauacuaaaauguaauuucuacauuugaaauguaauugcuguauuauuuuuaccucuuuguuuccagaguuguuuauauauuuggcccaccaguuaaagaaccuccuacagauguuacucccacuuucuugacaacaggggugcucaguacuuuacgccaagcugauuuugaggcccauaacauucucagggagucugguaaguugcucauguuuuugauuacuacccucugaaacuaguuuuuggaagcuugauauuaagaguaggaggauguggcuuuugcuuuuuagaugcuuuuguuuuuauuauuuaaaucuuugaauguucuaugauguugcuuuuuuuucuugagacggagucugucuugcucugucgcccaggcuggagugcaguggcacaaucuugguucacuucagccucugccuccuguuacaagugauucuccugccucagccucccgaguagcugggauuacaggcacccgccaccacaccuggcuaguuuuuuguauuuuuaguagagauaggguuuugccauuuuggccagcugaucucgaacuccuaaccucaugugaucaggucaggagucaggucaggccagccuuggccucccagaguguugggauuacaggcgugagccacugcaccuggccuauaauguugcuucuaaauaaaauauauuccccuuuguggccauuuguggacaugcacagagcagcagaaaauuugaauuuccagacuuagauguucccagcugaguuugaacaaggugacgcuaugccuucuuguuuucagcucucauaaugugaacaagucuuuuucauggucuccuugaugcuauaucuuuugcauuuuuaugucuuuuguuggugauuuugcuguuuaaaauggaucucaacuauaguguugaagugcugucuggguuccuaagcacaggaaugcugugauguaccuuacagagaaaaucuguguguuagauaaacuucauucaggcaugaguuaaagagcuacugauugucaguucaguguuaaugaaucuauaauaaauauuaaauacagugucuuaaaucagaaacacauaaaacaagguuauauauuaaucaguugaugaaaauauuacaaccagaggcuugcaggaaccuaacccuccauuuccccugggagaaaugguucaguauucgcuaauucguuguuugcaguguagaauauaacuauacugcaaauuauaauagagaauaaugagacuggacuguuucuguuuacagcacaucagugaaacaucacugaugugaucaaauucuguuuuuugcauuugugauuaaguccauuuaaaaugcucugcgaguagcugaaaucaaugcaugaugacagucuuaacuacgcuguguguguauaugugauuucagauauugccugggaggauuuaauugaacugaguuagagugcuuuucuaugguguggugauugguucuacauauaccuuucucuaggguaugcugggaaaaucagccagaugccggugauuuugacaccauuacauuuugaucgggacccacuucaaaagcagccuucaugccagagaucugugguuauucgaaccuuuauuacuagugacuucaugacugguauaccugcaacaccuggcaaugagaucccuguagagguaauuuauauauuuuuuucuaaugcacguucucaguaccucuuacauuuuauaauauggugaauggaauaggcuaugccagugcuguauuucuuauguugguuuucuguucauaagauaggcuuuuuuuuuuaaauuuucacauauuugauuaauacacuggggcagaaaaaggcuuuaaauuauauaugcucuccaauugugugauuacuguauaaaaaguaauugauuauaauuuuaucuaauccugccaauuucuacuuuacaaacaguauuccccaaauaaaaaagaaaacucuaggagugaagaagaguuuguuagaaauaaggaugcaauuugauagcuuuauggccagacacccaagaauugccuaaauguucucccuacuaccaauuccaacucaauuuuugauccuucuuugucuucaccagaacauuccaaaggagcuacuugcauaauagcaagugaaaaucaaagugagacucuauuaguugggccacugccuccagugcacuaacacgaagcugucgugauagcuagguagauggguugguucggaacguggcuuagagucauuuuucucuuaggcucaaauuugucaaauuugacaagugagcaggcuauccucuccuguauacuugauaaugauuauuacaguguacucugugccaccuugguggcccuuagaguuguauguuuaagcugcagauaauuugcagagcauuggcugaaacacauaaaaucacaugcuuggaugccacagcaaugucaaaucgcuauauguucuuaagcacuuguggcucagucacaaacacaacuugcagacuagcaccuguuuguggaucacacuuugaguaguacugaguuuaagucacuaauauuuuaaaccuuaauaacuuacaccuaucccugcagaggggaauagguucauuauauaagauuaaucagaaaccaucccauauacauggaggacaauagugaaaauagucaaauuuuaauuucaaauuacaaauguaagcccucuaggacugcuggacaugcaguggaugcugacuuuucucuauaauuuuuuuuaauaggugguauuaaagauggucacugagauuaagaagauuccugguauuucucgaauuauguaugacuuaacaucaaagcccccaggaacuacugagugggaguaauaaacuucuuguucuauuaaaguaccgugugcaguuuaa

SEQ ID NO: 191297 - RNA, 21490 nt, Homo sapiens
uuauaaaaaguaaauacacaaaccggugucauuuauugucauuaucaguauuacauacuguacauaacugaaugugcuguacuuuuauacaacuggcaguguaguagguuuguuuacaccagcaucuccacagacacgugaguaaugcacuaggcuaugacauuaaaacggcuaaaacaucaugaggcaauagauuuucugcuccauuauaauuuuaugggaccacuauuguauaugucauuaugcaguacauaacuguaaucuucugcaaaaccagucaaaucuaaccaugccacaaaaauaacuaccaccaucugucuuaaagaacgugacuccuauauggauggagauuaacaagggcauagaucgauucuauagaauauuucauuuaauugauuuuauuauaacuggauuaggucugagcccugggaaacagacaucaccuuguuauacagaaucacacauuauaguuuuaacugaaguuguuuuucauauaggacaaucauaaauaugaguauuacaagagcugacuacauacuuucaaguuuauauuuccugacaaaggauaugaccuuuuuccauccuguaauucagagaaaaagaaccacuugcccuauauaaacucuaaaaagaaaacugcauaaacccaggaacagggggcaaggagugcuccccuuugaccuacuauuagcagguccaacaaaugauauaucaccacgucuaugaagaaauuucuuucuauaaaagcacaaaauuuaaaucggauuugacuuuacauauuagggcuuucaucuugaugagaaacucauaacagcagcagcucaaacugauuguuaaaaggaaaaaacacagggcagauuaauaaugcaacuuggaucuucacucuucucuuuccaauucaaaugcuggaauaugacacucuuuuuauaauauucugcccaugagguucucucccuucuuuucugccuucagaguccuuuccaaaaggaaauuacugccuugcauucuacauuauuccuaauuuccagguggaaaaaugagacaaauuaagugacuucuaaaaacacuaggaacuguauuuuuuaaaaacaagacaauacuucagauuuucuugcuuuaauucuucucuauauuaccacaguaaaauauuuaacaaaguccaagagauuacugauaugcaauaaugaccuaugacuuuacauuaauggagugauguaucaauaauaaacugaucaguuaaguaacuggaaaauguuugcauguaaagaaugauucacuauccuuuuuaucuuguauugaaaucgucaaaacauuuaaaaacacaaaguugaaguaauuuuaaauaauaauaacugugaaauacugcaacaucuugaaguacuuuauaaaugaccaaaaacagguaaaauuuuguucaguauaacuucagugaagaaguuuuuugacacagaacuacauauauuuuuaaauugguaauccacauaagauauacacaaaaccuucaagugacuacauuguucaauaaauaaaacucuacauuguuuuguuuuuacagccuagugagcuuauaacucaguaacacccuuuuaagaaauucuagucuacagaaugacauguccaaauuguuugguccuauuaauuucuuuagcaaaaaccuccaauuccuuuauauuuaauuccuccacauaucaucuuugaagggccugacuaauaaaucacaaguguaacccuccagucuccagucuggguuuuucaugaguuucaguucaguguaagccagcacacugaccuccccaugaauuuuccacaguaccuacuuuauuuaacacuuuccacaaaguauccuguccuucuaggcuuuuuguagaaugugaaguuaauaauggcaugugguguuccuuagcaugaccugccaaaaagugaugaucuccuuggaagaaaagccaugggcugcaaucacacgucucaguugacagacauccaaauggauucuauauagaaagaaaagauuugugucuucuggaauaugaauguucacuuuuaauaaauucaaacagaucccgacauaaacaucuucaaacuugauggguuuuacgugacccaucauuucauagauccuuggcaccaaaucucuggacauuauauaacccaacccacugcaguauggagggaacaccuugaaaggauacuccugguaagaaauauggguuuuuugguaaaauccucuauaggaauaauuaucaauuagaggauaaccugugaaaaacuucucugagugguuuagguuuaaaagauacuucacuaaauugccaguauugaugaaaacaucagugucugucuucauuacguacuuggcauuggggcaaaacucaguuacccaccugaaugccauaaugguuuucaaggucagguuauuauaugugucuaaaaaaucuugucggauuaugucaccauaaagaagguguucauccucuaaggacaaugccaacauuuugucuuccuuuucagccucuuggccuaauaagaaaaauguaagaaccucauauccccaccaagacuuuuuuucaccccaaguaacucuaauggccugccuggcuuucacaucugaagggugggaggucaccagaaugaccagaaauggauuuugaugagagcaguuugaaugcucucgaagugugaagugaaagucuugucuguaaaucggcucauacucauagaaguacauccaguucacgcguucuaucacauuguaguggggaaggcugagguaccacaucacaaagaaacucaggagugacagcagcaggaggcuccauuugagggaucucagugacauccuacucggaaggacaguccagagagccgaggccauccacagcagcucagaagcacgcgagccgaagguucuggaagaguuaucaaagauuggguuaauauuccacaccgaaaacacauuuucaaaagacaucugacuaucuacucaaggagaaagaguaggagaacagaaucuccagaguaaaacaaaaaauccugacuugaaucuacuucauuuaacuguaagcaaauagaaaccaauaaccaaaaaucuauuuuagcuucuuacaucaagaccaagguuaaaacauauccuuugauuauuuuguaguaguuauccuacucuaccuaaauuaacaguuuacuguuaaauauaauucuauccuaggugcagauaugauagggacagaaagagauggguaaugauggguuaaaaaauaaaucuaccauaaaaacaaauaaauaaaauguaucuccucuuuauaacuauaaaaaaagaaggauuuaauucaaggggauguuacuagccacaugcccaaauaaacgaagggucuuucucagcuguguguucugauacggauucuagcaaaucuggauaagaaaaacccuauagugaucauuauucuauucuuagugacugcugaugugggauaaggcagagauucuucaccugaaaggcaaguccuccagacacaaauaggaucaucucucuugaguuuucaaacacugacuaugaaacagcuuuuaccugccccaaacaccaccucuccccuccuuuuaccucauugguuaaacucaaugcucagucugcauagcaacuguuuaaaucaaaggcccguccuuaguauuaaguuuucacauuucccauuccaaccucuucagaaaucacacacccaaucagaaucaugggauggaaacuccuaaaacacuugcuuuuacacagaagcuccagcugagacaagaggaggcacagaacauucagauugugaagugacagcucuguuccugaucucaaggcagagggugguuuauaauucgggauuccauagagcuuuccuugcaccaugagcauagacuucagucuaagggcauucauguauguauauuuacuggacaucugcuuccaaagaccaggcacuaaggagaccaaaggaaguaggagacgggagaaagaagaaaucccaagacaacguauaaacauggcagcacagugcaguacacacuguuuacaucaaaugcuaaggaacuuuagcauaagggacagaugaacaacaugaggaagggugggcugaggaggcugcuggcaggugcccuuuuacccacaauuauaugggggaggguucuuggaaagcuggaauuaacuauggaggacagacauuaauguccuuaugggaaggcuagucuaccaaggguucuaccuugggucaacuuuagggucucuggacauacagcuccucugucucuuaauacauaugaaaauaacaggauuucaaggcuccuuguccucuucaucuggucaucucuuaccugcccugauuacgucucaccacaauuaucuuuucuauauguaaugcuuuccauauuuuaacccacacaacgcaauguaauguuuuagcaaacucucuccaguuugguuccacguauaugugucuugccucuccacuuacauucuaugaccuuguuggcaaaaacaauuuuucucucaggagucaaagugcaagacaaagggaggccuacagcaggagugcaauggacacugaggcuugauaugcuaucuccauuuguaaaaggauaaaauauagaucuguccacccaccuccuauccuccccuauccccuuuacuugccauacacugccaaucccagaaaaaaaccugaaauggaauaguuugagagcaagaauuaugaaaguaauuaacacugccuuuauacguuuucuccucaccuggcuacugggcacuacgcaacccuugagggaaccauuuacaacucagccacuaacgacuuguacauuuaugacaacaaauaucucauucuaacaaaucagcauauuucaacagauuuuggaaaaacagaaggcaaguguuguaagaggugccauuuauaauugcauauggaugaugggggcccuacuacucuucaauaaugggaagaacuuaaaauggcaaaucuuauuauaaaaguuauuuuuugcacauucuauaagccauaguuucuaaaugugagaaugugacuaugguuaugaugucuaucauuuauggacccaugaauaaaauaaagcagcagcaaaaagaggagaaacuaucuaguccaaaagcaaggaacggacucuaaagaacuggccagaacagacuaggucaccuacaacacagguggcuccaaagccagccaccaaaguccacucuccagcucuguccuuuaccaaccaggaugaauggguauguuauguaucucuugaagccucaguuuccugucucuauauugaagauauuaauauagugcaaauuagugauaauauaugcaaaacuucuggccuguguuagguauucaacaaacagaagcuguuauuaucagcugugguucuacccuuggcaucauuuccauucuauuuguguucucuaaaaugauucuuacugucaaaauagauuauccugaaaaggagggaggggcaaaaaauuuuuucaugugguuaaaaaauguaacuaaaauacuagguaaaaaugacaugauggcuacaaaaagauguuucauaggaaaaguaaaauaugcuaacauucuuaguauauuuuaacaaagagauaugaauaaaccuucacauuuugcuaaaaacuucauuuaagaauguacauuaaccuuuacauugaucacugaaagaacaaauauagaacacuaucuuccaaauugauugagaaauagaagacacaaauuaaguuaucugucuauucaauauaagguaggaaaacgggaaauaaaaagaaaaaaugcaugcaaacacaaaaugcaaaagaugauggcaggaauaaauauaaaugugcuguuaauuaagguaaauguaaauguaaacuuaucuacuaaaaaaaaaagacucucaggcugggcaugguggcucaugccuguaauuccagaacuuugggaggccaaggcaggcggaucaccugaugucaggaguucaggaccaaccuggccaacauggcaaaaccccaucucuacuaaaaacacaaaaauuagccaggcaugguggugcgcaccuguagucccaccuacuugggaggcugaggcaggagaacugcuuaaaccugagagacggagauugcagugagcugagauccugccacuguacuccagccugggcaacagagcagcaagacugucucaaaauaaauaaacaaacaucauuaauaagggacaaaggagauguuauuacuaacagaagaaaccauccaaaaagauacuuuaucauaaagcucuguaagaagaaaccauccaaaaagauaauuuaacaaucaugaagcucuauaaccauaaaaacacaguaucaaaauauauaaagcaaaaccugaagaguauggguauaaaugggaaaacuuauaauccuaaugggagauuuuuaauacaucuaaguaacugauacaucaagcagauaaaaaaggauaugaauguuucaaauaauauuauuaaucuugaucaaaugaaacauuuaguaccuuucauccaauaaaaagaauagaaacauucauuuuuaagacaacauaacacauuuaaaaagaaaacuaauaauauuagguaauacaagccuucucaacaauuuuaaaaacaauaauacaggcuacauucucuaaccacagcauaauuauaaaucaauugcaaaaaauauggaaaacacuuaaaaaauuuaaaaaccauaaaauuucuuaaaaauuuguuuagaagcccaagguggguggaucacgaggucaggagauuaagaccauccuggcuaacacggugaaaccccaucucuacuuuaaaaaaaaaaaaaauuguuuagaagcucaaaauccuuauauacacaauuuguuucauccauaaauuuaaagagaacaccauaucugcacugcacaugagcaauguaaaauguuucaacucgguagcuacuauaccaaucucuuacuugaaaauuacugggaugauggaggaaagacagcauuuuuuauuuccugcuuuaaagaaucaaucaucuauaguucagaggaagcaaauagcucuaauugaagagaaaaagcucuucuuuauagaaaaaugccacuuauaggcugggugucauggcucacaccuguaauccuaaugcuuugggaggcuaaggugggaggaucacuugagaccaggaguucaaaaccagccugggcaacauagugagacccugucucuacaaaagaauaauaaaauuagccaggcaugguggcaugagccuguggucccagcuacccgggaggcugaggcagaaggaugguuugggugugggagguccgggcugcagugagcugugauugugccacugcacuguagccugggugacaaagcgugaccguuucaaaaauaaauaaauaaauaauuuaaaaauuuuuaaaagaaaaaugccaauuagaaaugucuagaaauuaccccugcaguuuccuggcccauaguuucaguuauccacagucaacuacagucuggaaauauuaagugaaaaauuccagaaauaaacaauucauaagcuuuaaaucgcgcacuguucugaguaauaugacaaaaucucgcaccauccuucucugucucagguagaacaugaauccucccucuucccagcguauccacacuauauaugcuacccaccuguuagucacauaggagcccucaguuaccagauucacugucaugguaucucaguacuugugugcaagucacccuuauuuuaccuaauaauggccccaaggcagaaaaguaggaugcugacacuucagauaggucaaagagaagcucaaagugcuuccuuuaagugaaaaggugaccuuggcauucuuuggguagggugugguacuaucaugguuucaggcauguuugggggacaggcuguugaacacagcccccauggauaagcagagacuacuauagauggaaugacagaauaagaaaacugucauuuugcaaucuuucaugaaauuacugaugaugauuauacaucagaguuuugauaauaaauaaaagguugauggacaauuggcuaucuguaugaugccaaaguaacaccacgaagauuacuuuuuaguugcaagaacugaaaaaauauaaacuuuacauuggaggaucagggugucaccauucuaacccaauaauuaaucguaacaucauaaaugauggaacaaacaccuauuauguaucuccuaaugagauacaauguaauguuuaacuggaaucuaaucaaauuuuacaagaaauacagaggauagaaagaaaagcuaaggaacaucacaagaaagcaaucaaauccauaaauauauguccauaagauaauaaauaaaaguugguaugucuuccaauggaauccuauaugauagcuaaaugaauuggauuuguauacagaacaucaauuuaacucucagaaauaaaacguugaguauaaacaaguuacauaaugauauauguauaaauuaucauuuauaaaaauucuaaaacuacacacaagaagugaugaaccuuuagaagcaacuacguauaaauaaugauuuuuuucuaaugggacuacaggaaaacauaccacaccuaucagcaggaagaaugaaaggaacaugugguuaaagggggaaaaaaacacuggucauaaauacuguacuguaauuaacagcugcuaauucagggcgauggaaauauagguguucucuaauauuuacaguuuucuuuguauauuaaguuuauuaaaacaaacaggaaaaaagcauaauaaaaaugcuuuggauaucagagccaauccacccuaaaucuugacugcaacaaugacuaguuguaugaccuuaggcauguuaguuaccuucucaaaaguuucauuuuucuuuuuuuuuuuuuuuuuuuuugagauggagucucgcucugucgcccaggcuggagugcaguggugcaaucucggcucacugcgccucccggguucacaccauucuccugccucagccgccugaguagcugggacuacaggugcuccaccacgcccggcuaauuuuuuguauuuuuaguagacaugggguuucaccauguuagccaggauggucucgaucuccugaccuugugauccacccgccucggccucccaaagugcugggauuacagacgugagccaccgcaccaggccaaaaguuucauuuuucagcuauaaaucaggcaucacaaaacuaauuauugugagguuuaauggaaagaacuuggauuaaccagucagcacagggccugguccaggaccaagagcacuuaaugguuucugaauauucccaacauaaagaaaugauaaauuuuugagguuauagauauccugaauuucugauuugaccauuacacauuuaugcauguaucaaaauaucacauguacuuuauaaauauguacacuuaucaaucaauaaaaauauuuuuaaaacgauacucaggcauguagauaaauaagggcucaauugaaguggccucuguguucauagcauguguguaucauagaaaucaaacuggccagagaucucggauuggcucauuuccugauagugagagcacagggcagcuggccugccuccuuaggacagcugagcagugggcuacaaggaccccgacacuguucuaaaucccaugucccaggggagggacggagagaagaaucaacaauauugacgaauagaaaacaauaugaaaagccccaacagggaaguacacuauuauuuuauuacugacuucuuaaaugccacacaucacugucaagaaagaaauuauaacuuaaaaauaauuuccauuuucuaaaagauaaacuuguggccaggcacugugguucacaccuauaaucccaggacuuuaggaggcuaaggcgggaggaucgcuggaggccaggaguucaagaccaaccugagggaacagugagaccccauagauaaaaaaaaaaaauuuuaagauaaacuugugcuuauauuaacuacauaugaauuugccaacuauaagcaauuuccauuaagcaaacaguaucuuaucuaucccaccaacuuagugcaaugcugggugaacagcaagccaccaguaauuacuuguugauuuagggguugaucugcagcagcugaaaaaacaucucaaauacuagaaaagcucagaaaaccuccaaagauaaaaaagguuaucaguuuccaguguuguaagugguagagacaaacucaaacaagacuccagaucucacauucuuggcugcuagaucccagggagugugcugccugcucacuaugcuuccuaugcuaaggagcucuucugaccagagcugcuuugaguuuuaauuucuugcaaccauugaacuuugauauaaacaguauggcagcaucacagccuuaucauuuucacaaggaagacucaaaauuccuacccuuaaaaccugaaauacaaauuuuuaacaagaacaguaacuaauuguucaugcagauauacaccuuuuuauuuaacaccaaaaacauacuggacgucacuagaaaauaaauggagguaucaguguuuaaaugcaaagauuccaggaaaacagacaaacagagauacuacaauggcacaauuauuuaagccaaaauaaccugaaacucuuuccuggggugcaaaaauguuggcuauuuccugcaaaaagaaaucaaauguaauuauuuaaaaaguaauuauucuaauuucaaauguaauauauguucauuagagaaaauuuagggaaugccagaagagcacagagacaauaaaagcuuaaaaauaacaauauuaacauuaaaaaaaaauuuagagaugugucuugcuauguuucccaggcuggacagcaguggccauucacaggcacaauuauuuugcacugcagacucaaacuccuggccucaagugauccaccccaguagccaggaccacaggcauuugccacaaugccgggcaacaacguucacauuuuuuaugaagaucugucaagucuucuggcuccauggguuuauauaagccccucuuucaucugcuacaacuacucccucccaauccuauuucaaccacaauggcuuccguucuuuuuuauucuuuuaaucuuuuaauuaaaaaauauauaaauauauagagaugggggucuugcuauguuacccaagcuggucucgaacuccuggacucaagcaauccucccaccgcagccucccaaagugcuggcauuauagaugugggccaccaaacccggccugacucccauucuuaucccugaauaugucaacuauuuuccucucuugcagagccugcacuuacucugccccuccaaccaaaaagcugguuguuggaaaggcuggcuccuucucaugccucacaucucagcacagugucacuuaggagaguccuucccugaccccuuaucucaaguaguucccccagcacuuauuuucuaucacaucccucauuauucccuuccauaaaguauaugaaugugcuuugguuaaggaauaggcuaaggcgaauaucugggccaaagugacuuagcaaguuuagggcacaggugcauacuucacuuguuagauaaccugucuuuguaaguuuauacuuggcuuugaguugcuauuguuuguaaaagguauaacugcccugcugaugcugcccaugggguuuggguuggcuugacauggcuuggaggugcacuaaugcccagagagaguaaugcuacugaccccuguaaggaagaguggauugccuugaaggcgggaaguggggacuuaugcccagagggaaaaaauuaagcugcuaacccugguaguauaggccagggagugcagcugcaaggcugggggcagcaggagcaggcucauaagaggagccacaaagcugaagcaaacagccaagauaaagaaacugugagaaacaguuagugugaggaagcugcugauuaaaaagcugcugaauaaaacuacauuucaccugccuaaagccccccgaguguucuuucagcaauucgcccauccacccacuccccucggaccucaacugggacucaaaccuaacaccuuguuggaccucagcugggacuuaaaccuaacaccuucucagcauuuaacccugucuagacuuuuaaaaaucuauuucuauuuguuuauugucuauucccuucaaaagaauauaagauuggagagagggaaaaccugaccccacuuauucacugcuauauguccagugucuaacacauaguaggcucucuguaauauuugcauacuuugcaaaugauuugguaauguacuuuuauccacuuaguaaauauuccuaagaauaagcugaauccaaaaguaaccugaauuuguugauuauguuuuucuucagcugucuucuaauaacaaaaccuuauuguaauaggcuaugcugauucugaucaugugcauuuuaaaagguccaaaaaaacaagaaacaaauuucaguuaaauuuuagguccaagcacgcuagagucaggaucauccauaugcuaacuauuauagauaauuaccaaacuacugucaguuuugcaacauucuaacuuuucuucuacauaaaauacugcaaagggaguggaaaucuuaauugccuaaaaaaagguccugugcauauuaaguuuaauucaaaucaucauuacaccaaucauguauauuccuuauaaagggaaaauaacuaucaauucacaucuuugagggaaauucccccacuacccuuucaaacuaaacacauuaacucauaaagcaauauaaaacucuaccauucaauuagacuugucaauuaaacaucuaauuauuuucacaacucacugcugcuuuguguuugaggcccuccccugauuauauuagaaauaaacacaaccagugccaucugaccacuacuuuuucuuccccucuucuuuaacccagugguucucacuuugcggcacauuauaaucuccuggagaacuugaaaaauacuggaagccaagcgggaucccaggccaacuaaaucagaguuucagaggguggcagggcucagguggcaguaauuuuaguauacgugcugccaaagcgagcaccagguggcaguauuuuuaaagcucccaggugauuugaaugugaugccuagacccucaccacucaaagugcaugggcaccaccuaggaguguauuaggaauacaaagccccaggccccacccuagaccuagugaaucagaaacauuuuuaacagguggcuuguggacauacugaaguuugagaagcaaugaaauccacuugagcaaauuacucaaccuuuuuaagcuucaguuaccuuaucuguaaaaugggagcaauaauaccuucuuugcggguuuauugccagagcuacaugaaauaauacgcgcuaaacaucuaggauggggcuggcacacaguaagggcuaaguagaugguauugcuguuauuauuagaguccacacuauaugcuuccucuacauauauuauuugucuacauuuccuuuacaaaccuugcuccuaacucccaaaugugucuuacauggcaugacaugcucuguaauacaauuaaacaugcaaauaaaucuuaguggauccaccuucuccuuccaaaucaguaagucuucuccuagaguccaagguuucuguuuuccuagaaucucccagugccugauguucugcuauccugcaaauacgagccccaaagaacuacugguagagguccacaaagccaaacgcacauuucuggguuccgccucugcacaugugcuccccucuccugggauccuucuuucugccccauggucuuucuacaacugaacaucauuuuuucugggaaccacucacacugucaaaagucucaccauaggcacuuguagcagcuggaggagagcugcaaaauacaagaaauuuuuccagcuguagugcgugugauauucaaguggugucaggcuacuuugaggauugugcauauuugauaugguuuacauuuuucuccuuacuuuggagcauacagcuggacauauaauaggaagugaaauuuuauuuacugaaugaaugaauagcaauugguauaucugcuuaauuugauaacacuuaaaaaugaaauaugcuuuacucugucaggguaaauaggcucacauuaaaaagaaccugcuuucuacucuauccaauuucuucauacuccccucucuccaaaauuuuagcaauaguccuugcuugguccuggcacuguaguaaguauguuuuauauuuccauucguuugaugacugccgcaaucuuaugaaguaggcaccaauauuauaacauuuaucuuucaguuaaccagcuugaaauuuggacaccuguucaggagucagggugucagagccugcaaagcagcacuaaaaacucagguauauucaccaccccaaguggagucuguagccacugcacuacaaaagcuucccuccugccuuguuuuauccuauuggccugguaucuucauacuuucacagugcagcaccucuguucuucuucagaggugaagaguugucagagcucaacgagaaacuuuuggccgggcaugguggcucaugccuguaaucccagcacuuugggaggccaaggcuggcagacugcuugaggucaggaguucaagagcagccuggcaacauggugaaaccucaucucuacuaaaaacacaaaaauuagccaggcauacuggugcaugccuguaaugccagcuauucgaguggcuaaaccaggaacuuuaaagaaagggaaguuuaguccaauuuccaugcaaaucaugcucacccaguuuucaacaaguccucuccaacaaguucacuuuuuggcaauggagaaauuccugaagggacuaauguuaaugcaucuguauuccaaauaacccugaauaaguugcugagacucuguaaacauuagugaacacuuaugacacaaacacaaugaccaucaggagcuagaagagauucacugagaaugcucuguuugacuauccuaagccccauuuucaauaggguucuucaauagaagaucaagguaacucgcagguaacaccuaagaaucaagcuucucuguaaagagagcuggacacuuaaaguccuucugaacaaaaugggaaaaugugaguaauaauaguagcuagauggcuuaaaaauuggcugauccaucauagccaguguauuuuucaugcagucauuuguucaagaaacauuucuugggcuugugcuggacucugggaauaguguuccacaaaagugccagagacuuguccuccugcugauguucuaagguugacuggagcaucuuugucaaacuggggaaaaaaaucacaggccuaucuuuagccuuuucucauuucauauuucuaauuaaagaacgugggcuuauucaauuuuguaggcaggaaaaaaaaugacaaauucauuaaaagauguaauuacaauccaaaagguuuuaacaggugagaaaaagcuaaagacagcaagaugaaauuugaugggaacacauuuauuguccuaugucagaguucgaaaaaccagcugcacaagggcaggauggggggccauuuuaacagcagccuaaacagaccuuacaguuuagcugaguaugaguccaauaugauaaaagguggugaaguaaaggaauaacugggcagucaggaaacaaggauucuaguucuggcagggaggccaagucauugaauuugaggaguuauuucucaacagaauuuuaggacauugggcuaggauaccucucaggcaccaucuggcccuaccagcagagggaugauguucauucuugcacacuguguccccagcaccuagcauagugccuggcacauaggaagcacucccaaguacuugugaaugaauggcagugcuaacagaaacucuacaagugaauacuagauugugucccccuucucuaacacacacacacacacacacaccccuaauacacuccuagguucaagaaacuggaaaagcaucugggcaaagggggucauaauuccauagccccauaugaguuccauuuugaaagggucacuaacaaguuagaagaggguaacucauuuggugaaggguuuaucaucucccauaaggauugcaugacauguggcugaaggaucuggggauguucuguucuggagacaagaaaagcuuagaagugccaugguagauacuuucaaauuauuuugaauaauaaaauauguaaguaucacuccagaaggcaaaugagaaaccaaagauaguguuauucuaacaaacgucgaaggucccuucuaacuacaagguuccacaacuuuguuauugauguuuaaaauguaguucauagaaaagguuucauuuuggcauauuuuaaauuguucaauuuuuaagaaugaauuugaaguauuuacugaguuuaagaaaaaagcccaccucgagcaccacucucuguaguugucacacaguuuuagguagacagugaguauaaauaccuauacucauuaccauuucccaauucugcccuugaaacucugcugguuguagcaccaccacccucagguaucuucuaagauguaugggagaaugucuuucauuaaagcuucauuaaaagggaagccugcugcuucauucagugugcugagguauaagacaucugaguuuuuaaagacacauguaaguaagacauauuauauauacuguuauacaaacuacuuucuuguaggcaaaacaaucccuguauaugggaaucucugauagacuucuggguuguggcaugcagaaucuuuuagggauuucuggguuugggcugagaaaaaugaggagcaaacaaaagcagcaggacuuuagaaggaaaauuuagccgcaauuuucuuuuugcuucugcccuaucugcauauuccaauaagaacauaaaaaucacucuuaauaauuugcaauacauguuaggauuuuuagcagggcuguuuuuuuuuuuaaaggcauagugaacuucugggcacuauacaaguuuauagugcuucuaacuacaaauuacaaagcacauuucaugacacuguaaaaucuguguuaacaucaaucccauuuuccagggaacagugcagcccagguagaggaagacauggaauccaaacucaagcccuucaacuccaaaugccaagcuccuucugccagggcacagugccccaggagagaccaaccucacaucuaaucucacagccuccugagauuccugggcagggagcaaagaaugcagcagaagcagacacaccuuuacacucggggugaguagucggagagcaccacgugauagagcagccagcgggaagagccaacaggucaaccggguccagggagcuaagaaaacuggagcagagcaaagaucacaaagucaggcagaacagcagcaagacugcccugaaagcugggcuuucugugucuguuuuguuacaaagagcuuuauccacuggaggaagaguaucggggagcugcugcaguuaacauuucuucccauuacuacccuaaauugagaauauuacagcucuuuacuauucuucuuaguuaagccaucaauuaccuuugcuuuagucaucugaggguauuucauuccuucauucaguguucuggaccuguguuagagguuggggcagcaguggggaagcagacagacaagcccuguccucaaguugccgacacucaaugcagagcgugguggaagacucacaacgacacauuucacaccaaacaucaugagugaggcccaccuagagaacaugggggaggcuuuccagcucaaauguuucuaaacuagugaccaaaauccacagcagggaacugaguuugcacucucagaauguguuagugcccaauagaggcauaaauuuagagccuguuaucaguauggagaagggaacuauuuaauacuaagagauaaaacuggacgguaauuuuuuaucuuagaaagugcguaacuccauucucaacgacaaagucuguaaccaaaauagcagccaaauacaauuccagauaugagauaugguuugagcccuaugacaugcugcaggaauagguggcugcaggcuugugaaauguuuuaacaggaggacuuguguauucuaacuuuuaugagacuauucaaaaugcacagcuugaguuuagcagaaauccauguucuaucccagaagcgggcaaacuuuuuuccccauaaaaggcagauaguaaauaucuucuuugagggcccuagggucugucucagcuacuccauucugcuuuugcauagaaagugguaacuccauucuugaaaacaaacucuggaaacaaaauagcuaaauauaguuccagauaacagacacagaaagagaagcaacagacaaugagauccuaccuaccuaccuguguucagagucagaaauacauggggugggaaaccgauaaccuacucuagcuuucuuuuaguuccuuaaugucucagagauucaaggagugcagguuaucuccccagccaaaucucccaaccuuccagcacuuggggcccuacccuacagauguucuguggcuucaucuuccuuccccaugcugaugcgcccccuacaaacugccguauuucuagcucauccucucaucuuccccuagccucuaauucacaauaugccaaaaggacugguaacaaaagcaaaucaguauuuauaauauacaauuuuuuauuaguauaaaagcauuguccauagucccaagagagauguuugccaaacagccugcuguuaaaugaacuguaacuuuugaauguaucuguugugcaaggucauuaagaguauccuguuugaucccacgugcuugaccccauccauguggcuaucuaccacacagugggaguuuaccccauagcgagcaaccaugauccauccuguuaaaagcuucuuuggucuggacaugauauaguugugaaagggacaaagacauuucccaaaagaggguucuaccugcaucauccaaugguggauggaacaaagcuggaggcugggcacaagaagaagagacaucauccauccaaaggggaaagagaaaaaguacucaauggagcauuuucuuaggcauaaagggaauugagucagaacuugaaguugaauaugacccaccaaauuaacuuuuuauaguuauuggguuuuccugaagaaccaugguauuuuaauaauucaauuuuuuagaaaauauauauauuauuagagccgggugagguggcacacaccugaaguccucgcuacucugcaggcuuagguaggaggaucauuugagcccagggguuccaguccagccugggaaacauaaaguggccuugucucuauuuuucaagcaagaaaaaagaaaaaaauauauuauccaaaauggcuuaguagagcuucacucuugaauuucuucaaauccucugaugaaagaaucguacuagaauauacaacaaacuucguggcugcaucaacgauacuuaaaaccuuguaaagggcauuauuaugggcauuuuuaaccaauuaggauaauuuauaaguuaaaaguagaugaacuuaccuguggaauuccagaugaaauuaaagcuuaaguuuuuuguuguuuucuguauuccaugcuuaauuaaaacacucagaucuguugugaacuacugaacagaagaacagaaaaaaauauauaugagucauaacauuaggaauuaugacaucuaaaaucaauguuguauacuuagcaaguuguuuuuggagccauuuauuacauaucaacacuuuuuucauuuuuggaaaagccuugauccucucuucucgcuuucaaaucaccucaugcucuaaucugaaauuauacuuggacacuguuuuuuuguuuuuuguuuguuuuggagauggagucucacucuguugcccaggcuggagugcaauggcacaaucucggcucacugcaaccucugccucccggguucgagcaauucuccugccucagccccccgaggaacugggauuucaggugugugccaccacacccagcuaauuuuguauauuuaguagagacgggguuucaccacguuggccaagccgaucucgaacucccgaccugaggugaucugcccgccucggccucccaaagugcuggaauuacuggcgugagccaccgcgcccggccuggaugcuguuuugacaacaguguuuauuuucaggucuggaguuauccaauggccauucauuugaacgaacauuuuagucuaugaggggaaaaaagucauagucucuuaucuguuaguaauaaacgauucuguucuccagacugauacgcguucaguaauuugugcuuuuaucaggcaucgacacaugcauacuaagagcacaaauucagcgcccuucuuuugcuuaagccuccugggagaagcuaaaaaacuuguucccaguugaacacugcaaacccaaauuuuccuuaccucugaaaacagaaaaaaagacaugguuuggcaauuucuuccuugauagcuuuucccacaacgcagccaccuccuaaacgcaggcaaucugugcaaaacgcagaggaaacaaaaucaugaaagcccugcaaaucucccuccuaaauccaacauuaagaaggcgaacggauacugaauucaaagacuacccguacuugaggauggcaucauuccuuacugcuuggaaaagugagacuccguugcaccucuaggaaucuuuuuaaaacgcccuguauguuccuuaacacugccuguaggaauccuguagcccuagccccgugggauuuccuucucucuccgcccguucuccacauuccccacuuaguuucacauuccuucccaaucccuccgacaucccugcgccggggcccuucccuagcgcuccgggaaagcguucgccgcaggccuguuaggggcccaccaauaccguaacaccguucccguccucuuccucggcaccgcugcaaacgccccgggucgcuacccggauuugacgguggcuggagcggcacgggcgacgcaaggcagguauugcacccuggggcaaggcaagguggacaaccagcggaugcggcgcggccgcggccugggccugggcccuccgcgucgcccacugccccacugggccccuucucccgcgcucaccggaggcgggcagcugcucgucaccgagacccgagacccacggugcggcggcucaaccugggccacgcuccgcucuagaggagugggcggugccucccggccuagcugccggggucuaggcguuuccgaggacggcgcguuccgggaaaggcggguccgguggcuauacccuccacccaguggcaggacucaaccgccucggagacccugcagggccgcccuucucacucaccuccugugcucggcgcgcacccagcucggaagcgggaagguggccggcguucucucccugcgcacacacgcagccuccccgcauccgcacgcacggccgggcgcgcgcagaccacgcgccagggccgcggccggaagc

SEQ ID NO: 191298 - RNA, 21490 nt, Homo sapiens
gcuuccggccgcggcccuggcgcguggucugcgcgcgcccggccgugcgugcggaugcggggaggcugcgugugugcgcagggagagaacgccggccaccuucccgcuuccgagcugggugcgcgccgagcacaggaggugagugagaagggcggcccugcagggucuccgaggcgguugaguccugccacuggguggaggguauagccaccggacccgccuuucccggaacgcgccguccucggaaacgccuagaccccggcagcuaggccgggaggcaccgcccacuccucuagagcggagcguggcccagguugagccgccgcaccgugggucucgggucucggugacgagcagcugcccgccuccggugagcgcgggagaaggggcccaguggggcagugggcgacgcggagggcccaggcccaggccgcggccgcgccgcauccgcugguuguccaccuugccuugccccagggugcaauaccugccuugcgucgcccgugccgcuccagccaccgucaaauccggguagcgacccggggcguuugcagcggugccgaggaagaggacgggaacgguguuacgguauuggugggccccuaacaggccugcggcgaacgcuuucccggagcgcuagggaagggccccggcgcagggaugucggagggauugggaaggaaugugaaacuaaguggggaauguggagaacgggcggagagagaaggaaaucccacggggcuagggcuacaggauuccuacaggcaguguuaaggaacauacagggcguuuuaaaaagauuccuagaggugcaacggagucucacuuuuccaagcaguaaggaaugaugccauccucaaguacggguagucuuugaauucaguauccguucgccuucuuaauguuggauuuaggagggagauuugcagggcuuucaugauuuuguuuccucugcguuuugcacagauugccugcguuuaggagguggcugcguugugggaaaagcuaucaaggaagaaauugccaaaccaugucuuuuuuucuguuuucagagguaaggaaaauuuggguuugcaguguucaacugggaacaaguuuuuuagcuucucccaggaggcuuaagcaaaagaagggcgcugaauuugugcucuuaguaugcaugugucgaugccugauaaaagcacaaauuacugaacgcguaucagucuggagaacagaaucguuuauuacuaacagauaagagacuaugacuuuuuuccccucauagacuaaaauguucguucaaaugaauggccauuggauaacuccagaccugaaaauaaacacuguugucaaaacagcauccaggccgggcgcgguggcucacgccaguaauuccagcacuuugggaggccgaggcgggcagaucaccucaggucgggaguucgagaucggcuuggccaacguggugaaaccccgucucuacuaaauauacaaaauuagcugggugugguggcacacaccugaaaucccaguuccucggggggcugaggcaggagaauugcucgaacccgggaggcagagguugcagugagccgagauugugccauugcacuccagccugggcaacagagugagacuccaucuccaaaacaaacaaaaaacaaaaaaacaguguccaaguauaauuucagauuagagcaugaggugauuugaaagcgagaagagaggaucaaggcuuuuccaaaaaugaaaaaaguguugauauguaauaaauggcuccaaaaacaacuugcuaaguauacaacauugauuuuagaugucauaauuccuaauguuaugacucauauauauuuuuuucuguucuucuguucaguaguucacaacagaucugaguguuuuaauuaagcauggaauacagaaaacaacaaaaaacuuaagcuuuaauuucaucuggaauuccacagguaaguucaucuacuuuuaacuuauaaauuauccuaauugguuaaaaaugcccauaauaaugcccuuuacaagguuuuaaguaucguugaugcagccacgaaguuuguuguauauucuaguacgauucuuucaucagaggauuugaagaaauucaagagugaagcucuacuaagccauuuuggauaauauauuuuuuucuuuuuucuugcuugaaaaauagagacaaggccacuuuauguuucccaggcuggacuggaaccccugggcucaaaugauccuccuaccuaagccugcagaguagcgaggacuucaggugugugccaccucacccggcucuaauaauauauauauuuucuaaaaaauugaauuauuaaaauaccaugguucuucaggaaaacccaauaacuauaaaaaguuaauuuggugggucauauucaacuucaaguucugacucaauucccuuuaugccuaagaaaaugcuccauugaguacuuuuucucuuuccccuuuggauggaugaugucucuucuucuugugcccagccuccagcuuuguuccauccaccauuggaugaugcagguagaacccucuuuugggaaaugucuuugucccuuucacaacuauaucauguccagaccaaagaagcuuuuaacaggauggaucaugguugcucgcuaugggguaaacucccacugugugguagauagccacauggauggggucaagcacgugggaucaaacaggauacucuuaaugaccuugcacaacagauacauucaaaaguuacaguucauuuaacagcaggcuguuuggcaaacaucucucuugggacuauggacaaugcuuuuauacuaauaaaaaauuguauauuauaaauacugauuugcuuuuguuaccaguccuuuuggcauauugugaauuagaggcuaggggaagaugagaggaugagcuagaaauacggcaguuuguagggggcgcaucagcauggggaaggaagaugaagccacagaacaucuguaggguagggccccaagugcuggaagguugggagauuuggcuggggagauaaccugcacuccuugaaucucugagacauuaaggaacuaaaagaaagcuagaguagguuaucgguuucccaccccauguauuucugacucugaacacagguagguagguaggaucucauugucuguugcuucucuuucugugucuguuaucuggaacuauauuuagcuauuuuguuuccagaguuuguuuucaagaauggaguuaccacuuucuaugcaaaagcagaauggaguagcugagacagacccuagggcccucaaagaagauauuuacuaucugccuuuuauggggaaaaaaguuugcccgcuucugggauagaacauggauuucugcuaaacucaagcugugcauuuugaauagucucauaaaaguuagaauacacaaguccuccuguuaaaacauuucacaagccugcagccaccuauuccugcagcaugucauagggcucaaaccauaucucauaucuggaauuguauuuggcugcuauuuugguuacagacuuugucguugagaauggaguuacgcacuuucuaagauaaaaaauuaccguccaguuuuaucucuuaguauuaaauaguucccuucuccauacugauaacaggcucuaaauuuaugccucuauugggcacuaacacauucugagagugcaaacucaguucccugcuguggauuuuggucacuaguuuagaaacauuugagcuggaaagccucccccauguucucuaggugggccucacucaugauguuuggugugaaaugugucguugugagucuuccaccacgcucugcauugagugucggcaacuugaggacagggcuugucugucugcuuccccacugcugccccaaccucuaacacagguccagaacacugaaugaaggaaugaaauacccucagaugacuaaagcaaagguaauugauggcuuaacuaagaagaauaguaaagagcuguaauauucucaauuuaggguaguaaugggaagaaauguuaacugcagcagcuccccgauacucuuccuccaguggauaaagcucuuuguaacaaaacagacacagaaagcccagcuuucagggcagucuugcugcuguucugccugacuuugugaucuuugcucugcuccaguuuucuuagcucccuggacccgguugaccuguuggcucuucccgcuggcugcucuaucacguggugcucuccgacuacucaccccgaguguaaaggugugucugcuucugcugcauucuuugcucccugcccaggaaucucaggaggcugugagauuagaugugagguuggucucuccuggggcacugugcccuggcagaaggagcuuggcauuuggaguugaagggcuugaguuuggauuccaugucuuccucuaccugggcugcacuguucccuggaaaaugggauugauguuaacacagauuuuacagugucaugaaaugugcuuuguaauuuguaguuagaagcacuauaaacuuguauagugcccagaaguucacuaugccuuuaaaaaaaaaaacagcccugcuaaaaauccuaacauguauugcaaauuauuaagagugauuuuuauguucuuauuggaauaugcagauagggcagaagcaaaaagaaaauugcggcuaaauuuuccuucuaaaguccugcugcuuuuguuugcuccucauuuuucucagcccaaacccagaaaucccuaaaagauucugcaugccacaacccagaagucuaucagagauucccauauacagggauuguuuugccuacaagaaaguaguuuguauaacaguauauauaauaugucuuacuuacaugugucuuuaaaaacucagaugucuuauaccucagcacacugaaugaagcagcaggcuucccuuuuaaugaagcuuuaaugaaagacauucucccauacaucuuagaagauaccugagggugguggugcuacaaccagcagaguuucaagggcagaauugggaaaugguaaugaguauagguauuuauacucacugucuaccuaaaacugugugacaacuacagagaguggugcucgaggugggcuuuuuucuuaaacucaguaaauacuucaaauucauucuuaaaaauugaacaauuuaaaauaugccaaaaugaaaccuuuucuaugaacuacauuuuaaacaucaauaacaaaguuguggaaccuuguaguuagaagggaccuucgacguuuguuagaauaacacuaucuuugguuucucauuugccuucuggagugauacuuacauauuuuauuauucaaaauaauuugaaaguaucuaccauggcacuucuaagcuuuucuugucuccagaacagaacauccccagauccuucagccacaugucaugcaauccuuaugggagaugauaaacccuucaccaaaugaguuacccucuucuaacuuguuagugacccuuucaaaauggaacucauauggggcuauggaauuaugacccccuuugcccagaugcuuuuccaguuucuugaaccuaggaguguauuagggguguguguguguguguguguguuagagaagggggacacaaucuaguauucacuuguagaguuucuguuagcacugccauucauucacaaguacuugggagugcuuccuaugugccaggcacuaugcuaggugcuggggacacagugugcaagaaugaacaucaucccucugcugguagggccagauggugccugagagguauccuagcccaauguccuaaaauucuguugagaaauaacuccucaaauucaaugacuuggccucccugccagaacuagaauccuuguuuccugacugcccaguuauuccuuuacuucaccaccuuuuaucauauuggacucauacucagcuaaacuguaaggucuguuuaggcugcuguuaaaauggccccccauccugcccuugugcagcugguuuuucgaacucugacauaggacaauaaauguguucccaucaaauuucaucuugcugucuuuagcuuuuucucaccuguuaaaaccuuuuggauuguaauuacaucuuuuaaugaauuugucauuuuuuuuccugccuacaaaauugaauaagcccacguucuuuaauuagaaauaugaaaugagaaaaggcuaaagauaggccugugauuuuuuuccccaguuugacaaagaugcuccagucaaccuuagaacaucagcaggaggacaagucucuggcacuuuuguggaacacuauucccagaguccagcacaagcccaagaaauguuucuugaacaaaugacugcaugaaaaauacacuggcuaugauggaucagccaauuuuuaagccaucuagcuacuauuauuacucacauuuucccauuuuguucagaaggacuuuaaguguccagcucucuuuacagagaagcuugauucuuagguguuaccugcgaguuaccuugaucuucuauugaagaacccuauugaaaauggggcuuaggauagucaaacagagcauucucagugaaucucuucuagcuccugauggucauuguguuugugucauaaguguucacuaauguuuacagagucucagcaacuuauucaggguuauuuggaauacagaugcauuaacauuagucccuucaggaauuucuccauugccaaaaagugaacuuguuggagaggacuuguugaaaacugggugagcaugauuugcauggaaauuggacuaaacuucccuuucuuuaaaguuccugguuuagccacucgaauagcuggcauuacaggcaugcaccaguaugccuggcuaauuuuuguguuuuuaguagagaugagguuucaccauguugccaggcugcucuugaacuccugaccucaagcagucugccagccuuggccucccaaagugcugggauuacaggcaugagccaccaugcccggccaaaaguuucucguugagcucugacaacucuucaccucugaagaagaacagaggugcugcacugugaaaguaugaagauaccaggccaauaggauaaaacaaggcaggagggaagcuuuuguagugcaguggcuacagacuccacuugggguggugaauauaccugaguuuuuagugcugcuuugcaggcucugacacccugacuccugaacagguguccaaauuucaagcugguuaacugaaagauaaauguuauaauauuggugccuacuucauaagauugcggcagucaucaaacgaauggaaauauaaaacauacuuacuacagugccaggaccaagcaaggacuauugcuaaaauuuuggagagaggggaguaugaagaaauuggauagaguagaaagcagguucuuuuuaaugugagccuauuuacccugacagaguaaagcauauuucauuuuuaaguguuaucaaauuaagcagauauaccaauugcuauucauucauucaguaaauaaaauuucacuuccuauuauauguccagcuguaugcuccaaaguaaggagaaaaauguaaaccauaucaaauaugcacaauccucaaaguagccugacaccacuugaauaucacacgcacuacagcuggaaaaauuucuuguauuuugcagcucuccuccagcugcuacaagugccuauggugagacuuuugacagugugagugguucccagaaaaaaugauguucaguuguagaaagaccauggggcagaaagaaggaucccaggagaggggagcacaugugcagaggcggaacccagaaaugugcguuuggcuuuguggaccucuaccaguaguucuuuggggcucguauuugcaggauagcagaacaucaggcacugggagauucuaggaaaacagaaaccuuggacucuaggagaagacuuacugauuuggaaggagaagguggauccacuaagauuuauuugcauguuuaauuguauuacagagcaugucaugccauguaagacacauuugggaguuaggagcaagguuuguaaaggaaauguagacaaauaauauauguagaggaagcauauaguguggacucuaauaauaacagcaauaccaucuacuuagcccuuacugugugccagccccauccuagauguuuagcgcguauuauuucauguagcucuggcaauaaacccgcaaagaagguauuauugcucccauuuuacagauaagguaacugaagcuuaaaaagguugaguaauuugcucaaguggauuucauugcuucucaaacuucaguauguccacaagccaccuguuaaaaauguuucugauucacuaggucuaggguggggccuggggcuuuguauuccuaauacacuccuagguggugcccaugcacuuugaguggugagggucuaggcaucacauucaaaucaccugggagcuuuaaaaauacugccaccuggugcucgcuuuggcagcacguauacuaaaauuacugccaccugagcccugccacccucugaaacucugauuuaguuggccugggaucccgcuuggcuuccaguauuuuucaaguucuccaggagauuauaaugugccgcaaagugagaaccacuggguuaaagaagaggggaagaaaaaguaguggucagauggcacugguuguguuuauuucuaauauaaucaggggagggccucaaacacaaagcagcagugaguugugaaaauaauuagauguuuaauugacaagucuaauugaaugguagaguuuuauauugcuuuaugaguuaauguguuuaguuugaaaggguagugggggaauuucccucaaagaugugaauugauaguuauuuucccuuuauaaggaauauacaugauugguguaaugaugauuugaauuaaacuuaauaugcacaggaccuuuuuuuaggcaauuaagauuuccacucccuuugcaguauuuuauguagaagaaaaguuagaauguugcaaaacugacaguaguuugguaauuaucuauaauaguuagcauauggaugauccugacucuagcgugcuuggaccuaaaauuuaacugaaauuuguuucuuguuuuuuuggaccuuuuaaaaugcacaugaucagaaucagcauagccuauuacaauaagguuuuguuauuagaagacagcugaagaaaaacauaaucaacaaauucagguuacuuuuggauucagcuuauucuuaggaauauuuacuaaguggauaaaaguacauuaccaaaucauuugcaaaguaugcaaauauuacagagagccuacuauguguuagacacuggacauauagcagugaauaaguggggucagguuuucccucucuccaaucuuauauucuuuugaagggaauagacaauaaacaaauagaaauagauuuuuaaaagucuagacaggguuaaaugcugagaagguguuagguuuaagucccagcugagguccaacaagguguuagguuugagucccaguugagguccgaggggaguggguggaugggcgaauugcugaaagaacacucggggggcuuuaggcaggugaaauguaguuuuauucagcagcuuuuuaaucagcagcuuccucacacuaacuguuucucacaguuucuuuaucuuggcuguuugcuucagcuuuguggcuccucuuaugagccugcuccugcugcccccagccuugcagcugcacucccuggccuauacuaccaggguuagcagcuuaauuuuuucccucugggcauaaguccccacuucccgccuucaaggcaauccacucuuccuuacaggggucaguagcauuacucucucugggcauuagugcaccuccaagccaugucaagccaacccaaaccccaugggcagcaucagcagggcaguuauaccuuuuacaaacaauagcaacucaaagccaaguauaaacuuacaaagacagguuaucuaacaagugaaguaugcaccugugcccuaaacuugcuaagucacuuuggcccagauauucgccuuagccuauuccuuaaccaaagcacauucauauacuuuauggaagggaauaaugagggaugugauagaaaauaagugcugggggaacuacuugagauaaggggucagggaaggacucuccuaagugacacugugcugagaugugaggcaugagaaggagccagccuuuccaacaaccagcuuuuugguuggaggggcagaguaagugcaggcucugcaagagaggaaaauaguugacauauucagggauaagaaugggagucaggccggguuugguggcccacaucuauaaugccagcacuuugggaggcugcggugggaggauugcuugaguccaggaguucgagaccagcuuggguaacauagcaagacccccaucucuauauauuuauauauuuuuuaauuaaaagauuaaaagaauaaaaaagaacggaagccauugugguugaaauaggauugggagggaguaguuguagcagaugaaagaggggcuuauauaaacccauggagccagaagacuugacagaucuucauaaaaaaugugaacguuguugcccggcauuguggcaaaugccugugguccuggcuacugggguggaucacuugaggccaggaguuugagucugcagugcaaaauaauugugccugugaauggccacugcuguccagccugggaaacauagcaagacacaucucuaaauuuuuuuuuaauguuaauauuguuauuuuuaagcuuuuauugucucugugcucuucuggcauucccuaaauuuucucuaaugaacauauauuacauuugaaauuagaauaauuacuuuuuaaauaauuacauuugauuucuuuuugcaggaaauagccaacauuuuugcaccccaggaaagaguuucagguuauuuuggcuuaaauaauugugccauuguaguaucucuguuugucuguuuuccuggaaucuuugcauuuaaacacugauaccuccauuuauuuucuagugacguccaguauguuuuugguguuaaauaaaaagguguauaucugcaugaacaauuaguuacuguucuuguuaaaaauuuguauuucagguuuuaaggguaggaauuuugagucuuccuugugaaaaugauaaggcugugaugcugccauacuguuuauaucaaaguucaaugguugcaagaaauuaaaacucaaagcagcucuggucagaagagcuccuuagcauaggaagcauagugagcaggcagcacacucccugggaucuagcagccaagaaugugagaucuggagucuuguuugaguuugucucuaccacuuacaacacuggaaacugauaaccuuuuuuaucuuuggagguuuucugagcuuuucuaguauuugagauguuuuuucagcugcugcagaucaaccccuaaaucaacaaguaauuacugguggcuugcuguucacccagcauugcacuaaguuggugggauagauaagauacuguuugcuuaauggaaauugcuuauaguuggcaaauucauauguaguuaauauaagcacaaguuuaucuuaaaauuuuuuuuuuuuaucuauggggucucacuguucccucagguuggucuugaacuccuggccuccagcgauccucccgccuuagccuccuaaaguccugggauuauaggugugaaccacagugccuggccacaaguuuaucuuuuagaaaauggaaauuauuuuuaaguuauaauuucuuucuugacagugauguguggcauuuaagaagucaguaauaaaauaauaguguacuucccuguuggggcuuuucauauuguuuucuauucgucaauauuguugauucuucucuccgucccuccccugggacaugggauuuagaacagugucgggguccuuguagcccacugcucagcuguccuaaggaggcaggccagcugcccugugcucucacuaucaggaaaugagccaauccgagaucucuggccaguuugauuucuaugauacacacaugcuaugaacacagaggccacuucaauugagcccuuauuuaucuacaugccugaguaucguuuuaaaaauauuuuuauugauugauaaguguacauauuuauaaaguacaugugauauuuugauacaugcauaaauguguaauggucaaaucagaaauucaggauaucuauaaccucaaaaauuuaucauuucuuuauguugggaauauucagaaaccauuaagugcucuugguccuggaccaggcccugugcugacugguuaauccaaguucuuuccauuaaaccucacaauaauuaguuuugugaugccugauuuauagcugaaaaaugaaacuuuuggccuggugcgguggcucacgucuguaaucccagcacuuugggaggccgaggcggguggaucacaaggucaggagaucgagaccauccuggcuaacauggugaaaccccaugucuacuaaaaauacaaaaaauuagccgggcgugguggagcaccuguagucccagcuacucaggcggcugaggcaggagaauggugugaacccgggaggcgcagugagccgagauugcaccacugcacuccagccugggcgacagagcgagacuccaucucaaaaaaaaaaaaaaaaaaaaagaaaaaugaaacuuuugagaagguaacuaacaugccuaaggucauacaacuagucauuguugcagucaagauuuaggguggauuggcucugauauccaaagcauuuuuauuaugcuuuuuuccuguuuguuuuaauaaacuuaauauacaaagaaaacuguaaauauuagagaacaccuauauuuccaucgcccugaauuagcagcuguuaauuacaguacaguauuuaugaccaguguuuuuuucccccuuuaaccacauguuccuuucauucuuccugcugauaggugugguauguuuuccuguagucccauuagaaaaaaaucauuauuuauacguaguugcuucuaaagguucaucacuucuuguguguaguuuuagaauuuuuauaaaugauaauuuauacauauaucauuauguaacuuguuuauacucaacguuuuauuucugagaguuaaauugauguucuguauacaaauccaauucauuuagcuaucauauaggauuccauuggaagacauaccaacuuuuauuuauuaucuuauggacauauauuuauggauuugauugcuuucuugugauguuccuuagcuuuucuuucuauccucuguauuucuuguaaaauuugauuagauuccaguuaaacauuacauuguaucucauuaggagauacauaauagguguuuguuccaucauuuaugauguuacgauuaauuauuggguuagaauggugacacccugauccuccaauguaaaguuuauauuuuuucaguucuugcaacuaaaaaguaaucuucgugguguuacuuuggcaucauacagauagccaauuguccaucaaccuuuuauuuauuaucaaaacucugauguauaaucaucaucaguaauuucaugaaagauugcaaaaugacaguuuucuuauucugucauuccaucuauaguagucucugcuuauccaugggggcuguguucaacagccugucccccaaacaugccugaaaccaugauaguaccacacccuacccaaagaaugccaaggucaccuuuucacuuaaaggaagcacuuugagcuucucuuugaccuaucugaagugucagcauccuacuuuucugccuuggggccauuauuagguaaaauaagggugacuugcacacaaguacugagauaccaugacagugaaucugguaacugagggcuccuaugugacuaacagguggguagcauauauaguguggauacgcugggaagagggaggauucauguucuaccugagacagagaaggauggugcgagauuuugucauauuacucagaacagugcgcgauuuaaagcuuaugaauuguuuauuucuggaauuuuucacuuaauauuuccagacuguaguugacuguggauaacugaaacuaugggccaggaaacugcagggguaauuucuagacauuucuaauuggcauuuuucuuuuaaaaauuuuuaaauuauuuauuuauuuauuuuugaaacggucacgcuuugucacccaggcuacagugcaguggcacaaucacagcucacugcagcccggaccucccacacccaaaccauccuucugccucagccucccggguagcugggaccacaggcucaugccaccaugccuggcuaauuuuauuauucuuuuguagagacagggucucacuauguugcccaggcugguuuugaacuccuggucucaagugauccucccaccuuagccucccaaagcauuaggauuacaggugugagccaugacacccagccuauaaguggcauuuuucuauaaagaagagcuuuuucucuucaauuagagcuauuugcuuccucugaacuauagaugauugauucuuuaaagcaggaaauaaaaaaugcugucuuuccuccaucaucccaguaauuuucaaguaagagauugguauaguagcuaccgaguugaaacauuuuacauugcucaugugcagugcagauaugguguucucuuuaaauuuauggaugaaacaaauuguguauauaaggauuuugagcuucuaaacaauuuuuuuuuuuuuuaaaguagagaugggguuucaccguguuagccaggauggucuuaaucuccugaccucgugauccacccaccuugggcuucuaaacaaauuuuuaagaaauuuuaugguuuuuaaauuuuuuaaguguuuuccauauuuuuugcaauugauuuauaauuaugcugugguuagagaauguagccuguauuauuguuuuuaaaauuguugagaaggcuuguauuaccuaauauuauuaguuuucuuuuuaaauguguuauguugucuuaaaaaugaauguuucuauucuuuuuauuggaugaaagguacuaaauguuucauuugaucaagauuaauaauauuauuugaaacauucauauccuuuuuuaucugcuugauguaucaguuacuuagauguauuaaaaaucucccauuaggauuauaaguuuucccauuuauacccauacucuucagguuuugcuuuauauauuuugauacuguguuuuuaugguuauagagcuucaugauuguuaaauuaucuuuuuggaugguuucuucuuacagagcuuuaugauaaaguaucuuuuuggaugguuucuucuguuaguaauaacaucuccuuugucccuuauuaaugauguuuguuuauuuauuuugagacagucuugcugcucuguugcccaggcuggaguacaguggcaggaucucagcucacugcaaucuccgucucucagguuuaagcaguucuccugccucagccucccaaguaggugggacuacaggugcgcaccaccaugccuggcuaauuuuuguguuuuuaguagagaugggguuuugccauguuggccagguugguccugaacuccugacaucaggugauccgccugccuuggccucccaaaguucuggaauuacaggcaugagccaccaugcccagccugagagucuuuuuuuuuuaguagauaaguuuacauuuacauuuaccuuaauuaacagcacauuuauauuuauuccugccaucaucuuuugcauuuuguguuugcaugcauuuuuucuuuuuauuucccguuuuccuaccuuauauugaauagacagauaacuuaauuugugucuucuauuucucaaucaauuuggaagauaguguucuauauuuguucuuucagugaucaauguaaagguuaauguacauucuuaaaugaaguuuuuagcaaaaugugaagguuuauucauaucucuuuguuaaaauauacuaagaauguuagcauauuuuacuuuuccuaugaaacaucuuuuuguagccaucaugucauuuuuaccuaguauuuuaguuacauuuuuuaaccacaugaaaaaauuuuuugccccucccuccuuuucaggauaaucuauuuugacaguaagaaucauuuuagagaacacaaauagaauggaaaugaugccaaggguagaaccacagcugauaauaacagcuucuguuuguugaauaccuaacacaggccagaaguuuugcauauauuaucacuaauuugcacuauauuaauaucuucaauauagagacaggaaacugaggcuucaagagauacauaacauacccauucauccugguugguaaaggacagagcuggagaguggacuuugguggcuggcuuuggagccaccuguguuguaggugaccuagucuguucuggccaguucuuuagaguccguuccuugcuuuuggacuagauaguuucuccucuuuuugcugcugcuuuauuuuauucauggguccauaaaugauagacaucauaaccauagucacauucucacauuuagaaacuauggcuuauagaaugugcaaaaaauaacuuuuauaauaagauuugccauuuuaaguucuucccauuauugaagaguaguagggcccccaucauccauaugcaauuauaaauggcaccucuuacaacacuugccuucuguuuuuccaaaaucuguugaaauaugcugauuuguuagaaugagauauuuguugucauaaauguacaagucguuaguggcugaguuguaaaugguucccucaaggguugcguagugcccaguagccaggugaggagaaaacguauaaaggcaguguuaauuacuuucauaauucuugcucucaaacuauuccauuucagguuuuuuucugggauuggcaguguauggcaaguaaaggggauaggggaggauaggagguggguggacagaucuauauuuuauccuuuuacaaauggagauagcauaucaagccucaguguccauugcacuccugcuguaggccucccuuugucuugcacuuugacuccugagagaaaaauuguuuuugccaacaaggucauagaauguaaguggagaggcaagacacauauacguggaaccaaacuggagagaguuugcuaaaacauuacauugcguuguguggguuaaaauauggaaagcauuacauauagaaaagauaauuguggugagacguaaucagggcagguaagagaugaccagaugaagaggacaaggagccuugaaauccuguuauuuucauauguauuaagagacagaggagcuguauguccagagacccuaaaguugacccaagguagaacccuugguagacuagccuucccauaaggacauuaaugucuguccuccauaguuaauuccagcuuuccaagaacccucccccauauaauuguggguaaaagggcaccugccagcagccuccucagcccacccuuccucauguuguucaucugucccuuaugcuaaaguuccuuagcauuugauguaaacaguguguacugcacugugcugccauguuuauacguugucuugggauuucuucuuucucccgucuccuacuuccuuuggucuccuuagugccuggucuuuggaagcagauguccaguaaauauacauacaugaaugcccuuagacugaagucuaugcucauggugcaaggaaagcucuauggaaucccgaauuauaaaccacccucugccuugagaucaggaacagagcugucacuucacaaucugaauguucugugccuccucuugucucagcuggagcuucuguguaaaagcaaguguuuuaggaguuuccaucccaugauucugauugggugugugauuucugaagagguuggaaugggaaaugugaaaacuuaauacuaaggacgggccuuugauuuaaacaguugcuaugcagacugagcauugaguuuaaccaaugagguaaaaggaggggagaggugguguuuggggcagguaaaagcuguuucauagucaguguuugaaaacucaagagagaugauccuauuugugucuggaggacuugccuuucaggugaagaaucucugccuuaucccacaucagcagucacuaagaauagaauaaugaucacuauaggguuuuucuuauccagauuugcuagaauccguaucagaacacacagcugagaaagacccuucguuuauuugggcauguggcuaguaacauccccuugaauuaaauccuucuuuuuuuauaguuauaaagaggagauacauuuuauuuauuuguuuuuaugguagauuuauuuuuuaacccaucauuacccaucucuuucugucccuaucauaucugcaccuaggauagaauuauauuuaacaguaaacuguuaauuuagguagaguaggauaacuacuacaaaauaaucaaaggauauguuuuaaccuuggucuugauguaagaagcuaaaauagauuuuugguuauugguuucuauuugcuuacaguuaaaugaaguagauucaagucaggauuuuuuguuuuacucuggagauucuguucuccuacucuuucuccuugaguagauagucagaugucuuuugaaaauguguuuucgguguggaauauuaacccaaucuuugauaacucuuccagaaccuucggcucgcgugcuucugagcugcuguggauggccucggcucucuggacuguccuuccgaguaggaugucacugagaucccucaaauggagccuccugcugcugucacuccugaguuucuuugugaugugguaccucagccuuccccacuacaaugugauagaacgcgugaacuggauguacuucuaugaguaugagccgauuuacagacaagacuuucacuucacacuucgagagcauucaaacugcucucaucaaaauccauuucuggucauucuggugaccucccacccuucagaugugaaagccaggcaggccauuagaguuacuuggggugaaaaaaagucuugguggggauaugagguucuuacauuuuucuuauuaggccaagaggcugaaaaggaagacaaaauguuggcauuguccuuagaggaugaacaccuucuuuauggugacauaauccgacaagauuuuuuagacacauauaauaaccugaccuugaaaaccauuauggcauucagguggguaacugaguuuugccccaaugccaaguacguaaugaagacagacacugauguuuucaucaauacuggcaauuuagugaaguaucuuuuaaaccuaaaccacucagagaaguuuuucacagguuauccucuaauugauaauuauuccuauagaggauuuuaccaaaaaacccauauuucuuaccaggaguauccuuucaagguguucccuccauacugcaguggguuggguuauauaauguccagagauuuggugccaaggaucuaugaaaugaugggucacguaaaacccaucaaguuugaagauguuuaugucgggaucuguuugaauuuauuaaaagugaacauucauauuccagaagacacaaaucuuuucuuucuauauagaauccauuuggaugucugucaacugagacgugugauugcagcccauggcuuuucuuccaaggagaucaucacuuuuuggcaggucaugcuaaggaacaccacaugccauuauuaacuucacauucuacaaaaagccuagaaggacaggauacuuuguggaaaguguuaaauaaaguagguacuguggaaaauucauggggaggucagugugcuggcuuacacugaacugaaacucaugaaaaacccagacuggagacuggaggguuacacuugugauuuauuagucaggcccuucaaagaugauauguggaggaauuaaauauaaaggaauuggagguuuuugcuaaagaaauuaauaggaccaaacaauuuggacaugucauucuguagacuagaauuucuuaaaaggguguuacugaguuauaagcucacuaggcuguaaaaacaaaacaauguagaguuuuauuuauugaacaauguagucacuugaagguuuuguguauaucuuauguggauuaccaauuuaaaaauauauguaguucugugucaaaaaacuucuucacugaaguuauacugaacaaaauuuuaccuguuuuuggucauuuauaaaguacuucaagauguugcaguauuucacaguuauuauuauuuaaaauuacuucaacuuuguguuuuuaaauguuuugacgauuucaauacaagauaaaaaggauagugaaucauucuuuacaugcaaacauuuuccaguuacuuaacugaucaguuuauuauugauacaucacuccauuaauguaaagucauaggucauuauugcauaucaguaaucucuuggacuuuguuaaauauuuuacugugguaauauagagaagaauuaaagcaagaaaaucugaaguauugucuuguuuuuaaaaaauacaguuccuaguguuuuuagaagucacuuaauuugucucauuuuuccaccuggaaauuaggaauaauguagaaugcaaggcaguaauuuccuuuuggaaaggacucugaaggcagaaaagaagggagagaaccucaugggcagaauauuauaaaaagagugucauauuccagcauuugaauuggaaagagaagagugaagauccaaguugcauuauuaaucugcccuguguuuuuuccuuuuaacaaucaguuugagcugcugcuguuaugaguuucucaucaagaugaaagcccuaauauguaaagucaaauccgauuuaaauuuugugcuuuuauagaaagaaauuucuucauagacguggugauauaucauuuguuggaccugcuaauaguaggucaaaggggagcacuccuugcccccuguuccuggguuuaugcaguuuucuuuuuagaguuuauauagggcaagugguucuuuuucucugaauuacaggauggaaaaaggucauauccuuugucaggaaauauaaacuugaaaguauguagucagcucuuguaauacucauauuuaugauuguccuauaugaaaaacaacuucaguuaaaacuauaaugugugauucuguauaacaaggugaugucuguuucccagggcucagaccuaauccaguuauaauaaaaucaauuaaaugaaauauucuauagaaucgaucuaugcccuuguuaaucuccauccauauaggagucacguucuuuaagacagauggugguaguuauuuuuguggcaugguuagauuugacugguuuugcagaagauuacaguuauguacugcauaaugacauauacaauaguggucccauaaaauuauaauggagcagaaaaucuauugccucaugauguuuuagccguuuuaaugucauagccuagugcauuacucacgugucuguggagaugcugguguaaacaaaccuacuacacugccaguuguauaaaaguacagcacauucaguuauguacaguauguaauacugauaaugacaauaaaugacaccgguuuguguauuuacuuuuuauaa

SEQ ID NO: 191299 - RNA, 30697 nt, Homo sapiens
cucuguggcggagacagccagguuggcagcugacgggacagccggggucuauuuuguugcggguuuucagcaaauccagggcuggucuggaggcgcgaaguagguuccggaguccgagaccugggcugucggccgcgggccccugaguagcggauggggcgggcuccccggccucggggccgugcucagucugcgugagcgccgcgugcccggaacccgugugcggucgcgccccgggguugggggucggcguggguggcccucgggcgccgggacgccguccggagacuccuguggcgugggucugaggcgcggugguccggugcggucccugggcugguggagagcgggagggcccgggcguccacaaucccgagcugaccucgcccuuggucguccaggguuggagcccaggugagauggaggucagcggcagagcuggguggcccgagggucuugcagcugggaagcucaggaaaucccaugguccucaucuuaaaguucuuuuuaacgaacuuacccaguggaguuggguuuccuucuuuccugcuuuuucgaaguucugugaauauauuaauuauucagagagacuggaggaagacguaaaaagaggagacuagguaaagugauuuaaaucccaacauucucuuuuuuuuuuuuuuuuuuuuuuuuuuuuuuaaaagaacuuaaggcauacagaacgauggaguauauggcagaauccaccgaccgcagcccuggacacaugugagugcgacacuucuuccuucccccuuaaaugugaaaaucuucagugagcccgggaaacucacuauggagaacgcuugagggugggugggaaagagcguauauugucauaaaugggaaaaaauagaagucuuauuucuguagaaaaucgaauuaguuucugguuauaaagcuuguucuaguaaauauaagcucuaagaggguuaaaauauuuaccauacauccuuuuagaucggcacuguccaauauguagccauuagcuacguguggcuauuuaaauuuacuuuuuacuuacuuuuuuuuuuugagacggaaucucgcucuguugcccaggcuggagugcaguagugugaucucggcucacugcaaccuccaccucccggguucaagcaauucccugccucagccucccgaguagcucggaugacuuccugauuuuuauuggagauuauaauguaguaauuuuuaaauuuugaacaucuuaaaucuuaguuaucaauuuuuaauuucuugcauuuaaguucaaauuaacuuuuuuuuuuuugcuguuaaauagguuuaaugauacagugcucuucaaagagauuacuacagagacuuuuaaacgauaauccuggaaucguucagcacagaccaauuagcuaaaucuaaaauaaauuggcuucuuaccacaacuacccuguaaacauuguaguccuucugucuagaaugacccuaaucucacaggaaaacaguaacuauggagaaacuagcuuuguggccaaaaguaaaaaccaaaggaaaaauaggaauucagugguuagugaaagcaggaaauuuggcccccuucccugugaugcuuuacucuucccuuguccaucaguuagcucaguggguuugaauaagccaucugaaaaugucuuuggagcucagcauagugcugaucuuccuuguucuaucaguagcuuuuaacagacacuugucuaagggcucaaagcccuucacagaacccuuucuuggaauggguuguuugaccauuauacuucccuccggacaaccagcacuucuggaagagccugguuagcucugucaggaacugcuuucuuuccaggugguaccgcuggcuccacucugucaacauaaaccccaagcaguuuaaguuggaaguuuccuaaauuaauuuaaauggaauaaaauuaaauacuugguugcucguuuguacuagccauguugccacauguggcuaguggcuaccauuggacauggaagauuauugaacuuuuauuuuggacaauguuguucuacauuagggguucucagacuuuuucugcccccaguacaucucgaauuaugauaguuccgucauuuauacugagucucuagauguugauagacuuccuauacuguuaaaaaaaaaauucugcuauggguaaauguuuauauuucagcaguccuuaugcuuuuuuuuuuuaauugccuuuggaguauauuggcgucugauucuguuagaaaugauuuagauauuaguuucuauugguguaguccagagauauacuugaagaaauguucauuagagauaaguagacagcuguagucuuuuaauguagugacaccauacuguucaccuaagcuaugguccucuguaugcccugaauaaauagauuuuugaagacuuaguauuuagagaugaggugguugaauuaaaaagagacaaacugaucuuacauauucuugauacaggauuuucuuuuugguuuuugccauugacacacuauugccuuguuaauugauucuuucuugguuuuccaauuuucaacaagggauaaugaauaacagugcuucucaaauuuuucccaaguuugcuauuacacuugugguugggaaguuuaucuguuuauuuguaaaaguuaaugugaauguuugugucugcauagaaaauguuuggaaggauauauacaaauuauuaauaaauguuaucuuuauggauaguguugguugggugugguaaagagcacguuaacauuuuuaauuauauuucaguaucuaaaauuaaaauuagugcaagauuuguauucuucaucaauauaccuccauuuguuuuaaugugacaauauaguuucauuugcuuuuaauaaaaaagacuuguuuagacccauacuggcuauuuaaauguaaauuugaauuaaaaaaauaaauugaguuucucaguuguacuagucacuuuucaugucccaguugccacauguggcuaguggcuaccuuguuguacagaccagaauagaacauuucugucguggcaugaaauucuguuggacaguacugaccuucuagaaccuuuaggacaucggccuuauauugaggauuuuuagaauuauagccauuuuugguguuuuugccccuguauuacaggguuauucuuuaucuacugcaucuuugaagauugcuuuguuucuuuuuuuuguuucuuuuuuuugagacauugucuuggucugucacccaggcuggagugcaguggcgugaucuggcucacugcaacuuccaccuccuggguuugauaugcaugccucagccucccaaguagcugggauuacaggcgugcgccaccaugccuggcuaauuuuuguauuuuuaguagagaugggguuucaccauguuggcgaggcuggucuugaacuccuuaucucaggugaucuacccgccucagccucccaaagugcuggaauuacaggugugagccacuggcuggcccagguugcuuuguuucuguuauuuuuuugaaaagggcaaagaugcuguggccuaacuugaaggcuuuuguuuguuuggcaucuaaaaaaaaauuuaguguauuuuaaaaaucuaaugugaaaaauuuauccuuuauuuauuaaagcuugugcugugagugugguguuccgauaaguccaaauccugccaauauuuguguggccuguuugcgaaguaaaguggacaucagccaagguauuccgaaacaagucucgauuucguucugcaaacaaugucaaagguacagugcgguacaauuuugcucuuuuuaaaguuggaauuuacauuuagagaaccaccgagauaugcugagauuacacgaagguauauggaguaaagugcaugcaauuaagguuuaaauuuucuguuggugucgccaaagauuuuagaauuugcaauuuuauaguguacuuuucuaguguguccuucuaaucugguaaagauaguguaaauguauuugaaucuguucuucuguuaaaggaucuaauagauuugauguauauaguuaauaggaguugauguuuguaagggugagagcagauuauugaggacauauuguuauuaugagguuuuuuuuucuuuaguuauuagaagccauguaugauaaaaagcuuauguuuggaguaauuuaguaauauguuuuaaaaacucauaacauucacguguaauuaaaauaacuauuguugauggaaaagaagcucaauaaauuauaucuggaauggucugaaauaaagauuggauuugaaggaagaagacuucuucugaauguuaauguuucauuccucuugauuuucuuugucagcauaaacaacuuacaucuauuaggccauugaguaacacaaaacugccuaaugaguguaaaaguguaugccuguuauuuccaaaauggauuaagacgcuaacuuuuugaguguguaucucuagaggggugguucauggacuccuuugagaauuugaaaacuguaucucuuccccaaaauauuuacauacauguauauauauguguguguguguguauauauguaaaaauauauauguguguguguguauauauacauauauauacacaaacacaugaaacuguguacuguuucagggaguuuacaguguauaagcuuagcaagugugaggcuuaaucuuuuauaaauauuugcuauuaaaagccugguggaguuagaaaaguacugauaaagaacuaaacagacuuaguuugucuuggcuuccucacaaacuagcuguuugaaacucuuagcuguuuaucaucucugggccucaauuuccucaucagaaugaaggguuuuauuaggugauaugugaagcccuuucuaacucuaaacguuuacucauaggccaggcuugguggcucacgccuguaauccaagcacuugaggaggcugaggcggguggaucaccugaggucaggaguucgagaccagacuggccaacauggugaaacccugucucuacuaaaaauacaaaaauuagccaggcgugguggggcacgcauguaauccuagcuacucgagaggcaggagaaucgcuugaacccgagaggcagagguugcagugagccgagaucauacacugcacuccauccugggggauggagcgagacucugucucaaaagaaaaaaggaaaaaaaaauacgaaauaaauauguacuuauaaacaaagggagaccuguguaauguuuuugauugaaccuugaaaagugaaagucaaaacuuucuguuauguaacaaguauggcaaaaagacauucacauaacauguuuggaaguauuuuauauuuagcaagcauuuauugaacaccuacuauaagauguauguggcauagugcuaaguccuggguaggcaggacuaaaaaccuuaaagcacauauguaagagauuuaaguuuuguuuuagucugguuuuacccaagauuuuaaauguuguuuuacaauuuacaauuugaaaaggacuugaaauguagaugaauagacugaacuauugcugauuuauaguguugugagguacuaauguaccuuuuuuuugugaaaaauaagcaguucucaggcauuuuagaaguacauaauaaaccauuuuaaugccauuuugagaugauucucaccuguuuuucagagcauagcuuuaagagacucuuggacauuuuaguggugauuuggugauuaaaguaauaagaucacuuuaguagguuauuucagauugacuuucucagucagaauuuuaccuuuuuaauuaaagcugcuagucuaguugaaaguuuuggaaccauuaaaauauguuugaguuaagugcuucauaucauccuuggguuuuauuaugccugguuaauaauuuggguuauaucuguguauucagauggaaauuucuguguuuccugacagauguuggauuucaguauguuaucuucucuuuuagguauuuucaaccaccaggaacuuggauacagugugcuuuagaauccagggaacuucuugcuuugugcuugaaaaaaaucaaagccccucugaguaagguaaguuaaacagcuaaaaucaguauucauagguauguuuucauuaaaggucucauuuucagaaaauucuugugaguagguuuuucaaaaggaauuuuuuuuuuuuuuuuuuuuuuugagguggggucuugaacugucaccugggcuaggcuagaguacaauggugugaucucggcucacugcaaccucugccucccggguucacacgauucuccugccucagccucccaaguagcugggauuauaggcgcacaccaccacaucuggcuaauuuuuuguauuuuuaguagagacaggguuucacuauguuggccagauuggucucgaacuccugaccucgugaucugccugccucggccucccaaagugcugggauuacaggcgugagccaccaugcuggccucgaaaguaacuauuaaauguuacuauuguugccaguagcaccccacuacaaacacuuuuuaaaguuauauauauucuuuuuaugaaaaguaaaaauaucuuuuugcuuuaaaaagacagaauuuaauuuuuuuccuuuguuauuuaucgagaaucucauguauaauuuuuuaacggaaauuuuuauguaaaaccaucacuaaacauaauugggauuauaauauuagggcuauguuauuugguuucuuuuuauugucauuauugaucuggaaauaaaauauuugugccugucacugaaagucagugcauaaauguauuaaaaaaaauaguuuguuuaaaguacaguuuauuuccugauauaaaauugaaagugauugacacuaugaguuuucuuuauuuuaagcuuuaugacucacuucuaccauguuuuuaauugaaauugacucuuucagauugaagacuuuucugauucuccuuuaagcucuaauaaaauuucauguaauaguucuuugaaauuucugccuuuauuuuccuacuaggucccagccaaccccacaaauuucugauggucacuuuuuggcgcuucuggcauaaaacuuugucuuuuucccuucauauuuuaaaaaaccuuuuugguuuuuuucgcuccccucuguucuuggugauuuuuacuuuaucuucuaaucuuucuaaugaauuguuuuuuuccaguaguaauguuuuuaaguuccagagucuuucauguucuugaugcauuuuuuuuaaguuuuucugaagauuuugauaauaggacuuuuuuuguuucuuucuguucccucauuugucucuguuuuuuuaugaagucaguuuuuugugugucuugguuuuuugcuuuuauacuugggguuuuugucaaaugucuagugagucuuaacaguucauuaauuaauucaucagauguuuauuaaguaccaacucugugccaaacugcuuuugguguuggggauauggcagugaauaaggcaaucccugucuuagaaagcguguauucuaauugcacacuaacaugccaguguggagcagcauguuaguaugcagcgaucaaaauagguggauauauuacaugguauauuaaaagguauauucuguggagaaaggagcuaggaagaggauaagaacugugcauggaagaguugaaauuuaaaguaaggguguuuaggggagggcucacugauagggugacauuugaguaaacacuaaagauuacaguaagggaggaagcugugcagaaauguggaggaagagcauuagggguaaagaaaacaaauguagagaccaaaagcaagagcauacuugugugaauagaacggaguggugaggggaaaaguaguuggggauagaguccagaaaagucauggaaggccacagugugucuggccuuguaggcccuuauaggggcuguuucuuacucugaguguaaggaguauagagggugaagggcagaguagugagaugacaugacuuauuaguauuccucuggcugcuguuuuuagaaugguuguaagggagguaaagguguuuaaguuuuuguaauaaucaugagaaaugguuuuggaucagcaauggaggugguaagaaguggacagauuuuggaucuauuuuuaagguaguaacauuuacugauguagcuggauguguuuuuguaagagacagaagaguuaaggaugccuuccacuguucgugaccugagcagccaagucacuggguagggggcaugagaguucaucuguaacugguauuuagaugucuacuagacacuuaaguagaaauacugaguaggcagguugauaaauaagccaaugagugguccagucuagagauaaugaauuuaggauauagauaguauuuaaggucaugaauuggauuagauuauuucaggaguuuacauagagaaggaaagaaacuggaggacugaauccuggaaucauuccuuuaauggguaaugaugaagaaauaauuggguaaugaggaggaaucagcaaaggagacugaaaggagcugcuaggagguaggaggaaaacagggugagugugauguccugggaggaaagggaaguguuuuaagaagaaaggagugaguagcuaugugauuugcagcugaugagucaaguaaugaguucuguagauuuaguaauguggacgaccuuaauaacaugggcaauuucuguuuagugguggugguaaagaugucauuuaaauagaaauuaaaaugggagaaggaagauagacaguucuuuugagauuugcuguaaacgaaaacaaagaaauggggcagugguugaaggggaaguuggggaagggacacuugucuuuuuauguuauuuuauuuuuuggagauaaggucuugcuuuauugcucaggcuagagugcaguggcgcugucaugucucacugcagccucaaacuccugggcucaggugauccuucugccucagccuccuaaguaguugguacuacaaacaugcaccaccacaccuggcugauuuuuauuuuuacuagaggugagaucucucucuuucucucucuuuuuggcccuguagagcagagaucucacaauauacccagacugguguugaacuccugagcucaagcgauccuccugccucagcuucccaaaguguugggauuacaagcaugagccacugugcuuggccaggauacauuucuuaagaugguauauauaacuguauuuguaagcucucugggaguguuagaguacggagggaaauuuuugugaaauugcagggagaagaauaauuggcugggggguggccucaauaaguggaaaagagauauaguacauagugaaagaauacauuuauuuguuaauucacuccuucauucaacaaguauucagcacuuacucuucaccaagcaccauuuugggaggcuguaauauuucauggaacaaaguaaagaucucugcucucuagaggggcauucuggagguugaucuugaugggaguauggauaauucaucugugguaacagcagggaagguguugagugggagcuucugggaauucuccucugguuccuucuuuuguacuggagaaaacagaagcgugggcaguagcuaugugggaagagcuguuagauagauguuugaggagagagcggaagauaugaaauaguccucuagaacuagaggaaaugcaccaggacaguguuggaugggugcugggcagugcugaggguuacuguuacaaguuuagacuagucacuguggugugcaucuauuucuguaguucugucagccacauagucaaggcauagagcaggcagagcacuggauuuaaccaaauuuauaauuuagccuaguggcuaaggugaaauaagagagggaacaaggaaauugaguguguacaugagaauaauuuugauuauugauuuugaagcuagugaggaggaaugaggaauaaaguugguaggaugaauggauuguccauuauauuagcuugaaagauauuuggugcccaggaacuagaggaaauaagcuggaaagaugggaggugguagucagggaguaggauguuuggaauugauaguuuggaggguuugcaguuacugguaauagaggcauaugagugacugagauaggaagguggauaauauuuugggagaagaagaacucaaagaauggagugagaggucaggguauuguggggaucaccuguguggauauugaaaucgcuagguauuaauauuguuggaaagugugauggugagccagaagcuaaaaucuuuugagaaaugaaaacaagugauacaaagaugaauagauuacuauaaaaaagagaguugcgggugguagagucuaaugacuuuagacuuagagcuggguauauuugaggaggagacaaggagaauggucuguaauuagcaaugaagagcaaggacgauagcugucuggugccugguccagugauaggaagaaucaguuaucacuuuauauagcugcaggggagagagaaaucaggagaucuagaaggugaagggaauguucagcaaaguugaggauuuaggagauuucauuguuaaugaauguugagcuccggagggcacaguagaaggguuuuaggauucggggaggaguguuagauggggacagaauagggaauaugcauaaccauauggaaauuggaguaugggaaauaggggugacugaggugucugggacuaugguaaagaaagaaagggacuaauaaaguugauuagucaugguugucugaggacacauagugcagugguuguguuggggaaugccgagcaggaugucaaggagacucuccauuccugcagguggagguuggagcuugaggggaagaucagucuuauucagugccuuuggggcuuuuuuuuuuuuuuuuuuuuuaaccacugcugauggagauugaaggaauaggaaucugccuaucacccuguguaccuggcaucacuuguuaacuacuaggcuuuguuuuagggaggccagcuauaugaggaggguuuuacucugguguguugaaucuuugcaucuacacuaaaaguggccagucuacuuuuuaccagacagugcuugauaaaaguauaaucugcugcugauaccucucaaaucuguuaacugcagcccaaauuuuuuuauagaucuccagaccaauuguaucuuacuguucacugaaaaguccucuuggguaucucacagauacugucuuaaacugaaaugucugaaaucaaauguaacaucuuuuucucauuauauccauuguuuauuucgguauagguagucacaaaaaguguacugccuaguugucuaagcaaauacuugagcaucauucuggagucuguucucuuccucuuuuccauauccaguuaccauuaaaucuuacagauuuuuuuucugcaucacuuggacugugcagauaaaucuuacagauuuuuaucuccuaacuagcccuugcaucugcuuuuguuauuuccagugccucucaguucagaucaucuacaaucuggcccagguuauuacagcagccuccauucuuguucucccacccaccccuucuccccaaacacccauucuggccauucuugaguuauauucagaucuucacauauagcaaacuguuuuggccuaugcagaugcugcagauuuaguagugaguuauaguuguggauuuaguauucagugcaugcaacuucucuaaucaaugucacuucuuaaaaaaagucacagaauauagagagaauaauccaaguggaaacuuuuguucaugagguuacuaauaaauaaugaggucacaaggucuuugcuuuccuccaaaaaauauaauuuccuuuuaaaggacaauguacuuuuuuuuuuuuuuuaagggaaaagaauuuuuuuccuaugcaaauacuuuaauuuuugcuuaaauuauaucaguugcauuaauauagucauuggguuguccuuugauuugcugcuguuguuacguaaccaaugauuaaucuuuuuuugugaugaugguguguaguaugcugaucacagauuccuuaagcaucuuaugaaaucugcuuauugaugauuuguucuuucguguuuuuuuuccuccuaggugagaacuuacguuucuuuuuguuuguguuuuauugaagguacggcuuguagaugcaggcuuuguuuggacugagccucauucuaagagacuuaaaguuaaacugacuauucagaaagagguaagcaguacauaauuuucucagcaugguuaaagugcagguagugaaaaugaagacccagugauaaguuauuuuauggcuugaacagcuuaaaagaaaaagaguacacucaauuuuagcuguuuguuuucuuuugagcaucuguacaaauaauuagaucacuaguaagaguagucauugcuucugauuagcagacuuacuuuuccagaguuauuuuuauuaggaaaggauugaaguaaaaacauggucuaagguacugauccucaaacuuggcugaucauuguaaugacucaucauaacugaagcaaaaauucucuguaugugaggccgggaaucuauaaguagguugaguaucccuuaucugaaaugcuugggacaagaaguguuucagauuuuggauuuuuuggauuuuggaauuuugcauuauacuuaacugguugaacaucccuaauucaaauacaaaauguuccagugaacauuuucuuugagugucauuuagaaacucaagaaguuucagauuuugaagcugaaauuucagauucuggguuuuuggauuuggaauguucaaucuguauuuaaaaagcuucccaugugauuucugaucaguuauguuugggaaucauuaaauuaaggaauuuuuuuuuugagaaguuuuccuuauuuuuuucuucuaaggaugauuuuucuauguaaacauguauaggcugggcaugguggcucacaccugugaucccagcacuuugggaggccaagguaggcagaucacuugagcccuggaguucgagaccccaucucuacuaaaaauacaaaaguuagcuggacgugguggugugugcuacuugggaggcugagguggagaaucacuugagcccaggaggcagaaguugcagugaaccaagaucgugccacuguacuccaggcugggcaacaggcagagugagacccugucucaaaaaaaauuauauauauauauauauauguaaaauauacacagaauauucucacaaccacuucagcuaaaggaaaauuugaaaugcuaaucuaauaaaucuuaggaauuaaaucuguauaccguucuugaaauaguauaacuuguuuuuaugacuuuaaauuugaggacauuugauugauguccucaaagcauuaauggaaaaaguuuuaaauuaaauauuaaagguucuucuuuaaagaaaauauuuguuauuaaacaaaaccaaaagaaugaaggaguguaauuguuuuaucaggugaugaauggugcuauccuucaacaaguguuugugguggauuauguuguucagucccaaauguguggagauugccauagaguagaagcuaaggauuucuggaaggcugugauucaagugaggcaaaagguaaugagagaagaugaugagugaguccuacaucuuauauuucgucuuuguuaauuauaacuuuuccuucuuucuaaauccagggauagucugggucccugaagcauucaccuuuggaaauagaucauuauuacauuuuagauaaucuuuaaagauuguuauuguuugaaaaaucaguaugcucuaucuguagauaguauguguguccuauaccuauaaauggcuuuuuuguggggcauuuauugaucaaauaauuuauauuuuagacuuugcauaaaaaaacuuucuacuaucuggaacaguuaauucugaaauauggaaugcaucagaauacacuucguaucaaagagauucauggugaguuaaaacucaaaagcauuugaaauuaugucagauuuuuauuucaacauaccuaaguaaucuuauauuuacugauaauaucuggauuaguacuguccaaaagaacuuucuguuaggaaaaaaaaaaaaaacaacuuaauucuuuaucugcacuguccaguaugguauagucacuagccacauuuggcuguugaguacuugaaauguggcuagagcaacugagaaacugaauuuuuaauuuucugcuaaugucaaacauaauuaucuuuuuauguuucauaccuaaguaugauauuucuugagguuucuguuugauacauaugcauacauacuucuguccaaucuugcucucaguuaagugagugacauugaaaagaguuagaaagaaagcuugccuucuuucuaccuagcauuuaauuaaccucuagaaguuuuuuaagaacuugcccauuaagccauccaauuugauaucuccuaagggacgucuuuucaguuucuuuuaugauauucaccucucagguauucuaccccuugagucaauuuuaauaccauuuuccaagaaaaaccauuucaucuagcuuuuuagauucuugguauaaaauugaacaaauaaaauaaaucucauccguaacuguaguuauguccucucuauuguuccuaauguuuaucuuuucucuuucuacucaccucaccuuagacuagcuacuuuuaucuauuauguuaguuuuuucaaaaaacuauuuuuaguuuuaaacaaucuuuuuauuaauuuuguuuuuaacacuaauucccucaacucuauuuaguucuguuuuguuuuaauuaauugaaagcuuaguuuauuuuuaauuucuaauacauauauuuaagaucauaaauuuucuucugaguacuauaaugggucuguagcugguacuuauagcuaccuuuuuccacugcccauugcauauuuuauuugcccucagcaagcaccucagcuguuucauucuuuuggguacauacuuagguguggaauuaccaagucauaugguaaauuuauguuuauauauaaaaaacuaccaaacugcuucaaaguggcuguaccauuuuacauuccugccgccaauauuucucuguauccuccucaacacuuguucuuauauuuuuguuuauagccauucuagagggugguaugaagugguaucucauugugguuuuaauuuccauuuugcuaaugacuaacgauguugagcauauucuggauacaagucucuuacugcauauaugguuugcacauauuuucuccuaguguguaggagaaaauucacacucuauauucuuaaugguguccuuugaauugcaaaaguuuuaaauuuuguugaaguccaguuuaucaaguuuuuucuuuuaauugugguuuugggguuaugcuuaaaaacuguuugucuaaucaaggucacaaagauuuucuccuauaguuucuuucaaguguuuuauaguuuuaggucuuauauauuuaggucuaacucuugaguuaauuuuugugcagagugugagauaagugucuaaauucauauuuuucuauguggauauucuucaucccagugaaaacucuguccuuuccucagugaaugccuugggucuucugucaaagaucuauugacuguaaauguaaugguuuauuucuagaaucugaagucugcucccauugaucuauauaucuauccuuauauuaguaccaugcuaucuugcauacuuacuaaaguuagugaguuuugacauuaaauguguaauguucauuuucuucaaaauuguuuuggcuauucuggguaauuuuaguauuggcuguuuugguaauuauauuuaguuauuugcaagaauaucuuuaauauuucucagcuagguagguuugcuuuuggcuauuccuuucuugauuucuagugcuacuguuuuaugaugagauaauguugucuuuaguaauuucuacuguuuaggauuuauugaaauucuuuuucuuuuuaaaaucuuaauacaugauuuuuaaaugaauguuuuaugaauguuugauaaaauauguauucuuucuuagaacuguguucuauaaucucaguuaacucgaccuugauaguugguuauucaaguucugugaauuguuacuauuuuuugucaauaugauuauuuugguuuugagagaguccuauucuaguccuucacaaugauuguauguguuaauauuuguuaauuuuuucuuuucuuuuucuaguacuuuuuguuuucuaucucucagauaguuuccuguuaucuucuugguagauuauuccauuuauuacauaaaauaacuuucuuuuuuuuuuuuuuuuuuugacaugaagucuugcucugucacccaggcuggagugcaguguugcgaucugggcucacugcaaccuccgccaacuggauucaagcgauucuccugccucagccucccaaguagcugagauuuggcacaugccaccacguccggcuaauuuuuuguauuucuaguagagacgggguuucaccagaauggucuugaucuccugaccucaugauccacccagcucagccucccaaagugcugggauuacaggcaugagccaccgcacccggcuguucauaaacuuucuuuguucuuuguuuuucugucccccuuggccuugaguuuuauuuuuucuagaauuagaauuacgaguuuuauuuucauuugcugauuuauuuugucugucuuuuugccaaagaagucuuaagugauaucucuaaucuguugugacuacaauagaguuuucuaauaauuugauuuuguuuaaaacagauguaauuuauaauauagucauguuaguagaggagaauccuauuuugcauaauuauuuucauagggcuuuuuuuuuuuuuuuaagauggucuggauuuuuauuauuccucaaaacaacaugcucagaagauggucgaauuucuucaguguacaguucccuguagguauguucugaaccuugaaugugacuaaaucuaaggacuugggaauggaugcggaucacauauauucuucaggcucagacaacuucucuuuauuuaaaaucguaguagaaauacuuacacaaucaggaagcauauauuggguuaaccacccacucacagaggugguaggacuugugcuccaaagaucgggaaauuuucauagcuggaguuuauauugaaagguacuauuagugugaacaaagauuugcagugggcguuaguauggcuuuuaauaaugcuauauagaaaguagauuggucugagccaacagcauguucuagagguuugguggaaaagguucaaaauagguagggcuuaguuagaauggugaagguuuugacaugcaagugcaggacaguagguuuuaccagaggaggcaucaugaagccauuuuagaccuuggacaaugaugguuugauuuaaugaaaauugauauuccugaguccauacagguuaaugaucuuugucuuuauauuacuacuaacuuuuuucuuaauagauacaaagcaucacaaagacugaucucucaagauauccauaguaacacauacaauuacaaaagcacuuuuucuguggaaauuguuccaauaugcaagguacuuuucuuuuucauuuaauccauaucuguaaaagaguacaaguaauuaauuggcuuauauguaauuuguagcuccugguuuuccucuaggguugguuaaaaauuuagaauaaguuccuuaagugacuucuaacacauucagccauguuaaaagauauauauuuuuaaaaaagucaugcuuauaauuaugaauugacaugccuuuuauuuugguguauuaaaaugaaaagaccugguuauaguugauaaaaguccguauucuuugaaauuugugauccuaugagccuguaucauauaguucagugaaauugaauaaaagaaaugacauuaaaaucaauauuagugagccacuuuguggaauauguacaaacaaaauuuuggcaagaaaugaaagaauauugugauaaugugaaaaugagaucauagaaucauuuuuaugauuuuaaaacauaagcugaauaaaacauuuaaaauguagauuauuucauuuaauuguacuaagauaaaacucugcuucagaaaaauaugaauuaaaauucaauaaauaguuauugaguaucuauaguauagaaggcuguguacugaggauuguauaacuacaggucucugccauguaagaauuuauaugucaguauuaaaucacuaagaaugauaacugccauuauugugaccauucuacauaaaguuaaucuagauacuuuagugucuuucaccucauucucaucucauaauaacugagguaagccauaucauuuugacgaugaggaaauugaaguuugaggagguuagauaacuugcccaaaguuacaugaucacaaaaugaugaagcuaggauuugcacccaggucugugucuccaaagcuuuaaaacugcuauugcuauuuuauaguauguacuagggaugaaaugauagcuuaaaauagggucagcaaacuuucucuguaaagagacagaugguaaauuuuuuaacuuucaggucguauaaucucuuuugcagcuacucagcuuugcuguuguacaaaaguagcauggguaauauguaaaggaaugucagggccguguucugguaaaacuuuauuuacaaaaacagauggugggucagauuuguccugaggguggcauuuugccaaccucugguuuaaaacaguaaauguuucccugguacaaaucuugagaaauaugaauuuaggugugagggcauauuuaggccuuguguaacugaguuuuacacauguaaaaauuaacauauguauuaaacuauguaaaaaaguauauuuguuuaucuuuggaaacucauguauuaaaaaccaaggacugaacuaagagcuguuaugauugugaauagauacaccuuaaaauauaacucagaucuuuuuuguauuuuaauucaguuuaaaaacagauaauuacguugcugcuucaugucucccaauauaaauguagacaugugacuuuuuugggcuuaaaucuuugauuguauauuggcacauguagccauguaagagaaauguguuccuuugaaguuuauuuuuuaauggagauugaaagaagucacagguggauuuauagaaucacucuccugcuaauguuuauaauacucuguuuagaauguacacuguauuaacauauagagugauaagaggcauucacacugcaauaaaauggaaauaauaauagcuuggugauuugggcccuggauuuuuuuuuuuuuuuugagagacaguuuugcucugucaccuaggcuagagugcaguggcaccaccuuaacucacugaagccucgaccuccugggcccaggcugucauuccaccucagccucccaaguagcuaggcccacaggcaugcaccaccacguuuggcuaauuaaaauauauauauauauguauauggagacagggucuccauauguuguccagguuagacuugaacuccugggcucaagggauucucccaccuuguccucccagauugcuggaauuacaggagugagccagcgugcucagccaggauuuuuuuuuuuuuaaagcauuuuuauuaagacaagaugccugucauacuuaaggucugauucuuuucuuuagucucuuuguugauugauagaauugaaaauaacguuuugguuggucaaaugcaauuggauuggguguuuauugaugaguguuuauuggacuguuauuuaggauaugccucauucuaaauguuaguucuuaugccuaggauaauguugucugucugucuccaaaacuggcacaaagccugggaaauaugaaccagauuuguguguguauucgaguaaccagugccauucaccucauugauccaaacacccuacaagguaaauucuggaaaugauuugccuugacaauuuuguuuuguaugacaaacaauaauaauuuguguuguuaauuuuucaagcauucuugcuaauauuguuuugaaagguuaguuaaaauuugugcuauuguuuaauacaaaacauuguggaauuugcaagcuuugauuaguuacuuuuguauuuuuuauuuaaagaaacaauucuguuaauuuuuacauauuuacugguuuauuccauuaauuuuuacugaaauugacuuuuuuuuuuuuuuuuuugagauggagucuggcucuauugcccaggcuggugugcaguggcgcaaucucagcucacugcaaccuccgccucccagguucaagcuauucuccugcugcagcuucccaaguagcugggauuacaggugccugccaccaugcccagcuaauuuuuguauuuuuaguagagacgggguuucacuguguuggccaggcuggucuugaacuccugaccucgugaucugcccgccucggccucccaaggugcugggauuacaagcgugagccaccauguccagccugaaauugacuuauuuaccucauuuaauuuuugugacuauuuacuuaaguccauugccaaaauuuggugucuagcaguuauuuuaaauuuuggaacauuuggcuuuuuguggcccauuggaacauuuaguuugaauaugaauuuuaaccaauuuuguuauuacuguagaucauuuuuuaacauugucuauagaauaaauuauuuuuuaaggaagaccacauuuugguagguaucuuaguauuuggauguaucuucugcuugaucuuuuucauguauuuucuguaauauaaguuuccuuuauacaaaaagugaguuuauuuugauauuuuucaaagucauucauuaucuuuaucaguuaggauucauaaguuaaagaucuguuagcaauauugggauggacauucuuuaccuaucugguagaacuaggcuuuauuucccauaaacuaagcagcuaaggugacagauacguuucuaaaauaaagugccagcacgugaaacagcuguaccacugauuggcucugaucuuacuuaagaggcacuuagcccuguggcauucugguuauaguaacuauuuaagauauguuugacaucugauauauuuuucuugugcuuugagaaguuugggauugguuuauaggaguaauugaugacccuaaggagugaguugacacuaguucuguugaccugccacuucccaguugguaucuaccaguuuauucuuaguuaauacauuugauaauugaaauauauaauuuuucuuauguuuuuguguucuauccuuauuuuuaguggcagauauugaugggagcacuuucuggagucacccuuucaauaguuuaugucaucccaaacagcuagaggaguuuauugugauggaaugcagcauaguccaagauauaaaacgugcugcaggugcuggaaugauaucaaaaaagguaagcuacauccugccugccaguguauuuuuuuuuccccucaguuauuauuguuucagucccucuuuuaaaaaaaauuuguugguguuuccacaguauggaauccaaacuuagcaccacauuaggaaaaaaauucuuuuuuuuuuugucuuuuuaauauguggucauuguggaaauuguuagacuuagacuguuaaguuaauuuauucucuuuuguguaggaaaaaucuuuuaaauguuuauuccauuauauuuaaaaaaggcauuucuuugcuuuauuuuuauagaggaggaccuuuauuuuuguagugguuaucuugacuuuuaaaaagucaucaccaaauacuaaauacuucagugugcaucucucacacacaggaauauuuuucuacauaaugaaaauguuguuaccauaccuauaaaacauacagucuacacaguauucugcucuuauccauggggauacauuccaagacccccaguggauuuuugaaacaacccacaauaguaccaaacucuauguguauuguuuuuuccuauacauacauaccuaugauagaguuuaauuuauaaauuaggcacaguaagagauuaacaauaauuaauaauaaaauagaccaauuauaauaauauacuguaauaaaaguugugugaauguagucucuuucuuaaaguuaucuaauucuacuccaccaaccuguuuuuggauagcgauuaacugugggcagaugaaaacuuugaaagggaaacuauggauaagggggggauuacuguguucagauuuccucauuugucccaaaagugucuuuuaugccuuguucaaacagguauucaauuggagaccacucauuaaaugggaauauuauaccuuuuuagucuuuuauuuaauaauaguccccuucuuuuuucuuuuauugguuaugauaccaacuuccuuagacaacuagugcauuuaucuuguagaauacuccaccuucuaaaucuaucuaauuguuuccucaugaugccauuuaacuagcuucuuaauucauuguguuuccucuaaacuggaaaguugaucuaaagguuugguuacauuuagguuaaauuuuucuugccagaauauuucagagaugaugccauguacuuuuuauuauaucaagagacaaguaaugucugacuguuucacuuguuaacauagugauagucagauuccuccauuguaauguuaugauuuuuuuuccuucugaccagcaagcaaucuguggcuuaauacuauaauaauaugcaaguacugaguuccuguuaccucuuuuuuuuucuggcuuuagcaucuguugauaauucuugcccauaaauuaauuauuuuauucaggguuacaaaauggugaauuuucuauuucuauucuacauuuacuagcugucauucuuaaagaagagcuuuucauuauuaacuagggguuauguagcuuuccugaaaugcucgccugcauacauucuuuuaauuaauuaauuuuagacaugaucuugccguguuguuugggcuggagugcgguauggcuucauagcucacugcagccucaaacuccugggcucaaaugauccuccugccucagccuccugaguagcugggaccacaaguaugugccaccaugcccagcuaauuuuuuaauuucuuuguagagauggggucuccauguuacucaggcuggucuugaacuccugagcucaagcaauccuccugccuuggccucccaaaguguugggauuacaggcgugagccaccuccccuggccuaugcauaaauuauuaauucuuuuagcaaauauuuuuagaguaaagaguugaucuaggaaucauuuccaguggugaaaauuagcuuacauguacagguggugucucucuuugugauuaucauugugaucuccugaaguauaaguauuguaucauuuacuguauuuucuuuuguuuucuucuucucuccuccucucccuucauuucuuuuccuuuuuuuuuuuuuuuuuuaaagagacaaggucucacucugucucucagagcuggaguucaaugguaugaucauaggucacuggaaccuugagguugugugcuccagugaucuuaccaccucagcaugcugccacaccugucucauuucuauuuuuuaauuuuuuguagagucaaucucacuguuuuuucaggcuugucucaaacgauccuacugccucccuuauaggaaugagcaugagcgccugcccuuucuuuuuuuugaaauccucauauugcccuaaauuuauucaaugggagccccuucagaaugguuccuauguuguuuugacgugacucuccuggucuuugaaagcauccuugauuucuggugcaacacagcauucagguguuccagaaucacauguauaguuuauaacccauaucugaaaucaaauguuucuucaaagaugaaagucuggcuucuuuuacugugaaauaguaucuagagacucccaggguacccuugugugugugugugugugugcgugcuaauaaugcuucuugagacaaaaauaacuugugauaauuugggaaaaauuaauggaaauggaagacagaugacauucuacauuuuauuuauaaauuaagguaauguacuuagggcaaacuuuucauuuauaauaaauguagaguaucauuucccuucaggcagauauaaaaccagauacuguauuuucuugguuuuuaaaaaauagcuagaagagguuaauaaauuucuuacaagcagaagucuaauagcuagaaaguaaauccuguuaaauaaaauguagucucccuguuaauugacuuuucuuuugcaguucuuaaguuugagacuugucuuuuauuucaguuucuccuucugcucuauuucuuuucauuuuuuucauuucuuuuucuuugaccaacugcaauaagaaacacuugauucuuuucauaacuuuauuuugagauuccuuaauuuuauuuauaacucuuaguauuuuucucucgaucucacuucaguuggucugucuuuguuguuaaagguguuggcauguuagaaagggaauuaauaguuuucuaguuuaaaaauugggauguuguuucugcuauauauauauuauauauagcagauguacuauauuauauauagcagauguagagaaugauuguagucuacacuaguagauacuuuaaaaauuaauuugauaaagauuuggccucucuagugguuuacuaccaggauuucuaggcuguuuugucuggacccugauuuucugaacccuugugucaagcaagaguuugcuuggaauacguucuugcuuuaagauuccccuaccuuuucaguuauuuuguucacucugccuauguuggcccaucuuccugugaaaacauuucuuuugaaaauucuacauauauauauuuuuagggacauuauuaauguuuuauaaaagucuugaauaaaaucuuagaaaaagucaaugauuuauuuuuaugaauuguuugugagucuuucuauacucaugauucaguaauuuguuaauuuugacaguguuucauacaucagaaaaauacaaaaaauuuucugucuuuaaaaauuagaaaaccaaaaaucaauauuguauuuaacuuuucucugagaugcuuuuagaguuauguuuagauuauugaagaguacauuuucuuuccucuuaagcauacccucggggaagucuggguacagaagacaucugaaaugaauacagauaaacaguauuuuugucguacucauuugggacaucuucuaaaucccggagaccugguguuaggguuuguauuauuucauauuuuaaacugccaauuaggauugcaaauuuucuuugggaaccagcaaaacuaccuaaaaauacuaacauuguuuauucuaaaaagaucgaaggguucuuaggagccuuauaacucauuuuauuguugauaacuaaauuaaacuggguuggacagaagcccauaguuacuccauuuugguuauaaucuuaaagaguaauuuguuguaagauuuuguuaauugagccuugaaguuauaugguuguauccauauuuagaacugcuuuugcagauugggucuuuuuuauugugcaguugcuacugcucagauaacucacuuuuaagauaugacaacuauauauauacaaagggcuuguaaaggcauagaucaguucuuucugaaucagaguuuuucagugagugugugauuaaacccucaaauauugcuuuugcuuuuaggauuucaguuucuuuuacuacagaaugagguguuuuuuuuuuguuuguuuguuuaaaauaaacuagaaggaagcaacuaauugaauucuaaaguuggacugauauguaagucuguuuugcuuuuacaaauguauggcaagguggacaauaauugauuauaagugaaacucagaguuccuuauugucuuuaccagcaucuacagaagcauguucauuguguaauaaaugacagaacuuuuaaagugagaagcauauuaaauguuugauuuuuaggaaguuuuaggugauagccauaaaauaaaaaguuacacacaaaggguaaauggucacuaaguuuuucauuguuuacauuucagguuugauuuggccaacuguaacuuaaaugaugagcaugucaacaaaaugaacucagauagaguuccagaugugguaaggcuuuagauuuuucccuuuuuuccuguguuaaagaggaugaauguaacucuuagggguaagagguaggaguucacacuuuugaaaauaacaaaucaauuuagagauuucugaaacugcagauaagguauaauagcaaaauuuuuuuuuuuuuuuuuuaaagaaacaggaggcugggugcaguggcucaagccuguaaucccagcacuuugggaggccuaggcagguggaucaccugagguugggaguucgagaccagccugaccaacauggagaaacccugucucuauuaaaaauacaaaaaaauuagccaggcgugguagugcaagcuuguaaucccagcuacuugggaggcugagguaggagaauugccugaaccgaggagguggagguugugguaagcugagauugcgccguugcacuccaggcugggcaacaagaacaaaacucagucucaaaaaaaaaaaaaagaaaugggagucuugcuuuauugaccaggcuugcgugcagugucaugaucacucacugcagcucaaaauucugagcucaaguaauccucccaccucagccuccugaguagcugagacuacaggcacaugccaccacucccagcuaauguuuaaaacacguuuuguagagacggggucuuguuauguugcucaggcuggucucgaacuccuggcuucaagugauccucccaccucagccucucaaguagcugggauuacaggugucaccuaucaugccuggcuucauuuuaaauaauuuuucuuggugggguaaauccaagauuuauugugauuguuccuuuucuaaucacauuuucauucucgaucaaaauaccugauauuaucuguagagcaaaaauaaauuuagccgggugcgguggcucaugccuguaauccuagcacucugggaggcugagguggguggauugcuugagcuuaggaguucgagaccagccuggaaaacacagugaaaccccaucuuuacuaaaauacaaaaaauuagccaggcgugguggcaugcaccuguagucccagcuacuuaggaggcugaggcaggagaauugcuugaaccugggaaguggagguugcagugagccaagaucaugccacugcauuccagccugggugauagagcaagauuccgucuccaaaagauaaauaaauaaauuugcagcuaaaaaugaugacauuuagcauuuuuucagguucauuuuuauuaggcucacuucguuucacauacauuguucaguuaagaaggcauuuagaguuaaggcuguuauucaaagcugaauaaaauauccgugaaaaauaaucuucacaguaucaagccuuggaaaaaaacuauuaauucugaaaaaucuguuaaguucuaacaugaugagguuaagaaucaugagaaacugaaugaaauuagugugaaagacccugucuucuauacuugcuuaaucuuuuagaauaaacauugauuucuuuagcagugagcaaaaaaaguagagccaugacaaaucaaggacuccgaccaccugcccaguuguacuuuuauuaguugauaaauuaggaauuaacagcgugguuggaguguaagucuaaauagguauuucuaacaaggucauaagaggagaucauggcaaucuuacaauauuuuguauuuuguaaaauuauuuucauucuauaauuuauuaaacaagcguucuaagauacauuguugugaaaguuauauauaguucuguaaaugcuuauugguggguauaagagaaaaaaaguaucuacuugugauauucagaaugauuuauaugaaugguagcugaaaacugaaguuugaguuaaaagaaaacuacaguuuuuguuauuaagaaaaacaguauucagucacugaaaaauuuuagcaaauuuuaacaauuguacaaauaaugcuugaauccauucucauaaaaaguuaaauacauggagaaaaauuuuaaaaguccucuugacacugucucuccaucccuucuccuuucuccugagguguaaccagugucauuaguuuggucauuuuuuagcuuuauugaauuuuguggccucacuguauaguucccauucuuuguaacuuuacaaauauuuaucuugcagguauuaaucaagaagagcuaugaccggaccaaacgucagcgucguagaaacuggaaauugaaagagcuugcaagagagagagaaaacauggauacagaugaugaaaggucucgcuuuucuuuaaaucucuuauguugucucaaaggaaauauuuaugauaaauacuuuuuauguuguaaagaaauaggcaucacacaauugauccuugcacucaauuauaaucuuggauucuuaucaagguauuaauggaaucaguauaagaugauguaaagacauuuaacacagauuuaguaauuauuuccugguuuaugaccuaauaauuguaguguuaauguaaacaauucauuugaaaaguuaaaauauaaucauacuuugcuuaacaaugggcauaccuucugagaaaugcaucauuaggugauuuuguugugugagcaucauagaauauguggcacaugacuuuauaauaaauaauuacauuaugaauaucacaaauagcagaugaguacuuauggcuugagauaaaaaggaaacagcucauugaugccaaguguguuauuccucaaauaauuuaagcagaaaugaagacaguguucuaaaacaguuuauuggaugauucaaaaaguggcuuuaaugauggugaagacaccgaugucuaaaaaaacugagaguuuauauaaaauuguuucaugaaaugugaguuggaaacagcaguaugucuacauaguccuuaaaaugaaaguccuuaaaugaagaaaauauaacuauauuuuuggugaugaaauauuuaaauguuuauuuaaaggcaauaccaagauuuucuugaagaucuugaagaagaugaggcaauucgaaaaaaugucaacauuuacagagguugguguucuaggaguguuuaagucauuuguucuguauauaaguauaguuccuaguaugaauauuuugguaucuuaagcuuugauucucauaaaugucuuuaauuguuuuuucaacuacucuagucacacuucuacaaaaaaacuugcaaaacaauaaauaaaacuuaacaaaauacuguuuuguauauuacaguuaguauuauuugcauucuagcuugaucccuuaaguugcucacuccuauagugguggaaguauauucuuacaguuacucaguucauuuguucagugaauguaauuugaaugacugcuguaagagacaagagcuucugauacaauguaguuacauaauaauaaugauaagguagauauuuguauauuuucaaauauauuuaauacuuuguauacauauaaauacuuuguauuuauuuuauucucuuuguauuuuuuuagauucagccaucccuguggaaagugacaccgaugaugaaggagcaccucgaauuagucuggcugagaugcuugaagaccuucauauuucccaagaugccacuggugaagaaggugcaucaaugcugacauaaugagauguuguagacuguuuccauacaugggcuuaagaaguuggacagaguuaccuuaagugucucuacuaucuuugccuccagauuucaagaggagaaauuuaguuuuaaaccugaauaaacauguuuguuuucagugcucacucaaaccacuaaaacagauggauagcuuugagguuuuagauaaggaaagauuauggagaauguaguuguuauugauuuuuggcaauuuuacauuuggaauuuuaucacugugcuuuuuuauaugaggcacuguaguauuuucacauaguauaguacucuggauguaaaagcucaaaaauugugauuccuugaacguucacuaaaucuucaagcaaaaacacauuuuuacauuauuuuuacguugauuauuuuagugaaagaccauaugaagaagcauuuuuaauauuaacuuguuacauacuuugauccacuuuacaucauuuuuauguuguugagguagggaaauuaggguucaguuuaucacuggacauucaggaggcaagucaaucuuuuuuauuuccuuauaaaauuaacucuucaaaagccguuaaacagagaguuaucuuaauuuuuauugcaguaggaggaaauauauuuaaaauauuuguagauuuauagcaaauagagacucguuauuuaaagguuaaauaacaauuuguucuuuuguuguuuuugccaguuuagggcaguagcugcuuuugucauaaauaucuuccuaccacaucaaaaaugcugcuuuuaaaauuuuuguuuauaaauugagaaggaauuuucucucuauaaguuucugucauugaacagaucaccauuaaaaagaauauuagaauccagcaugaagauaauggcuaauaaaaaugagguacauacuuuauaaaaccauuaaucagauuugaaugaggaaugcuucccacauccuugaaagaaaaacuguggcuuacguuuugaaguauucugagaaugaaguauuaagauccaauuucuauaagcaagaucagacuuguuaaguaugccgcaaguaagagcuaauucauucauuccaugugugccacuaaauaaagagauugagcaagugc

SEQ ID NO: 191300 - RNA, 36565 nt, Homo sapiens
gugcugugggauucgcggaccccucuggccgcgcuguggcuguuucaccgcuccccggcugggacuuggagucccuuaucuuucccugguuugguacaugacccggaagccucggcuggccguugcgucauccauggcgccggcgcagagcgagaaggaggugggaacgccgugaagcaagagcggucggcagagcggggaggcgaacugcagcagaguucuugcuuuccggcaggugauggcgccccccgcggccuagagguccagcgcccgccgcgagcagcggacaguccuccuguuguguccgaccgagaguccuggugacuuugaacaugcuggugccgcuagccaagcuguccugccugggugagaggaaacgggcgguggggauaaguggaggaguuagggcaaaagggacaaggccgguccugggggcuguaggcaccucucgccccuucucucaucagcuuucucaggcuaucuagggcaaaggucacgcgcugucagccuguugggggacccuggcuuccucccucugggguugccccaguugguagaauuaauaucuaggcuaaaggucaagggcggggaaaacuugucaacacgcccucggcaucaccaccaccugucaacacacacacaccucgguggacuccugaacugaggcuucccaaauccugguucuaaucuucaaaccucuguuggaaauggaaaaaaaaaaaucguauuugcccaguuuuucucccugguccugaccugacuuucgucuucggagccauucuaguucagucuaaagaaauugaagucugaucugucacaucaugguuaacauucauauguugaccaagucacccaaguguaucuggagccaguuuuucugcguugucuaaaauuaagggcugggcgugguggcucaagccuguaaucccagcacucugggaggcugaggcggauggaucaccugaggucaggaguucaagaccagccuggccaacauugugaaaccccaucucuacuaaaaauacaaaaauuagcugggcguuguggcccacuccuguaaucccagcuacucaggaggcuuagguaggagaaucacuugaacccggagguggagguugcagugagcugagaucgcaccacugcacuccagccuaggugaaagagccagacuccgucucaaaaaaaaauuaaauuaaauuaacucuaagggcuuuaucguguuauggguauucugugaaccaucgugacagaugaaguuggauggucuuuuuaaaguuuuacuuaaauuuuuguuguugucguuaauucaaacagaaaaguucccuaaaggaucucauauucugucauaacuggcuuaauuuuuuuaaaucuuuaguuuacuuaaguuuuggugauagaaucauuaagucuaaauauuccaaauucaaggauauucuuaugaaauuucaugaaaguagaauuuuguuaaauuuggcuuccauauauuaagaaauuagaacuuuguuuaaauuucaugucacccaugcauuuuuugcugcacuuaauguauggauaagaugguguuuggaacguuaaaguagucagaugcuaucugccuuagagccuaauuuagaugcaaucagccuugggcccagugcuaaccaaauuccacuaccauuucuguuuucuuuggauggcaauucauugccauuuucguagccugcuggcaugaaagagguagacaccaaugugccaucagugugacuuugauauggugaugcuaugaguucaguggacuuugugacuucucuucucaaccacggagacugaauauuccaaucucuaaagugagauaucagauguguuuucagaaaagggguaaagguugugacuuuuuuuuccaauccuuuggagaaauucagacuacacaguuccaaauauucucaagaaaaucaguagcuauacaagcaguagaaauaguuugucauaugucagucaucaguuuucagaaguaaauaacuucuaugcacuaaacuacaaugcauugaaaacuaaauauuuuaaauauucguuauaguguauuugaacucuugaacugaguucuagaauaucuuuauguauuuaauauacuuuuuuuuuuccaaaauugaggauaggugaauaguuaucuaaggcuuaaaaaguguugccaauauaguuuuuuuguuuuuugggguuuuuuugacacagucuugcucuguugaccaggcuggagggcagugauguaaucucagcucacugcaaccucugccucccggguucaagugauucucgugccugagcuuccguaguaccugggaucacaggugcccaccaccaugccuaauuuuguauuuuuaguagagacgggguuuugccauguuggccaggcuggucucaaacuccuggccucaagugauccuccuaccucagccucccaaagugcugggauuauaggcaugagccaccaugccuggccccagugcuauaguuuuuaguaugcguaaguaaguucauuucuuugccacuuuaaaaaaaaugaccaaacacagauuuuuauugccuuuucacagaaaauuacucugaaaagcauuaaucuuuuauaguaccaugugucaaggacuaucuaauauuuagucaacaaauauguauaccuaacauuagguuuucacguacaacaaggucagugcuuuuggagcaugcuaucugcuggagaauacagacaacuaaagacauuuauauuuuuacccuuuuuuggucacauaaaugguuuaaauuuuuagucuaaugauauuguaacuuuuuagauuuuuaucauucuuagaaaauaacuuugaaaaauccuagauucuaaaaaaaaaauuaccuguuuucuucauaauauuuuuguguguggcuguaaaugcucuuuuuuauaacagcuuuaauaaacuuuaauaagauaugucacaaaucauacaauauauacuauuuaaaauggacaauucaaugguuuuuaguauagucagaguugugaaaccaucacugcagucuauuuuagaacauuuucaucaccccaaaaagaaacuauucacucccaagccccuuccagccuuagacaacaguuaaucuacuuucugucucuauaaacuagccuauucugaauauuuccuguacauggaagcauauacuauguugucuuuuugugacuggcuucuuucacauagcauauuguuuucaaaguucuaugugguagcauauaucaguauucaauuucuucuuauugcuaaauauuucauuauuuggauauaucacuucuuaccauuuauugaucaacauuuggguuguuucuacuuuuuggcuguuauaaauaauucagcuguuggucaggugugguggcuuacaccuggaaucccagcguuuugggaggcugagacgggcauauugcucgagcccaggauuucgagaucagcuuacacaacccagugagacugcuugucuacaaaaaaauagaaacaauuauccgggcaugguggcaugcaccuguagcccuagcuacucaggaggcugaggugggaggaucacuuaagccuggaaagucaaggcuucagugagccaugaucacaucacugcauuccacccuuggugacagagugagacccugucucaaaaaaaaaaaaaaaaagucagcuaggaacauucaugugcaaguuuuuguguagaaguauguuuucauuaucuuagggauagacuuaggaaugggucacaugaaaacucuauguuuaaccuuuugaggaacugccagacuguuuuucaaagagacugcaucauuuuugcauucccccaggaguguaugaagguuccaauuuuuccacauccuugcuaacucuuguuauugaaaccgcccaacagguucuccuugcccacuacccagacagagccaauuuaucaaaacaggagaauuagaauagagaaagaguuuaauucacacagaggcggcuguacaggagaccauaguuuuauuacucaaaucagucuccccgaaaacuuggagacuggggauuuuaaggauaauuugaugaguaggggggucagaaaguggggagugccaauuggucaggucagaggugaaaucacagggagaugaguuugucgucuugcacugagucaguuccagggugggagccaaacgaccagaugagcuaguucaucgaucuggguggugccagcugauccaucaagugcaggaucugcaaaauaucucaaguagugauccuagauuuuacaauagugauguuauccccaggagcaauuugggaagguucagaaucuugccaccuccagcugcaugacucuuaaaccauaauuucuaaucuuguagcuaauuuguuaguccugcaaagacagucugguccccaggaaggaaggggguuuguucugggaaagggcugugauugucuuuguuucaaaauuaaacuauaaacucccaaaguuaguucagccuacucccaggaaugaacaaggacuacuuggagguuagaagcaagauggagucaguuaggucagaucucuuucacuguaauaauuuucucaguuauaauuuuugcaaaggugguuuuauuauugcuugacuucucgacuauagccaugcuaguggauguaauaguaccucauguggcuuugguuugcauuucccugauggcuaaugcugcugagcaucuuuucauguacuuauuggccguuuguauaucaucuuugaagaagugucuauccagauccuuugcccacuuuuuaauuggauuauuugucuuuuguuacuagauauaagaguucuuucuguauucuaaauauaaguccauuaucggauauaugauuugaaaauauuuucucccauuccacgggcuaucuuuucacuuucuugaugguauccuuugaugcacaaaagguuuuaauuuugaugaagugcaguuuaacuguauuuuuugucguugcuuguguuuuugguuguucuaucaaagaaaccauugccuaaacccaaguguugaugaaaaagccaaacuccauaaacuauuugaagagauuaauucugagccaaaugugaggaccaugacccacgauacagccucaggagguccugagaacauguauccaagguggcuggguuacagcuugauuuuauacauuuuagggagaaaaguuacaggcaaagacauuaaucaauacguguaagguuuacauuggcuuggccuggaaaggcaggacaucucaaaaguucacgaauuuguguugggccacauuuaaaggcauccugggcaacauguggcccauaggcugcagguuggacaagcuugccuuaaaagguaucagacucuuaguuaaaucucuccuagaucaggaaaaggccuagaaagggaagagaauucuccacagaauguaaauguuccucacaagagacagcuuugcagggccaauccaaaaauuauguccaagaaauauauuuugggguacaauacauugauuuccucuagggccuguugucaugugauguuauaccagagucagguuggaguugguaucuuauugcuacaaagagucuguucugucagucuuaggauuucaauauuaauguuaaugcuggucaguuaugucuaaacuccaaaagggagaggguauaaugaggcaugucugacccucuacuuaccaucauggcaugaacuacuuuuuuggguuucuuuggaaucccccuggccaagaagagaguccauucagugguugggggccuuagaauuuuguuuuugguuuacacaaggucacaaagauuuacacucaugucuucaaagaguuuuaugguuuuagcaaauauaggguuugaucuuucuugaguuaacuuuuuuuaucaccauaaucuuuuuaacuuuuuaucuugaaauaguuuuagauuuacagauaaguugcaaaaauaguacugagaguucccauaugcccuuugcggagcuucaugucuuauguaaccauaguauaauuaucaaaacuaagaaauuaacauugaugaaauaaaguuaauuaaacuacagauuuuauucagaucuucuuuuucuguuccaggauccaguccagggcacaagguugccuuuaguuggcaggucuccauagucuacuucaauuugacaguuccucugucuuuucuugugucccaagaccuuuacaguuuugauauguacuggucgagcauuuuguagaaugucccucaaucugaguuugucugaucauuucucaugauuagacugagguuaaagauuuuuggggauaaauaccacagagauaaagaacccuuuucaccacaucauaucagggauacaugguaucaauaugucuuauugcugguaacauuaaacuugaucacuugcuuaaagugauaucugccauauuucucuacuguaaaguuaacauuuuucacuuuccauucucuacuuguuagaagcuacucaauaaguucaucccacaucacucaaagggaggagagaauugaagaauuuauggauauaucaccaucuuuuuuuuuuuuuuuugagacaaggugcuuguugcccagguuggaguacagugacgugguccuagcucacuguagccucgaauuacugggcucuagugaucaucguaccucagccuccugaguaggugggacugcaggugcauaccaccacaccuagcuaauuuuuuuacuuuuuauuuuuuauuucuguagagaagaggucuugcuauauugccuaggaggaucuugaacuccuggccucaugcaguccucccgccuuagcugagauuuacagucaugagccacugugcccagccaaccauagucuucuauacuuugaaccuacccuaauaaaaucuucgaucaaauauaauucauuuugaccuagggagcagaguauacuuuuuuucugaauggcuuucuagcuaucucugcaccauuuaaugaguaaccauuucuucucccuaauuugaaaugguaucuuuauuauauaccauauaccuauguguauucuauuucugaacucuuuauucuuuuuuuaauuauucuaucccuucuccuauaacagacuucuaaugaauauagcuucaaauauaaguuucuauaucugucaagagugguuucaugggaggauucuuugucuuuuuuuaaugauagggacgauuaucaagaugaacagagccugagaagggagucaaaauugaagcucagaagggaugguaucagauggaggaaugucucuagacaacgggagagauaagccuucucauccagcuagaaagauuaaccccaguggagaagaauauagucuguuucacuauauucauugaguacaaucaacgggagaaaagacaucucuucugcuauaaacugagauaaugaacaaaguaugggcacaaauacagauuauauuagaaguuacugccaaggaguugagaaaauucccaucuaauugcuucugucuuuaugagguuugaugcuaggguaccugcccuggauaaaggaaagaagagguggaguugaagguuugaggacaacagagaagguucagugaacauuuuugcagauaaaucuuugcauauuucuguucauuuccauaaaauacuuuuugcugacucaaaaauguauacauuuuuaaggauaucagaagauacuguggccaggugcaguggcucacgccuaugaucccagcaauuuuagaggcugaggcaggcagaucacuugaggccaggaguucgagaccagccuggccaacauggcaaaaccgcaucucuacuaaaaaaaaaaaacaaaaauccaaaaauuagcugggugugguggugcacaccuguagucccagauacucuggaggcugaggcgugagaaucgcuugaaaccaggaggcagagguuguggugagcugagauugcaccacugcacugcagccugggugacagagugagacucugucucaaaaaaaaaaaaaaaaagaagaagaaaaagaagaagauacugccuuaagaaccugaccauaaaacaaaguuugugcuuaaagccauugaccuaacacggugauuauacuacuccauauuacucucaaaguguucagcuuucaugacuaauccauaguuaagccugacaugagcuaaauugaauaaauuugcuuauuaguuuuaaaauauuuaagauuugaaaacauugcuuuaugagaaaaagcuauucaaaguguucaccuaggaaagauuauaguauauuucacuauacucauugaguauagucauucacuuauauuuuuucagucuacugaggaaaacuaauuuuaaggaagauaauaauuuucguaauuuuugugcagcauaucagugcuuucaugccuuaaaaauuaagaaaaauuaucuaccucuaugugcuacaagauggucuucaacuucuacugugccucgaauuacuacccauuauacuauuuauccccgggauaaggacaagagaugggaagguaaguaauaauuuguguacaauuccugagacuuuucuggauacuuuguuuucauuuuguggaggagaguauuaauauuuuucauaauuuaaaaacaucuaauaauauuuuguggcuuuaccaagucacaugcugcauaaugacccuucagucaacaacacgacaauuauaaugguaaucccuugacauuauaauggagcugaaaauuccuaucaccuagugacaucuuuuagaacauagcuuccagaccaucguagcucaacacauuacucaauuauuuguggugagucugauguaaacaaacauacucuacugccaguucuuuaaaagucuaccauauacaauuauguacaguacaugauacuugauaauaaacgacuguuacugguuuauguauuuacuguauuauacuuuuaucauuauuuuagaguguacucuuacuuaauuuuuuuaaaaaguuaacuguaaaacagacacaggcagguccuucaggagguauucuggaagaagcuaccauuugcauaggagaugacagcuccaugcguguuauugucuuugaugaccuuccagugggagaaaauguggaggugaaagauauugaugauccugacccuguguaggccuaacuaauguguguguuugugucuuaauuuuuaauaaaagaguuuaaaagguaaaaggaaaaaaaauuuuaaaaagaaagaaacuuauagaaaaaugauauaaaaaccauuuuuuguacagcuguacaauguguuuguguuuuagcuaaguguuauuacaagagagucaaaaaguuuaaaacauuuaaaagcuuauaaaauaaaaacauuacuguaagcuaaguuuaauuuacugacgaaaaaauuuuuuuauaaauugcguguaaccuaagcauacaguguuuaugaagucuauaguaguguaauguccuuguccuucacauucucacugcucacucagucacucaccaagaacagcuuccaguccuguaaguucuauucaugguaaguacccuguacagauauaccauuuuuaaauauuuuauacuguauuuuugcuguacuuuuucuguguuuagauguguuuaguuacauacauacuauuauaguugccuacaguguucaguauagucagucacaugcuauauagcuuuguagccuaggagcaauagccuauacccuguugccuagguguaucauaggcuguucaauuaguuuguguaaguauacucuaugauguuugcaaaagggcaaaauugccuaacgaugcauuucucagaaagcauuucugucauuaagugacuugugacuguauuuuacacaaguaaauauuugcuaaauguauaauaauaaaucucaaagccaagaauuaguuuauggaaacugaaauaaaguauguacuggaacagaaccuaagaauauaaucauacuaauacaguaauaugcuuaauauaauuauugugcaaaacacagggagaauuuccauaaauaauacucuaaagcacaguggauauuuuuuaacugucaugugauuuaucaugugauuauuggguuauauuaaucccagaauuuuuauuucucccaggagugaacauggaaagguuugcagaagaagcagauguuguaauaguuggugcaggcccugcagggcucucugcagcuguucgucuaaaacaguuggcuguggcacaugaaaaggacauccgugugugucuaguggagaaagcugcccagauaggagcucauacucucucaggggcuugccuugauccaggugcuuuuaaagaacucuucccagacuggaaagagaaggggguaugaaaaauuguuuuuuauacaaagucuaaucuuuuguaauuguauuucaguaauuguucccaaauuacuggaauauaggaaacccuuuucauguaacucuaucuuuuuuuuuuuucuuuuuuugagauggaguuucacucuuguugcccaggcuggagugcaauggcgcgaucuuggcucacugcaaccuccaccucccagguucaagugauucuccugccucagucucccuaguagcuggguuuacaagcaccugccaacacucccagcuaauuuuuuguauuuuuaguagagacaggguuucacuguauuggccagacuggucucgaacuccugaccucaggcgauccacccaccuuggccucccaaagcacugggauuacaggcaugagccaccacgcccagcccauguaacucuaagggaauaauuauauacuuuuuaaauuaaaaaaaaauuuauaucagaauuguaauuuaugauauuaacaaauauuuuuguguaaugcuuucuacauguauuuauguaauggguauaugagaagauaacuugagaagaccuuugaauauuucuugggaggcauuuuguauuuugaggguauuuuuaaacuuguucuuuaagucuuuguaugauuguucuuaauaaaguaauaauuccugggacaaugcaauaucuaaagccaaagaggauaaccuaauuuucugaagaaacauauuaauauggcuucccauaaccuaagcagaaaaaccacaggugugauauacagaggaccaaguccaaguuuuauugucuuaaauaaaauuuguaugaauuugguuaaaaucuuagauugucaauuuuuucuucucuaagauggguuauauuauaccuguccuaccuccuagauuagauuauucagugguugugaauauacuugcaaagaucaaaaauuauauaaauaucuguauuuuuuccauauggaauaaauugaauuccaaaaauuucgucugucucuccuuucugaaauaucaagcucccuuaaacuagaaauacuuuaauuaggcccaguugaauuuauccuuuugauauuauaucagaaauggauauuauugaauuaacacugacauaauaucaauucuaauagaaaauguuuuucauguuaaagcccuuuauugcuuuggcaccuuuuuuuugagacagggucucacucugucacccaggcuggaguacaguggcacaaucauggcucucugcagccucaaccuccggggcucaaguaauccucccaccucagcccccuuaguagcugggauuacaggcgugcaccaccacacccagcuaauuuuuguauuuuuuuaguacagacaggauuuuugccaugugggcucaaaaccacuagcuucggccucccaaauugcugggacuacaggccugugagccaccacacagacuuuggugccuuuuaauauguauagccagcagguacaguguaacaacauguuaauucucuuuauccaagaggaaaauaaaacuucucuuaccuuucaccaaccaggaaguuucaacuuaagagccaagcaacuuggcuaaccucuccacagagacaaaaagacaugagggucacguuucaaagguguuuccaagacucccaagaaauauauuccugggaugcaaaacuggcaagagguuuauuuagauuuuuaaaagauucccagcuggccgggcguguaaucccaacacuuugggaggccaaggcggauggaugacuugaggucaggaguucgagaccagccuggccaacaugguaaaacccccucucuacuaaaaauacaaaaauuagcccagcaugguggcaggugccuauaagcccagccacuugggaggcugaggcaggagaaacacuugaacccaggaggcagaggcuacagugagcugagauugcaccacugcacuccagccugggugacagaaagagacacugucucaaaaaaaaaaaaaaaaaagauuucuguacaucucagacagagaaaggauucacagugacaaguuuuauaaaggaaaugccaaaagaaaauuaggggggaguucuuuuuuugucaucagaguacauuuuauaguuuuuuuguauuuauauuuacacuugcaaauauaaacuaaaaacauuucuuuuucuucuuuuauuucuaggcuccacuuaacacuccuguaacagaagacagauuuggaauuuuaacagagaaauacagaauuccugugccaauucuuccagguaagguauagugaauaugcauagaacuauggaauuccacagcuggaaggaacuacauuucaucugacgaaauuuccuccuuuuacagacaagaacugagacccagauauuugaaggacuuacucaaagcuauacagcuagcuggugggaaagcaggacuagaacucaguucuuuugucuuccagucuagaagaauugagauagccuuguaagccaagcaggaauuucuaacuuagugcuuuaauguuguuuguaauguaauaaauuagaacucuagaccaaaauuguagaaaauaaguugaaagugugaccaucaauguagcacuuauguagaaauacauauugauucgaaauuuuaaaguauuuauguuuuuguaaugucuuaucaauaaaaagucagauuuauaaauuaagcauauauuuauagggcuuccaaugaauaaucauggcaauuacauuguacgcuugggacauuuagugagcuggaugggcgaacaagcagaagcccuugguguugaaguauacccugguuaugcagcugcugagguuuguauaguuuuguuuuguuuuaauauuuauaggaacucucuuuuuuuaauaaguggagaauuuuauaaaguugaagaaauaaauauuuuuuaaaagccaugggauuuuagaauuauaagauuagaaggaaucuuuaaaguaucuaauccaaagaguacuugaauuccucauguuguacccccaucaagugauuauccaacuuaugauugaucaccauaagggaugaaaaauuguagauuguugguaaucucuuccuuauuuugaacagaacuuaccuaugguuuuauacuauccagaacaaaucuaugcccucuuccaaggacaacuuucuaauuauaauuauucccugcucucucuuccucccuaucuuuacucuggaauuuuuuuuuauuucccaguauaggggugguauaggaguuaagggaaagguuugucucugcccucugaagguucaccagaaaugaacugacaauagacagaguaauaggagaagaagcauagagauuuauuuaacaugcauaagcacaagagaaugaugacccgauaacccagugagguccaaaugcuuaucuaccuuucagcagaagggaaggggaaauuggguguuuagcaaucuugaaaggaagugaaugauuuuuagggaaaaugaaugcacccaagacacagaaauuaacuuguaaaugauucucuuuggaauuugaaugagccugagaggcaggcaugaucuuaugaaaaaguguuugucuagguguaguugcuuuuuucuguuuucuuuucugcaauagauauuaacaauaagauuucaggaaugggauggaagaccauuguguucucuuuggcagguccagucuuaagguagagaauggaauaucagagaagagccgcauccagugcuuuagaagagauaggauugaaagacaggaggaggggaaggucagagagaccuugaagcugcugcuuugguuuagcaugccagagugccauauuuuagccuaucauuuucugagccccaauagcagaaaggugugauacccuuccucacccaucauaagggucauagcugacacuccuauaacaaaagacaggguaacaagaaaaacauaccgcauuuguuuaaucaaaguuuuacaugauaugaaauccuucagaaauaaaggccccaaagacccaggggaaaccauuuuuaugcuuagguacaauaagaauggacagccauguugaaaugugauuagacagaaggguaugaucuaacgguaguagacugagagaggaagcuaagcaaggccugucuguucacauucucuuuggccuuuuuguguagcauuucuuccuccgagguauggcuggagcagaacuccucuggagugagaguuuucaaggggaaagggagaaguaagaaaauaaccuuucuagguuuuauggccuguauuaagggagaggauuucagguuucuaugacucaaccuugaggaagaggaauccugguuucuaugacuugcuuuaggggagaaagagggaugggagaagguaagaaagaccuuguuucugaggccuuccagucuuucuucaguuccagguacucagcauaggggcugagugccaagguaagacuucccccucacccucugaagguucauagaaaaauuggcucacaagaggcagguuagcaggagaaaaggcauacagguuuaucagcgugcaugaagggaauauuacagagugaugacccugccacacaaugggguacaguuauaugccuuucuugguagggaaaauggagauggagaaguauggaugacuuuagggggauaguaggugauuuuuaggggaauucagugggcuugaagaacauacagcaaccugggacaaagucucuugagccugcagaggaaacaaugguuucugacagaagccuguccaaguuuauugacagacuucagucauucuuccugcaauaugaguucaguucaugaaaacucaggaaagggaccagaaguaauuguuugcuucuuugguaggcccguauuuuaggaagauaagggaacuucagagaacaacuucauccugugcuuugggagagacagacgauuaagagacagggacaguuggccagggaaggucagagagacauugaagcuucuucaguucagcaugucaaagcaccauauuuugggauaucgguuucugagccucaacaucagcaugccagggacauacuuuuuaggguauuaucuuaagagccccagcacuagcuuaaauauucucagugcuuucagccaugacgguacauaauuugaguuuugaguucuuucaguauucuugcugcccacuucugaauggaaccucuucuuacccccuuuacaaaguggcacccagaaugaauaaaccacuucaugucuaguguagaacuguuaucuucuccauucuagaaacuggucuuccauuaauucccucaaaguaauuacuuuuuuggcaacuacaucacacuauugauucuuauuaugcauuacuggggaaauuauuaaaaauaaaaucuuggccgggcgcaguggcucaugccuguaaucccagcacuuugggaggccaaggcaggcaggucacgaggucaggagaucaagaccauccuggauaacauggugaaaccccgucucuacuaaaaauacgaaaaauuagccgggcauggcggcacgugccuguaauccuagcuacuugggaggcugaagcaggaaaauugcuugaacccagaaggcagagguugcagugggccgagaucaugccacugcacuccagccugggugacagagcgagauuccaucucaaaaaauaaaaaauaaaaucgccugaggacccagaaaaauucucuucauaaauuauaaaaaagaaugaaacaggccaggugcagugacucaugccuguuaucccagcacuuugggaggcccaggugggcggaucacgaggucaagagaucgagaccauccuggccaacauggugaaacccccucucuacuaaaaauacaaaaauuagcugggugugguggcaggcgccuguagucccaucuacucaggaggcugaggcaggagaaucacuugaacccgggaggcagagguugcagugagccgagauggugcaacugcacuccagccuggcaacagagugagacucugucucaaaaaaaaaaaaaaaaagggcacaguggcucacaccuguaaucccagcacuuuggaaggcugaggugggcggaucacgaggucaggagaucgagaccauggggaaacccugucucuacuaaaaguacaaaagauuagcugggcgugguggugggcaccuguagucccagcuacuugggaggcugaggcaggagaaugucgugaacccgggaggcagagcuugcaguaagucgagaucacgccacugcacuccagccugggugacagagcaagaguccaucucaaaaaaacaaaaaaaaagaacgaaacaguuuuauucuugaauuaggcuuaaaccaagacugaugcauaucacaggccaagacagaaaucucacccuuuuaaauagccagguagauacaauccauucauuacauacauguuaacuguuuuuacagauacaaucuauucauuacauacauguuaacuguuuuuacucuaaggaaaaauaaaauaucucguuuuuuuguuguugguuuuuuuguuuguuuuguuuuuugacaagcaggaaguuacaacuuagagccaaacaccuacccaaauucccauagacacaggaagacaggaggcauccuucuugguguuccauuucaaagcaauggcuccaaagcccuaaaaaagacauuccuggaaugcaguuuaaaaagacugccauguaucucagagagacaaauaaaggauuuacaguuggaaguuugcuaaaggaaaugcugaaagaaaaguuauuggcagcaaggaaaauucaguuuuuuuuauuuguuuuuacccuuacaguuuguaagucaaauaaaacacguaggucccuguauuauacuugcugcuauaaauuucuguuuuccuaacccauauacaugcauuugggguuuuuggacccaagugugggauuuugcauuucuccuuguuaaacauuguugacuggaaucggugucaaagucacagguaggugguuuguagaauccaugauuuucacuuuuggaauacauacaugaacacuuauagucacuuguaucacuuuucuuuuucucggguccuuaaugauuaccaucaacagauuauugaucucuuugccaggguuuuuugaggguacacugagccaaacuucaguuuagucuguagccauauucugcuguugauuuguucguuuucaggaucucaaauaaaaccuucauauauauauauauauauauauauauauauauauauauauauuguggggggguggguucauauccauugcugcuaaucuuuucuuguacuucuccaugcccaugcuuucuuacaaucugcuguguaauugcauuguacauuuuguacuuuacuauccagcgagcauuuuccuccacagagaaaacagaaaccaaggguuacagacuauugcuauuucuccucaucagaauuacacuuuugaccuauuuuccccuuuuuucuugcuccaaaaauaaacuuuuaucauccuuggucugucuucagcuucucccuguuuuguuuuauuuuuguuuauugaaugaagucuucacucauuugagauguaagcuuuccugacaguuucucuccaccuucauguucuucauguguuacaggccuccauuucagauucuuuacacgauuugacaucugaagggcacuucuuguuuaaucuuacugguuucccuaguaaucucucuaguagucucccccuuuucuuucucaucaagguuguggcauuguuuucauuucccauugugcgagcucuguucuuuaauacucuggaagggaguaccuuaauacaugucucuuuauuaccugaacauuuuaaacucuguauuucuauaaucuagagaagauguucaccuucuaagaaaccuaaggcuguuuacuguuuuuuucaagauuauuaugaauucuaagguauuaauaaauuuguuuuuuaucauuuuuagguccuuuuucaugaugaugguaguguaaaaggaauugccacuaacgauguagggauacaaaaggauggugcaccaaagguaaaccuuuuuaauaguuacgugcuuaauaaagcgacaaacaacagaaagaacugugugggcaucaaagugaaaccccaucucuccaaaaaaagaaaacaaaauuagcugggcuucgugguauacaccuguaguccuagcuacuuuggaggcugaaacaggaggaucacuugagcccaggaguucgaggcugcagugagucauaaucacgccacuucauuucagcuugggugagugacagagcaaaacccugucuuaaaaaaaaagaagaagaaagaaccaacuuugacuuaauaaaggucuugcuacaaacuguacauuaauuauauggguguugggaugccaaggcagauagaucacuugaacccaggaguuugagaacuuccugagcaacauggugagacccugucucuaucaaaaauacaaaauuagccagucuuauaaccuggucucaaaauaaauaaauaaauaaauaaauaaaaauuuuuaaaaugucaaaaaauguggguguuagaauacaguaauuaauauggaauuuuucuuucauuaaaaaauauagaagcaacuuugagcuaacaaugguuuaggcaaguaguuauaauauguuuaaaaauuuuuuaaaagauaauaacauacaaauauacaaacauaagucaaacacaugucaaagauuuuauuucauuuaguuaaggagagaaucaguaagauguuacaaccagugcaaggagaauucaaacauauacacauuuauaggccaucaauccacugcauuaaccaaauacaucaaaugaaaauaguuuccacaguuuuuauuucuccacaauuuucauuucuuuggacaagaaucauuuugcauuacuaucaguagguaaauagugauauacuuugacauguuuguuuguuuguuuguuuguuuugagacggaguuucauucuguugcccaggcuggagugcaguggugcaaucuuggcucacugcaaccucugcuuuccagguucaaguaguuaucccgccucagccucccgaguagcugggauuacaggcgugcgccaccauaccuggcuacuuuuuguauuuuuauuagagaugggguuuugccauguuggccacgcuggucuugaacuccuguccuaguaauccacccaccucggccucccaaauugcugggauuacaggcgugagccaccgugccuggccuuuaucacaguauucuuaagcacuuugacaugauuuuaacaucuuuugguagauauaaaacugauucuccaccucccauucaaaauauaaaccuggauaauuuucagguuuucacaucuuguauuuuugaaucugaaagcaaaaccguuagaacauagaauucucacucuuuggaaaagauaaggaaaaaaauagcuugcuguccuauaauaugaacaaaacacaaauuaacaucucaaucaacuaaccugccuauucagguuuauuuauuauccaauuucccaacuagauuauaagcucccuaaggauggagauccugggguuauucuagugccuggcauaaugccagguaccuauuagguaucaguaaauaugugucaacugauaguuuauccuccucucugccacucuuggaauagaauuaggaaucuacagucucuuccagcagauuuucuccuucucacauuuccugcuuuaaaagcaaauagcggcccgucgcaguggcucacgccuguaaucccagcacuuugggaggcugaggcaggcagaucacgaggucaggagauagagaccauccuggcuaacacggugaaacccugucccuacugaaaaaaaaaauacaaaaaaauuagccgggcguaguggcgcacgccuguaaucccagcuguucgggaggcugaggcaggagaauggcgugaacccaggaggcggagcuugcagugagccgagaucacaccacugcacuccagccugggcuacagagcgagacaccgucucaaaaaaaaaaaaaaaaaaaaaaaaagcaaauggcaaauccuguuugggacuccuagugguuuaacugaccccaucagaaucaugugacaucuuggggcucagccuguccugcaguaaggccuaagaagcuguuuuuuaacaagccuccagggauuccgaugcauagccagguuuguaaagaacuguuaucucauacugccucucaguaaaagaauaugguuuuucauauauuacgguucuuuucuauauuaugacuaauuauaaauuauauuuuagucuaaauauuuuuauauuuuauauuauaacaaaauugaagcacacaaauucuaccauucugauauuucauuuuuguguguucucauuuguucaaauaugggcuuauuucagguggcagagguugcagugagccacgaucgcaccacugcacuccagccuggacgacagagugagacuccaucuaaaaaaaaaaaaaagauuaaaaaaaaaaaaacauauauauauauauauaugguuuuuaacuuuaugcuuugcauuuguaaaaacguuuacauuuuguauguuguauuuauacagaucuaauagcauagaagaguacaauggagucuuaguaauuugagccccaaaaucuaaguuuuuaaaaauaguacuaccacaagauuagaguggggaaaaucaaagauucuguuuaagguguuguuccauucucuauuuaacccacuguagcuaagcuuucucccugcgauuucacugaaacagcucuuguuagagucacaaauaccuccauuuugccaaucugguggacaggucucuguuuucccuuacuugaccuucuaguggguagcacuugacacaguuggauuauguuuuccuucuugaaacacuuuuuugacuuggcucucuuacagccuucucuugguuccuaucuccaauaugcaucuuaucauaagaauucugauuuggacauuuuuaaguuacagagguuaaguaacuuggcuggggucagacaccugguaaguaguagggcugggauuugaauacaggcuguguggcuccacggccugucccuugaacacuaaagggcauguuaccucuaagaagaaacagaaauauguucaugaauauuuuaguucauacagauugaauuguuuuauaaguggugcuggggaaacuauauccaucuggaagcaaauagaguuggaccccgguuugcugguuguuucuuucuggugauuuaaagaucuaaaacaauacaaaucagaaaucuaagagaugacaguuaacaauuuugguguaggguaagccacccuaccgcaacaagauacuaaaaaccugugaaaaaacagacaaaccuuuuuuaacuuaauauauaaaaguuaaacacuucuuuauaccaaaguauacuauaaagucuguaaauguuugacugucuguaauaucaaggugcacuuaaacaucgacaagaaaaaagacaacacauuggaaaaauggguagagucuaaaaaauuaacaauucguagaagaacaacuccaaugaccacuaaucauaaguaaagauacuuaaauauguuuuuuucagaguccagagguuaaaugucauuucuucaaagaggacuuuccugaucacucaaucuagaauagcuggcuucuauuauucucccuuguaauacccucugcucucuuucauagcacuuaaacaauuuguaauuauauacucauguauuuauuuaaugucugucugucuauggcuaguccaaagaaaaggaacguauauuuuuuucaauucauccauguauucccaaugccuagcacagaaccuggcacauuguagguauucauucacuauuucuugaaucaaaaagaaaagaugcucaaaauaguaaucagggaaaugcaaauuaaaauaguauugagggccaggcaccauggcucacacuuguaaucccagcacuuugggaggccaagguggguggaucaucugaggucaggaguucgagaccagccuggccaacauggugaaacccugucucuacuaaaaauacaaaaaguuagcugggcuugguggcgggugccuguaaucccagcuacucaggaggcugaggcaggagcauagcuugaacccuggaggcggagguugcagugagccgagauugugccauugcacuccagccugggcaacaagagcacaacucugucucaaaaaaaaaaaaaaauuaaaaaauuaaaaaauaaaauaguuaucacacuugauacacuagcaaaaauguaaaaggaacaguuauaucugucacuaacuguacuauagggaaagggucuuauauacuacugauggaaauauaugcauugcuucaggcuuuuuggaaaguaauaugauaauaucaauuuuaaaaaaauagauguacccuuugaucuaagagggccacuccugggaaucuaucuuauaggaauaaaagcaccaauauuguacguguauacaggugucccuuggugugcacgguagacuggcuccaugacccuccaaguauaccaaaauucaugcauacucaagucccaaaguuagcccugcagaacucacauauaugaaaaaucggucuuccauauauucggguuucacaucuggugaauauuguauuuucaauccucauuugguuaaaaauaaguccuuguauaugugaacccacacaguugaaacccaucuuguucaagggucagcucuauauuaaauauauauucaagaguguuuguaucuuauaacauuguuuauguucaugcguaagcuggaaacagugaauggcuauuauccauuggcagaggagcuggauaaucuauccugucucucuacauggacuacuaccuagucauuaaagagaaagauuugagcuauacagugacuugaaaagauuuccaugagguauuuuaagugagaagaguaagauuauaugauucuauauauuauauauuuacuaugugauucuuuauaauauuauacauuugcacugucucuucuacaucugaaucauaguucaauuuaaaucugaccagaaugugaauguauuuuaaauugucaaauguugccauuuaacauguuuuugcuuuucaggcaacauuugagagaggacuggaacuacaugcuaaagucacaauuuuugcagaagguugccauggacaucuagccaagcaacuauauaagaaguuugauuugagagcaaauugugaaccucaaaccuacgggauuggacugaaggagguauccugguuuguuucuguaauuuuaauuuugaaagauggaauuuaaauuuauuuguauuaucagguaguuuauaauacugauuuaauuuuaguuauauuuuuucauugucuugaaauguucauuaugacuaaaacuuauuugcgauauuuuucaaggggcuagaagauauuacugaucaaauuauauuacugguuaaguuaguuuuacauguuggaauugucguaucaaguguugcuugaagugaaucuugaacuugugaauauuugaaucuuuuuuauuuucauuguaaugccaucugcccuguuaggauuguucuuguuauccauaugcuguuuguaggaugaccacauccuacgaagaauuauuuuuuucaaaauuguaaugugaaguuaauuuucuuuaugaaagacacacucagccauaguauauuaaucugcaaccuaaaauuuaauuagguuaugcauuguacauuuucucaauuuauccauucucuagucuuauuuucccaaauccuaggcuuauuagaauguaaauguaaaauuuucauuauaacccuuuugcuuaaauauuuuuguggagcuagcaaugguggcccacacccauaaccccagcauuuugagaggccaaggcaagaugauugcuuggguccaggaguucaagaccugccugggcaauguagugagaccucaucucuacugaaaauuuaaaaauuagccaggugugguggugcacaccuguagucccagcuacucuggaggcugaagcaggagaaccacuucacuccaagagaucaagacugcagugaccugugaucauaccacugcacccuacccugggugacagagugagauccuaucucuaaaaaaaaaaagaauauaguaauuaacaacaaaaaauuuauuuuagguuaaaucucagaaagguucaaagucuauauaaaacuagauucauuauauugugaauaaggguuuguuuugauagauugcauaugucugauugcacauaauauuaucugacuuagauaaaauuucagauagaaauuguucagaauuuaaaauuuaccagucugaaaagagggugaacaauuuauuucaauuguggggggcaggguagagggaauaaauugcuuuguuggagaauacauguccauuaugaagagaccuuaaguguacagcuacauuaauuuuuacauggugaacauauccauguggcugucacccagaugaagauagagaacacuaccaguaccgcagaacuuucccucagccuuucaguaggauuuccuaauuuccuauaauuguauaaaagucuuuaccaauuugagaaucuauuuaaugucuuaaagaguucauaaguuuucugaccuguuucuuuaaucugacucaugcugcaguuugauauaauuuucuuuguuauucaaggugauccaccuguauucuuuuuuauuauuuuuuuauuuuuuuuuugagacugagucaugcucucucacccaggcuggagugcaguggcaugaucuuggcucaccgcaacuucugccucccggguucaagcaauucucacgccucagccuccugaguagcugggauuacaggcauccgccaccaugccuagcuaauuuuuguaguuuuaguagagacaggguuuuaccauguuggccaggauggucucgaacuccugaccucaagugaucugcccaccucagccucccaaagugcuaggauugcaggcgugagccaccgugcccagccuucuuugauauuugaaguaauuuuguuguauucuuauaucacaguuuuucacuuguaauuuucauaaauaagacauuaaaccuggcaaguuuuaugcauuguggugacauaaaaacauuuuuaaaauacugcaggacuuuuuuguuugcuuuuuuuuuuuuuaguuauggguuauugaugaaaagaacuggaaaccugggagaguagaucacacuguugguuggcccuuggacagacauaccuauggaggaucuuuccucuaucauuugaaugaaggugaaccccuaguagcucuuggucuugugguaaguuauauucccauuagggaaaauucugcugcuagaguuauauuaccaucaguguuauaaaauaaggguuuugaaucugaagacuguaaaaugcuuuuuauuuaaagcuuucuaauuuuaucaauauguaaagugcuuauggcugcugugucauuaagucuacuaaacacacguagcaauagcaauaguagcugcuacacuccaggcacugugcuggaugcuuuucugagauuucuaaguaaguuucauaauaacugugaaauagguauaucuuuauuuuacagaugagaaaacugaaguccaaauaaguuaaacaacuuacccauauacacccauuaaauaacaggcagaaaugccugaccuugucugaccucaaaucccauuuccacuguggcaugcuaccacugaaaaugaaaucagcacuagauuugaacuuagaacuuuuuaaaaauaccagcaguuucuccuuuuuuggccuccuacacaucuuugcaguaaauuacauguugaacauuacaaagaauggaaaaauuaguuucuguaccuugcaacugguggcagcuuuauaguuuagugucaugauuagaccuccauaugauacauuguuaaauuuauguguuacugguguuuuuugaccccccaguccaauguucaucccaucaccuuuggauauuuauuccugugacuuaauuguaucaaaggaaaaagaugcaguuaauuuuaacacuuugguaaugcauuauaaaauauaaccuucuauauuucuuuuccucuuuuuuucugaguguaguuuacauccuuuuucuuuauuuuugccccaguuguacuguaguauagauuauuaguuucuuucaaauugguauugauuaauguauaauaaaucauuacagcuccuuucauagaaacauaaucugagaugcuuaccuacagauauuguucuaauuuguuuuuuuuguuguuguucauuuuuauuuucuaaucucaugauagauuguuuuucuaauuuggacuuugaguuccagagcacaaggauuucuuaauauguucuaaauucucauaauuuugaugauaauaaacacaugcuauccuuuucuuuaccuuuucuuuuccaaacagauuuuauacaauuuuuaauuuacauuuggauuacugcacauagugcuccaaauacuuuugaguaaaagaaauuuaaccuacauguuuucugauaaacauugcuuacauuuuagcuugauuuaauuugaaauaaaaaugucuaauuaaauauaaguguaaauuuuuaagguuggucuagacuaucagaauccauaccugaguccauuuagagaguuccaaagguggaaacaccauccuagcauucggccaaccuuggaagguggaaaaaggauugcauacggagccagagcucucaaugaagguggcuuucagguaacucuuccaacuuuuauuuuccuuguuucuguauuauaaauucagaauugaacauauaauguaacaaauuuagauaaagaauaaaaacaauauuggaauaggaaaaguauguagaguuuauaaaacugugucacacaauacuucaauuacaccaugaauuuaguuuuaagaauauauuaggcugggcacaguggcucauacauguaaucccagcacuuuggaaggccgaguuggguagucugccugggcaacauggcgaaaccccaucucuacaacaaauggaaagauuagccaggcauggugacgagcgccuguggucccagcuacucaggaggcugagacaggagaaucacuugagccuaggagguggagguugcagugagccaagauugugccacugcacuccagccugagcagcagaauaagacuccaucucaaaaacaaaagcaaaaaauaauauauugaucucuagagauaaauucauggacauuuuguuuguuaguuguuuuaaccagaaaauaaaaacuguaauccauaauauuucucuguuccuuaacugccaggaaacucaaaggcaaauuuaguuuucagcaaacauaauucauucauuccaacuaccuaguaacauucaugccuuuuagguuaccucuguuaagcuuuuaccuuaauuguccuauuuuuguauacauucaaaaucuucucaaauauaauguauucaguauguauuaaacaaugaaauaagaccuaguagcuaauugucauaaaagcuguuaauacuguuguagaaauguuaucauacagguaagaugaucuaaaaaugugcucuaaagcuuguaccaaauuauuuggagcaaguucuuuaacuuuggccuuaagagaucaucuguaaaauaaagaugaucccucugucucuaauauucuaggaaucuaggacuaucuuagaaauuggauuucuuuuuaaaaacuuauuauaaaaguaacagauaauaggaaaauuuggggaggagaaauugccuuaucuuuaaaagugagguucuaaauacuuuauuacuguaauaguauuucauaaacucaaaaccauagcuacauuauaaauauaaucacuagaaucuuaaaauaaugcuguccccaaagucugucaugagauuacuucucaugagauuguuuuuguuucuagaguaguaauuccuuugguagaaauauguauugaauuacauaacuguauucaagccuauuaaacuuuuaaaaauaauguccauaauaguuacugucaaucuaacccuacucuaauuuauaaagguuucaguauauucaauaguacacccagauuuuuauugaaaaccaucuaccuuguguacuuaagcaugucaaacaugucaaaugauuugcaaauugacaggagaugacucuccccuccccccaccacacacacacacacgcacacacacacacacacacacacacacacuuacuuuucaccugaauuuucugauuucauuggccagagauucagaaacuuauuuccaguuaaggucuuaaagaccuuaagaggcaacaaagacuauacuuucagggaucauuucucuaguucaauacuacagaaguuucucugaagguguagcaagcaccagaaaccacgaggaaagugcaguauucucucccaagugugaugccgcccgucucuugauguugcuuugcucagcugccauucggcauugaugauuguuuuauccuuccuuaggaagagugagagggaaaggaugcaguccaaguggcucccauuuagguaaagaaaaagaagaggcaacaauucgaaacauucaguuuuguuuauuuugagcuaacaaauacugucuaacuuuuuucuccuucuucagcugacuauaccaaaaaucaucuuccccuaguagguuucuaauuacuuguagcccuaguuuaaugaaugucccaaacaaggugcguagcugcuaguaacccagcccacccaagguaggauccuccuagaacuuaaaaacauacauuuuccuugggcguaauauuuuuauucuuaggauuuaagcaccuauuuuggaagaacuugcacucauaguuuauauccuuuuauuaaauuucacauucuucugguucuugaaucgaacuuggugucaacaaagccacagccuuauuugagaaaagcauugucaucaucuaagucccuaaucuuuaucuguuuucagcuaguagcacuccagauagcaccuccuccccauugucugcucugugguccugauuuaaugcucuuuuaucuaagugguccuaauccugaguuuggucugagaaccacagucauaaauucauuccccacauauacugugaaaggaccugggcccugauccuucucucuuaccagcauuccuucugcccccuaguuuugcuuuucaccacuauucccucacagaauuguaucacugaugagagcuguggcgacagagugcucaccaugucucuuuugcaguuggugucaauaguuuucuuguuagcucccuccucugagucccucuuaauaccaucagccaaauguaccacucaccauuuucucaacaaagaccccauggcuuacuuuaggaaauccucagagaagaaaaaaauacagaauguggaaagaacaacgcugcuuggcucucuucuuuucaaacuauaagaguacauuuucccaugcaaacaaucuauaguucaguugccauauugugggcuacauauggacauuuauugucuaaacugaaaaauaucccacccuuauuacauuguuuuuuuuaaucagaaauguauaccaagauccaaagaauugucuuuaucuauuuuauuuuggaaauucagcuuguccuuaaucaaaaucuauuguuuaggguaguagcuaguugcaguggugccaugauuagagcauagguuucuaucccuagcugucaaaguaaaauaaagaggguguauaguauccuuuguaagucuuguauuaccccgaaugcauguaaaagcaaaucacagguuuuuuuuuuuuauaugcccuuugaaauuuucagguccacuuaauuuuggggggagagaggauacaaugugauauuuccauacauguguauaauguuuaaugaucaaaucaggguaauuaguauacccaucacuucaaaccuuugucauuuguguugguaauauuuaaaaucuuucuucuauuugaaaaaaauaacaaauuauucuuuauuauagucacucuacagugcuauagaacaauagaacuuauuccuccuauuuagcuguauuucuguauacauuaaccaaucuccauaucccgcccccacgccccgcaucccuuucuaccauucccauccucuaguagccacuguucuacucuccacuuccauaagaucaacuuuuuaaguuuccauauaugagugagaacauaggguguuucucuuucugugcuugacugacuuaacaugucuuccaggcucauccauguugucacagaugacaauauuucauuuguucuuccagcugaauaguauuccauuguguauauauauaccauguuuccuugauccauucaucuguugauggacacuuaguuugauuccguaucuuggcaauuauugugaauagugcugcaauaaauaugagagugcagauaucucuuccacauacugacuugcuuucuuuuggauauauacccaauagugggauggcugggucauauggguaguucuauuuguagcuuuuuuaaggaaccucuauacuguuuuccauaaugguuguacuaauuuacauucccaccaacaaugugugaguuuucuuuuucccacauccucaccaguaaguuuuuugucuuuuugauaauagccauucuaacuagggugaaaugguaucucauugugguuuugauuugcaagcaaaucacaauuuagauaacagcauucagguuuagagaauauuuuaacuaugacauggauauguguaaauaaaacauucuauuuaaaacauauugaugcuucagucauaaaucugucccauguagaucaguuaugaggauggaaaaagaaaaacucucacagaaaaauaguaauagucuuaauccucacucuuagggcaggaagaagaaaacugcccuugcucuguuuuauuccuuugcucaauucauuuucauguauuuauuuuucagccuuucccuacagcucuagaauacuuuaagacugauuuggaguauucuguuguucuuguuuaauaugaacuaacaaauguauucugaaucuuuguuuccucagucuauaccaaaacucaccuuuccuggugguuuacuaauugguuguaguccugguuuuaugaauguucccaagaucaaagguacucacacagcaaugaaaaguggaauuuuagcagcagaaucuauuuuuaaucaacuaacuagugaaaaucuccaaucaaagacaauagguaagaaauuccuguguaaaguauacaaaagaaaauugcuggguuauguguauuucaauugacauuaaaagauuuguauugcaucugucacuuuauagaaaguauuaauaagcaugcuaugcaaagaaaacuacauggcuuauucucaauaauuacagucagugauuuuuuacuguaauguucuguuuuauucacaucaaaaaaguagaaaaguaccagugguagccagccacgguggcucacgccuguaaucccagcacuuugguaggcugaggcggguggaucaucugaagucaggagcucgagacuagccuggcccacauggugaaaccccgucucuacuaaaaauacaaaaaaauuagcugugugugguggcgggugccuguaaucccagcuacuugggaggcugaggcagaagaaucacuugaaccugggagguggagguugcagugagcugagaucgugccauugcacuccagccugggcaacaagagcaaaacuccaucccccacacacaaaaaagaaaagaaccaguggugucccaccuaguuagaaacuauuacaaauaugacaguacugcauuuauauugcauacauguaauacacacaauuaagauaccucccaaauaccuaaguaucaauagaacaaacaccuuuacaaaaggcagaauuagcuaccuauucuuuagcaagcuuuguaaguauaggccuaugacucuucugcugugguggagagaaacagccagcacuuauaccuccguaaagcuuuaaucuaaaaagacccuuuaccaacuccagccacacuggcuucuuuacaguucccagaacaugccaagcacucccaccucauggucuuugcucacggcuggcuccuuuguucucuuucccuuuguuuaaauagcacucacaguggcccugccuugaccacaccaauuaaugcacaacacacagcacacacccaguucccccugcauggccuuuucuagcgcauuuuccaccuuuugguacauuauauuacuuacuuguuuaucaacuuuugucuucugccacuuggaugaaaacuccgagacuagagguauugcuuagugugaauccuacauaccuggcacacgguagcgacuccauagauauuugauaaaugagucuuaauucuuagaauccccaguaaauguuccucuaguuagagguauguaaccagguuaugccuucaaaucuuuguaggaauggaggccuagcguggggagaugaaguggaaaacagaaagggcaaaggguacuacuucagggagaauggaauagccaagauggagugcaguggcuggguagaaguuuuuuucuaauuuucuugucaaguaucguuccuuguuggaccaccagccauacuugaacuguaucauguguauauaguaccacacauagauaauacuggagccaguauaucaccaaagacuagauugaggguuaaagccuaaagaaaaggggaguggagccagaacaggaaacaaugacuggaaaaaguagucauguggaguccaccaaaagccguaagggaaccaauuuguccucuuuauuaagugcaugcaccaaguuuucucuaugaagugguggguuuguuuuuguuuuuagagacagggucucucucuguugcccaagcuggagugcagugcugcaauccuuggucucugcaaucucaaauuccuuggcucaagcaguccucccacuuuggccucccaaguagcuggaaauuacaggcuagagccacugugcccaguucugucccuucuucuaaggauaccagccauauuggauuagagacccacuguacuguaguagaccucuucuuaacuaauuauaucuacagccacuaauaaggucacagucuaagguacuggagguuaggacuucaaaaccuauuuuggggggacauauuucaacccauagcagguagaaauaguuugaguuguaaauuaugaaauuucuucacucuuacagguagcaugaacuuuuuaucuuaaagcuucuuucucgguuucacuaaaauuugaaacuaauuuuccaugcuaccaauguaagaaaucaaaugccuuacugccuguuaauaacauaucuauaucuaaugguugucuuuuuggaagaugccaacauuuauacaugaaagagccuucacuguggaccauguuuuaaaaaauuacuuaagauucacucaucagccaggugcgguggcucaugccugugaucccagcacuuugggaggcugaggcgggcauaucacuugagcccagcaguucaagaccagccugggcaacauggcaaaacccucuuucuaccaaaaacacaaaaguuaguagggugugguggcgugugccucuggucccaccuacucaggaggcugaggugggaggauggcuugaaucuaggagguggagguugcagugagccaugaucacaccacuguacuccaaccugggugacagagcaagaccuugucucgaaaaaagaaaaacuucacucaucagcuaucaaaguagcaaaauacuuagcguauuuuacacacauuugggcaguuucgcacuuaacauuucauguuuuuaauaaaaggacuccauguaacugaauaugaggacaauuugaagaacucauggguauggaaagagcuauauucuguuagaaauauaagaccguccugccacggaguacuggguguauauggagggaugauuuacacuggaaucuuuuacuggauauugagaggaauggagccguggacucugaaacauaaagguaauucaaacaagaguaugagugacaugaucauuaaaaauucaugaaugggaucuguuaauuagagaaagugauuguuuuaauguuuucaacuuggagaaauuauaaauuuagugucuaagaacaguauauuauuacuugagggcuagucauauuucuuuggugugauaauauuuugaaguuuuuauacaaauaggcuuaagaaaaaguacuucaaaaucauauuuuguuaagcauuucccucaaaauuguugaagguucugacuuugaacggcucaagccagccaaggauugcacaccuauugaguauccaaaacccgauggacagaucaguuuugaccucuugucaucuguggcucugagugguacuaaucaugaacaugaccagccggcacacuuaaccuuaagggaugacaguauaccuguaaauagaaaucugucgauauaugaugggcccgagcagcgauucuguccugcagguaauaauuuccaucuauuccuaaauauuugcuuuaaacauuuuaggaaugugauuuuguucuuuuaaaaaaugauuucuguaucuccuuccauuccuuagaaauuguaaaugacuucauccagcuuccuuuaggaaacauacuuuuaacuacugguuuuguuaagccuaguucagauaacauuucucaaaaaaaaaaaaaaagcccuuugucuacacucagacuaagaugaagauucuugaaaaugaaauaccucucuuugcagguucaugugacuauuuaaagucauuucugucauggcagcucaucuguauguauuugggugcauguacuagaacagcacauuaugauuacauucaguccaaggaaugcucugaaacuuuaaauucaccaugaauauucuuucagugcugagcuuucaacugaaauuacaguaauaggaaccaggucucaaaugauaugguagaacaaaauaguauuccgauacucgaaaaguaguacauucacaaaagaagauacacugugacuuggucuuuuggcuuuugucauuacaguggguugaaaacucccugagguuaaauuugguuuuuuagcuguaccguuaggcuccucuuacccccagucacccacggucugaaaauaagaaaauuccagaaacaaauaauucuugagucuuaaauugugcacguuaaguuuuaaauuguguaccauucgggcuugccccacccugaaugugaauuaucccuuuguccagcauauucacaccuaacauucguuauguuacuugguagccaucuaaguuaucagauuuacugucacauuaucauacuuguguccaguaacccuuuagaaauauccccacaacgcaagaguagugaugcugacaauucagagaugccauaaagugcuuccuuuaagugaaaggagaaaguucucuauaaagagaaaaaaauccuaugcugagguugcuaaggucuaugguaagacuguaucuucugugaaagaggaaaaagaaauuugugcguuuugcuguuggaccucgaacuguagaaguuauggccagaguguggcaagugcuuccuuaagauggaaaaggcaucacauuugugggugaaauacaugaacagaaacguguucugacugacaauguaaguugaguacuaccugagguuucaggcgucuacuggggaucuuggaacuuguccccugugaaugagaggaugacugugaauaagggaggacuucgagguuguguggaacucaaacacucagugucgaguacccuugauagugagacaacucagcugaauaccgcuguaccuccuuuuauuauguacauguaauuuacacucacaucaauagcaaugcaccaaggucuucauaaucucuauggguaagcauucagaaagcaaccuuuaagguuucuguggcuacucuuuccuuaauuuuuacuuuugaauuuaaaaauuuuuuaaaguuaggcacuucaauauuauuuauuuuuacuuuucaggaguuuaugaauuuguaccuguggaacaaggugauggauuucgguuacagauaaaugcucagaacuguguacauuguaaaacaugugauauuaaagauccaagucagaauauuaacugggugguaccugaagguggaggaggaccugcuuacaauggaauguaaacugcagcuagccaguuucuuucaaguauggcaagcuaacguuaaaauguuuagagauuaacagauuucagaaugucuuucugcauauuacugaacagaauagucacaaaaugauuaucaaauaaaaauuuuauacuauauguaagauugucccauaaagaa

SEQ ID NO: 191301 - RNA, 7180 nt, Homo sapiens
ugcuguccuuuacacaauucuuauucauuugggacacagacagggagcuacuucuacuuaucaguguagcaagacuacaaagagguuaaccgaaggaauuucuucaaaggccuccaaggaauaucuucuaauuuguauucaggaccuucccaggcugggaacagagaugccagucaggauuuaucucuaggcuaggagcgcaagcucauguuuauucauucauuugguagcgcuagaaacuggcaacugugggcuaaaucuagcccauagaccuaaauuuauguuuuucuuaaccuucacaauauuuagaaaucagagcacuucacauaggucuacauuuucagcuucuuuuagcaggaaugcuccuucaaaggguaucugcauuccuguucccacagcccccagcauuccuuguccuuuagcugccuggcuucucuaggcaccugaguucaugguccuggguuagaagcugcagaaaggacugugcugacucccucaacuaaggggugguacuaccgcuugcuccucucagcagcugacgucccagagaucaguuuccuuucugggagggacuccucauugaggggggugcagaagaccugcagaccugcaucaacccuggucuuugaggcuucaacuccugaaaaucaaucaauugagcccuaccuuuaccagaccuuuagucucucuucuucuguuucuuuuuggcuuucuggacagugcugacuccagcucuuuccuucuugggaugcugcugccucuuccucuuaccucugcugcuugagccagugugugcucugcucucugcuucccuagccccgccauccuucucaucccuuacauccaagauguccuccuccucuugaugcugcugucuuuucuucuugcuuuuccugcuucuuccaucacugcaugcucugcucucugcuucccugguuccaccaccuaaaaguuuccucaccucuaucuucuagguucaaguccuccuccuccuguugcugccucuucuuucuucggcugcaugggucagcauaugcccugcucucuaccuccucuguccugacacugccugcagccuccuugccuuuuccuccuuccuccaagacccccaucuucuccucuucauggugccaccucuucuuuuucuucccuuuccugagggacugauugguuugcucucugcuauucaauuccccaagcccacuuguuccugcagcguccuccuucucauucccuuuaguuguacccucucuuucaucugagaccuuuccuucuugaugucgccuuuucuucuucuugcuuuuucugauguucugcucagcauguucugggugcuucucaucugcaucauuccuuucagaugcuguagcuucuuccuccucuuucugccuccuuuucuuuuucuuuuuuuuggggggcuugcucucugacugcaguugaggggccccaggguccuggccuuugagacgagccaggaaggccugcuccugggccucuaggcgagcaagcuuggccuucauugugaucccaagacgggcagcccugaaacagacaggguccaagucaaagcgaggguaucgggggaaaugggccuaguccuuaagccugcagggaaaguugguggaggguaggaguggggagcugccuaucuucaggcaauagauggguagguaauaggaaucauuucccugggguaaaaagaaccaagagguggcacaggccauggucaaagguggggagaaaagggagcucaaggagcugaccacuacuuacuugugugcuguucgccccucacaggcuuggagcagcaucucaucagucagacuguuaggggagaucagcaguuacaaacagaccugguggaaaggcuugaccucuccuccuucuaaaacauuccuucaacacugaauucuuguucaggaccuggcacuuuuugagguacuagggauacaaagauuaguacaacacaguuccacccacccccaagaagcccccagucaagcauuagauuuagcccuuucucuugccaucugaagacaucucuucccacauuccccaagagcuaaaaugaagucucacaucuuuggggacuuggaccccugguugucgucaucacugcagcucuccaagucuuuguuuggcuucucuccaccugaagucaauguagccaucuaggaggggucauggggguagauaaggccuucucaacaccaucaccaucccuauucccuuguggaagcccccuaagaauuuauagcuccaggcagugguuugccagcccccaccauugcuccuugaggagccacagggaggugugccauccugcauacucgaacuuggauaggagaugggcugcugcugcugggaugugcagcagcuuuggccucucucacccacagcuggcuggugagcagaacaagaagaggaaaugcucugguucaucaggucuucacaguggacaagugccagugacugacaguaaagaugccccgcuccaccccgaccauaguaccuguucacaguaccuucauuuaaucagauuaauugagagucuacuaugggccaaggaguuggggauucagaguggaauaagaaugagaugggcccagcccagauggaaucuacauaggcaauuaugauggaaguguugccugugauagaggaaggguacucaacucagacuucagagaauggcuucuaaaaguaacugauguauaagcugagcucuggaggauaagagaaacucagaagguaaagggggaaagggagaagaaugucccaagcagagggagcaacaugugcaauaaccugaagauggaagacugucguaccuucaaagaaaagaaacagauuggaaucuguuaugcuaaugguuaggcuaaaguagugguccuggagaaaagugaagagaugaggcuggagauggcaggaacaggcaugcagagccauauaagccaguccgauaaaucuggauugugucauccuaggucaaacaagacccagugacaugaugacauuuauguuuuagagagaacacuggaugcuuuguggagaaguccauccuccacaaagguugggguggggagugagacuacagguguucuuaggaggcugcuggagaaagaaauuaggcaagagaugaugauggcccgaagugggguaguagaugguaacagagauguagagaaaugggaaagauuugcuagguaacauguauagcccuuagcacauaaugaccauuacauguuagcuuccuccuauugguacaguagaaaguggaggccugaaguccuggguuccaguccuguuugccauuacuagccagcugugggcucuucagcaaaccacuuuucacccuuuuagccacaucugcaaagcagggaugguccagauaaucucucaggucuccucuggcuucuaaguccuuugaauuagauguccccuggcccccccaaaauuuggcagcuccugacuuaagagacuguacccuaccucccacgcccuauugcugcucccuuaacagauggcaggauccacggaaccugaagaucucaauuccugcugagggucugggcagucuaaguaagcaacagcaaggcuggucacaggaucccacuauguuaggaaaguucugagaauugauaaggcauacaaggcaacuguucaggccccagggaaaccagggaagagaaaaaggauggacucuguuacccacagccucuaauaccuucacaaacuucugauacagcaaguugggcuugggaugauuauaacggguggucuccuuagaaaggcuccuuaucuguacuccauccuguagagaauuaucaguaccagugaaugggugacauaucaugacugccuacgccacaggucccaggcccucuguuucaugugcccaucuaucaagagcucauaccugcccaguuuccacuaccaaguuggccgcagucuuguugaagagcucauuccaccagugguuugugaacuccuuggcagggucauguccuaccugccaggggaauaaauaugagcucugagugccugccucaccugcccucaaggguccccucucccacacaugcuaaccuuccucaguccacccagucuuaccccaugagugucuugcuucagugucacccugagagccugagugauaccauucuccuuccggccgaggccuuugccugcagaggacagugagcgauuuggcuuauucuccugccugcugugagaccucacaaggcaccccccacacaggccucuugccauuccacacaccugacauugggguauacucuguaccucucagaagaccuccuagcgcacuucuuucuaguaccacuccauauaguccccugccuuugugugagccugaacuaucucuuccuucaaauucuuuugguagagagcccauaucucuuuuucccuccccuaguccucccaaccaccacuucuucauuauccacugucaaauuucuuccuuucuucccuuuucugggaaaguuagaaauuuucuucugcaaauuucccuuuaaacuagcuuuuccuccuuuaauuaaauggacuacauggggggguaauccaggaugauggcuuuccccugggcagaugguaggcagggagcugggggauguggaagaggccccauggggaucaccuugaguccauccaugcuuuagcagcugcuccucagcaaacuucaucccacgacucuugaccucuggggugacauucauggugagaaaaaagucucuauccucagacucucaccagagaagaagaggugauaucauccuuuuaagaagaaaguagaaagugcccaaacagccaucaguuccauccugacugcuuguuaagaauucucugcuaguugggugcaguggcacacaccuguagucccagcuacaugggaggcugaggcgggauugcuugaguccagccugggcaguauagcaagacccucucucauaaaaagaauaaagcggccaggcacagugguucacauuuguaaucccagcacuuuggaaggccaagguagaagaaucacuugagcccaggaguuccagaccagugugggcaacguagugaaacccugccucuagaaaaaauaaaaaauuaaaaagaaagaaaaaagaauucucuuuccugagccagagacagaggaaggagguggccuggucuuuggggagcucccuaucuggcuacagaaagagcauauagagaagucaaggaggaauggugucaauucugauaccuaaguuuauggugugcucaccacaugccaggaugugcuaagacuuuacaaagauuauuucauuuaaucuucccagcccauucagggaaauauuagccuauuuuacaaaugaguaaaguaaggccuaaaaagguuaagugacuucaaggucacacagguaacauguagaauucaagcccaggcagcuugucugcagaaucuguacuguaccacuacauaguaucucccaaaauauauuaccuuguaaacacaaagcuaaugaggugcuuauuaaccugagucauaagauaaugguacucgguagagaccagauccuguacuuaugcuucagcauuuacacuguccucuuggugugggggcuacacacuucucccacaccacugcaguauuucagucuggcuggaguuccccuuuugaaaguguccaacuuaggaagggcacuccuauugagcacuuaaugcauaacagguggauuacacauauugccacacugucauauuaacucagucaaucuuuuuuuuuuuuuuuuuuuugagacaggguugcucugucgcccaggcuggauggaguggagugcaguggcacgaucauggcucauugcagccucaaacuuccaggcucaagcaauccucccaccucagccucccaaguagcuaggaccacaggcacaugccaccacgccuggcuaauuuuuguauuuuuuuuuguacagacaggguuuugccauguugcccaggcuggucucuaacuccugggcucaagcgaucugccuaccucugcuuuccaaaaugcugggauuacaggcgugagccacuaugugugggcuuaacucauuuaaucuugauaguccugugagauagauauuauucuuauuuuacaaaugaagaaaacaaggccuggguuucuugccuaagguuacauggcuaguaaaugauggagcuggaauuacaugauggagguggaaugagcccaagucgccugacuccaaagugguccucugucuuucuuuuuuuuuucuuuuuugauacggagucucacucugucacccagucuggaguacaguggugcgaucuuggcucacugcaaccuccaccucccagcuucaagcgauucuccugucucagccuccgaguagcugggacuacaaggcucaugccaccaugcccggcuaauuuuuguauuuuuaguagagauaggguuuccccauauuggccaggggcuggucucgaacuccugaccucuggugauccaccugacucgaccuaccaaagugcugggauuacaggcgugagccaaggcacccggccaaaaacugauguucuucaucacuacacucuucagucucuuacagcucuuugugcuuucuccuguaagaccacacacagccuaacccuugucgcaauaauugaaaacuacaugcccuggaaguuaagagaccggcuuuauuccgccacuccagagcacguaacgcggcgccagaacucaagaauacauucagucguuauuuguugaacugaauggcauaguuaggaauggcuuuaccggauuuucaguggauaacuggguagaagcugugcgccccagucuuucugaaaccugugaucacacuucgggcacuguccccucuacagucaaucuguguuuucagaaguggccccagguucacucgucuuacagcaguccuaaagagccggcugcccuuucccuaggcuuccuugcucuugagggcuaaauuccagcccuccuaccccagugccacuuggguaaaaauacucugcuccucucacguuugcuaauaagcccgggcuccgacuaccaccguucgggggaagggagccccuuaccgucauugcuggguccgcuccgcggaaacaugugccggaccugacuugugcgccgccaucuucccggaaaugccguuuu

SEQ ID NO: 191302 - RNA, 11920 nt, Homo sapiens
ucaauguggcauuuguuuuuauuagaaaaccccuuaguaagcacuucucuaacccagaauagacacuggguauccuccaagagucccauagcuuucauuucaucuuccacccucuucugagagggggaggcaggggauagggguggugucaggcagucuccaaaaugccccuccuagaccccugagagaauucacguugccagcaauaaaccaacagcaccucaguggggcaucagagggcccucuaggcucaaggcuauugccaaaggcauuccuguuuauggcuucacgauggaaccaaggaggcucucgcagacuccuagggcugguccuucacuauggcugagagcagggcaggauccaggagaaaguggccaagggcuaagagagaagagauugcauuuaagauacccuuuggagucuggaaagcaccuggauuucuugggagaggagccuggauuucuugggagaggagggcuguggaagccccaaucaguucuucuucguuuugggagugucauauuuccucuugcuggaguaccacaauagcagggggaugccgauggagggaagggucaugaccccaaaggcugcccaguccagcuguaaaggaaaacaaagaccuugcuuagaagucuggauuagggcacaggagaagccagggaaaauaugaguccaaugagaaagggagcagucuagcccaaauuuauuuauuuuugauacaaagucuuaguuuuuuuuuuugagacggagucucgcccugucaccuaggcugguaugcaguggcacauucucagcucacugcaaccuccgccuccaggguucaaaugauuuuccugccucagccuccccaguagcugggauuacaggcgcaugccaccacaccuggcuaauuuuuguaucuuuaguagagacuggguuucaccauguuggucaggcuggucuugaacuccugaccuuaugaucugcccaccucggccucccaaagugcugggauuacaggcaugagccaccgcgcccggccgauacaaggucuugcucuguugcccaggcuggaguggaguggcauggucacggcucaccgcagccuugaucuccugggcuuaaguaauccucccacuucagccuccugaguagcuaggaucacaggggcguaccaccacaccuggcuaauuuuuuuuuuauuuuuuguagaggcaaaauaucacuauguugcccaagccggucuccaauuccugggcucaagugauucuccugccuugaccucccaaagugcuggaauuacaggugugagccacaacacccagccuaaauuuucuuaauuuuuauuuuauuuuuuuagagauagagucucacucuguugcucagguuggagugcaguggcacaaucauagccacugcagccucaaacuccugggcucaagcgauccuccagcagagauuauagguacacaccaccaggccuaacucagcacaaauuuuaagcagaacuuuaggcaagaagguuccucucugaccaauccugauauagaauggcucucuaaagaccaaucuuucaagcugugaaaccaaaggacucacccgacccaaaccagacuggaagagaagcuucuguuccagacaauuuuugagaauggagaugcccuggucuugccccugacagucaagccaccuaugaucuaacccuuguuuacacuucaggcccccucuuuuccauuccuccaccucacauucugcccuucagccuugauaaacuacuugccauuccugaaucacaccaugcuuuucucaaucucggcugcucucucuccucaagugccugcccuuccuuaccuccuccagaaaguccccucucauuagauguuccugcugcaggcuccuccagcaccuggcauauaaccucuaucacagcauuuuccccauuuaccuuuuuuuuuuuugacagcguuucgcucuuguuguccaggcagcuagagugcaguggcucgaucuuggcucacugcaaccuccgcaucccgggcucaagcaauuccccugccucagccuccccauuuacuauuuugaguccucuaugagcucguaagaucuuguuauuuucagaggcaggguuuugcugugucacccaggcuagagugcaguggugugaucauggcucacugcagccucaaacucuuggccgcaagugguccucucgccucugccucccaaagcacuggcauuacaggcaugagccauggugccucgccagccuguaagaucuuuaauggaagggacugugucuuauucaucacuguguccccaaagcagagcacagaaugagcacauaaucuggaacaucauacuuauucacugaaugaauuccagcauucaguacuucaggcucaucuucaaaaaauucuuuccuagacuagaccacaguaaaguucccacuuaaccuacccaaugaucuaugacccucugaaucuaaucagauuuuuuuuuuuuaaaccucaaaauagacccaggaguuuaagauggguaucuacucaaagaugggacucuacuuaagucaguuuuaugguuuuggcaauugugaucucauugccaaaaaucucuggacauggcuaaaucaaucuauuugaugaguaucuauaucagacaccaaaaaacacacagggcaagaaccaaccaacaaaacaaaucuguggaagccaagaggguccagaaccaaaagggcauucucauaccaaggaacugaugagagagaacacuagaaagcuuacaaaaugaggggagaaucgccugucaaacucccgcugagccaggauuccucccuguccaggugcacugguagagccaaucugaaaagaagaaaagaacgacauuaagggaaguccaccucaugaaguuccaccucaucuacucugagaaagggcagucccaaccaacccaacucuaugcauuagagucuuaguucccaaaggcucagaagaacuucaagaagaugagggaaagcuuuuggcuagagagaguuggaugauucucucuuaguguguuauaaagaggaguaccuaggagccagaagaccugagaaauaccccauggagaacauauauuaaacaagguaggccaggcaugcaacugaaauuaaagccaaauucuucugucugagccucagacucugcaaagagugaaguugcucaccaccacuggucccucuacagggcaaggugugcguggaaugacuuacccuugguaaucauuuacuuaauccuccagcaaaaauccacuacuucacaggguuaaugugaggcucaaaugaaauagcaaaaauauauaaugaaguauaaagcccuacccaaauguacauuauuagaggagggguugagucugguccacauuccuuugucuuggagaggaagccaagaguuuggagcacacugcaaacaacuuuauuccaaaguggcagcaaagccuuugauuuuaugucuauuaacccaucaacuaccagguagaaccaaagaguccugagguugguucugaaagcagaaaugauaccggaugugaaaacaccgcuagguuuagaagaauaugguuccauguaguuuaugaaaaacgaaaaugcagaaggugcaaugaauguuaguucuuuucauucuaugguugacuguguuaagucccuucccuacuguguacuaauuagccuacagcccuacugguauggaggaucacacauuuuggcuucauaaauuuauacauuuauuuggcuuuauacauuuaugacuuaagcuuuuugaggacuuggacaguauauuaauccucuugguauuccccagagucuggcacauugcaggggcuucauaaaugucuauugaccuuuacaucaaucaaaagacuguuuacuacugaguuucuaucauauaugggaaaaagaaaucuaagacaguuacuggccucagggaguuuauaauuaaauugggagguggggguggggagagggaagaucuauaaauaagaaacaaacuacugaagacagugauuaaauguucaagugccauagacuauaagugcuacagaaguuuagaugcagucaauauauguuuaugaaagaaugaauaguggccgggcacgguggcucacgccuguaaucccaguacuuugggaggccgaggcgggcggaucacaggucaggaguuugagaccagcuuggccaauauggugaaaccccauuucuacuaaaaauauaaaaaaguagccgggcacgguagcacacaccuguuguccuaguuacucgggaggcugaggcagagaaucgcuugaacccgggaaguggagguugcagugagccaagauugcgcuacugcacugcagccugggugacagagugagacucugucucaaaaagaaaaaaaagaaaaaaagaaaagaaaaaagaaaagaaugaauagcaaagagcaauaugaacugaaggcagaaaacaaggagacauagcucaaagcugggucuugagaaggcuucagauauaauggaguggagggaaaaggguacuucaaacagaacaaaggcacaaaggaaagaauaaggacugaguugggggagaagguaugggaaguagcuuggccuaauuaggauguagggucuguaugggcagagugggagagaaggcuggaggcagaaaauagcuagacuacuggaggggggugcagugagaggcagaaaagcucagcccugaugccguaagcaggagcaaucuaagcaagggaaggagagaguaacaguggagacugggaagaaucugacaguggcagagaagacagaucagaaagacaaggacaucaguaggcagcaaaugacacacuccagaugaaaaggaaggcagaaggaaugaagagaaggggaaggccaugguacaccucucccauccauuucaaucacucuaguccagaacuuuaauuugaaacauacuuccuuaggacaauaccaagugucugguuaauguuaucucccucagaauuuaguagcuacuguguaaauuuucuguaagagguuuuuguuuuuacaaucuauacuuuuuagauggauauccaucaccuuaaacauuuaucuuuuuuuugagacagggucucacucuguugcccaggcuggaaugcaguggcaauaaaauggcucacugcagccucaaccucuggggcucaagcaauccucccaccucagccuccugaguaccugggaucacaggcacgugcaccaugccuggcuaauuauuugaaaugggggucucaccauguugcccaggcuggucuccaacuccugggcucaagcaauccaccugccuuggccucccaaaguacugggauuacaggcgugagccaccacgucuggccgcauuuaucuuuucuuuaugauggaaauguucaaaugcuucucaucuggcuauuuugaaauauacauuagauuacuguuaacuauagucacccuacuaaacuaucgaacacuaggucuuauucuuucuaacuauauauauauauuuuuugagacggagucucacucugucgcccaggcugaagugcaguagugugaucucggcucacugcaaccucugccuccuggguucaagugauucucuugcuccagccucccaaguagcugggauuacaggcgccugccaccacgcccagcuaauuuuuguauuuguaguagagauggggcuucugcauguuggccaggcuggucuugaacuccugaccuuaggugaucugcccaccucggccuccaaaaaugcuagauuacaggugugagccacugcgcccaguccuaacuguauuuugguaucuauuaaucaaccucucuucaucccccucuuacccccaccacaagagauuuuaagggaaggcagauccaaauuccauccagcuaaggguuugggcaacucaccacaacgggcccauccuccugggccagguaaguaauuguugccgaggugaaguugaaauaaccagccuugagagggcgcaggaccacagugugggagacauugcuagcacuggcucaagaguuaaggaacggaaagagaugaagcuaaaguuguagcagccuuucaaccuguggacuaaaugcaccacuuacaaaacauuugccaauacaugcugaucucaugccggcaauauucugcaggaaugaaaaaauauaggcuucuuugccgggcaugguggcucacgccuguaauccuagcacuuugggaggccgaggcggguggauuggcugaguucaggaguucgagaacagccugggcaacacggugaaaccccgucucuaauaaaauacgaaaaaauuagcugggcauggcagcaugcgccugcagucccagcuacucgggaggcugaggcaggagaacugcuugaacccgggaggcggagguugagugagccgagauugugccacuguacuccagccuggguaacagagugagacuccgccucaaaaaaaaaaaaaaaaaaaaaaaaaaaaaaauauauauauauauauauauauaggcuucuuuuuaaaauuuacugauuuuuuuaaauauuaaaaaaaaaagagagagagauggggucucacuuuguugcccaggcuggucucaaaaucuuggguucaagugauccucccaccuuggccucccaaaguccugggauuacaggcaugagccaccauauggggccuaggcaucuuuuuuaaaucuaaaguguaugguauuuuuuuccagcuaaauuuuaagggucccauguuauacucagugucaugguuuuugaaguaaacuuccaaagcaauauauguuauggauaaaaaaauuauagucacuuggccaggcaugggagcucaugccuguaaucccagcacuuugggaggccgaagugguuggaucaccugaggucagaaguucgagaccagccuggccaacauggcgaaaccccgucucuacuaaaaauacaaaaauuagcuaggcaugguggcgagugccuguaaucccagcuacucuggaggcugaggcuggagaaucgcuugaacucgggagccagagguugcagugagccgagauugcaccauugcacucaagacaagagcgacaagagcgaaacuccaucucaaaaaaaaaauuacagucauucaaucagugcuucuucuuggaugauuaaaagaaauuauagucacuuaagcucacagaaaaucuuuuuuuuuuguuuuuuuuugacagucucgcuccgucgcccaggcugaagugcaguggcaugaucucagcucacugcaagcuccgccuccuggguucacaccauucuccugccucagccuccagaguagcuggaacuacaggcgcccgccaccacgccuggcuaauuuuuuuguauuuuuaguagagacaggguuucacuguguguuagccaggauggucucgaucuccugaccucgugauccacccgccucggccucccaaagugcugggauuacaggcguaagccaccgcgccuggccaagcucauagaaaaucuuuuguuaacuauaauugaaggaaauuauugaaaauacaaaaaaaaaagacaaaacaaaaacaaauacaaagaccacauuuacccucaccaauaaaccuaaacguauacauaauuauuauugauaugauuuggaucugugucccugcccaaaucucauguggaauuguaauccccaauguuggaggaggggccuggugggagggaauuggaucaugggggcagauuucucccuugccauucuaaugauaugaguucucacaagaucugguuuaaaaguguguagcaccuccccucuuacucucuuccuccugcuccagacauguaagacgugccuauuuucccuuugccuucuaccauuauaaguucccugaggcauccccagccaugcuugcuguacagccugcagaaccgugaacaaauuaaaccucuuuuuuuaaaaauuacccagucucagcuuauucuucauagcaacuugagaacagauuaauaaaauacaauuaauuauuauuuaagagacuaggucucacuuugucaccaaggcuggaguacagcagcacuaucauagcucacugcaggcuugaacucccaagcccuagcaauccucucaccuccaucucccaaguagcugggacuauaggcaugugccaccgcaccuggcuuaaauauacuuuaauucacaggaagaaaaauaccaucuaauucaauacucaggagauaauugguagauuagaauaagagacucacugaauaagagacuuuaaaaggucacccagauccuucaugcuagcaucccagugaauuucuuuuuuuuauuuuugagacagagucuugcugucgcccaggcuagagugcaguggcgcgaucucagcucacugcaaccugcaccucccggguucaagcgauucuccuaccucagccucccgaguagcugggauuacaggcucccgccacugcgccuggcuaauuuuuguauuuuuaguagagacgggguuucacuaucuuggccaggcuggucucgaacuccugaccucgugauccacccaccuuggccucccaaagugcugggauuacaggcaugagccacugugccuggccugaauuucuuuuaaaagcaccuuaaauaccuuuguccagccacaaacaucuuuauuaagugucuauauccucccaguauaguauguuucagguuuuuuuuuuuuuuuuuuuuuuuuuuuuugacacagagucucacucuguugccuaggcuacagugcaguggcaggaucucggcucacugcaaccuccgccuccuggguucaagugauucuccugccucagccucccaaguagcuagacuauaggugcgcgccaucaugcccagcuaauuuuuguauuuuuaauagagacaggguuucaccauguuggccaggauggucucaaucucuugaccuuaugauccacccaccucggccucccaaaaaugcugggauuacaggcaugagccaccgugcccagcuuguuucagggucuuauaaucugaacuucaguauccuccuucuucaugucuacucuaaaucaugcucacacaauuuacaccaaccucucuugcuccaucuuauccagagagaugacaggaggacagccacacauauccagccuauuugaaguaccccugcugcuuugcaggcaaggcucucccugccccccgacccuucaucaccaagugccaagaggauacggggcaauccggucccauuugacauugagcauuccagacacaaugccaaagucuucuggagggaaggaaucaucagauaguuccacgucuaaugcagcacuagaaaauggaugaaacaaaaaggguuaguaaguaauggauauaaaauuaaagcaggccgggcgccguggcucacgccuguaaucccagcacuuuugggaggccgaggugggcagaucaccugaggucaggaguucgagaccagccuggccaacauggugaaacccugucucuacuaaaaauacaaaaauuagcugggcgcgguggugagcgccuguaaucccagcuacucgggaggcugaggcaggagaacugcuugaacccugggaggcggagguugcagugagccaagaucgcaccacuauacuccagccugggacagagcgagacucugucucaaacaaacaaaaaaauuaaagcaauaguccgggcgcagugguucacaccuauaauccuagcacuuugggaggcugaggcuggcugaucucuugaggucaggaguucaagaccagccuggccaacauggugaaacuccgucucuaaaauacaaaaaauccugucucuaaaaauacaaaaauuagccaggcauggugguaugcgccuguaaucccagcuacucgggaggcugaggcaggaggaucacuugcagcugggaagcagagguugcagugagcagagacugcaccacugcacuccugccugggugacagagugauacuccaucuaaaaaauaauaauaaaaaaauuaaauuaaagcaauaaacaaucaaaccugccugcuucuccaaaaaaaucagaauugcaaaagauaugaguaauauagcaacuugguucuguugcacugaagaauccaggucaaggacuggauucuauugcucagaagcaccaaaauaaucaaguauccaggaggcaauagguccaaguucauccuugccucaauuuuucuucauguacaugccuauguguguggagggagggagaagaggaacacagugaauacagaggagaaaguuauaagggaauaaaaugaaagaaaggcaacaaaaaugcucuaggcuaaugaaagaaggaaaauuacacuuuuuuuuuuuugagauggagacucggucuuguggcucaggcuggagugcaguggcgcaaucuccggcucacugcaacuuccgccucccggguucaagcgauucuuuugccucagccucccgaguagcugggacuacaggcguccgccaccacgccuggcuaauuuuuguauuuuuaguagugacaggguuuugccauguuggccaggcuggucucgaucuccugaccuccagcaauccgcccgccucagccucccaaagugcugagauuacaggcgugagcuaccaugccaggcuggaagaugacacuuuaaaccccugagguaacaagggauuguguauuuucugugucuuuaucuuucccuccuaguuuuuccacaauucuugccacuucccuacucuaaaauucuuccaacccgaaacgugaaagaugguuucuuguagcuuagguaagaauguccuccuuuccaaaaguagaucccgaaguguauucauucacucaauauaucugaugcuggaagugucccaaagagaaaccacuacccaccaauaugcucccuauucccaucugaaaacuaagaauccagaaauaggcuuaaucuguaacucuagggccucgaguuaccuugagccaacauuguagauguuguacugcaaggucaggucucgucccuccacggcguaucuguucagcagugauuuggaagccaaaagccuggcuccuuccucugcuugagugacagcaaauagagccaacaccacaaaugacagcagccucaucuuuagagaaaaaagcaaagugaguuaucaaaccaaguacgucaaauucaccaaaauccucuugacagcgcucccguagaaagcuccuucgaugcuaccagaacagcagccccuuccacagaguaguccauaagccaccagagcagacccguucuccagacucuccuaccaucuucacccugcagcccucgaaaaaccgguacaagcaccaauauaucuacugcccucuuccugucagaagccccgggaugcccaccggcugguggagucuucugaggggacaccauguggccagagcagggcuuccuuggggugccugauuucggccgaucucggaccugcaggagccuguagcuuucccucacacaggagugcccacagccuucccgcugcuccccuccuccuuggccacagcucuauugggaucccaccgcggacucgcgggguccuccucacaucccuguaccccacucuccaguccagccccugagaucccauucguccucgccugucacaucccuuucuuggucccacgggcgggggggcgggggucaaucaccucugccccccgccucccgccucuugcaagguuacacguccuccagccaccgcguccucugcccuucccgcccuccccuagcuaacccccagccacggggugaugcgcggacacgaggcucucgccucucccguucggacgcccuaagccuccggacuuaccguuggcaucccaaacgccuuuccggagccacaaagacaggaagagagcgucagcauccgaaagaccggaaauaagcacu

SEQ ID NO: 191303 - RNA, 227273 nt, Homo sapiens
aggaguggaagguugaggggggcgcuaggcgcccuucgcucccucccucuggaggagcugccgccgccaccgccgccacucugcugcugccgccgccgccgccgccgcucccgccgccauuuuggguucgcuuugcggaggggagacgaucccagucucgguugcgggacccgccuccccucaguuugcccccuuuagccuuccaccuuucccuucuccucucucgcauuuccgccagucagcuuacccgcuggccgccuccugacaagcgggagggauccgccguggacccagggaagcggaggagccuggcggccacccccucuuccccacuucccugcacucucaucgcucucggccucggccucggccuccgacacggugaguagaacgauuugggccggcauucgggccuaagcacucucucagcgauugaauccugggcuuucugggagccacugucaucucccggaccuggaucucugagagagcaguggugaagaugggggaggggagagcagggagggggauccugagccuaccgggaagucccuccaggcggggugaaggggugucccugacaggcagacucccggagggggcugggaaguaagcgaguggaggcggagucggcugugccccugacagguuaguuuguguuuguaggcaugaucggagccucccccauaguccaguuuguguguguuuaauuaagggauaagaguggucgaggacacgaucuugagaggggauuuuaccugugugacaaggucuguggugucccugccgcguugaacgguaugugggaacgacaggaugaucucaguguuguaaguuuaauaaaugucacugguuaguuuguacauggaaagagauguuuuuggucuagcagacagauggucuguugguguguagcggcuguguugguguguguaugugaggauggcaaguguuuccguaagaguuugccuuuauuuguguaaguguaauggaguuccccuuauaaguuagcuuauuucuugaauaaauguugggagguuccuugcagguugauauguguguguauuuuagggauugggagccccuaguuacuuguugggaaagagcggcaaugguaguguucuguacagcaugugucugugaggucagggaggggagaaacuuggcauagccaguuguggucuuaagaauaguuugugccuuugguuagagugaguuguguaaaugugaagggccaaaauaucuuuaacagaaucauuacuacaaaguuguaaagaauggguggccuuauuuguugucgcggguuuauaguaauaguuuacaauacaauaagaaagcucuuucaguuuuuuugugauacugaaucucugugaaaaugguaggaugcuuucuuccauuuuacaaaauaggaaauuuaggcauaaggagagaacuucuccaaggccgcauguuaaauuggugacaaaguuggaacuguaacucccauauuuucacuacuacugcagcaguauauucagcauaccauggugccucaggaagucuuugucggcaaaucugaguaugcuggaaagauaggagcacauaagacugguuggcuuguauuugggggagaccgauugugucagauauguauguggaacguagcuguccuugccgagucugaccuguaugaaaugcauauccaugacuauauuauuuuggauuuauggaggaagcagagcauuucugacacuugagguuguaugugugagggagagaaggcuuucacagcuuaacuuguaccagagcagcugcaugggugcugacagcuuaacuugaaaucugugggaggaaggauccuuuuucauucauucaacaaauauuuguugacugccuguucaauaaaugguccaugccuuggcgugaggauaaucaaggugucucuguaaauagccuggguacaacgugaggggaguuguuuugacagugguggguauuaaguugagggaggcgguguggaauuaaaaccagagaacuguuuuuggguucugguaauuguuaauacaugugccuguggauguuggaacuucuuggcugggcugaaggaauccuuugaaagacucauuucauauaguaagaauccccucuaugaauaugaagaaagaaugcauaaacuaagccacuuaaccguauucuucugaaaaaugggauguuucuugauaggcuagaugagugguucuuaaaauuuuuuggggucacuuauccuuuugagaaucugaugaaagacacugggcccucaaguuagaagaugagcauaagcacaaucacaugauuuauauauaugauuuuaggaacuuaaaauguaauaaaauagagccaauuuauauuuaggucucauuugaaaaccuuucauuuucauuguucggguguguggauguuaguaugaguuuaagaugaaagagucuaugguauuugaacauguugacaggagaacuuuaggguccauguuuuuuauucuuuuuaucaucugcaaacuuauuucugcaguauuaguaaaggacucugaauuuggugauaagggaauauaauauagcacaaguaucuauggcuuuguucuuugucaguaucuuuuuguuccuaaacucugagaaguggguuugucuuuuuucaguuuuggauugggccugaggugauuugaagcuccugucuuggaguuuagcuuaguuauaacaaacacugaguuaauccuaugcaggagacacaaaaaucaauaauauauggucucugugcuugaagagaugcuaauucaguugagucugaauuguuugaugguggcagcucucaaaaggacaaggaagagggaaacauuccuagaaguugaaauuuuguuacccaauugcaaagagauuuuugccacuacuuacucuuugaauaagcauaaaguguuuauacucuguaugcagcuuuguacuuuaaaaaaauauguuuuguaucaucuugugcuuuuuuuuuuuuuuuuugagacugaguuucacucuuguuaacaggcuggagugcaguggcgcuaucucaauucacugcaaccucugccuccuggguucaagugacucuccugccucagccucccgaguagcugggauuacaggcaugugccaccaugcccugcuaauuuuguauuuuuaguagagacagcguuucuccauguuggucaggcuggucuggaacuccugacagaugauccacccgccucggccucccaaagugcugagauuacaggggugagccaccgcgcccggccucaucugguguuuuuguauaaaggaacuauugguuugagaagaaggcaaacauuuauauuucuuaccuucuuuugggauauauuucuacagugcguuuauguaaaaagguuuugaugucgcugggcaugguggcucucacuuguaaucacuuugggaugcugaagaggguggcucaccagaggucaggaguuugagaccagccuggccaacguggcaaaaccccgucucuacuaaaaguacaaaaauuagccaggcauggugugugugccgguagucccagccaguugggaugcugaggcaggaggaucucuugaaucccugaaguggagguugcagugagccgagauccaccacuguacgccagccuggacgacagagugacucucucaaaaaaaaaaaaaaaagaaaagaaaaaggggccuagggccuggcauaguggguuaucccuaugaucccagugcuuugggaggcugagccaggaggaucacuugugcccaggaguuugauaccagccuggccaacauaggaagaccccauuucuacagaaaguuaaaaaauuagaaugaacaccugcaguccuagcuacucuggaggcugagacaggggaauuacuugacccaggaguuggaagcugcugugagcuaugguggugcuacugcacuccagccugggcaauagcgugaaacacugucucuuuaaaaaaaggaaaaggauuuucauguucuacucuugaguuauauugugaaauagaauacagcacaucacuuuuuaaauuuuuuuuuuugagagagaguuucgcucuuguuguccagccuagagugcaacagcgcgaucucagcucgcugcaaccucugccuccuggguucaagggauucuccugccucagccuccccaauagcugggauuacaggugugugccaccacgcccggcuauuuuuuauguauuuuuaguaaagacaggguuuugccauguuggucaggcuggucucaaacuccugaccucuggugauccacccgccucggccucccaaaguguugggauuacaggugugagccaccgcaccugcacaucacuucuuaauaacuugcuagguacugugucuuuauaguauuagcaauuccacuugagucuuuauucugagucuuccuccaugcuuuauuaauauugaauuggccaccuucauuucugcccaagacaauguggaagcacacaguggagaagucuuacuauguguaagauugugguggugguggucuccauuuaaaauaacuuuguauugcuauuugaauaauguguauugaucugagucuuuuaaagguaguauacaaccucacuauaaucugcugugagaucugcuuaggccagccuuuucagcagcauguaguauuuuaaaccugggugccgcaagagguggaaaugcaacuaguucauuuuuguuuuguuuugagguaugcugcuaguuucuguuaucauuuuccuuaaaauuaauuuuaguguuuuuucauuuauauuuuuucauaugaagaggcuagauuuucuuauugcuugucaucauaguuaauaauagucuuauauuucacguuuuagaaaucgcuuuuuuagugacugccucaucaggccuguaauuggcagaaugugauauuuaucaaaauuaacuuuaaaauaaugauuucuaggccgggcgugguggcucacaccuguaaucccagcacuuugggaggccgaggugggcggaucacaaggucaggagaacgagaccauccuggcuaacauggugaaacccugucucuaccaaaaauacaaaaaaaaaacccaaaaaacaaaauuagccgggcauggugaugggcaccuguagucccagcuucucaggaggcugaggcaggagaauggugugaaccugggagguggagcuugcagugagccaagacugcgccacugcacuccagccugggugacagagcgagacucugucucaaaaaaaaaauaaauaaauaaaauaaugacuucuagugaugacagaaauuuaaccaauaaucuuacugcuauuucagaguuguauuuuuucauugaacagcuaaguuuucauguuuggaaaucuaugaaauuuuuauuguaguauuauauuugcuuuucauagucuuuagucauuugcccucagacauacacaaguugaugacaagguuguauacuuuuuuccaucuaauuaaaaaaauuuuuuugagacagggucuuacuaugucacccaggcuagggugccgugguacgagcauaacuuacugcaugcucuaccucuugggcucaagcaguccuuccauugucccaaguaacugggauuacaggcacaugccaccacgccuggcuaauuuuuaauuuuuuuguagcgauggagucucaccguguugcccccacuggucucgaacuucagcaguccucccucuucagacucccaaauugcuggaauuauaggcaugagcuaccacaccugggcaauuuuguucauuuaaaaauauuuuuggccaggugcaguggcucacaccugucaucccagcacuuugggaggccgaggugggcagaucacgaggucaggaguucgagaccauccuggcuaacguggugaaaccccgucucuacuaaaaauauaaaaaauuaggcgcagguggcaugugccuguagucccagcuacucgggaggcuaaggcagaagaaucaguugaaccugggagguggagguugcagugagcugagaucacgccacugcacuccagccugggugacagagugaaacucugucucaaaaaauauauauauauacacauacacacacacacacacacacacacacacacacacacacguauauauauguauauuuauauuuauaauuuuuuacagcuggggucuggcuguguugcccagacugaacuugaauucccaggcucaguugauccucccacuuuagccacucaaguguuugggaccacagguaugugccaccacauguaugugccaccacaucugguuaauuuuuaaauuuuauguacagguagagucuuacuguguugcccaggauggucuugaacucuuggacucaugugguccucccaccuuggccucccaaagugcugagaaaugugagccacaaugcccagucagcuuuuuauuucuuuaauguggcaaauugcaaacauauauagaaauaaagagaauaguauaaugagccuucauguacucaacauccagcuucagcaguuaucaacacaguuaacacacuguuuccacaucuaccagccccugucccuccuuccccucuugcuuauuuuaaagcagaucuuccaguuauuguauaauuucauccauaaauacuuaaguauuuaaaaauucuuuucacuguuaagugaggaauuacuccuucauaguuagguuuauauaacuuuuaaguaucugaucauaguuggaacuaaacuacuuacaccaucuacuucuaauccauauuacuuaucaguagggaauucccugugccagcuaagaagaaaugagguaaauaguucacaucauugcuuuucgauguuugcauugaacauuuagaacaguuccuaugcuauucagaauagcuuaucagcuuuuuucaaaugcacaagagagaaacaaaggguuucuuacaguuuuuuagucauagcgacaagaugcuaaaaaaugucuaguuuuuagucccuagauuuucauuuuuuuguuuuccauuuuuuuuuuuuuuuuuuuuuugagacagagucucacucuguugcccaggcuggagugcaguggcgcaaucucggcucacugcaaccucugccuccuggguucaagugauucuccugccucagccuccugaguagcuuggacuacaggugcgagccaccaugcccagugaauuuucguguuuuuaguagagaccggguuucaccauguuggccaggcugaucuugaacucuugaccucaagugaucagcccgcaucggccucccaaacuguuggcauuacaggugugagccacugcacuggccuguguguuuaauuuuaagaggaagaaagucaaauaacuguaggucagacuuuaauucuuuuuuuuuuuuuuuuugagacgguuucucacucuguccccaaagcugaaguguaguggcacgaucucggcucacugcaccucuuccuccugaguucaagcgauucuccuguuugagccuccugaguagcugggacuacugguguaugccaccaugcccggcaaauuuuuguauuuuuaguagagaugggguuucaccauguuggccaggcugaucucuaacuucugaccuucaggugaucugcccgcuucagccucccaaagugcugcgauuacaggugugagccaccacacccagcugaguuuaauuuacuuuaacaagccauucauuuguuuguuuuguauucauucauuccucacuccacugacuaacauuuuuccagugcuuccaccauacccauuucugugcuuagguguggggaaaagacauacaguguuuuuuuuuguuuuuguuuuuguuuuuuaaaucucagauguaauccuagcucugugggaggccaaggcaggaggauugcuugagcccaggaguuuaagaccagccugggggcaacauaaggagaccugguuacuaaaaaaauaaaaaauucaggcugggcaugguggcucacgccuguaaucccagcacuuugggaggacgaggcggguggaucaccugagauugggaguuugagaccagccugaccaacauggagaaaucccaucucuacuaaaaauacaaaauuagcccugugugggggcacacgccuuuaaucccagcuacucgggaggcugaggcaggagaaucgcuugaacccgagaggcagagguugcagugagccgagauugugccauugcacuccagccugggcaagaagagugaaacuccgucuccaaaacaaaaaguaaauacauaaauuaaaaaaaaaaaauucgccaagugugguggcauccaccuguggucccagcuacuugggaggcugaggugagagaaucacuugagccugggagauugaggcugcaguaaacuguaaucgcaccacucuacuccagccugugugacagagugagacccugucucuaaaggaaaaaaaaaaaaacucgggccgggcgcaguggcuuacacuuugaguggcugaggugggcagaucacgaggucaggaguucgagaccagccuggccaacauggugaaaccccaucuccacuaaaaauacaaaaauuagccaggcguaguggcacacgccuguagucccagcuacucgggaggcuguggcaguagaauugcuugaaccugggugguagagguugcggugagccgagaucuugccacugcacuccugccugggugacagugagauuucaucucaaaaaaaaaaaaaaauucuaauaggaggagcauguuaacaaacauauuacaguaauauuauguaauacauuugccuauguuaacaaacauacuacgauacauacuauguaauguuuuuguccaagguggggaaguuauucaaucuguggugagaaaggaaagguuaggguggcuuccuacaagugggaagagccaggcuuuaaaggauaagugugagacauucagacuuaagagagggcguucuagguagagggagaucaucugcaaacguaugaacguaugacacagcaggaugagugcacuguaauuuggaucgguaaauuuucaacccauucucuuaugauuuccugugucuucagugcuauauaagguuggccuuuguaauuagauaucuucuaucaaauaaagauggaaauauguucaaaauacuuuucuuagacaaaaaacuauuguuauaaaaguaauuucuagcaaagauuaaugucaauaaaauauuugguuauauuuuaguuacucagaaaauuuuuacuagaauguaacccacucagcauucuaguuaaucaggccuugauuauaauaaguaucuagccagaucuaaaaauguauaauuaguugucuuaauaaugaaugaaucucucagcaucugcauugguauauuuccccucaauuuguugaaaaucccaaauagucauuaagaucauagacucugaaaucagauugauuaggcucagaucugaguuuugcuaacuuauugacuguaauuuugagcaaaauacuuacaaucuuugguuuccuugacuguaaaauauggugauauaguaaugauaauauuuauagcauagaguuggcggauucuacgagaugauauguauaauguguuuagcauaaugugugccaugcagcaagcaaauaauguguauuuguuauuauuuuaguuauuuauuuucuucauuuccaaaaaagaauauagcaaagcagauuacuucccucauagguaagaauauguaaaauacacuuuugaaguguauauaagcaauguccuuauuuguauacauauuuuuuccauuuucaauuuuuagcauacuauuuaucuuuucucacaugugaauuccaauuucguauuuucccucuucauuuuagccuagguuuucguguuuggcuuuuucuuuuugagucagggucucgcucuguuguccaugcuggagugcaguggugcgaucucggcucacugcaagcucugccucccggguucacgccguucuccuguuucagucuccugaguagcugggacuaccagugcaugacaccacccuguuguaguuucuaucaaaacuucuuuuuguuuuuuuugagacagagucucacucuugucggcuaggcuggagugcaguggcgcgaucucggcucacugcaaacuccgucuccugggcucaagcaauucuccugccucagccucccgaguagcuggaauuacaggcaugcgccaccacgcucggcuaauuuuuguauuuuuaguagagacgggguuucaccauguuggccaggcuggucuugaacuccuaccucagguaauccuccugcuuuggccucccaaagugcugggauuacaggcgugagccacugugcccggccuucauauauuuauuuagugcuuacuaugugccaggcacuauucuagguacugggauacagugauggacaaaacaagaucccugcuuugcugucuuaggacuuaauaauuugggcauuuucuuuuuucgauauagaucuuuuaguacugauauaacauacuguuagccaguauauuacguguuguucaagcaagauucuuuuucuuuuuugacacggagucucaaccuuucgcccaggcuggagugcaauggcaugaucucggcucacugcaaucucugccucccagguucaagugauucuccugcuucagccucccaagucacugggauuacaggcgcccgccaccacgcccggcuaauuuuuuuuuuuuuuuaucuuuaguagagacgggguuucaccauguuggccaggcuggucuuaaauucuugaccuugugauccaccugucuuagccucccaaagugcugggauuacaggugugagccaacacuccuggccugcaagauucuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccacugcgcccggccguagauucuuaagauagacucaagauuccugaagaaauuccugguauaugauuauuuuucugcuaaagugaaucaauuaugugacaaaaauuuuucccccccgaggaaaagauacugugugccuauguuucauccaggcauuccauuggauaguuaguccuuugagauaucaguggauuaaaucaucuguuaagaaucaaauaaaaugcugcaggaagaaagugaaaaacaaaacaaaaaaagagucaaauaaauaaaggcugggcaugguggcucuccccuguaaucccaggacuuugggaggcugagguggggggauugcuugagcccaggaguuccagaccgccugggcaacauagugagaccaugucucuaaaaaaauuuuaaaaauuagccaggcauuguggcacauaccuguagucccagcuacuugggaggcugagcaguagauuucuugagcccaggaggucgaggcugcagucagccaugauugcaccacugcacucuagccugggcaacaagaugagaucccaucuggaucuuuaugucaaguacuguauuaagcccagaguauacaacagugaauaaaacagauaaaaguuguugcuuucauagugcuuccuuuugaguaagauagacaauauuaaauaaaugggaaauauguccuagcauuuugaugauagaugugguaaaggaaguauaaacaagguaagggauguuggguaguuagggaaguccucugaggcacuaauauuucaggagauaccugaauuauaugaaggacccagugcaacuaucuggggcaugagcauaagcccugagacaggaguaccuguugguguguucaaggaauagaaaagggcuaaaacaguaaaggggggaauagugauaggagauagaagagguagccagggaccagauaacauagggacuuaaagacuugauagguaucuaguuuuguauuucaaguuugauuggaagcagggaaaugacuugaucugauauaugcacuuugaaagaugaauaaugcaaccagguugaccaguucagaggcuaucguggacugggcguagugguucacaccucuaaucccagcacuuugggaggccgagauggguggaucacgaggucaggaguuugagaccagccugaccaacauggugaaaccccaucucuacuaaaaagcaaaaauuagcugggcgugguggugcacaccuguaaucgcagcuacucaggaggcugaggcaggagaauugcuugaacucgggagguggagauugcagugaacugagauuacgccacggcacuccagcuugggcaacagagcgagacucugucucaaaaaaaaaaagaggcuaucgugauaguugaggcaacagcugauugugguguugaguguacugguggguggauuugagguauauuuuggagguaguggagauaauaacuugcugaugguuuggaugugggaucaggguaaaagaggagucaaggaugacuucagugauggccugagcaguuggaugcuuuuuucuuugaugaggaacacugugggaaaagcaaauuauaaggaguacagaaaugagggauuugguuuggauauacagucaucccucgguaucugugagagauugguucccccgaggauaccaaaaucuguggaugugccagucccuuauauaaaaugguauacuacuuggauauaaccuauguguaucaucuuguauacuuaaauuuuuuuuuuuuuuuuuuuugagacugagucuugcucugucacccaagcuggagugcaauggcacgaucucggcucacugcaaccuccgcuuccuggguucaagugauucucgugccucagccucccaaguagcagggauuaccgugccuggcuaauuuuuguauuuuuaguagaggugggguuucacuauguugcccaggcuggucuugaacuccugaccucaggugauccacccgccuuggacucccaaagugcugggauuacaggcgugagccacugugucuggccaaaaaguuuuuuuuugagacagggucucucuguuauccaggcuagagugcaguggcauggccauagcucacugcaaccucaaacuccucagguaaagcuauuuuccuaccucagcuuccugcguaggugggauuacaggcucacgacacaauauucggguaauuuuuuugguuuuuguagagagagagucaugcuuuauugcccagguucgucucgaccucccuguuuguauacucuaaaucaucucuggauuaauuauaauaccuaauacaauguaaaugcuauguaaauauacuguguugcuuagagaauaaugacauaaaaaguauauauauucagugcagacacaauuauccuuuucuuccaccccugccccuggaauauuuuugauccgugguugguugaauccucguaugugaaacccauggauacaaagggcugacuguacaggguuugagauuucuacuaaguguuuaaaguugaaauauugaauaggcaguuggguguacaagucuugaggucagggcaaauauaaacuugggagcugagcagcauagugaugcuauuuagagccaaagaacuugaugaaauuacccagagagugaguguagauagagaaaagaugaaguucuuagacugaguugcuggauaaauauuuuugauacugggagaaauuuaucuagaauaccagaacuaaaagagaaucuuuugauaauuugaggacuaacaccuuccuggcuaagaaacucuaacaaguacuaacuagucaagauguagagacaaauguaaaaugguuggugaaugaaugucuauuuuuuaucucucuuuuguuugauacggagucuggcucuguugccuaggcuggaguacaauggugccaucuagguucacugcaacccccaccucccagguucaagcaguucuccugccucagccucccgaguagcugggaguacaggcaugugccaaacacgcccggcuaauuuuuguauuuuuaguagagacaggguuuuaccguguuggucaggcugguauugaacuccugaccucaugugauccacccacuuuggccugccaaagugcugggauuacaggcgugagccacugcauccagcucaucaucuagguuuuaagcuccacaugcguuaguuacucguccucagguucucccuccccuugccccccaacccacugacuggccccaguauguuguuccccucccuguguucauguguucucauuguucaacucccacuuaugggugagaacaugcgguguuugguuuucuguuccuguguuaguuugcugaggaugauggcuuccagcuucauccaugucccugcaaaggacaugaucucauuccuuuguuuuuucuuuuuugagacggagucucgcucugucgcccaggcuggagugcaguagugcgaucucggcuuacugcaagauccaccuuccggguucacgccauucuccugcuuuagccuucugguggguagcugggacuacaggcgccugccaccaugcuuggcuaauuuuuuuguauuuuuaguagaggcgggguuucacccuguuagccaggauggucucaaucuccugacuucaugagccacugugccuggccuuuuuuuuuuugagacugaguuucacucuuguugcccuggcuggagugcaacaucaugaucucagcucaccacaaccucugccucucggguucaagcgauucuccugccucagcuucccgaguagccaggguuacggucaugugcuaccacaccuggcuaauuuuguauuuuuaguagagauaagguuucuacauguuggccaggcuggucucaaacuccugaccucaggugaucugccugccucagccucccaaagugcaccucaccgagccgaucucauuccuuuuuauggcuacauaguauucugugguguauaugugccauauuuucuuuauccagucuaucauugauggguauguggguugguuccaugucuucgcuauuguaaauagugcugcaguaaacagaaacacaugugcaugugucuucagaggauuuuaacuuuuuuuuuuuuuaaaugguaguuguggugaguagucauggcccucauuaagaauaugaugaaacauaaucccagcacuuugggaggccaaggcgggcagaucacgaggucaagagaucuaaaccauccuggccaacaugguaaaacccugucucuacuaaaaauacaaaaauuagcugggcaugguagcacaugccuguagucccaguuacucgggaggcugaggcaggagaauugcuugaacuugggaggcagagguugcagugagccaagaucacgucacuacacuccacccuggugacagagcgagucuccaucucaaaaaaaaaaaaaaaaaaaaaaaaaagaaugugaugaaaccuuuguagucuuucccagaaaguguauauaugcacauaaaaugugaauguaagggguucacuggcacuuuggauuguaggccaauauucuuuguuauauaagugucuuaauuaugaaaaucauggaaugacaguugcguuguuuaccuguucuuuaccagagugcuuuuuuuuuugagacggagucuugcucugucaccaggguggaguguaguggcgugaucucagcucacugcaaccucugccccccgaguucaagugauucuccugccucagccucccgaguagcugggacuacaggcaugugccagcaugcccagcuaauuuuuguauuuucaguagagacugguuucaccguguuggccaggaugguuuagaucuccugaccucgugaucugcccgccucggccucccaaagugcugggauuauaggcaugagccaccgcgcccaacccagagugcucuuaaaaguggaaauaaacucauguaaggaaugcuagugguuagaugacgauauaagcaaaucuuuacucacugucaccuguucaccucccuuuccccuuuaccauuaugguaaugcaauaauuucuuuuuuuuuuuuugagucagagucucgcuuuguugcccaggcuagagugcaguggcacgauaucggcucauugcaagcuccgccuccugaguucaagcgauucuccugccucagccuaccacguagcugggaccacaggugcaugccaccacaccuggcuaauuuuuguuuuuuuuuuuuuuuuuggugauggaaucucguguuauugcccaagcuggcgugcaguggcaccaucucagcucacugcagccuccaucucccaggcucaagcgauucuccugccucagcuccuguguaguugggauuacaggcacacgccaccacgccuggcuaguuuuuuuguauuuuaaguagagaugggguuucaccacauuggccaggcuggucucgaacuccugacaucuagugaucugccugccuuggccucccaaaaugcugggauuacagucuugagccacugcauccagccuaauuuuuauguuuuuaauggagaugggguuucacuacguuggccaggcuggucucaaacucuugaccuuaagugauucaccugccucagccucccaaagugcugggguuacaggcaugagccacugcaccuggccucaaaucuuuuuaaaauaaguuuuuaauggauuuuuguuuuauuguaaaacuaaugcaaauucuguaauaggaauauauauguguauauauaauuuuuuuccuuuuuuuuuuuccuuccaaaccuuucuccuuuaaaugacuagcacuaucaauuugguguguaaucauucauaauuuuuucucuauauaggauuuuuguccuacucuuuccaaauaugagaucuugcuugcuuuuaacuaagaaauagcagacauauauuuuguguguguguguauaaaaaauauuuuuggucaguaugaaggaaaucuucauauaauaaaucuuuuuauugguacuuuuauuuuucuauaggagucucaaaaguaggauuacuuuuggagucaaagaguauguaaaauguaaaaguuuguaauggauaguauaaauauuacuuucuaaaaugaugguggccacuagugcccauuuaccauacauuaucaguauuacuugcuauuuugaauuucaaccaaauugauaaguaaaacauagcuuuuuuuuuuuuuuuuuuuuuuuuuuuuuuuuggugagauggaguuuugcucuucuugcccaggcuggagugcaauggcgcgaucucggcucaccgcaaccucugccucccggguucaagcgauucuccugccucagccucccgaguagcugggauuacaggcauguaccaccaugcccggcuaauuuuguauuuuuaguagagacgggguuucuccauguugguuaggcuggucucgaacucccgaccucaggugauccgcccgccucagccucccaaagugcuagaauuacaggcgugggccacugcgcccggccaauaguuuguuuuuauucacaccucccugacuauacuaaugaggugguauaucuuuuuauauuuguuauuuuuaucucucuuguaauugccuaugcauauuuuuuguauaucuuauuuaagauaauuuuauauuaagauauauuaauccuuuuucauguuuauauuuucucccaaucuuauuugucuuuuuauuuuauuuacaaugucuuagucuacagauauauacugcuuuaacauaaucauacuugucacuauuuuucuuuaugguuuuuaguuuccugauuugccuaagaaggguuucucggccgggcacgguggcuuacgccuguaaucccagcacuuugggaggcugaggcgggcagaucacgagggcaggagaucgagaccauccuggcuaacacggugaaaccccaucucuacuaaaaauacaaaaaaauuggcuggucgugguugcaggcaccuauaguuccagcuacucgggaggcugaggcaggagaauggcaugaacccgggaggcagagcuugcagugagccgagaucuugccacuguacuccagccugggugauagagugagacuauaucucaaaaaaaaaaaaaaggggguuucuccaccauagguuauagaaauagucaugaacauucagauacuuuuacuuuuguauguaguguuuacauccacgaguagggcuagucauaguggcucacaccuguaaucccagcacuuugggaggccgaggugggaggauugcuugaggccaggaguuugagacaagccugggcaacauagugagacaccccuugcuugagcccaguagcuugaggguacaguaagccauguucaaacaacugcacuccagucugggugacaucgaaagacccugucucaaaaaaauaaaaauaaaaaauaaauccaugaggaaauugcuuuuuuguuuuguuguguuuuuuuugagauaggucuuguucuuucgccuaggcuggagugcagugacaccaucaugacuuacugcagccucagccucaaccucccgggcucaauugauucuucuaccucagccccugccaaguagcugggacuacaggugcauaucaccaggcucagcuaauuuuuaaauuuuuuguagagauggggucucacuauguugcccaggcuugucuugaacuccuggccucaggucacccucccaccucagccucccagagugcugggauuauagaugugagccaccaugccagccuuauuuuuguuuaugaugcaaagaauggguggaacuuuguuuucugccaacggauauccaguuaugucaacauauagccacauauaucaaauaaaucaucuccuugucauacugaaaucuuuuuuuuuuuuuuuuuuuuuugagacagagucucacucugugaugcaggcuggagugcaguggugugaucuuggcucacugcaaccucugccuccuggguucaagcaauuuuccugcugcacccucuaaguagcugggacgacaggcaccugccaccaugccuggcugauuuuuguauuuuuaguagagauagaguuucaccauguuggccaggcuggugucgaacuccugaccucaaaugaucugccugccuuggccucccagagugcugugauuacaggcaugagccaccacgcccggcugacugaaaucuauuaauugaaaaggguuuucauuuucacaggacugccacuaauccauauuuuguuuuuaugcaaaauaggaaaggauuuccuucuacaagauacuuaauuuugaucuuccaggauuuuuagguggcuuuacugagauauaauucauauauaguaauuuaaaguguacaauuuuuccccagcagccacacagugccguuaaaauauuuaaaaaaaaaguaauaacaagguguaagauuuaaugguuuuggccaggcaugguggcucacgccuguaaucccagcacuuugggaggccuaggcagguggaucaccugaggucaggcagccugaccaacaugaugaaacccugucuguacuaaaaauacaaaaaauuagcugggcaugguggcgggcacauguaaucccagcuacucaggaggcugaggcaggagaaucacuugaaccugggagguggagguugcagugagccaagauugcaccacugcacuccagccugggugacagaaugagacuccuucucaaaaaaaaaaaaaaaauuaauuaauuaauuacagcaugaauuuugccuucuuagaaguggcucuuuuguuuaaaauauaagcauguucaguggccuucaguugacaggcuguaaucaucgccaaaauguaauuauuuauuuauuuauuugagacagagucuugcucuguugcccaggcuggagugcaguggcgcaaccugggcucacugcaagcuccaccucucagguucacgccauucuccugccucagccuuccaaguagcugggacuacaggcgcccaccaccacgccuggcuaauuuuuuguauuuuugauagagaugggguuucacuguguuagccaggauggucucgaucuccugaccucgugauccgcccgccucagacucccaaagugcugggauuacaggcguaagccaccgugcguggcccaaaauguaauaauuuauuaaugggaaaaucuuucugauacaacuugaacuuucuuccuguugucauuuuagaauucccuaaagauugagaucaguguuccuauauauuucucggaaacacaauccuacauuccuaucccccucccccucuuuuuuaacaaaacagaauugcaguuauauuuuugaucuacguuaacuuugcuauucagguaagcuaaguaagguuugauuggauaaucuguauggcagucugaguauaauuuuuccaucaagauuuuuagccuugggacugcuuucuggggcuuacuuuuccccuugugacuugguaauuggaaauuuaugucuauuucacuuuccuguucuaaguuucuagaaggacuuguugguauaauacaguauuuucuuggucaugagaugcauacuuuccucccaguuuaauauuucuaaaauuaggaaauaacauaauugauguuuacauuuaaucuaguagugcucccucaccccuaaaaauaugguuauugauucaugaagcuucuuaaaaucagcagcuucuugaaauugaagaaauauauagaguacauaaauaugaaacuaacuagauuuauuggauaucaguacuuugagaguuagaaaugguuacugauugucaucuuuucagugaaggguucuauaguugaguaaaaaauuugucuaacuuuguaaguauaguuuauauuguagaaauugcuuccaauuuuguugguaacuucaugaagcuauucuaauuuuuuugugauuuuagugacuuauauaauauuagugacuuaguaguuucauguaaaauaucuucaaacuaauuagggcauggguuacucuuuuaccuuuggaaagcacauuacaugguguauauagugcuuauuuuuuaaauuauagaaacugaaaaauuuauauaauauuuaaagaaaaauaucaauuuuuaauauuuuaaguuucauuuugccuauucucuuuuaucuauauacacguuuuaaaauguagaauuaauguuuguuuacucauucaauagauauuuuuugaaugcccuuuauguucuaggugcuuugcuaaggauguagcagugaauacagcaaacaggauuuuuauucucauguaaugcauggucuaguggaagauauggauauuaaauaacuuaauugguauaaugcauauuaagagacuuauaguauggauaugcacuuagcagggugaucugccagacucaagccauccucccgccucagccucccaagucuaggggaauaggaaaugucuccccgagggaaugacuuuuaaacuaagauggaaaggaagagaaguagucauauggaaagaugcuggaagagaguuccaggcagagagaacuaacuguauguucuaaaggagggaaaacaguuauuugggaacugaaaagugcuucaaacacauguaucacagauguaugaguguuugcuuuuuuguuguuuccuguuguuguuguuguuaagacagggucucguguugucacucaggcuggagugcaguggugugaucuuagcucgcugcagccuugacuucccaggcucaagcgauccucccaccucagccucccaaguagcugggacuaugggcaugagccaccauauccagcuaauuuuugcauuuuuuguagagaugggguuuugcuguguugccaggcugaucucaaacucuuagacucaagcagucugccugccuuggccucccaaagugcugggauuacagguuugaguaacugcacccagcugagugcuugcuuuuuuuugguggugguuauuugcucuugcucugcucacaacaguguggggaauggugaggccagagauauguaggggcaguuaacaacaacaaaaaguaaacagugauacugugaagugcuguucuaaguacuuuucauauauuaguuuauugaacccuuacaacaauuucuauucacauuugagagaacugaggccgugaguacuuugcacaaaauuaauauagcaggacuagcuucugagacuguguuuuggcuucagagacuauauucuuaaccaccaaaccaugcugcagauuguaaguugcaaguuaugagugugauuagggacuuuuauauaugaagggcagugagaaaacauucaaagauuuuaagcagggaaauuacauuaucagaauuuuuuuuuuuuuugagacaaggucuugcucugucacccaggcuggagucaguggugcaaucauagcucacuguagccuugaccuccugggcucaaggaauccucccaccucagcuuccugaguagcugguacuacaggugggugugccacaacaccuagcugauuuuuuauuuuauuuuuuauuuuuaguggagaugaggucuugcuguguugcccaggcuggucucaaaauccugggcucaagcgaucguccugccuuggccucaagcgaucuuccugccuuggccucaaugugcugggauuacaggcaugagccacugggccuuugagaaaaacaaucucuaguggcucacgccugcauucccagcacuuugggaggccgaggcuggaagaucguuugagcccaggaguucgagaccagccugggcaacauagcaagaugcugucucuacaaaaauaaaaaauuggcugggcaugguuggugugugccuguagucccagcuacucaggaggcuaaggcugcuugggcccaggagguugggacugcagugaacuaugaucgugccacugcucuccagccugggugacagagcaagauuuuuucucaaagaacaagaacaaaauauauauauauauauaaaauaaaacaccuuucuggauguagcuugggcuggaggagagcaagguagauguacaaagaaguuagagggcuguugcuauauucugggugagaauuguugguuuuuuuggacaagucagugggagaauuggagaggaacucuauguaaucacagauuauuuaugugacauucagaaguuuugguguuagguugaagguugacaauaagggagugagaauagucaggaugagugccacugcacuccagccugggugacagagugagacuccaucucaaaaaauaaaaaauaaaaauuaaaaaauuaaaaagauaccaaaagauuuuagagaagcaaaagacugacugaaccuaaagaauuccaacaucugggagucugguaggccaaaucagaucugcagauaagacucaggaguggcuuccagagagguggcaggaauguguacuaucauaguaaccuguaguaguuugacuaguaguagcucugacuugagcaauuggugguacugaaaugggaaagauuggaggaggauuaaacuuuguaaagauauugaaccagguuucagauauacugucuggagcuuaaaagucuuaaguaguauaauaaauuacacagggaaagaaucuagaguaggagccaggugcaguggcacaugccuauggucccuauuacuugggaagcugaggugggaggaucccuugagcacaggaguuggaggcugcaguaagcuauuauuaugccacuguaccccaggccagaugauagagccgucuuuauuaaaaaaaaaaaaaaaaaaaaaaggcuggguacagugguucacaccuguaaucccagcacuuuggaaggccgaggcgggcagaucacgaggucaggaguucaauauagugaaaccuugucucuacugaaaauauaaaaaauuagccggaugugguggugcguuccuguagucccggcuacucgggaggcugaggcaggagacucgcuugaacccagaaggcagagguugcagugagccgagauugcgccauugcauuccagccugggugacagagugagacuccaucucaaaaacaaacaaacaaacaaacaaacaaaaaaacgccaggugccauagcucaugccuguaaucccagcacuuugggaggcugagguggacagaucacuugaggucagacguucaagaccaaccuggccaaaauggugaaaccccaucuccaaaaugcaaaauauaaguacuaaagauacaaaaauuagccuggccuggugaugcgcaccuguagucccagccacuuuggaggcugagacaggagacucacuugaacccaggaugcagagguugcagugagccaagauggugccacagcacuccagccugggugacagagugagacuccaucuccaaaaauaaaaauaaaaaauaaauaaaaauuaaaaaauuuaaaaaaugccaaaauauuuuagagaaagaaaagacugacugaaccuaaggaauuccaacaucuggaagucugguaggccaaaucagaucagcagauaagacucaggaguggcuuccagagagguggcaggaauguguacuaucacaguaaccuguaguaguuugugucuuguguucauuuucuuaguacugccuuuuugaaggacagaaguuuauaguuuuggugaaguucaguuuaccagcuuuuuuuaaaaaaaaaaaaucaugcugucauaucuaagaaauuuugccuaacccaaagucacaaagauuuccuucuacauuuucuuuuaggaauuuuauaguucguuuucgaauuuagauuugugauccacuugaguuaauuuuuguguaugaugugagguaagggucugaguucuuuucuugcagauggauauccuguaguagauuuggagugagaagauuacauucaauccaaguucuucuauuuacuaauuuuacagucuuagaguuaaucacguuucgaagccuguuugcccaucuauaaaaugugauuaguuaaaucuaauaagauuauugucagaaugaaacaaaugagacaauaagugaaaccacuuuggcauaguguauggcgccuaguaggacuaagauagauaaauguuaguggaguuugaaaaacacucccaggauacccaaauacucuucuuguuuguuucuuuaaauucguuucagugagugaauaaugcccaagcuuuugguuuucagauauaaucauuguaauauuuaaucccuugaaauuaccucuuaaucuuaaagucuaucagcuuuaaacucuaggcagcaaaugcacugcaggcauguuuuagggaguuuugacuucuuuggguuuguuugauaacauuugauaaauaauugccuuucuguguugaauuucuuucuuuuuucccuuuuuuuuuuuuugagacagagucuugcucugucgccaggcuggagugcaguggugugaccucggcucucugcaagccucgccuccaggguucacaccauucuccugucucagccucccaaguagcugggacuacaggcacucgccaccacgcccggcuaauuuuuuuuuguauuuuugguagagacgagguuucaccauguuagccaggauggucucgaucuccugaccuugugaucugcccauuucagccucccaaagugcugggauuacaggcaugagccacugcgccuggccucuuucuuuuuucuuuuaacuuuuuuuagagacugguucucacucugucacccaggcuggagugcaguggcaugaucauagcucacugcagccuugaacuucugggcuugagcagucauccuggauuagccucccucauuauguagaaguauuaaaagcauggguucuacuuuugacagacauagcguauucauauaugggagcuguugaguagugagaaaugacugcauauguuuugaagguaaagcugacagauuuugcugacagacugcguguguaggauuugagauaaaggaaggagucaaggaugauaacaaguuauuaggccaaaaauuugucaucucaauucaguagcagaugaucuuuucaaggccugagucagaucaugucauuucuuaaaaccauuuugauggcuuccugucucaaaguaaaagcuaaagucuuuauaagucugcaaggcccucuguauaaguccugcaugcccucucagucugcguacucauucaguuccaggaagccggguugggcaaaggucuccauucuauuucugaaacacaacaaaaauacuuccaccucaagaccuucgcacuuacuuuuuggcuugacuagaaccuccauuuccuggguaugugauuacuuagcuaguuugauauauccuaagaaauaugaugguuaucuguggaaauuuuaaagagucugaagcccagcacaaauuuaaaugaauaaugugcuauaaauuuuuuucuuuuuuuuuuuuuucuugagauggaguuuugcucuuguugcccaggcuggcgugcaauggcacgaucucggcucacugcaaucucugccucccagguucaagagauucuccugccucagcguccugaguagcugggauuacaggcaugcgccaccacgccuggcuaauuuuguauuuuuauuagagacaguguuuuuccauguuggucaggcuggucucaaacucccaacccaaccucgggugaucugccugccucaaccucccaagugcugggauuacaggugugagccaccaugccuggccuaaugugcuauacauuuuuaaauaaaaucuugugucgcuaauuuauacuuuuuuuuuuuuuuuuuaagagauggggucuugcccuguugccaaggcugaaaugcagugauauuuucuuagcuuacugaggccucaaguuccugaguucaagcaguccuauugccuuggccucccaaaguguugggauuacaggcgugaaccaccacacccagccuauaacugguuuuuaauguuaagaaauaauguuguaauguuuagaaauaaaaagucucuagccauguuuaauaaagaucacaaaggaaaacaaaaauuccuuguagaugagcaggcaugguggcuugcccccuguuagcugcgcgggaggcugaggugagagaaucauuugagcuccagaguuugaggcugcagugagcuaagaagaugccacugcauuccagccuuggcaacagagcaaaacccagucuuaaaaaaaaaaaaaauccucagauaagacaaguuagauuuuacuuuuuuuuuuuuuuuuuaaauggaguuuuacuauuguugcccaggcuggagugcaauggcacgaucuuggcucaccacaaccucugccuucuggguucaagcgauucuccugccucagccucccgaguaguugggauuacaggcgugugccaccaugucccgcuaauuuuuguauuuuuaguagagaaaagaguuucacuguguuggcuaggcuggucuugcuccugaccucaggugauccacccgccuuggccugccaaagugcugagguuaugggcaugagccaccgcaccuggccagauuuuacuuguuuuaagcuaacaaucuaccugcauuguuuaaucuauaacauggcaauuuuaaauagguuuacuuaucuaaaaagaaaaagaauuguucuucauuguucuuccaggcuaaaaaucuuauaaaauuccguuaacuuuuucauuuguauguuguuacacugccucccucuguauauagcauauacauauauuuucagcucucucuuugacuuuccacuuaaauguuucacagguaccuaaaauuuaauguacuuauuacugaacccuuugaucuucccuuucugucucauccuggcauacuucuagaauauuggccccacaaagcaaggguuuuugucuauauuuuguacuauuguaucuccaguucuugauauauaacuugguaaauauuuguugaaugagucuccaaaugguaccaccauaccauuuaccauuuggucaagucuucaguuuuuuccacccucauccucucacauuauauugacaaauaucuaacaugucucuuaaauccacccguuuuucucuauuuccauuguuaccauccuaaucuaguaugcugauaugacugguauuccagaaccaacuuuugcugucuuuggaauaaucuuccuuccucagcaaacagauguuucucaaaauguaggcuuguaucuuguuauuguccuucucagagcccuuuaauaccuucuuugugaauuccaaauuuuuuuuuuuuuucuuuuuugagauuggaucucggccuguuuccagcguggagugcaauggcaccaccauggcucacuauagccuugaccuucugggcucaagcagcugggaacucucagaaaauaaauaaauaaauaaaaauaauaauaaaaaaauuuaaaggaaagaaagcacuuaaaguucaugagaccaaggaccauguuuguguuacucaugacgguaucuacagugugugucacaauucucaaaacauauuuugaggcucucagaaaacauuuguugaaugaaugaaggaauagauuaagaaugaugaauccauaaaggaaaugaugaaaugguuggagagguguugggagaaccaguagaauguaucauagaaaccaaagaguuucaaacguagcaaauaugccaaauguagcagagagaaauaauaagaucgagacuaaagaugaucuuuucuuuuuuuuuuuuuuuugagacggagucucgcucugucauccaggcugaauggagugcagcggugcgaucugggcucacugcaaccuuugccugccagguucaagugauucuucugccucagccucccgaguagcuaggacuacaggugcacaccaccacgccuggccaauuuuuuuuuuuuuuaaguggagacgggguuucaccauauuggccaugcuggucucaaacuccugaccucaugauccacccgccucggccucccaaagugcugugauuacaggugugagccaccacgcccagccuaaagaugaucuuugggaggcagcaaagcauagugguuaagaggagcgaaacagaccuguuucugccuuuuauuggccauuagccugucuuuucaugucuaaaaagggaauaauaauaguaacuaccgcaugcugauugugagccuuaaaugagauaauauauguaaaacauuuggcauagagcuuuguacaugcuaagaacucaguaaguauuuuauuacuuuuacugaugcuaaauucacugugaggacucauuuguaguacuuuaaaaaauuugguugauuuuauauuguuuugcugaauaguguuccaucaaagcauggcuauucccuuucuaccccugaaaauagaugggguauuuacauauaaaaugauuuccaaacauaguugucuuccagaguaguucuguaucucagaccagaccuucgccaccaacacacacacacacucucucucucucucucuccccccauauauauauacacacacacacauauauaugcacacauauauacacauacauacauauacauacauacauauauauauacauauauauacacauauauaugugugcauauauauauauauaauuuuuuuuuuuuuuuugagacagagucucacucuguugcccaggcuggagugcaguggcacaaucucggcucacugcaaccugugccuccuggguucaagugauucuucugccucagccuccugaguagcugggaugacaggcaccugccaccacaccuggcuaauuuuuguauuuuuaguagagauggaguuucaccauguuggccaggcuggucuugaacuccugaccucaggugauccacucgccucagccucccaaagugcugggauuuauaggcaugagcaaccacgcccagcccagaccacuauauuaauaacaguguauuaguuaauuuuuaucagauccacuguuuguuacuuggaugugggauuagaauggcagguguugggguggauagaggucuucauuuuguagagaauauguauuuguaaauuuguagguaguuuuuaacauauuguuagauuaucauacuuuguuuuuauacaauguauauguccuauuaauauaauuaguaauuuccuuuuuaaaaaacauaugguuaguaauuuucuaaagaguuuacuuaaugcuguaaugauuugugcaaaaguauuuaaugcuguagguacaguguuacuuuccuuugaauuuggaccagacugucccacauuguuccagagauuugaaaacauaaaucccaaaauugcaugugagaugaauauugaguuugccuguuugagugaagagauucuagcaaucuuaggucuguguuuuuccuuggaaauguauuuuaaguugaauauauuguaguagaaaccaaaauaaguuguguuacaacauggcauccuugccccuggauggaaaaccuagauuguuuagauauuuuuccaaaagcugaaagaaugauauucucaaugaacauugcuuugaaaguucaaaaaacagcauucuggcagcugcuguagggacuguuuuucaagcaguuuacauucagcagauaaaaagcacucuguugugaaauaucuucagaauuuggguuuaucuugacuagaaacucuuaaauuugguaugugggguuugccaaucaugauuuuccaguuuuacuaccuaaauggauucucaaaauaugccuguaagcauacuguucguuuuucuccuugaucauguuagggaaauguaguauuucucucuucucauauacauuuuuagggggggaaauaaauguuuucaaaucucuuuucaguuuauugguacucugcuauuuauguaauaauaugugucacuuggauuaaguuuuauaauuuuuuuucauuuuuaaaaugagaaucauguuucugucagaccuuucucuguaauguuuugaaagggaauuaagugcagauaaaaaaugaauucuuugcuugaacccgggaggcggagguugcagugagccgagaucacgccacugcacuccagccugggugacagggagacucuguuucaaaaaaaaaaagaauucuuuggaaaaaugcugaaauucuucauuuauacauauaaauuuugcaguuauacauauuaagacauggaauucuuucauuacaaaaauuguaaugggaaaauuuaaaauguaugcauuugugaguaaugaauauaaaagcaauucuuuuuuuuuuuuuccaaauuguaaaauguuguggguuuuuuguuacaucuguuuuuugagaugggggucucucuuuauugcccagacuggagugcaguggcacgauucuagcucacuccaguguugaacacuugggcucaagugaucuucucaucucagccuccagaguaacuaggccuacaggugugucccaccacacccagcuaauuuuuuaauauugauugauugauugagacagagugucacucuguuggccaggcuggagugccucuggaguagcuaggacuacaagugugucccaccauacccagcuuauuguuugauugcccgggcuagaguacagugcugugaucauggcucacugcagccucgaccuccuagacucaggugauccucccaccucagccuccuggguagcugggacgauaggcacgugccaccaugcccagcuaauuuuuuugauuuuuuuuuuuccuucccgagacagagucuuggucugucacccaggcuggagugcaguggcacagucuuggcucacugcaaccuccaccuccuguguucaaacaguucuccugccucaaccuccugaguagcugagauuacaggagcgugccaccaugcccagcuaauuuuuguauuuuuuuuuuuuuuuaguagagacgggguuucaccauguuggccaggcuggucucaaacuccugaccucaagugaucugccugccuuggccucccaaagugcugggauuacaggcgugagccacugagcccggccuagaaaggggacaauuugaagcucguaaaauauaacccacauaagucagggaauuaauucuacaaauauuuauugaacaccuacuauaugccagcuaguguucuacgugcugggauauagcagugaaccaaacugauaagucuauuuccugguagaguucaaauuucaauggaaagauguacacaacaaauauauaguacaccaggugguaagaagaguaugagaauaaaauaggauacugaaugugaguagagggugguggggggauagguguuuuuuuuaggaaaugcuucuucuguaaaauuacguuuagacaaagauacgaaggaagugaaagagcaagauaugcaauuaucuggggaaaggguguucugucaagcggaaugguaagugcaaaggucccaagguaaagaguauuuuuguuguguuugagaaacagaagggaaacuucuuuuuuuuuuauuuuuuuuauuuuuuuuugagacagagucuugcucuguuaccuaggcuggagugcaguggcgcaaucucggcucacugcaaucuccaccagaagggaaacuuuuguaccuccuucuuggaacuaagugaggagacugguaggcgauggaagagagguagagaggacuuuaggacaaauuaaauuggaucuuuagaccauuuaaaaaauuuuggcuucugcuuugagggagauaggaagccuacgaaaggguuuugagcagaggagugacaugaucugaaucaggcuuugaaaggaucacccugcaacugaauugagaagacuggaagagauaugaggguugaagcaaggaaccaguuagaagcauguugcauuuugcaagcuaugcaucugacaaaggucuaaugucagcaucuguaaggaacuuaagcaaaucuaugagaaaaaaaaugauuaaaaaguggguaaaggacaugaacagacacuucucaaaagaagacauacaugcagccaacaaucaugaggaaaagcucaacaucacugaucauucaagaaaugcaaaucaaaaccacagugagaccaucucacaucauucagaauggcuauuaaaaagucaaaaaaaaaaaaaaaaagaugcuggcaagguugcagagagaaaggagugcuuauacacuauuggugggaguguaaauuaguuaagccauuguggaagacuguggucaucccucaaagaccuaaaaacagaaauaacauuugacucagcagucccguuacuggguauauacccaaaggaauauaaaucauaaagacagaugcaugcguaucuucauugcagcacuauucacaauagcaaagacaugggauuaaccuaaaugcccaccaaugguagacuggauaaagaaaauguaguacauauacaucaugaaaugcuauggagccacaaaaaaaaaaugagaucauguacuuggcaggaucauggauggaguggaggccauuaucuuuggcaaacuagugcaggaacagaaaaucaaauacuguauguucucacauauaaaugggagcuaaaugaugacaacacauggacacauagaggggaacaacacacacuggggcuuauuggaggguggagggugggaagagggagagaaucaggaaaaauaacuaauggguacuaggcuuaauaccugggugaugaaauaaacccccaugacacaaguuuacccacguaacaaaccugcacauguaccccugaacuuagaauaaaaguuaaauauauuaaaaaaucaauaaaucaauggacuuugaguuaagcagaucacccuccauaauguuggggaggaacuucaucuacucaacugaaggcauuaacagaacaaaagauugaccucuccucaguaagaggcaagucugccagcagaaugaaaacauugggucuuccugggucuucagccugccacugacccacccugcagauuuugggacuggccagcuuccauaaucaugugagcaauuccuuuaaauaaaccucuuucuuuaaaaaaaaaaaaagcuauugcaauaauccauucacauauuuaucaucacuuggaucuaauagcugucagaguaaugacaacugguuagauucugcauacauuuugaagguaaagcugacaaacuuagcugaccaaauggacaugagggguuugagagaaaaagcaauuaaggauggguagagauuuuuggccuaaauauuucucuuuggaauuaccauauuuugaaaugaaaccuguaggaagaauagauuuggggcagugggcaaagaugaauugauuuuaaacauguuaagugccuaucuauuacacaauccagucaguaugucaaguaagcauuuagauaugugaaucugaaguuccagaaagaggucucagcuagucucuaucugaagauagaaauuugugaaucaucaauguuagaugaaauuuaaagccguaagacuggaucuggucauuugggaacugaguguagauagaaaaaggaagagguccggguacccugcgucacuccaguauuuaaaggucauggaggaaggaaagaaccugcaaaggagacagaggguaguagccagugaggaagaacaaucaagagaggagucccagagcugggcacggugacucaugccugucaucccagcuacucgggagucugaggucggaggauugcuugaggccaggacuugaagacuagccugggcaaccuagugagacccugucucuaaaacagugaaaaaaaauuggacaugguggcacaugccuguauuucuagcuacuuggaauagcuacuuggggucugaggcaggagaaucacuugagcccaggauuuugaggcugcagugagcuaugauugugccacugcacucuggccagggugacagagagagaccuugacucaaaaaaaaaaaaaaaaaaaaaaagguaucccguaagucaagugagguagcgagggagcuguuuagcugugccaaauucuguugauaggucagguaagaugagaggacugagaauugaucauucuucuuagcaauguggagguuguuggugaccuugacuagcaguuucuauggagggguggcagugaaaguauaaucaguauguucaagagaaaaagcaaggauuggaggucagggagaauagacaauauagagaauucuaacaauuuuguugugaagaggaacagagaaaugggaagaugguggaggauguggagucaagaggaauuuuuuuuuuucuuuuuuuuugagacggagucucgcucugucaccuaggcuggagugcaguggcaccaucuuggcucacugcaaccucugccucccggguucaagcaauucuccugccucagccuccugaguagcugggauuacaggcaugcgccaccacaccuggcuaauuucuuauauuuuugguagagaugggguuucaccacguuggccaagcuggucuugaguaucugaccucaagugaggucugcccgccuuggccucccaacugcugggauuacaggcgugagccaucuugcucggcuaagaggaauuuucuuccaugagagauauuauaguauguuuuuguuuucaggcuuauuggcauuauucagaggaaauaugagaaauggaugaugugagagagaaaggagauaguugccuaaaugaagagguugaaaggagagaucguuuauauauugugauaggaaggcagucagacuauaggaacagacacagguaggaagguagguagauauauggugggcacuuguggcacuuuucuguuuguuacugcuuccuaucugacuacugcugugaucagauaggaagcaaaauuagggacaaugaagaaaggggagaugggaugaaauaguuuuuuaggagagugguagagggaauagauuagggaaguguauuggcagcaccaagggcuuacucggaguuaguggucaggaauauaaaaugagaucauugaguguuauuguuuuucuuagacuagcugugaugguacagagacagaagauguauaaaauaugauuuggaaguauguuagugcugaaauuaggauauuuuaguaaauuuacagaaaaccaccuaugugaaauauaaacauauuaagaaaaaacuuguguauaguuuucucauuguaacacaagauaaaguuauguaaaacaggaaaaaagacauuugcuacaugccaaucauuguauuagaaguuacaggaaccuuaaaauucacucauucauuuauucagcuauuuauuggguacuaaaauuugugcuauucauuguuucagcugcugggguuacaguggugagcaagccagaagagguuccuauccucaugaagcuuauauuuuaauuauacaguuggccuucccuaucugugauuccgcaccuguggauucaaccaacugcggaugaaaaauauuagaaaaaauuaaaaauaacaauacaauaauaaaaaauuauacaaaauuuuaaaguacaguuuaauaacuauuuauauaucauuuacauuauguuagguauuauaaguaauccagagaugauuucaaguauacaggagcauguguauaggcuguaugcaaauaccauaccauuuuauauaagugacuugagcaucgucagauuuugguaucugagggggugggaugggaggugggaggacuuaaucuguugagggguauagcugacaaauacagaacaagaaaaaaguuaauugcccuaauugugaucuuauauggaucauaaauauucagggauggaucaggucagugcaagcuuaaauauaggucugagaacauaggucuagaauccauuacccaaauguuggugccguaaguuuuuuucuuuuuaaaaaaauucccugcaaguguuacacguuuuucuuuuuucuuauuuuucuucuucuucuuuuuuuuuuuuuggcuuuuagaaauguagauugggugaacuggcacagugguguuugggaguaguagcauccuuuacuaacuuaaucaagcccauuaauacuucugcauuguaauuuaucauuauucauggaaauuaggguaauuaagacuaaaauggguccgugucaaguuuuaucacuagguuuugaaaaaacuuggauuucagaguuuuuuggacuucaggauugugagcccaucauggagaagauaggacuuuguacuuuuuauuuuuuguuuuagaguuuauuuuuuuaauuuacuuuuugagauagggucucgcucuguugcccgggcuggaguccaguggcaugaacauggcucacugcagccucgauuuccuaggcuccagccaucuucuugccucauccucccgaguagcugggacuauaggugugcaccaccaugcugggcuaauuuuuuauuuuuuguagagagagggucuugcuguguuugcuagacuggucucaaacucuuaagcucaagugaucuuccugccuuagccuuccaaagugccaguaauacaggcgugagccaccgugcccaggcaggauuugaacuuuuaaaauuauuauuuauuuuuaaaaaaacauuuggguuauuuuaauuacuuuuuauacacagcauuuuauuauuuauuuuuucucccuucccuaauuauguauuuguuuuuuugagacagggucuuguucuguugcccaagcuagaguguagugguacaaucacggcucaguguaaccucaacuuccugggcucaaaccaucuucccaccucggccucuugaguggcugggauuauaggcacaugacaccacacaccuggcuaauuuuuuauuuuuuauuuuuguagagaugaggucucacuguguuguccauacuggcuuugaacuccugggcuaaagcgauccucccacuuuagucucccaaagugcugggauuguaggugcgagcuacugugcacagcuaacuuuguacuuuuuuuuuuuuuuuuuuugagacggagucuugcuuuguugcccaggcuggagugcaguggcacaaucucggcucacugcaagcucugccucccagauucacgccauucuccugccucagccuuccgaguagcuaggacuacaggcacccgccaccacgccuggcuaauuuuuguauuuuuuuuuaaaagaugggguuucaccgaguuagcuaggauggucucgaucuccugaccuccugauccgccccgucagccucccaaagugcugggauuauaggcaugagccaccaugcucagccuacuuuguauguuuaaagggagaguguguauguuuauaugacacauaagcagaaaugaacaugauuuguuagggacaguaaagaaaacugaauugacuaaaugauaguggguguguguugggaaguaaagauaaguuugaauaguuagaggagagugagguuauuaaaagccuugaaugccauugugaaauguuaauacaugaaaugguagacaagaaucaucagagugaaaugauuggaagauuaguuuuccagcuguuuauaugauugaauggagcaauaacaagcuaaggaguuacccaaucggccaaaauuuguugaguacuuauaaacacugcugcugcuccuacuacuacuaaauuauuggcaccuuuuuuuuucuugcucugucaccuggccuggagugcaauagcaugaucuuggcucacugcaaccuccgccugccagguucaagugauucucaugccucagccuccugaguaguuggaauuacaggcaccugccaccacacucagcugauuuuuguacuuuuaguagagacggguuucgacauguugaccaggcuagacucgaacuggugaccucaagugaugcaccugccuuggcccccgcaaggugcugagaguacaggcaugagacaccauacccggccaguaccuuuuauugagcccucgcuaugugccagucauugggcgagguauuuuacuuacauuccuuguagaagucauaagacaacuauuuuuucccuugagacagggucuugcccuguugcccagguuggagugcaguggcuugaucacagcucacugcagccucgaccuucaagguucaagugaucucccaccucagucuccugagagcugggacuacaggugugugccaucacacccugcuaauuuuuguacuuuuuuagagacaggauuuugccauguugcccagucuggucucaaacuccugggcucaaagaguccacccaccucagucccugaaagugcugggauuauaggugugagccaccaugccuggccaggaaucuuacucucuuguuguaaugaaaagucucagggcacaucguuuaaaauauucuacuucauaaauggaacuuucuaagggauaagauguucuccguuuuccagauacuaguucuagaucuugacucagacauauguuugacaugaagacuagucugucagucuucaagaauacugacuuguuuuguuuugguuuuauuaauauauucacuagucucuggcugggcacgguggcucacaccuguaaucccagcacuuugggaggcuaaggcaggcggaucaccugaggucaggcguucaagaccagccuggccaacauggugaaacccugucucuacuaaaaauacaaaaauuagccgggugaguaugguggcuugugccuguaaugccagcuacucgggaagcugaggcaggagaaucucuugaacccaggagacgcagguugcagugagcugagaucgcgccacugcacuccagccugggcgacagagcgagacuccaucucaaaaaaaaaaaaaaaaaauucacuaaucucccuaaugauuauaugguaaucugguuuccugaggaucuuuauauuuaaaaugggagugcuuuguggagauucugagauuagguguaucaccuauuguaaaauaauaaauuagcacgcuaguuuuaaaacauuuuguguauuuggggaauugacacaugccuacuauuugcuauuaggaaaacuuguaaaaauaaauugcugauuuuuaagguucuuauaacaacagugauuauuuguauaaauauuugcuuaauguuugcccuucucacuagaguauaaaccuuaaaauuuaggaacuggguucauuuuguugaauacuguauuuucagaguguagcaugaugccuggcauaugauagauguuuggaaauauuuuuugaauggacaagugaaugauucagaguugaauuguauccuaacaacaaagauaauaucugcauaaguuccugcaucagagaguccuaaccucaaaaagccugauaaucucuucuaaaaguuuggaauacugaaaccagccuaagagauaauuuaaaaagaauuuuuauagguacauagcguguuuaaauauuuauggggugaacgugauauguugaugcaggcauacaauguguaauaaucacauagucaauggaguaucaaaaaaagaugauuuuuuaccuucaauaaaacuguaggaaauaaaaguguacuucagcagaagaguggggaauauauucuuuuaaaacugaugagugcgaaaauauaugaaaguuauuuugauuuuaggcaauguuugcuugacuguaaguuucagaagcuucuuggugauucuuaaauuugcauuugcaccauaccacuauggcuuguuuaugauaucuguagaaugauaaacuuauucugaauuuuaaauguauuuauaacuaaauggauuuacaucuauuuugaauuaacauuucgaucuaacugugauuuuuuuuuggguaguuguugaccuccuugucuuccccuauacccauuacuuauguuaaucaguaguugccucuuuucugauaaauuuuuguuaugaucuguucugcagagaaagaugcugguuucgaguuuuggagauccuuguuuuuuauggaacacaguucuguaaaauuuucauaagauuccuuggcaauaacauacgcuugugauggacccuagaaauacugcuauguuaggauuggguucugauuccgaagguuuuucaagaaagaguccuucugccaucaguacuggcacauuggucaguaagagagaaguagagcuagaaaaaaacacaaaggaggaagaggaccuucgcaaacggaaucgagaaagaaacaucgaagcugggaaagaugaugguuugacugaugcacagcaacaguuuucagugaaagaaacaaacuuuucagagggaaauuuaaaauugaaaauuggccuccaggcuaagagaacuaaaaaaccuccaaagaacuuggagaacuauguaugucgaccugccauaaaaacaacuauuaagcacccaaggaaagcacuuaaaaguggaaagaugacggaugaaaagaaugaacacuguccuucaaaacgaguaaguagaauuccuaacaauaugugguuauugacaauauuuucauuucccuauuaauuuuuauccuauauauguauuuccgggaguuugauuuuaaucuauguuauuuccagauaguuuguuuuugugagccuuaaaauaagccccaaggcuugucaaagauguaaguuaauagcauaaccauguauguauuuguacuuguaaaauuauuuuaaaauuuuauuuauuuauuuuuuugagauuaaguuuugcucuuguugcccaggcuggagugcaauggugugaucucggcucauggcaaccucugccuucuggguucaagcaguucuccugccucagccucccgaguaccugggauuacaggcacccaccaccacaccgagcuaauuuuguguuuuuaguagagacgggguuucaccauguuggccaggcuggucucaaacuccugaccucaggugauccguccaccuuagccucccagagugcugggauuacaggcaugagccaccacgccuggccuauuuaugcaguuuuuaaaggcaaaacuccaaagugcugggauuacagguguaagccacugugucugaccgaaaaaagagaaaucuuuauugagauaugauucauauaccauacaguuugcccauuuaaauucagugauuuuuaggguauuucauuauuagcuuuaaaaauuuaugugaaaucauuucuuucuuucuuuuuuuuuuuuuuuuuuuuuuuuugagauggagucuuacucugucgcccagacuggagugcaguggugcgaucucggcucaccgcaaccuccgccuccuggguucaagcgauucuccuauucuccugccucagcccccugaguagcugggauuacaggcgcccaccaccgcacccagcuaauuuuuguauuuuuaguagagaugagguuucaccauguuggccaggcuggucucgaacuccugacuucaggugauccagccaccucagccucccaaaguacugggauuacaggugugagccacuguacccagccaaaauaauuuacuucuaaaccuuuuucauuaucccaaauuaaaacuccauaaccauuaaauaaugucuuccauuucuucugucugcagcgacugguaauaucgaauguacuugccgggcgugguagcucacgccuguaaucccagcacuuuggcaugcugaggcagguggaucaccugaggacaggaguuugagagcagcguggccaacaugaugaaaccccgucucuacuaaaaauacaaaaaauuagccaaccaugauggcaggugccuguaaucccagcccuugggaggcugaggcaggagaaucgcuugaauccaggaggcagagguugcagugagcucagguugcgccacugcacuccagccugggcaaugaaagcgaaauuccaucucaccccccaaaaaauucuaauguacuuuuagcaacuauaaauuugccuauccuagcuaacucauauagguguaaucauacaauauuuguuauuuugugucuggcuuauuucauuuaccagaauguccucaaggugcaaccauguuguagcaugugccaaaacuucauuccuuuucauggcugaauaauccauuguguggauauaccacuuuauuuuuauuuauuuauuuauuuauuuuuugaguuggaguuucacucuuguugcccaggcuggagugcaauggcgcgaucucggcucacugcaaccuccgccuccaggguucaagcaauucuccugccucagccucuugaguagcugggauuacaggcgugugccaccauucccggcuaauuuuuguauuuuuuaguagagaugggguuucuccauguuggucaggcuggucucaaacuccuguccucaggugauccgcccaccucugcuucccaaagugcugggaugacaggcgugagccaccacacccagccaccauuuuauuuuuuauccauucaucucuugauggaaucuugguucacauccacuauuuggcuauugugaguaaugcuacagugaauguugccauacaguuaucuauucaaguuccugcuuugaauuuuuggguauuuacuugggaauagaauugcugggucauacgguaauuauuuauuuagcgcuuucaggaacuguacacuuuuacaguggcuauacuguuucauaucccaucagcaaugcaugaguuuuugauuucucugagucuucaugagguuuucuuaauuuuucuucccucccucccucccuccauuccuuccuucuuuucuuucuuccuuccucuccccgucuccccucuaccucuccugcucccugucucugccucucccccucucuucccuccccuuccuuuuguuuucuuccuucccuucucucucuuuccuuccucccaccgcccccccaccgcccccguucucaagcuguagcacauugugguuuuugauuugcauuuucuuaacaacuaaugauguugaacaauuuuucaugugcuuauuggccauuuguguaucuucuuugaagaaauguuuguucaaauuauuugacuacuuuugaauuguguuuuguuguugaauuguccagguucuuuauauaaucuguauauaggauuuuaaaaauauuuucucucauucuguggauagucuuuuaauuuccuuuuguguccucugaugcaaaaaaaaguuuucaauuuugaugaaaaccagguccaguuuauuuuuuccuuuauuaccuguauuauuagugucauagccuagaaaucacugccaaauccaauguugugaaagucuucccccuauguuuuccugaggguuuuaucguuuuagcucuuauguuuagaucugugauccguuuuguauuuaaguuuuguauaugguuuaaaguaaggguccagcuucauuccuuuacaugauauucaguuuucucagcaucguuucuugaagagaguaucuuuucuucauugaaugguuuuggcaacuuuguuaaagaaauuauugggccgggcgugguggcucacgccuguaaucccagcacuuugggaggccgaggcgggcggaucacgaggucaggagaucgagaccaucccggcuaaaacggugaaacccugucucuacuaaaaauacaaaaaauuagccgggcguaguggcgggcaccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaagaaauuauuggccauauaugugagaguuuauuuuaggacucuuccuuuccauuccauugguccauaugucugucuuucugcaaguaccacacuguuuucauuacuguagcuuuguaguaaguuguuuguuuguuuguuuguuuguuuguuuuagauggagucuuacucugucgccuaggcuggaguacaguggcaugaucucggcuugagaccgcagccucugccuccuggguucaagugauucuccugccuccugccucagccucccucccaaguagcugagauuacaggugccugcuaccacgcccggcuaguuuuuguacuuuuaguagagacaggguuucaccauguuggccaggcuggucucaaacuccugagcucaaaugaucugccugccucggccucccauaaugcugggauuacaggugugagccaccgugcccuuccuguuuguuuuuaaagagagagggucuugcuccgucauccaggcuacgcuacucacugcagccucaaacuccugggcucaagugauccuccugccuuggucucccaaagugaugggauuauaagcaugagccaucauggcuggccuguaguaaguugaagucagaaagugugaguccuccaacuuuguuauuuuucaaaauuguuuuggcuauuugggguuccuugagauuccauauggauuuuaggaugggguuuucuguuucuuuaaacaauaauguugggauuuugauagaaauuacauugaaucuacagaucacuuuagguaguguugucaucuuaauaugaagucuugaaauccaggaaugugggaugucuuuuguuuauuuaagauuuccuuaauuucuuucagcaauauuuuauaaaauuugugguguucaagccuuucaccuccuuaaauuuauuccuguguauuuuauuuuuugaugcuauugcaaccagaauuguuuuaaauuuacuuuucagauugcucauuguaaauauauagaaauacaacuaguuuuuuuaauuauuaauuuuaauuuuuuuuuagagacagggucuugcugcccaugcuggaggggcaguggcauugcucauuguagccccaaacuccuggacucaagcaaucuuccugccuuagccuccuuuuguuuauuuuaauaaaaaaaaauuauuuuuguagagauggggucuugcuguuuugcccaagcuggucuugaacuucugaccucaaugauucuccuuccuuggccucccaaagugaugggauuacagguguaagccacuguguuggccacaacugauuuuggcauguagguuuuguauccugcaacuuugcugaauucauuuauuagcuugaacaauuuguugauguuuuaggguuuucuacauauaaaacugugucgucugccaacagagauaauucaguauuuuaauauaugccucagguauuucuuacauuccagcagauuugggaaacacuagguuuacuuacugugaaaugagaguagguuauuuucuguucagugaguuagcuacugaaaauaguguucuuuugucuacugaaauauuauauauaauuuuuuucauauuuuuaaaauuauaaacucccaauggccauuacugaauagguuacauacaguguuuugaauguggucaagcaaccucuuuagugguccuuaccgguagaagaacuuaaacaacuaguauacugaaaguaguaguugcugguacuauagcaggaagacaaaagaagaggaaaacagaacgauagaaggcaguguaagaaacaagaggaaaggaugaugauaaagugccaucaggcuaccucaaaggauaaaguuuucuguccauaauccaugcuaguauaguauguaggcuaaucuccgaguuauauugauauauauguauauauagauuggugcaaaaguaauugcaguuuugggccaugcauuuuuuuuuuuuuuuuuuuuuuuaaggcagagucuccuuuuguugccuaggcuggaguggagugcaguggcuugaucucggcucacugcagccuccgccuccuggguuaaggcaauucucuugccucagccuccugaguagcugggauuacaggugcuugccaccauaccuggcuaauuuuuguauuuuuaguagagaugagguuucaccauguuggccaggauggucucgaauuccugaccucaggugauucgccugccucagucuuccaaagugcugggauuauaggagugagucccuguguccggccauugaccaugaauuuuaaaucaucauaacuaggcucaaacacaucuuuauuaaucaaaauaggaaccauuacaauaaaaguuugugccaaaaagaaaucaguuuguuuaauccuguagcauaaaaaucugugcuucuggauucaacaaacucuugggaaggauuuuacgcauccugcugguuguggaagcuguuucccugcaaaaaauuguugagaugcuugaagaagugguagcugguugacgagaggucgguugaauaugucaggugaggcaaaacuuaguaguccaauucguccaacuuuugaagcauugauugugugacauguagucaggcguuguccuggagaagaauugggcucuuuuuguugaucagugcuggcggcaggcauugcaguuuuugguacaucucaucaauuugcugagcauacgucucagguguaaugguuucgcuggcauuuggaaagguauaguggaucagacuggcagcagaccaccaaacggugaccaugaccuuuuuuggugcaaguuuggcuuugaaaagugcuuuggagcuucuucuggguccaaccacugaucugguuguugccgguugugauauaaaauccacuuuuugucacacaucacagucugagaaauuuuuccuuguugguguguaaaaugccgaaugacuguagaaugguugaaguugccgaguuccucggcaacuucucguguaguuaaaagaggaucaguuucgaugauugcucucaguuguugugagcuucugacagccagccacugugcuucuuaucuucaaggcucuuaccuccuuugcaaaacuuccugaaccaccgcuguacuguacauucauuagcaguuccugggccaaaugcguuguugauguugcaaaucgucuccacugcuuuaugacccauuuuaaacccaaauaagaagaucgcuugaauuugcuuuuagucuaacauuuccauagucuaaaauaaauauaaauauaaauauaaaauaaacagcaaguaaucauuagcaaaaaaacauaaagugagaaaugcgcauuaaaaugauauauaacauaaccacauuuaagaacguauuccaauaucaaguggcaaauuucaacagugcaaaaacuguaguuacuuuuacaccaguauuaccuguuuuauuuauaguuuauaacaauuauauaguuuuaaaaaauaaauguguguauauguauguauauccguauauauaaacugugguaggcugcauauaaccugaacuuuuuccauuuuaaccauuuguaaguguauaauuuuguggcauuagguagaugcacuuuuugugcgaccaugcccacccaccagcucuggaucuuuuuuugacauuuuccagcugacacucuauuaacucuucauucucccuccugcagccccuagcgaaaccacuauucuacuuucugucuuugaauuugacuacuguaauuaccacauauaaguagaaucauacaauauuuguccuuagguaacugccuuauuucccuuagcauaauguccucaagguuguccaucuuggaguaugucagaguugcuuucguuuuuaaggcugaauaauauuccaguguauguauauaccaaauuuuguucauucuauggauaugucagauucagaagcuguuugugaauuuuuagguuaaugugauugucaacuauuaauuucuagauuuguucagcuauuacuuuucuggguaguauuuuacuagauaaguuaaucuaguccaucuauggauggccacugguauugcuuccagcuuuuaacaguugugacuaaugcugaacauguguguagaaauaucugagucccugcuuucacaucuuuuggguauguauauauguggaaguggaauuuuuggucguauugcaauuuuuuugguaagagauugggugucgcugugucacccaggcuggacauuguaauucuuuuuuuuuuuuuuuuuugauacaggaucucacuccuguugcccuggcuggagugcaguggcauaaucacagcucacugcagccuugaccuccugggcucagaugauucugccaucucagccucuugaguagaccggcuacaggcaugcacaaccacuccuggcucauuuuuuguauuuuuaguagacauggggguuucaccauguugcccaggcugaucuugaacuccuggacaggcuggacagucugucugucucagccucccaaagugcuaggauuuacaugugagccacugugccuggcuggggcauuauaauucuauguuuaauuuuuugaaagaauuaccauacuguuuuccacaggggcuguacaauuuuacauucccaccaggaacucacaaguauucugguucuuccacauccucgguaacaguuauucuguauuuuuaaaaaauuauagccauccuaauguguaggaguuacucauuauauuuauaauuuauuauuauauaucuauaguuuuguuuguuugagacagcaucuugcuauugccuagguuggagugcagugaugugauuaggcucacuguagccuugaccuugaccuccugggcucaagcaauccuaccgccucagccucccaagaagccgcggcuacaggugugugccaccacacuucuaauauuuuuauauuuuguagaaauguugcuccuuauguugcccaggcuggucuugaaauccugggcucaagugauccucccaucucagccccccaaagugcugggauuacaaggugucagccaccgugccagugagccacugugcccagcuugauauguguuuuuuuguuuuuuaaacauaagacuaaucgcagcacuuugggaggccgaggcggguggaucacuugaggucaggaauuugagaccagccugaacaauauggugaaaccccaucucuacuaaaaauacaaaaauuagcugggugugguggugagcaccuauacccccagcuacucaggaggcugaagcaagagaagcucuugaacccaggagguggagguugcagugagccgagaucacacuacugcaccccugccugagucacagagugagacuccaucucaaaaaaaaaaaaaaaaaaaaagucuaagauccuuugccuuucuuuuuuuuuaaaagacagagucucacucugucacccaggcuugcaugcaguggcgugaucucggcuuacugcaaccucugcugcccagguucaagccauucuccugccucagccucccgaguagcugggauuacaggugcaugccaccacgcccugugcugcgccuggcggaucuuuugccuuucuacuuuaucuucagugcuccaaaagaagcagcccuggaacuccuauugagauugugauaaaggauugugauaaaggauaguauuuucuccuuuacugaccauagggaaauaagagaauaagaaacaaucuuggcugggcacaguggcucacaccuguaaucccagcacuuugggagacccaggcggguggaucaccugaggucgggaguucgagaccagccugaccaacauggagaaacccugucucuacuaaaaauacaaaaaauuagccgggcgugguggugcaugccuguaaucccagcuacuugggaggcugagacaggagaaucgcuugaacccaggaggaagagguuguggugagccgagaucccggcauugcacuccagccugggcaacaagagcaaaacuccaucucaaaaagaaaagaaagaaacaaucuugccgggcgugguggcucaccccuguaaucccagcaguuuaggaggccaagguggguggaucacaaggucaagagaucgagacuaugcuggccaacauggugaaacucugucucuacuaaaaauacagaaauuagcugggugugguggcucacgccuguagucccagugacucaggaggcugaggcaggagaaucacuucagcccgggaggcggagguugcagugagccgagauugcgccacugcacuccacccugucucaaaaacaaacaaacaagaaacagucuugguuuguucaugaaagaaucuugauuuguuuguguccuacucuuaauuguaauaccuuguuaaggaauaauugacaguggauugaaguuuggaaagucuccagagagggaauaaaaccucagaaucuccugaaucuagaaaaacauuguuaaguauaucaaacugcagugaucccugugggaauuuuguaguuucaguguagugaagauggcuaaugaauuagacucaaaaauagaaugccacauuuagauuacuguucuaauguuucuuugcauaaacuuugguuccagugaguucuuaacuguggugguguuuugcaaacaaagggaaaccugaagacauuuucaguauauucgucuucuuuauuuccuuuaagaaaagguuauucugcuugaugauuuauguaucacauaucauggaugguuaaugcauaguauguuaugucauauuucauacuuuuauuacuuggaaauuuuuauuuuaaaaugucagacucauauuugagguucaaaaguugagaauuuuuagguuaauaacaugauuuucaacugucaauuucuagauuuguucaggugucauuuuucuggguaauauuuugcuauauaaaaguuaauuaucuaaucaguuuacuuucagugaaaauuuuuguucuguauauguuuacuguggcuuccaucagccuauuuuaguuaaaaaacaagacuuaauuuuagcuggguagucugggugacagagcgagauccugucuccaaaaaaaaaaauguguuuucagguucaucuucgcuuggagaaucauaucacauuaagaauaaauuguugggaaucaaaguugguacaaagaaacuuccagaagaguaacuccaacauugcuaucuuugguaucuuccagaaacauauuugcacuuacaaaccaguaugcauccccuacauacauguucuuuccccauuuuaaaauguaaauaguagcacacuguaccuacugcucuguaucuuuuuucuauuaaauaguauauacuaaagauuuuuccauaacaagacuaugagaacuucuuuagcccuuggaaauguggcuuauauaauuuuuuuuuuuuuuuuuuuuuuuuuugaggcagccuugcucugucguccaggcuugagugcaguggugcgaucucggcucacuacaaccuccgccucccggguucaagcuuuugucuugccucagccucuugaguagcugggauuacaggugugcaccaccacgccuggguaauuuuuguauuuuuaguagagacaggguuucuccaaauuggucaggcuggucucgaacuccugaccuugugauccguccgccucagccucucaaagugcugggauuauaggcacgagccgcugcgcccagcauauaauuuucuuuuuccaguuuguuauuugucuuuagacuuugguuauguuauuuugccaugcagaaauauuuagcuuuuuaccugauguaauuuauaaaucuuuuuaaggcuucuggauuuuugacgugucauuagaaagaccuucuuccuucgaaguuuauaaaagauuuccuuauguuguuuugcagaucuuuguaguguuuuguuuuuuaacauauaaauccuugauccauuuggaguuuguuaugguuuaugaguuaugguuccaaauuuaucucuuuccaaauggcuacaugguugucccaacacuuauuauuauuauuauuaucauuugagauggagucucgcucugucgcccaggcuggagugcaguggugcagucucggcucacugcaaccucugccuccuggguucaagcaguucuucugccucagccuccugaguagcugggauuagagacacacaccaucaugcccagcuaauuuuuguauuuuuaguagagacaggcuuuccucacguuggucaggcuggucucgaacuccuaaccucaggugaucggccugcuuuggccucccaaagugcuggggauuauaggcgugagccaccaagcccggccucaacacuauuuuuaagaaguccaucuuuacuucucugauuugagaggcugcuuugucauacacugaauuucuuuauguacuugguucuagucugauuuuccuuuuaguaucaaugauguuucuguuuauuuacauuuuuuguuuguuuauuuuuaagagucugagucuugucuuuuuuaaccaggcuguggugcgguggugugaucauagcucacuguaaccuugaacuccuggggaucauccuggggaucaagcuaucuuccugucccagccuggcaaaucauuaggauuacaggugugagccauggcacccggccaccaugauacaguuuuaaguauuuuguuuuauagguaggacuaauccauccuccuaacuuguauuuuagugugcucccuguacuuuugccuauuaauuuauaaacaauguaauuucagugaaaauaauuuuuuuuuucuagaauguggcugauuauaaaguuuguauauuguucaucuuuaucugugguugaauuuggagccuaauuugaugaugacuacuuugagaggcuuugacuuuaguuuuccaggaguuaggguacguuacugacaccuuuccuggggucucuauuuugccccuagcgcaugacuugaugcacuuacccacuguauuauugugccuauuuaggucagcccuuuuuauucuuuucuuuugguccuguuggagcuucuucuuacuccuaugaggcagcaguguaagaaacguauuuuaugcugguuugaguuauuuuguuguaauagaagacucuucacaguauuuagcguagcauauugcucuaaguagaaagccccugauuguuuuauaagaaauaauguucauuauuuuauuuuuacuuuugagacuagagucucacugugucauacaggcuggagugcaguggugcaaucuuggcucacugcaaucuccgccuucugggguucaagugauucuugugccucagccuccugaguagcugggauuacaggugaaugccaucaugucuggcuaauuuuuguauuuuuaguagagaugggguuuugccauguuggcuaggcaugucucgaacuccuggccucaaguuaucugccugccuugaccuccaaagugcuaggauuacaggcaugagccaccaugcuuggacucauuauuaauuuuauagcagguuuuccuguuuucuuuuuuccucccaaguggaaagaaaaacuuucuuguaauuuuucucuaaaaauuuauguuuggcuuugaugcaguuacauguggugucugccauuucauaagcugucagaaugguacauucauuuuucuacagcaguauuuuagaaagugaaaguagagauggaagucacaauauuuacuuguauuuaucacacaguaacuuaaaaggagauggagcaaugguacauuucuuuccagcauuuaaagaaaauuccguuuuuggaguuacauaauacgugauuguaguucauuuaguaugcuuagccaaaaaaaaaaaaaaagucaaguauacaagcuugcaauaaaaaguucuacuauauuaggaagucagaguugaggagguacacaaaggcaucuuggcaaaaaugcacaaaugguggauacauaacauuuuuuaagagacacggucuucuucuaaagaggcagucuguugcccaaggcugugcaguggcaugaucaugguucacagcagucuuggcucccaugggcuuaggugauccucccaucucagcuuccggaaucacuaggaccacaggugugugccaccgcacuuggcuaauuuuauuuuauuuuuuauagagacagugucuuguuguguugcccaggcuguucucgaacuccugugcugaaucgauccuccugccuuguccucccaacauacugggauuacaggcgugagccacugcauuuggucauaucauuauaccaugucucaugauuaugaugagcagauuacguauuagucaaauagcauugaaauuuggugcuuuguugacuaacauuuuugucauuggauaguuuauuugauguuacuuuagucuagaugaguggauuucaugagcacaaugaauuacaaguaaaauuuauagccauaauuauaauuuccaguccaaaaaugguuuucuguuuagaaaagaaaauucuaugccaucuuaauagauuuaagaagcaguucguugaagaaauaauuuugaauuucagugaagcguuuuuuuuuuuuuuugagacggaguuucgcucuuguuggccaggcuggagugccauggcgcgaucucggcacaccgcaaccuccaccuccuggguucaagcgauucuccugccucagccucccgaguagcuggcauugcaggcacgcaccaccaugucuggcuaauuuuguauuuuuaauagacaggguuucuccauguuggucaggcucauuucgaacuccugaccucagguggccugcccgccuuggccucccaaagugcugggauuacaggcgugagccacugcgccuggccuaagugauuuuuuuggagaauuauuauuacuuuuuaaacaaaauuugauaaaguuaaauauuuuucuuuuuuguagaaacagucuggcuauguuggccaggcuggucuugaacuccuggggucaaacgauccuccuaccucagccucucaaagugcuaggauuacaggugugagccaccauacccggcugagaauuauuaaaacccacaugaauccaaguauuagacuuaaagccuguccuggaauuuaaaauuuuauaaugcuauauaacugguagauuaauguuucuuuuucuuuuuuuuauuugagauggagucucgguccauugcccaggcaguucaguggcauaaucuuggccacacugcagucuccaccucccagguucaagcaguuuucccaccucagccucccagguagcugguacuacaggcacacgccaccaugccuggcuaauuuuuguauuuuuaguagagacgggguuuugcuauguuggccaggcuaaucuugaacuccugaccucaggugauccacccacuucggccucccaaagugcuaggauuacaggcgugagccaccgugcccagccuaauguuguuucuuaaauaagaaaaauggauaauaauagugccuuaguucuugcucgguagagauuauuugccuggcaguuuuuaaagugcugcaaacaaguuccaauuauuuugaaauagaguuguuggaaaaaaauugguaugacauuaccuagguuuuggauuuuuuuccuuuguauuuguuagauaauaauaguguauuaacauauacaccaaggaauacuaugcagccauaaaaaagaaugaguucaugucauuuguagggacauagaugaagcuggaaaccaucauucugagcaaacuauugcaagggcagaaaaccaaacacugcauguucucacucauaggugggaauugaacaaugaaaacacuuggccacagggugggaaacaucacacaucggggccugucguggggugggggcaggggggagggauagcauuaggagauauaccuaauguaaaugacgaguuaaugggugcagcacaccaacauggcacagguauacauauguaacaaaccugcacguuguacacauguacccuagaacuuaaaguauaauaaaaaauaaugauaauaauaguguguuagguuuucuagauaauaauaguuccuuuaaauuauacccuauuuuaaguuagcccaguuuucuauaaaauguauauauuuuaaauugagauauaauucaaauacuguaaaauuuauccuuuuaaaauguacaguucaguguuuuuaguauauucaguauguuaaguguauacagaguuacgaaaccauuauuaauaauuuuaaacauugucaucuuaauaaacauuuucaucuuaaauuuguaucuuucgugugccuuuuauacuuaaaauaacugaucaaaaggacuaauauuuugauuuauacuuucacaaaggagguuacaguuuuauaucacuuaacuuugcccauagucucuagugcagagucacaacauucuuugauuuguuuuuccacgugcuguaaaaaaaaauugugcuaugacaugauaacugccaugauagaaauacauacggaguguauaugugaaucgcagaaucauuggagaagguggugagcaagagaauaugcaaagaagggcucaugcuuaaaauuagguguugacaacuuugucagaauuugcuggaaagagaaaggcuuuugggacaaaguaaauaauaaagggaaaaugcacacuuaggaugucucacaggguuuucucaguugugcuguaaaacaagaauuugacaguucuuuacuguagguaaauaguaagaaaauauaaauaaugaggccgggcgcaguggaaaaaaacaaaaagaauugcaugaccauacuuauuuuuucuuaggauuuuucuuugguuuuuuguuuguuuguuuguuuuuaaguuugugguccuacuuuguaguaggauuccucuuagaggaaaaauuaaaagauaaaaccacuuuuuuggacuauuuuucuguuucagaaauuuggguuugcuuugguaaguaggggcccugucauuuauagcuguaaugguaaaucuuuuuuuuuuuuuuuuugagauggaguuucagucuugguugcccaggcuggagacaaugguguuaucucagcucacugcaaccucugccuccuggguucaagagauuauccugccucagccucccgaguagcugggauuacaguugugugccaccaugccuggcuaauuuuuguauuuuuaguagagaugcgguuucaccauguuggucaggcuggucuugaacuccugaccucaggugauccgacugccuuggccucccaaagugcugggauuacaggccugagccaccgcgcccagccaguaaauacuaacaaagucagauaaguaccugacuuuuauuuuacaaauaugugcauaauuaauagugaacuacccuggucuucaugagagagugaaagucaagcuauauaauauuggggcagauucguagagcuucuuuaucuuacagaacugcaacagcagguggcauuagagaucagguuuaagggugaguugcaacguauuuuuaauaguugccacuauuaggaagggaaguaacacauauuggggauucaggguacaacuggcaaagcucagcuugacccuuggguguugcugaucuguuagaagauucuccguauguguauauauuuuuuuaaacuaaccacuaaaaaauauagcaauuaagaauuaccuuccaagaagaaagggaaaauaauguuuuaugucuaauaccuaccuuuccauaucccaaacuaaacaguugaaaaauaagagggugucauccagggccuacuuaauaacguuuaccuuuucuuuacaaaugaaugucauuuugcaccagcagaugccuuaugucaagaguuaugggcuggacaugguggcucccaccuguaauccuagcacuuagggaggccaggguggguggguggcuugagcucaggaguucaagaccagucuggcaacauggugaaaccccccuguacaaaaaauacaaauguuagccaggcaugguggcuuacaccuguugucccagcuacucaggaugcugaggcaggaggaucacuugagcacaggaggucgaggcugcaguaaguuguguucaugccacuguacugcagccuaggugauagagagaugaaguggaauauaugauuggauaaggacuuacagggaagagggugguaguuuacauauuaacuguggcuucccuggaacugcuuaauguaaauacggaucuuucuauaaucuggauuaugcauacuaaugcuuuaguuucucuaaaaucaaugaccuaaauugagagaauacugauuauuaaaagaagauaaugucaacaaagaugucagaaauguuauuaaggugaaauuguaaccagaacucacuuuugaaacaaaacagguacugaacuaguguuuauuuuuuaacagccaaguccuaauuuacuauguauauuuuacuuuuauuuuuggaaaacauaucaaaguauacaagcuugcaauaaaaaguucuacuauauuaggaagucagaguuuaggagguacacaaaggcauuuugacaaaaaugcacagaugguagauacacuagaauauuuuagcuguauugagugaagcuacauugaauuacuaacaucugaggauauauaugaaggcacaaaaaugauccuaacaucuuucuguaggauuugauaguaacucucacaguaaaaacagugaaacaaaauggcaccugcuucucagccucacuuuuucauuucuuagcaaaauuacugagugugauuauuguguaguuccuugccuagucuuugauuuuacgggcugggggcuccaaaagauugcugaggagaucaaaagcagaugcugaaaauuauaagccaaggcaggggagcuugguaaccuuucuuucuaagcuguuuguugauuauaacgguuagggcaauuaugaagguuaggaauuaugaaauauggaaauucuccuaagcauacuugguaacucuuaaaaauucuauuugucucaaccucgauaacuaaaauuaccuaagauaaaugagaaaaauuagaaaagcaaauuuaaucacuaaauuucuaaauaaaaagcaaaaaggauaaaaaaguuucacugugcaaggagaaaggaaggaggaugagggaauggaaagacucagcuuagacaucccccaauucugugaaacguucccugaaccuuucuaggagguuacucuauccucuguguuuccauugcauauauuucuguuuuuaacauauagcacauuguauaauaauuauuaauugauuucucuauuucuuuggcuccuucagugucagggugaucuuuuaaguuugugcuuuuuaugagcaacacagaaaaugcuuuaaaaacaguucaguaagacugaagaaaagaucuguaagcauaaaacaaauaccaucaucauuaccaaaaauucagugcuuaaaauauagcuugagaaugugaguauuuauuuccuuauuccuaagauuuugcuuuugaauacacuaucugccgggcgcgguggcucaugccuguaaucccagcacuuugggaggccaaggcgggcgaaucacaagaucaagagaucgagacuauccuggccaacauggugaaaccccauuucuacuaaaaauacaaaaaauuagcugggugugguggugcgugccuauaaucucagcuacucgggaggcugaggcagaagaguugcuugaacccgggaggcggagguugcagugagccaagaucgcgccauugcacuccaacccggaugacagugugagacucugucucaaaaaaaaaaaaaaaaagaaaagaaaagaaaagaaaacugucauaacuguauuacucaaauauuuccucuucucucauuugcuaaaaauauauaguaaaacuuucaugccuauuuaaaacaaucucuaggccgagugcaguggcucaugccuguaaucccagcauuuugggagguugaggcaggcggaucaugaggucaauagaucgagaccauccuggccaacauggugaaaccccguuucuacuaaaaauacaaaaguuagcugggcaugguggcgugugccuguagucucagcuacuugggaggcugaggcaggagaaucgcuugaacccgggagguggagguugcagugagccgagauugcgccacugcgcuucagccuggugacagagcgagacucugucucaaaaaaaugaaugaauaaaacaaucuguagauugcuauuuuuaagaaauugcggaugccaaggugggcagaucacccgcggucaggaguucaagaccagccuagucaacauggcaaaaccuggucucuacuaaaaauauaaaaauuagccaggaauggugacacccaccuguagucccagcuacuuggagggauggaguacgauaaucacuugaaaccgggagguggagauugcagugagcugagauugugcuacugcacuccagccuaggugauagagugagacaauauguaauaaauaauuaggaacaucugaaaguaaucuuaguuuaagaaaacauuuugaaguugggcaugguggcuuaggcuuguaaucccaguuacucagaagacuugaggcaggaggauugcuugaggccaggaguuuaaauccauccuuggcaacguaacaagaccccauuucugauuuuaaaaauaaggaagaaagacaaaacauuuuuagaugucaaacaccuuuugaaagaguuuaacacaucuuaaugacuuaccccaaauaggugguaccauaugaacccaagucaaacaauuuuauuauuaauacuaugggguauuguguuuuuccaauugccuuuuguuuuguuuuuauuuuuuaaaccaauucuuuguguuuaggcuccuuagcucuuuuuuuuuaaauauaguuucuuuuuauuuagagacagagucucauucugucgcccaggcuggagugcaguggugcaauaucagcucauugcaaccucugccucccagguucaagcgauucucaugccucagucuccugaguagcugagauuacaggcaugugccaccauguucggcuaauuuuguauuuuuaguagagacaggguuucgccauguugaccaguuugguaucaaacuccuggccucaagugaucugcacgccuaggccucccaaaauucugggauuacaggugugagacaccacgcccagucuaggcuccucagcucuuaccagagaauuugggacuuguuaauaggagaagauaggcacauucugucaucuuacuugugcccuaugggcugcgugccaucucagagugcuuuuuuuuuuccuuaugccuauuuaugaagagguccagaaugcaugucuacauuauuugacugcugcguuuucacuuccauguucuuguugacaaaugcuauucaagcaagaagacccgauuguauguagguaucucugagucuugcuaugauggauucuguagucuuaccuucaucuugauuguuuacuuuaaaagcugcuuaagcuagagguauuuuuaugguagagaagagaacaguuggcacagagcccagcuucuccauggcagcagcaauuaugcaaauuauccuggaucuuuacauuucaguaaaaccuuucuucccccuuuacauacacaaaauagacagcuaaggggcugugaucuguccuaaagccuuggagauaaaacaggaugucacucuuuucucaaaaugacuucuauuacggaagcaugagcucccuuaaauggaagggcaaagcaaaucccugccauugggcucugcagccucugcuauaaaugugccaggaagauuaaaacuaccguaauuaguuuaaucagguucauccucaauucuugcuuucauuauguaguaggaacuucccuaaucaguacugcauuuggcugauugaagaguucacuuucauagcuaggauaucugcuggagucuguauugugguuuguuuuaaugguguauauauggugaaugugaauguuucucauuucauuguugaucuugcuaauggaaaaaaaaaaucauuauugaaccaaauuguuagaagguauaucuucuuuagucccagagaauuaagccuaaauaucauuacuuucacucacuaauucguauacugcuuuuuaugguugucugcucauaucuuugauuucauuuuaaugauuguaaaucacuccagagauccucacauacggcugcucaauaauuacacauuacuaauuaauucugagcuacagcuguauggaaaugaaugaaagcuuuuugagagacaucagaauuaaagguccuauaugauaagaugacaaaaccuggaacuuuuaugaaaauucauuaauaggaagacaagaugaaacuuaaugaugaaagaaaaguuuccucucugaccucacuuugugagucaaaaucacugaguacauaguucaaaauuguaccucuuucguaacuaguuagauggggauagggagaaauccugugagaaagacuauagaugaagucagauuugcagugguuuuucauguugggaauaaaagagguguuaaaaagacccugaagacuuuguccucugccacugggacaaauugacaccuuaugucuauuccuuaaauuauauagcaagaagaacuucuugggugguggaaguuuacaucacaugaugauuucuauauuaguauugccauuauuuuaucauaauuuauuuaagaaauuaugcuaguaacauguuuuggcuuacucuugauccuaugagggccauauaaugaggauagaauuuggggcuucaguguggaauauaaaauucaaguucagcaucuaaugguuuuguaauuuaagaaaagcccauuguggucugcuuuugaaaagaaaauauuuggugacuuucuauuaaaaugcauucuugaccuauauguuuaauuuucuuuaauauuucuuuuuggcuuuuuuuuuuuuuuuuuacuccuguucucagauguuuugguucucuuuugauuauaugccacaaacugaagcguacuuuucuugaaaguguuuucugggccaggcgcaguggcugaugccaaggaguucaagaccagccugggcaacauagagagacccugucucuacaaaacauuuuuaaaaacuagccggcuggucaggcacaguggcuuaugccuguaaucccagcacuuugggaggcugaggcaggcagauuaccugaguucgggaguucaagaccagccugaccaacauggagaaaccccaucucgacuaaaacuacaaaauuagccaggcgugguggcacacaccuguaaucccagcuacuuggaaggcugagggaggagaaucgcuugaacccgggaggcagagguugcggugagccgagauaaugccauugcacuccagccugggcaacaaaagcgaaacucugucucaaaauacaaaaaacaaaacaaaacaaaaaaaugaacaaacaaaaaccaaaaaaacuagccaugcaugguggugugugccuguagucccgucuucucaggaggcugagguaacauuaaguacauuuacauuguuuugcagcccucaccauccguucuucucuacaguuuuuuuuuaaucuucugcaacugaaauuguguaucuauugaacagugacuccccuguuaccccuccuagaagccccuggcaaccacuauucuguuuucugucuuuaugaauuugacuguucugguuaccucauauguaaguggaaucaugcaauauuugucugcuggugacuggcuuguuucacuuagcauaguaucuuuaaaguuuauccauguuuuagcauucguuagaauuuucuuuuggccgggcgugguggcucacgccuguaaccccagcacuuugggaggccgaggcggguggaucucaaggucaggagaucgagaccauccuggcuaacacggugaaacccugucucuacuaaaaauacaaaaaaaaauuagccaugccugguggcaggcgccuguagucccagcuacucaggaggcugaggcaggagaauggcaugaacccgggaggcggaacuugcagugagccgagaucgugccacggcacuuccagccugagcgacagagugagacuccgucucaaaaaaaaaaaaaaagaauuuucuucuuuuauggcugaauaauauuccauuguguguacauuugacccuuuaacaaugcugaaguuaugggcaccaacuccacacacaguugaaaauccaaguauaacuuuugacucccccagaacguaacugcuaauagucuacuguugaccagaagccuuaacgauaacauagccuguuaacacauauuuaauguuauauguauuauguacuauauucuuaaaguaagagaauagaaaaugaaauauuuacacuguucguuaaguugaaguugauaagguugucauccuuaucgucuucauuuugaauaggccaaggaggaagaguagggguuggucuugcugucuaagggguagcagagguggaagaaaaucuccauaugcuaugaagccugcacaguucaaacuuuuguuguucaagaaucaguuguauauaccauauuucauuuauucauccauugaugaacugugaagcagccugcuuuuggcuguugugacuaacuaaugcuuccaugaacauggauuuacaaauaccuguuccaguuccugcuuucacuucuucugggugucugcaaguuuaagaaucaaaauuuuaaacaaaucaaauuggcacuagauaaguuacuuguaagguuuguauggaaaaauaagcaagaguagccacaacuuuucugaaaagaacaguaacuagaaaucaggcuuauuagauaauaaaacagaaauuaaaaggguuagaauauugugguugugguggacuggcagacggaaaaucacugacgccgaauagaaaaucuaauaauuggcugggugggguggcuuacaccuguaaucucagcacuuugggagguugugacgggagaauugcccgagcccgggaguuugagaccagccugggcaacauagugagacccccaccucucuacaaaaauuaaaaaaaaaaaauagccaagcgugauugcacaugcuugugaucccagcuacucaggaggcugagguggaaggauugcuugagcccaggaggucaaggcuacaaugagccacguucuugccacugaacuccagccuaugugacagagcaagacuccaccucaaaaagaaaaaggaagaagaaaagaaaaacuaguaguagacucguguauacgugaggauuuaguacaugggaaguguagcauuucaaaucagaggaugaaagauggaauuauucagucaauuccauuagaaccgguaguucuguaguagauuuuauauuaccauacacgcauauacaugcauacauauauauuaaacuucaugagugcaugucuuuuuucuuuuuauggcuacauuuacuuugagaagacaaagaugucauuuuccacauucaaaagaaacuacagucgcgugcugcguaaucauguuuggaucaaugacagaucacauuuugguggucccauaagaguauaauggagcugaaaaauuccugucaccuaaugaugucuugaugauccugacccuguguagacuuaagcuaauguuuguuuguguuuuaguuuuuaacaaaaaaguugaaaagguaaaaacaaauuuaaaaauuuuuaaauaaauaauuguaaagauacaaagaaaagauuuuguacagcuguauguuauauuugcauuuuaagcuguuacuacaaaagagucagaaaguaaaaaaauguaaaagguaauaaaguaaaaaaggaagcuaagguuaauuuguuuuguuuuauuuauuuauuuuuuuuuaauugagacagucuugcucuuguugcccaggcuggagugcaauagcacgaucucggcucacugcagccuccgccuccuggguucaaguaauucuccugccucagccucccgaguagcugagauuacaggcuccugccaccaugaccagcuaauuuuuguauuuuuaguagaaacacaguuuugccauguuguccaggcuggucucaaacuccugaccucaagugauccgcuggccucagccucccaaaguacugggauuacaggcguugagcugcugugcccagccagaugaauuuauuauugacgaagggaaauuuuuaaaaauuuaauguagcuuaaguguucaguguuuauaaagucaacaguaguguacaguaauguccuagcccuucacagucacugagcauucacugacuuucccagagugucguacagucuugcaagcuccauucaugauaaguacccuauacagguguacuuauauuuucuauaaguagauuuuuaucuuuuauaccauauuuuuacuguaccuuuucuauguuuauauacaaaaauccuauuuuuuuugcaguggccuauaguguucaguacaguaccacgcuguacagguuaguagccuaggagcaauagguuauucuauacagcuuagguguguggcaggcuauaucaucuagauuuguguaauuacacacuaugaucauacaaugacaaaaaucacauuucuuagagacauuucuuagaauuuauccccauuguuagguaacacacaccguacuuugauucuacuucaucaucuagcugucaccccacuucacuguuucccuugcuauucuuuacuuacuuuuuagauuucucuuuccauucucuuucaaacccauuucaaccagguuuuugcuccuuaauaaaggaacugcuguugcaugauuaccagugacuccaauccaacaaacaaauguauguucucauuucuacuugacuugucagcagcauuugucgcuccuggaaauaugugcuucauuuggguuccaagauaccacacauucauucucucucucucucucucucucuuuuuccuuauucuuuucuggcuucucaaucuucaugaucuuuaauguuacaauaccuugguguuaucaguccuuaguuuacuguucgguuuacauucacccucacucgguuauguccagucucaagcuuuuaaaugucaauaugcuguugacuucuaaauuugaaucuuucuucuuaggcuucucuacuuugauguuuaguaaguauuucaauuuuaacaugucucaaacuaaacuccugaucaucauuuucagucuuccucuaagugaguuaauaauuuccucacuucugucguuacuaaaauguuagcugaucaucgcagcauaaccuaauugccuaauuaauuuugcaagcccucuccuaguauucacuugcuguuuauccccuaacacuugccaccuucuaacaaauaauaaucuuuaaaaguuuuuuguguuuuuucuuuacuguccucucugcaauugucugucuuuuccuugacauauccacaacaguaaguacccauaaauauuguugaaugaauggucaagucauauaccucuucauaaaaucuucgaauggcuuccucuuucuuggacugaaaaauguccauuuuccuaccaccugcaacauuacucuucucuugcuuacucuaguacugcaaacauggauucuuuauuguucuuuaaacagacaagcuccuggcucagggccuuugcuuucuugguuccuguuuuuucccacauaccuacauggauccaucuuugucuuucaccuccuuuucauuucugcacaauugaguuuucaaucagaacuuuccgacagcccguuuuaacauuguaaauucuuuccaucccuggccuuuucaauuccuccaugcucugauuuucuccauagugcauuuuaucaucugauauaccaaauauuuuacuuauuuucucuacuuugcucaugcauuacaaugacaucuccauggaggaagauguuuuuggauuuuuuuuuaacugcuguuauccucagugcucaauaguagguacuuaguaaauacuugcugaaaaaaugaaaaaaaaauuuuuuuuugagauggagucuugcucuaucccccaggcuggagugcaguggcacgaucucagcucacugcaaccucugccucccugguucaagcuauucuuccgccucagccugccaaguagcugggauuacaggcacacacugccacacccagcuaauuuuuuuuuuuguauuuuuaguagagaugggguuucaccauguuggcuaggcuggucuugaacucccaaccucaggugauccuccugccucagccucccaaaguguugggauuacaggcgugaaccgccaugcccccccugaaaaaugaauuauugaugaagcaagaauuuaauauuauaaaaugaaaucaaguguucuugaauacuaucaguuauaguuagaaaguauucuguaacagcaagaagaauuuauuaauaaaagaaacagcagaaucuaugaaauacuuagaaauauauuuaacagcacauguuuaggauuuauauagauauaaauacccagaaacacgaaaaagcuugacuaaauacauuuacuuuguuauuguagagcuaaaguuaauguugagauauguuuuucuacauuaagauacaaaguuaaagccaugugagguuuuuuaaaaacuucaaucauaucucaaguuugugaggaaguauacguauggaaaaacaguccgaugaaaagguuauuaaaguaguggugauauuugcacaauucuguaacuauaguuaaaaaaaacccacugaauugugcacuuuaaaagggugaauuugguugggugcaguggcacaugcuuguaauuccaacacuuugggaggcugagguagccagaucacuugagcucaggaguucgagaccagccugggcaacaaagugagugucuuaucucuagaaaaaauuagccaggcaugguguugcauuccugugaucccagcuacuugagaggcugaggugggauguuggcuagagcuugggggggcaaaaguuguggcaagcugagauugacacugcacucuagccugggcaacagaaccgggccuugucucaaacaaaaacaaggugaauuuuauggcaugugaguuaaaucucaguaauguuguaaauaaaauagagaauuucuauaggaauacaagaaaaaaaaaaaaccuacuuguuuucaaauauucaaacguuauuaugaaguuauaauauccauauauuaguggcacaauaauaaucauaaauaugaaugaaacaaaaccuuaggaauuuagaguaagauccaaauacgaauaagaauauguaauaaguauguuauuacauuacauuaauuauaaauaaucaaugggcaugaaaugaguaauguucuuagaacaaugagcaauguucuuagaacaaugagcaaaccuuuuggaauaaaggcugcuucccuacccccagauuauauuuuuagaauuuaacauggcaaauaaaggaaaaacgaaaagaaaccgaaaaauaauuaauugaaaguguagugaagauugucgucuagaaggacaugauuuuuccaaguauaagaaaacaagacugggcgugguggcucacgccuguaaucccagcacuuugggaggccgaggcuggcggcugagguugggaguucgagaccagccugaccaauguggagaaacccugucucuaccaaaaauacagaauuagccaggcauucugugcaugugcaguggcacaugccuguaaucccagcgacucgggaggcugaggcaggagaaucacuucaaccugggaggcagagguugcggugagccaagauugcaccauugcacucuuagccugggcaacaagagugaaacuccaucaaaaaaaaaaaaaaaaaaaaguaaacaaaacuauauuccaccuuaggcuggaauauauuuuuucaugaaugaaaaaaagagagcuggguacggugacucacgccuguaaucccagcacauugagaggcugaggugaguggaucgcuugagguccagaguucgagaccagccuggccaacauggugagacuccaucucuacuaaaaauauaaaaaucagccagacgugguggugggucccuguaaaccagcuagcuacuugggaggcugaggcacaagaauugcuugaacccaggagacggagguugcagugagccgagguugagccacugcacuccagccugggugauagagcuaaacucagucucaaaaaaaugagagagagaaaaaaccccaaaacaaaccuauaaaguuaaagagacuauuuuauuuaaugcagugauuaagcacuuuaguuaugaaaucagacuauguuuaaauuauuucuuaaucauuuacugguuaagugaccuugagcaaguuagccaaugucuaaaccacucuuuaaucuuuuaaaugaggauaguuauaguaauuucacuauauggugguuguaaggaauaugugagguaauuaguacaguuuuucauaaguauuugaauacauaaaagauuuuggccaggcacaguggcucauaccuguaguccuagcacuuugggaggcugaggcaggagauugcuugaggccaggcguucaagaccagccugggccuuucacuuuuuaauaaaaauuuuuaaaaccuuuuguuuaagauuuuaacuucaagaagaauaguaggugaaagagagcugguaaauugggaaaaaugugcaacaugugagaaagaaguauuauauuaagggcccaucuaaauuagaaaugaccuccacaauuuagaaaaauauggaccaggaucuugaacagcuuuucacugcaggagaaauacagauggccagcaaaaucaugugaaaagacguuuagaauaauagauaagucaaauauaaacaaaugcaauaggaagucuuuuuuuuuuuuuuuuuuuuuuuuuuuuuuuuuuuuuuuuuuuuuuggaaucagggucucacccugucucccagguuagagugcaguggugugaucauggcucauggcucacugcagccuugaccuccuggcucaagccauucuccacuucagccucccauguaccugaaacuacaggcaugcaccacugugcccagcuaauuuuggagauuuauuuuuuguagagaagggggucucccuguguugcacaggguagucucaaacucuuagguucaaguaauccuccugccucagcuucccaaaguguugggauuacaggugugagccacgaggccuggccagaaaaagagagagagagaguguguguguaugugugugugugugugugugugugugugugacguagucuggcuguguagcccauacuggagugccguggugcgaucuuugcucacugcaaucuccgucuccuggguucaagcaauucugccucagccuaccucagaagcugggauuacagguaugugcugccacuuccagcuggauuuuuuuuuuuuguauuuuuaguagagaugggguuucaccauguuggccaagcuggucuggaacuccugaccucaaauuauccacccaccuuggccuuccaaagugcaaggauuacaggcaugagccaccacgcccaacccuggaugucuuuauauaagguugugacaucuuacauacugacaauuggaaauaaaaagucuuuuuuggccgggcaugguggcucacaccuguaaucccagcacuuugggaggccgaggugggcagaucacaaggucaggagaucgagaccauccuggcuaacacggugaaaccccauaucuacuaaaaauacaaaaaaucagccgggcaugguggcgggcguagucccagcuacuugggaggcugaggcaggagaguggugugaaccugggaggcggaguuugcagugagccgagauggcaccacugcacuccacccugggcaacagagcgagacuccgucucaaaaaaaaaaaaagucuuacaugucauugucuaguguguaacuaaugcauaugcccuucagcuuuguacuuucaccuuuaaaaauuuaccugaaggaaguaauugaacaaguauggaaagaaaaaugcaauuggauguuuaccauauuguuauuuauuuauuuauuuauuuauuuauuuauuuauuuauuuugagacagugucuccccauuuauuuauuuauuuuuuuugagacagugucucccucuguugcccaggcuggagugcaguggugcaaugucagcucaccgcaagcuccgccucccagguucacaccauucuccugccucagccucccgaguagcugggacuacaggcacccgccaccaugcccgucuaauuuuuuguauuuuucguaaagacgggguuucacuguggucuugaucuccugaccucgugauccaccugccuuggccucacaaagugcugggauuacaggugugagccaccgugcccagcccuuuuuuuuuuuuuugagacagagccucggucugucucccaggcuggaguacagugacacaaucucggcucacugcaaccucugccucccgaguucuagugauuguccugccucagccuccugaguagcuaggauuacaggugcgcaccaccacacccagcuaauuuuuuuguauuuuuaguagagaugguguuuucaccauauugaucaggcuggucucaaacuccugaccugauguucugcccuccucggccucccaaagugcuaggauuacaggugugagccaccgcgcccacauauuauuuauaguaacaaaaagccagaaacuauuuaauuacagucaguaggugguugauuuuaugaauuaugaacuauugugaaacuguugaauuuaacaucuaacucuuauuuacacauaaaggugucauaucauuuaaagcaaaugggcuacaaaacagcaagcauuguuggcuccauuuguauaaaagaauguacacuuguuuauuuugauguauaugguaaaauaucugaaauguaaagucuuuauucaugaaagguauuauuuauacuuugguucuuuuuuuuaaaugagaguauuuuauauguggacuaaagcuauuuuucuguuggaaaaaauuacaugcuuaauaucauguuuuaauacagcaucuuuuucagugccuaauugauaauaugcucucuuaaagugauaacucuuaucagucauuuuaaaguguucuuacaaguguaagaggauaauaucaucaguaccaaauacaguuuucaaaaucuuuuuuuuuuuuuuuuuuuuuuuuuuuuugugacagagucuugcucuguugcccaggcuggaguacaguggugugaucucggcucacugcauccuccgccuccuggguucaagugauucuccugccucagccucuugaguagcugggaccacaggcaugcgccacccugcuaauuuuuuuuuuuuuuuuuuuuuuguauuuuuaguauaggcgaguuucaccauguuggccaggauggucucacucuccugaccucgugaucugcccaccucggccucccaaagugccgggauuacaggcaugagccaccguacccggcuucaaaaucuuaauguugucucauucauuuauuuuauauaguaucaggauuuggaagaaaagauuuuugaaaccaacaucaaauuaucugugugccuuauuuagucauagaccauuuacugugggauaugaacucuguuuuaaacugcuuuuaauuucucucagauauuuauuucagguaaaagugaaaaaccaggccaggcacaauggcucaugccuguaaucccagcacuuugggaggcugaggcggguggaucacgaggucaggaguucaagaccagccuggccaagauggugaaaccccgucuuuacuaaaaauucaaaaauuagcugggccugcuggcgggcuccuguaaucccagcuacucaggaggcugaggcagagaauugcuuggacccgggaggcggagguugcagugagccgagauggcgccacugcgcuccugcuugggcaacagggcaagacuccauuucaaaaaaaaaaaaaaagugaaaaaccaggcuugaacacauucauuagccaauuaaggaagcugaauauguuucuacuuuacuuuuagacagaauuuaaaaaauaacuuccuauuuaaguauaacauacauauagaaaaauacccaucauaaauguaacagcucagcgaauuuucaugaacucagccauaugggacaaccaacauucagauuaagaaauguguuugccaggugcgguggcucaccccuguaaucccagcacuuugggaagcugagggaaaaucacuugagccccggaguucgagauuagccugggcaacaaagcaagaccucaucucuacaaaaaaaccaaaaaacaaaaaacaacacaaaaaaauuagccagacaugguggcuugugccugcagucccagacuugggaggcugaggugggaggaucacuuaagcuuagaaguucaaaguuagaaucaggucacugcacuccagccugggccacagagugagacccugucuuaaaaaaaauaaaaaaguaguaugacauugcuagcacccaguaagaaccccuugggcuucuuucucauuacuguccuuaccaugaguaauaauuuuuuuuauuuuuaauaucauaauaaauuuuuccucuuuguggucuuuauauaaaugaagucagaauagguacucuguuuuucuggcuccauuaauucaguguuguucgugaggcuuuuuguauguuuguuugcuuuugagguggaguuucauccuuguugcccuggcuggacugcaauggcaugaucucagcucacugcaaccuccgccuccuggguucaagcgauuauccugccucagccuuccgaguagcugggauuacaggcaugugcuaccacacccggcuaauuuuguauuuucauuucagacgggguuucucccuguuggucagucuggucuugaacuccugacuuugagugaucugcccgcaucagccucccaaagugcugggauuacaggcgugagccacugugcccagccagagcuuuuuuuuucuuuuuuuuuuuuuaaacuguaauacaugguauugcguguaaucauaguucacauuuuuaaggauaaguuuuaaaauuggaagugucauuuucaggcauaaauauguuuaaaaauauuuaaaacaaacugcuuaauauuuguuuuuaaaaguauaaaaguaaugaaugggaauuguuuuuucauuuuuaauuuuuguggauacauaguguauuuaugggauacaugagauguuuugauacaggcaugcaguguguaauaaucacaucauagagaaugagguauucauccccucaagcauuuauccuuuguguugcacaccaucuaguuauacucuuuuaguuauuucaaaauguacaauuaaaugauuauugacuauagucacacuguugugcugucaacaguaggucuuauuuauucauucuuucuauuuuuuuuuuuuuauuuuugguacccauuaaccuuccccaccuccccgggauucuuuaauauaaugugaagaaagugugugggguuuauuuaauuuucaaguuaacauaagucugaguauaugagacugucaaagccaguuugcccuugggcaaaauuauaagguccaguccaaaagaagagauaguucccuuuauucugagucaaucaaguaccacauguauuguguucauuuaaaggugccacauguaaagagggauauuuacaaacuuaaaacacuugcaucagaaaaugaccagaaagaagugaaacuguugagucaggaaguuaaauauuuugguugaguucaaaugucugacagccauugggaagaagaggaauuagacuuacucugugauuuuuagaaagugagacuuggaccaguaacugaaaguugcaaaaaaauauauuucacuuuacucuuaggaagaacuuuuuuuuuuuuuucaauagacacauuucauuaugggaaauuuaauacaaaaacauagugacuaguucaaagugaagauacuagaguuagauaccugucacuaggaucaucuuuuauauuucuugucuaauauuuggaaacagucauuucugcaggagcccugauucauuuuaaugggaaaugguuuuagagaccacggucuugagguguucauugcuaauggguugucgauguuuguaggcauuuuaauggauagagagguagauagacuucauauauuuuuaauucuaucuuaaaaguauagccuuuuacuucuuugauuuuauaguuguacguuuuuugcuucuaacauuuugguuccuagugauauucacaugguuaccuauuuuaucuauguaucuguuagucaucuaucugucuaaauucaaaauuacuauauguauuaccaguaauaugcucacugagggcaauuuaccacuuucuuuugcugggcaagauggcuugugccuguuagcccaacuacucagaaggcugagcggggggaggauggcuuaagcccaggcauucaaggcugcagugagcuaugacuaugccauugcacuccagccugggugacagagcaagaccccaucucuuaaaaaaaaauaaaaauaaaaauaaaaaauagagagguagagguucuuugguauuugguuuuggguuuuuuuuuuuuuuugagacggaaucucgcucuuucgcccaggcuggaguacaguggugcuaucuuggcucacugcaaccuccccgucccagguucaagugauucuccugcuucagccugcugaguagcugggacuacaggcaugcgccaccaugcccagcuaauuuuuuguauuuuuaccagagaugggguuucaccauguucgacugcucucaaacuccugaccucaggugauccacccgucuuggccucacaaagugcugggauuacaggcaugagccacugcaccgggugguugguugguuuuuguuuuuguuuuuguuuuuguuuuuuuuuuuuuuugagacagagcaucacucugucaccuaggcuaaagugcagugguacgaucuuggcucacugcaaccucccccucccagguucaagcaauucucauaccuuagccucccaaguagcugggauuacaggcgcccgccaccacguccggcugauauuuguaguuuuaguagagaugggguuucaccauguuggccaggcuggucucaaacuccugaccucaggugaucugcccaccucggccuccaaaaguggugggauuacaggcaugagccacugcgccuggcuggcuugcuuguuuguuuguuuuuuggguaauguuuugagauuuaggauguagauucucaauauuguguuuuauaguaauucaaaauaauuacuuuucauauacuuauauaacuaauuuucuauauauugaauagaugaauuucuuuuuuguuuguuuuugagacagagucuugcucuuucgcccaggcuagagugcaguggcgcaaucucggcucacugcaaccucugccucccagguucaagcgauucuccugccucagccucccgguagcugagauaacaggcacgugccaccagccccagcuaauuuuuguauuuuuaguagagaugggguuucaccauguuggccaagcuggucucgaacuccugaccucaggcgaucugcccaccucagccucccaaagugcugggauuacaggcgugagccaccaugcccggccuauugcuuuuaauauuuggagaucugggaugcuuuccuuuauuauauauaacuuuguuucauaacuauguaaaacacuuccaaacugaaaaccauaaaguuagaugcauaggggucuaguuucuaacccuguuuacuuucccauaagucacuauuuucgcuaaucuuugguucauuccauuuuaaaauauaaucgguaggcauauauauauucauauucuucauccccauuuucuuauacagaagguauauuauauguauaaggcauagcauagcauagcauauuauaaccauuguucucaaccuugcuuuuuuucauuuaauaauauauccuggaaaucacuccauagcacuauauugauaucucuuccuacuccuccuacuuuuguuuuuguugacaauuucucaauauuccauuguacagauguaccuuacuuuauucagccaguuuucuguagauaauuguuuggauuuuuuuaggguuuuuuuuuuuuauauuaaaauaguggugcauuuuggacccuugugcagacauuauauuuuuaagaguguaucuuggguagacccucaaaguaggauuucugggucaaaggauguaguuaaaugcauauggaauuuuucuaguuuauaacuagauuguagcguuuuccaugcaguacauuuucauacgugcuugaauuugguuuuauguuuucuguccuguuucauugguuuguuugucuuuucauuugucacuucuguacuguuucaaugauuggggcuuugaaaaaugauauuugguaugguuauucccuggcuuuucuacauuuuagguuuuucuagcuauucuugcauaucuauuuuccccauugaacaucacaaucaauuuuucuaaaugccaaagaaaucuguugguauuuuuauugagauugcauuaaauuuauaaauuugcuuagggaaaauugucgucuuuaugucuuccuauccacaaacacaguauaacuuuacauuuguucaguucugaguauuuuauauuuaggaagaacucuuuagugguuauccaaaaguaaaacagacuauugugugaaguagugaauucauuucuagaguauauagugaggauucaugaauuagcauuuuacgguaaaugacuuaaauguuacuucccauucuaagauuuuauauaaaaacacauucugaugaaaauaugaauuuuuaaauugucuuuccuauuccacauuaagagagagcucuacugcucacucaagaccauaauugagaaugaguuauaaaagaguagaaguagguuagggauugucuucuauagguuuagaaucauuuaagucaaugaaggagguaggcaguaaacuauuauuuuagaugacgaccauaggauacuguaacuaaaaauaauuuucuuuucaaaaaugguaacuucauaugcuucauuuauauuuacccagucaaaaguaagaugaaaguagacuauugauuugccauuuaaaaaaugucaaaaauaucagggauauuucuaaagacccucuaauguauaguuuuaucguguugaaagucaacaaagauaauauaccaugauagccucucguauagcagcagaugagcuaacauacugugacauaaguauaauauuagguuuuuuaaaaaccacuguugccuauuguuuaucugauaugugauccauuaguuuguuggauuguuaagcuaagcuaaagugguguaagguuuacucccucuuuaacuuuuuucuuguucaaauuuuaggacccuucaaaguuguacaagaaagcagaugauguugcagccauugaaugccagucugaagaagucauccgucuucauucacagggagaaaacaauccuuugucuaagaagcugucuccaguacacucagaaauggcagauuauauuaaugcaacgccaucuacucuucuugguagccgggauccugauuuaaaggacagagcauuacuuaauggaggaacuaguguaacagaaaaguuggcacagcugauugcuaccuguccuccuuccaagucuuccaagacaaaaccgaagaaguuaggaacuggcacuacagcaggauugguuagcaaggauuugaucaggaaagcagguguuggcucuguagcuggaauaauacauaaggacuuaauaaaaaagccaaccaucagcacagcaguuggauugguaacuaaagauccugggaaaaagccaguguuuaaugcagcaguaggauuggucaauaaggacucugugaaaaaacugggaacuggcacuacagcgguauucauuaauaaaaacuuaggcaaaaagccaggaacuaucacuacaguaggacugcuaagcaaagauucaggaaagaagcuaggaauugguauuguuccagguuuagugcauaaagagucuggcaagaaguuaggacuuggcacugugguuggacugguuaauaaagauuugggaaagaaauuggguucuacuguuggccuaguggccaaggacugugcaaagaagauuguagcaaguucagcaaugggauugguuaauaaggacauuggaaagaaacuaaugaguuguccuuuggcaggucugaucaguaaagaugccauaaaccuuaaagccgaagcacugcuccccacucaggaaccgcuuaaggcuucuuguaguacaaacaucaauaaucaggaaagucaggaacuuucugaaucccugaaagauagugccaccagcaaaacuuuugaaaagaauguuguacggcagaauaaagaaagcauauuggaaaaguucucaguacgaaaagaaaucauuaauuuggagaaagaaauguuuaaugaaggaacaugcauucagcaagacaguuucucauccagugaaaagggaucuuaugaaaccucaaagcaugaaaagcagccuccuguauauugcacuucuccggacuuuaaaaugggaggugcuucugauguaucuaccgcuaaauccccauucagugcaguaggagaaagcaaucucccuuccccaucaccuacuguaucuguuaauccuuuaaccagaagucccccugaaacuucuucacaguuggcuccuaauccauuacuuuuaaguucuacuacagaacuaaucgaagaaauuucugaaucuguuggaaagaaccaguuuacuucugaaaguacccacuugaacguuggucauaggucaguuggucauaguauaaguauugaauguaaagggauugauaaagagguaaaugauucaaaaacuacccauauagauauuccaagaauaagcucuucccuuggaaaaaagccaaguuugacuucugaauccagcauucauacuauuacuccuucaguuguuaacuucacuaguuuauuuaguaauaagccuuuuuuaaaacugggugcaguaucugcaucagacaaacacugccaaguugcugaaagccuaaguacuaguuugcaguccaaaccauuaaaaaaaagaaaaggaagaaaaccucgguggacuaaagugguggcaagaagcacaugccggucuccaaaagggcuagaauuagaaagaucagagcuuuuuaaaaacguuucauguagcucacuaucaaauaguaauucugagccagccaaguuuaugaaaaacauuggacccccuucauuuguagaucaugacuuccuuaaacgccgauugccaaaguugagcaaauccacagcuccaucucuugcucucuuagcugauagugaaaaaccaucucauaagucuuuugcuacucacaaacuauccuccaguaugugugucucuagugaccuuuugucugauauuuauaagcccaaaagaggaaggccuaaaucuaaggagaugccucaacuggaagggccaccuaaaaggacuuuaaaaaucccugcuucuaaaguguuuucuuuacagucuaaggaagaacaagaacccccaauuuuacagccagaaauugaaaucccuuccuucaaacaaggucugucugugucuccuuuuccaaaaaagagaggcaggccuaagaggcaaaugaggucaccagucaagaugaagccaccuguacugucaguggcuccauuuguugccacugaaaguccaagcaagcuagaaucugaaagugacaaccauagaaguagcagugauuucuuugagagcgaggaucaacuucaggauccagaugaccuagaugacagucauaggccaagugucuguaguaugagugaccuugagauggaaccagauaaaaaaauuaccaagagaaacaauggacaauuaaugaaaacaauuauccgcaaaauaaauaaaaugaagacuuuaaagagaaagaaacuguugaaucagauucuuucaaguucuguagaaucaaguaauaaagggaaagugcaauccaaacuccauaauacgguaucaagucuugcugccacauuuggcucuaaauugggccaacagauaaaugucagcaagaaaggaaccauuuauauaggaaagagaagaggucgcaaaccaaaaacugucuuaaaugguauucuuucugguaguccuacuagccuugcuguucuugagcaaacagcucaacaggcagcugggucagcauuaggacagauucuucccccauuacugccuucaucugcuaguaguucugagauucuuccaucaccuauuugcucucagucuucugggacuaguggaggucagagcccuguaaguagugaugcagguuuuguugaacccaguucagugccauauuugcauuuacacuccagacagggcaguaugauucagacucuugcaaugaagaaggccucaaaggggaggaggcgguuaucuccuccuacuuuguugccaaauucuccuucgcacuugagugaacucacaucucuaaaagaagcuacuccuuccccaaucagugagucucauagugaugagaccauucccagugauaguggaauuggaacagauaauaacagcacaucagacagggcagagaaauuuugugggcaaaaaaagaggaggcauucuuuugagcauguuucucugauucccccugaaaccucuacagugcuaagcagucuuaaagaaaaacauaaacacaaauguaagcgcaggaaucaugauuaccucagcuaugacaagaugaaaaggcagaaacgaaaacggaaaaagaaauauccccagcuucgaaauagacaggauccagacuuuauugcagagcuggaggaacuaauaagucgccuaagugaaauucggaucacucaucgaagucaucauuuuaucccccgagaucuucugccaacuaucuuucgaaucaacuuuaauaguuucuauacacauccuucuuuccccuuagacccuuugcacuacauucgaaaaccugacuuaaaaaagaaaagagggagacccccuaagaugagggaggcaauggcugaaaugccuuuuaugcacagccuuaguuuuccucuuucuaguacuggauucuauccaucuuaugguaugccuuacucuccuucaccccuuacagcugcucccauaggauuagguuacuauggaagguauccucccacucuuuauccaccuccuccaucuccuucuuucaccacgccacuuccaccuccuuccuauaugcaugcuggucauuuacuucucaauccugccaaauaccauaagaaaaagcauaagcuacuucgacaggaggccuuucuuacaaccagcaggacuccccuccuuuccaugaguaccuaccccaguguuccuccugagauggccuaugguuggaugguugagcacaaacacaggcaccgucacaaacacagagaacaccguucuucugaacaaccccagguuucuauggacacuggcucuucccgaucuguccuggaaucuuugaagcgcuauagauuuggaaaggaugcuguuggagagcgauauaagcauaaggaaaagcaccguugucacauguccugcccucaucucucuccuucaaaaagcuuaauaaacagagaggaacaguggguccaccgagagccuucagaaucuaguccauuggccuugggauugcagacaccuuuacagauugacuguucagaaaguucuccaagcuuaucccuuggaggauucacucccaacucugagccagccagcagugaugaacauacaaaccuuuucacaagugcaauaggcagcugcagaguuucaaacccuaacuccaguggccggaagaaauuaacugacagcccuggacucuuuucugcacaggacacuucacuaaaucggcuucacagaaaggagucacugccuucuaacgaaagggcaguacagacuuuggcagguaagaggguuauuuuguuaccuguuauuuguuaaagaaauagguuauuuuccacaggugccugauaaauguagaugaacuuuuaauauauauaucuuuuuuuguuuuuuaauaaguguauuuugaaaucucaguauuccuuuuccuuaagauuuaagaaguagggaaugucuauauuauuuuuuuguuuugagaagagcuauugucaaaaagaaaaaaagaaagaaauauacauaacuuuuggaaaccaggaaaaaucauucaucuuuuuuauguagacagguuauuacacaauuuuuauaaagacaaauggcucauaggucuguuaguaguaugcaggaucucccaccacccccugcccccaccaccccaagagguaaaagguaaugcuggaaggauuuuuaauguauauuaauccaguaguuauaaaugcaucuuuguuacaggaagaauauguuauuaauacuguaugucucauaauaaaaauucaaacauuggacauuuucagcauuguaaaauuuaacugaauauucauucagacagacuucauuuugcagcauaccuuuugauguuuucauaaaagcugcuucaauuagauagaaaaaaaagaaaucuggaaaaugcauuuguacaucuagaaagaauuguacaucuuuuucucucuuaauuauacaccuuuuaagaauugagaagauagaaaacaaagaguaagcauuugccacucgaauaaaagauuagaaguucuuugugagagaucuuaagccuaagaguuuguaaaauaacucuaggaaguccauaaacccucugauguuguaaguaaaauuacggguauauauguuugugcaucuuuuuuagugauaaucuagaaaaauuucaucagauuuuccaaguaaauucucuaaaccucaguauauucucuaaaccuccuauauaaugggauuuguagggguauuaugaaaaguaaucacauaguaagcaugcaaauauuaguuauuauuauuauuccccuaaaagauuaaaaacuugugcauuaggccaggcgcaguggcucacaccuguaaucccagugcuuugggaggccgaggugggcggaucaugaggucaagagaucgagaccauccugguuaacacgaugaaaccccaucucuacuuaaaauacaaaaaaaauuagccaggcaugguggcaggcgcuuauagucccagcuacucgggaggcugaggcaggagaauggcgugaacucuggagguggagcuugcagugagccgagauagcaccacugcacuucagccugggcaacagagcgagacuccaucuuaaaaaaaaaacaaaaaacaaaaaaagacuuguguauuagggaaaagauaaaccccucgaauacaaagaguuuuuguuccugauuuucauuauucaugaacuuuugaaaaauuaaaacuuaguggagaaucugaguguuccuuagcuuuuaacaguguuuauuuauuuauucauuuuuuuauuuugagacggagucuugcucuguugcccaggcuggagugcaauggugcaaucucggcucacugcaaccuccgccucccggguucaagcgauucuccugccucacccucccgaguagcugggacuacaggugcaugccaccacacccggcuaguuuuuuauauuucuaguagagacaggguuucaccguguuagccaggauggucucgaacuccugaccucgugauccgcccaccucggccucccaaagugcugggauuacaggcuugagccacugcacccggccagcuuuuaacaacguaaagagagaaaaagucuuaugcuuagguccauucaacaaauaguuuauuuaaucaguaauaguuacugaauaucagguauuuaccaggcauucuacuuugugggcccuuguuauauaauagagaaugaggcacacagguucauugagucauggagauuauaguagaggagguagauaauaaacaaaaaaucacauuacguguuguuaaaauugugauaaggacuguaaaagggagagaguacagcaugaaauggggagccuaacccagagaagucuuuccugagaaggugauccuaaacugagaccuggcagaugugcaacauuuaacuggauaaacagacucauucauuauucauucauuuacugguucauauguugaauuccugaaacauacaggacuauucuagucacuggcauauacaauaguaaaugccugauaucugaccucauaauuuucagcuuagugaaggaagacaaaccauagagugauaagcaaauaaauaauggcuuaauugagaaaaaugcuauaaaguuaauaccauggaguguuaugauacagauuaaagggcuggcagaaggggaucuaauuagauaguuacuaguuauggcugaggauaaaaaguugagacuuaaaggaugagaagccacagugaaguccaggcgcgguggcucacgccuguaaucucagaacuuugggaggcugagguggccagaucacuugaggucaggaguuugaggccagcuggccaacacggugaaaccccaucucuacuaaaaauacaaaaaucagccgggcaugguggcacgugccuguagucccagcuacuugggaggcugaggcaggagaaucgcuugaacccaggaggcggagauugcagugagcccagaucacgccagugcaacagagugagacuguaucucaaaaaauaaaaauaaaaaaaaagccacagugaagaacauguuuuaagauucucaguugggaaggaguuuagauauuggauaaacugaaaaaagcuucaucguggugaaagaggaaauacagagagaguagugagaaauguggcaaaagaagagaccaaacaauguguuaagaauuuuggauuuuauauuaagaacaaaagacaaaggaguauugauuuuagguuugcauuuuuaaaugaugauuuugccuucugcaugaacacuggauggagaggauaaaaauaauuugaaggaaacugguuaauaggcaauugcaguagucuagauaacaugauggugcuuagauuagguuaguggcaggcuuaugucugaacauaugggagauuggagauaacaugcacuaagagagagaagacuauaggaggagcagauuuagaggagaacacaguuuuuuuuuuucuuuuguuuuugagacaggcucucacucuguugcccaggcuggagugcaguggcacgaucuuggcucacugcaaccuguuuccugggcucaagccauuuuccagccucagccuccugaguagcugggacuacaggugcaagccaccaaugccaggcuaauuucuuuguauuuuuguagagaugggguuucgccaugccgcccaggcugaucuugaacuccugggcucaaagggacccuccuaccuugcccucccaaagugcugggauuauaggccugagucaccacucugagccacuuuuuaauacauacaguuugaagugucugaacguugaagcggaggauuugagaaggucguuggguaucuaguucucaggcuuaguagagaagcuugaccuggagauaagagcauuuccucugaguauuugaaaaauuguguuaggcaauaucauucacuaaaaagggcuucugggugaaauaaaaguuaggaacagacucucaaaaaccugugcaacuuuauaagcagagcaucaagaaaaguaauaauuuucaaaaacagcaguuaaaaagacauacuagaccaggcacaauggcucaugccuguaaucccagcacuuugggagaccaaggcaggcagaucaccugaggucaggaguucgaaaccagccuggccaacauggcgaaaccugucucuacuaaaauaaaaaaauuagccagcagugcugguaugugccuguagucucagcuacucgggaggcugaggcaggagaaucccuugaaccuggaagguagagguugcagugagccgaaauugugccacugcacuccagccuggaugacagugugagagucugucucaaaaaaaauauauguauauauauuguuaagacuaaaugucuuaauaaauaaagaggcugggaaugguggcuaaugccuguaaucucaacacuuugagaggugagguugaaguaucacuugagccuaggaguugaagaccagccugggcaacauaggagccucccaucucuacagaaaaauguuuuuuaaauuagcugggcaugauggcauacgccuguaguccuggcuacucaggaggcuguggcaaguugaucacuugagcccgggaguucaaggcugcuacuguaagcugugaucgugccacuucacuccagccugggcuggcagagugauacucugucucaaaaaaaaaaaaaaaaaauagaaauacuacaauaaauauaggcauuaaccuuccaggaaaagaugaaggucgcuuguagggauauaaagaaggguugaagcugcucaacuguaggcacagaaggaugucauugguagauaaauguagcaaugccagacauagcugguucuaguguauuguaccuguuuguuucuuuuguacaaacauugagagaagccacacaauaaaaacacuugcagaaaagucuguugccaguaggagccaagaggaagaauguggaugaauguacauuuugaacagaacuacauugcuuauggcuuucuucauuuaguuuguguugguguacuccuucguucagcugcuaguuuuguccugcaaaauauuuaugugcuuuaaaagucauguauuaaccaauacaacuuccauauucugguaucauucuuguauuuaucaaugauacaagagcuauuuaacuauauagaaacacauacaauaacaaaacauacuguauaccuuugugaauuuuuauauguauaaucaugagaguaaugauauuuuccuugggagagaauagggagugaaaaacaaacagccuuggguagcucugaggaacugcaguauuuaaaguagugcuuaaaaaacugucagcuuuuggcccacaugugauucuuugugaugaucucuacacuuuuuaaaaaauugcucauauuaaaaaauguagcaauuuuacauaaaaauguggaauucugcuucucagaaaaaucagaacaucuggcaacaauuaguccacauuucguggauaauagggauggcuggggcucaguauuggcaggcccuuuuucauugcugcuuguauucuuuuguucgccacaguccucacuguuuucuguuguguguuguaucuggcccucuucagcuauuuaaagagggaacuuuuggauuugagaucccuaauuucagagucaugagaaggagauuauaaaggaugaguaaauugaggugaaggugauaugagaugacagguuaggauguugaauguaucaucuacauggacauugaaauuacccaagaggacaguuacagaaguuggggugaaaaugguggaugugaaccugguuucaggguccuuggggaaugagaaagauagcagggaaguuuaugcaaaaguaccuguguuaaguacgaauuugucuuuuuaaaaauuuccuucuuuauuuauuugagauggagucucucucugucauccaggcuagaguucaguggcguaaucuaggcucacugcaaaacccgccuccuggguucaagcuguucuccugccucagccuccgaguagcugggauugcagaagugcaccaccacauuuggcuaauuuuugaauuuuuuguagagucgggguuucacuguauuggccaggcuaguuucaaacuccugaccgcaagagaaccaccugucucagccuuccagaguacugggauuacaggugugagccacugcacuuggcuuuuuuucuucuuuauaaaauaacauacagaaaccacaaagaccucucugaagucacugcucugacacuaguucucuaucaccaauuggauguuguacaauuuaguucaauucugaauacaaauuaccugaagcuagugaagaccucaaguuaagagcagaguucaucaugagacugcagaugccagucacaaauuuugguguuccugagacauccauacuucugccuggccugcuaaaaauuugcaacuucgugcaacccccucaauuuugguaacuuguuaaaaggacucacagaacuugugaaagcacuauaguaugauuacaguuuuguuacaaaggaugcagaucaagaacaacuaguugaagagauacauagagcaguguuuggugcaagaaggguccacagaccuccaugccuuuccccuuguggaauccgggcacauugcccucccagcacaucacuauauucaccaaccuggaagcuccagugaaccucaguguccagaguuuuuauuggggcucuguuagguaggccggauugauuagaucauuggccauguuuuuuaauucaauuuucaguucuccacucccuugagguuggggugacccaaaguuucagauuuuuaauuaugugauuuggucuuucuggucaccggcccccaucuugaaguuaccucaggcuuucaucucacugucguaacagagacauuccugucacuuggguaauuacaaggguuuuugaaacucugugccaggaaccagggacaaagaccagcuauauucuuuacuugaucauaagucuaaauucuuuuguuaauuguucucuaucuuggaaucucuccaucuucuucacaauuacuguugauaaguacauggagaugugacuugauuuucuaauagaaacuuaauauacuuuuuucagguagaugugagaauagguuuaguugucuuaacaaaaaccagucgaggaaaaguuuuuaguuaagcagaauacuaaauaaaaauauuaauucaggcucagauaucuuuuguuuugaucccuuugaaagucagaacugguuuuguuuaggaguauuuuauguauuugauuuuuauucuuaacuauucccuuaugaugguagcuguucuuucagcaaacaguuauuuugugccuauugugugccaggagaaggaacaugcuguaauuccagcacuuugggaggccgaggugggugggccacuugagguuaggaguucgagaucagccuggccaacaugguaaaacccugccucuacuaaaaauacaaaaauuagccaggcaugguggcacaugccuguagucccagcuacucgggaggcugaggcacaagaaucacuugaacccaggagguggagauuguagugagccgagauugcaccauugcacuccggccugggcaacagagcgagacucugucucagaaaaaaaaaaaaaaagguaauuucugcuuuaaaguugauuuauaguuuagacauguauaugaauaguuauugacaguuuuuuuuuuuguuuuuuuuuguuuuuuguuuuuugagacagacucacucuguuggccaggcuggagugcaguggcacaaucuuggcuuacugcaaccuccgccucccaggcucaagcaauucuccugccucagccuccugaguagcugggauuacaggugugugccaccaugcccagcuaauuuuuguguuuuuaguagagacggaguuucaccauguugaccaggcuggucucgaacuccugaccuauggugauccacccgccucggcuucccaaagugcugggauuacaggugugagccaccgcgcacagccugacgguucuuaauauugagauacuuacaaggcauuuuggggagcagagaagugagggacugacuuuaaaggucuugggaaggaggagggaguuuugaauuuagcagcgaagaauaaugugugacacguguuucuuacacuagauaucagcuuugcaagggcauggggauguguuacugugcuuaguuaaguguuaaugguuugauaugggacccaagagaugggacuggaaagauaggcagaucauaaaguccucguuuauaugagacucccaagaguauagaguuuacuuuauaagguaugagaaguuaaggguuuuaagauggggaauaauuuguugagauuacauugacagcagugugauagauggauuagugaaaagagaucagguagaucaguuuggaaacugcucccacaaaauauuaugaggcucuuauuaugaggcucugagccaagguagagaugaugugauuaagugaaaugagauaugcaaaaggauaagguuggaaauagguaauaaauuuggauuucaagccuguuuuguaggacagauggaucuguagcucaaaggagagguaaaaccugaagauaauuauagauacuuuauuauuaaggcuaugagaaggaaugacaauauuuauggugaauucaguggguuucuuaagugaguuuauuauagucaagagugucaaguggguggacgugguggcucacgccuguaaucccagaacuuugggaggcugaggcgggcagaucaccugaggucgggaguucaaggccagccuuaccaacaugacgaaaccccaucucuacuaaaaauacaaauaauagccggacgugguggcacaugccuauaaucccagcuauucaggaggcugaggcaggagaauugcuugaaccugggaaguggagguuguggugagcugagaucacgccauugcacuccagccugggcaaggagagaaacuccgucucaaaaaaaaaaaauuaauuaauuaaaaaaaagagugucaaguguuaugggagauugguuagguaaguacugaaaguggaugauuggcuuuggcgguuaguuugucuugugucugagagccauuuguauaguggcaaauguuagauuucuggaggcugaggaauggaaguuaggaaaugcagacaauuaaaauucuuacaccuuuacauuuugcuauuuuuuccucaguguuuucuuuuguagcacuucugacugguuuauuauuugcuuuuuccuuacaaugacauuguuauucuauagcauucuguugaagauguaauuacauuuucucaaucugugaugucagguugcuuuuugaaguauaaagguuuaagaaauacauaauuacauaugauuuuuaagugaucuucucggucuucaguugauuuuuuccauauauaaauuuaagguagauucauuuuacauuugguaucauguuaaaaugcucccaaaacuaccuacuguauaauagguauugcaauauuguugaucaccuucaggauauuauuauccugaaaugucucccagugguccaagcugggacaguuugagcaacaaaauaaauaugagaggauuggauuauaaccuaaaaaauaaagucaauaucuauaaauccauguugauuuaaauaaaugauugacuaaauaaauacuuggcagaaaagaagcaaaucuuccuuacagaaaaauuccaaauaauauauguagaacacacuuucaggagguggaacuuaauuuaccucuucuugaauauggacuggacugcugacuuuuaaagaacagaguaugaagagggaaaagcaguaacuuuacagugaagaggccuggcagacagcaccuuaaccaaguucaagguuaacuucaccaaugauaaggcauggugauaucauguacucucugauagaauguguuaaaucuaagcagaaaaaaaaaauaauaauaauaauaaagggcauucuacaaauacuugaccaguacuaaaaaguaucaaggaccugaaaaaacaaggaaagucugagaagcuuuuacagaacagagaagacuaaggagacaugacaacuaaauacaaugugauaucccagauugacagugaaaaaaggacaugaguggaaaaaaauuggcuaaaucuaaacaaagucuggaauuuuguuaauaguauuauuccaauauuaauuucuugguugugacaaauguacuguaguuauguaagauguuaacauugggggauguuggguaaaggacauacgaguauucucuguacuaucuuuguaacuuuuauguaaaucugaauuuauuccagaauaaugaguuuuuuuaauacagcagaauacaaauuguuaaguaaaacauaucucaaacugauaauugaugaaauaagaaauaaagguuauuuacuauuuguauugaguggauuccucauaaguguugguuggggguaaaacaggcauauuugauaaaucauguugauauaaauuucaggaaaaauaaaugaaaccagauuagggacacuggaauguguagcuuggaccaaggcauuuaacccuucucuccuuguuucaaaaauggggaaucaaacugacuuaucacuuugagcauuuuuaaaguaaacaaguauauucacuguaaaauuaaaucuuaugaagacuuaaaaggaauaacagcuauaaucacuuuuauaaauuaugugcauaugguaguuagcuuauuuuucuaacauauacuguucuguacuguacagacuaacagcuauaaaaucagcuugaugcaagugaaauuacaguaaaauuacacacuuaaguaaggccagguuuccugguuucucccaauccugauagugauucuauuuaauuuauguauguauguuagguagacaugaaauaggucucaugggcaagaguuucugacuuggaugagcaagaguuucugaccuggaaugucaguuauuucaucccuguuuuucagcauaugugacucauggcuggcuacacaugacagaacuuacaaaccuggauucuaaaauuggcagagcaguagaauggaguauuuucauuuagcauuuauagcuuacaagucauagaacaagcagacaauggaacauuauuauaaaugauuuacuacauguaaauuauauacauuauuuggugcauucagugaugaugaauauuuuguccuccaagaauaagugaggcuuaaaccuuuuuuuuuuggaaaaaguauauucacuguacaagcauauagauugaagcaaagaauacugaguuuucucuuuaacugaagaguauaagcuuugaucagaauauacugaucucaaacaauuucucuagugcuguuuauaagacacaccuaugcaacaguuagaaggaauaaguucagauguucaguagcaggguggggugacuauaggugacagcacaauauuguguuuuucaaaaauagcuagaagagaggacuugaaauguuccugacacagaaaucauaacuacgcaaggugauggauacccaaaauacucugaccugauucuuauacauucuauacauguaacaaaauaucacauguacccaauaaauauguacaacuauuauguaucaauuuuaaaaagauuuaaaacaugauagaaaaaagauaugccuauaaaggaagugugaaccuacagagaugaaagaaaauuguuuguggugugguuagugcaguuaggggaauuuccagaagaauuccauuucagugaaugaugucauuugggcauuaugaaaaauagccuaguuagagaaaaaaacagaguuuuuguuuuguuuuguuuuguuuuguuuuuuugagacggggucucacucugucgcccaggcuggaguacaguggugcuaucuuggcuuacugcaagcucugccucccggguucaugccauucuccugccucagccucccaaguagcugggacuacaggugcccgccaccacgccuggcuaauuuuuuguauuuuuaguagagacgggguuucaccguguuagccaagauggucucaaucuccugaccucgugaucugccugccucggccuuccaaagugcugggauuacagacaugagccacagcgcccggccaaaacagacuuuauagcuuaaaaaucgccagaacaggcucugagucauacucucuuguagugcauuuaguuggugcaucagauaaaauguauugcuuucuguauuucccacaauugaaaacagcuguuuuuauuguggacccagcuuuuaccuuagcauucagcucauucacaagaagguuccaagguggcuaucaacugugaaccauaccaaaggauucagaacuugaaucugggaacaaaaaaaaucuugaccagaaguucucaaauaguuugauauuuuauguucauauuccuuuacuaugguagccauuuuuauuacaaccaauuuugguucagucguuguuuaacacacauucccaaauagcuuugacuuauaaauaaugaaagaagagaaaucuuuuuuaaaacuaaacuuuuguaacaauuuaauuuuggugggaaggaacaauuucaguguuagaaacuuuuaaaguaaauuauuuuaaaaucgauaauaucuuagaacugacuacugcauagcauucuuccaaauuagcauacuuaauuuauuuuucuguaauucacccaaagauauuucuagcauugcaaacaucaaacauuccacucauauaaaugauuucuuaguuacuugugucuuuaguguugaucuccagagugugacuaaaauucauacuauauuaaguuauaaaagcuuuaauagugaacuuaggcuaaagaaacauauguuuuguccaaccaacuauugauuuaauucacuguuuuuuuuuuuuuuuuuuuuuuugcuaauuuguauuuggcaccagggaaauuccuuguuuuucuaggcuaggaugcucagggcuucaaugaguaguuaguugaaucuuuauucucaugauuucuuugggaugccuccaccacugcagacacuauuaucagugagaauuuuaucuauucugcuaucuuugccuguuuuacugucuucacacccaggcaucuguaaaaguagcauuacuuuuauaucuuugguuuguuuuaguuccuccaguggaaaugucaaucaagauuuuuuguggcaaaucaauuugaaaacagguucuugguuucugcucauuuucuguuuauuauaaagauuuucauaaucuuauuucuuuaugauccaguuauguucuuuuuuuacuuuuucaacuuugacaguuuguaucccugauuucaucuuacaguuuugcuguaaaagcacuaccuuuccccucuuguuuaaauuggcaaaaauguuucuguaaauccugucuuuaucuucaaaaguucaucaaauacuggccaaauaaaauccagagagucuauaauuaaaaucacuuccaagguuccuucacauuugcaaguuugguuuuaauucuuaauuuucucuguauuauuccaauuuaugguauucucuuuuucugucuuccucuuuacuaguagucugccuuguuuacaugagggccuuuauuuccaacggaagaaaaacuauuucccuuaauaaucuacuuauauuuauucugaaauccaauuuuauuuagguacuuuuuuuuuuugcagcuugccuauaauuucuacuuccugcauuuauguguguagaauuuccaaacauauucugaaguugucaucaucugagugaugagacacagcgguggucuacguaguaauauugugaacuaaggaauuccuauuuguagucuuuauucacuucugaaauacuuauucugcuuuauaguauuuugaaaugaaaaaugaugggaacucuuugauaucuacaauuguguucuuuguguguaugcuuugaggaagugucagauuuucuugaacuagaauucauauaaaccucuuguccuuuguggaauggggagccuccacacauccuuccaggcagaucuaaaauggcuacucuugagacaugagcaaacauuugucacaugauggagacagcaaggaaaagggcuaaguaggggaagcagaaaacuacuuucucccuugggaaaaaacugagcagaaagccagacgucuucugguucugacucaucucuugggcauacucugcaaaagcuauggcgaagagucagugaauuagaagauucacucagaguaacuuuuuccuacccugcaaguaccuaccagcccuggaggugccuauaugaguaguacuucuuaauuggauucacucuauguuuaagguaaaugcuugauguuaauagguuaguucuagcucccuacuggguauaacucacugcucuucuuucuaucauuauuauuauuauuauuaaggcaagggucucacugucgcccaggauggagugcaguggugcgaucacagcuugcugaagccucuaccuccugggcucaagcgaucuucccacuucagccucccaaguaacugggacuacaggguaugcaccacuaugcccagcuaauuuuuauuuuuuuuuguagagacugaguuucgccauauuguccaggcuagucuugaacgccugaacucaagcaaccuggcuaccucggccuagcaaagugcugggauuacaggcaugagcccccacaccugccuauguaaaaauuccauaauaaaccuaaggacucaauuaauauauaguagucacuaauauuuauaaaacauuuugaauuuuauaaaauuguuuuuggauuacauuaucucguuuugggacucacaacaaugcuguaacuuagcuuuauuaaaccaaagcccaggcacauuuacuucuauagauucucucuaguuuaauuuguagcagagccaggagucaaacccaaggaugcuuuacuccauaguccauguacugaacacgauaucgcacucgacucugcucugcauuauguuuuagguuuggacacauacauauauauuggucucuguugaauuggacauacuaguucucugggcauuaucugguucuuucuggaagcccaacugcaaauuggcguuuauaaaacaguguauuucuggcaauguuacagauguuugcagauuucauaugauuccuacuguuaggcuaauuuuaacauacuuugaacaucuuuuaacugguugcuauuucuuuuacauaagugauagcaucacuuuccagucuuaaacuugguugcuuuauaucguuaauguuuuuucaguuauccucaucuucuuacugccucugugagcacugcuuuuaagugaaauaagaugcuagagcugaugauuaccaagcgauagagaucuguaucucaaggauacaacuugauucuuuuuaaauauggaauauuguuaagaauagcucugcucuguaugaacagggaauucaaacuuuuaaaaaugaaaaaugagaaccuuccugaaugaaauuuuacucaaaucuccuauuaaauccuaagaauaggcugcuggcuuccauuacuuucaggaaaugaaaaauggcuuagaagcuaagugagcuaaguaagccaucucucucucaauuguuucaguuucucaggaauugcugccaauaaugcugccaauaaugaucuccauggaucugacccccauuccaucucccacugccucugaagcuccagaugucaccaaaagaaggagcuuugaagaaagugccuguacccucuuuuuacccugaggugggugaggccaggcagggugauucucaggauauccugauuaucaaagguacaguugaagccuucaucaagacuuucuugaagaugaccaagaaauucaggaaacacuaccaaauagccuaagaacugaagauggagcucaagaauggauggcacaagugccaccuaaaauguagugcaugaugauauacacgaugauuaguaagcuccuugagggcagagaccauuacaccauuuguagucuucccccuaccuucacaauaucuagcauaguaccaaacauauaaacuauacucacuuaauaaauguuaguuuauuacugagagaaaagacuauauaaaaagugcucuuagggcugggcgcaguggcucaugccuauaaucccagcacuuugggaggcugaggcgggcggaucacuugagguaaggaguuugacaccagccuggccaacaugauggaaccccgucucuacuaaaaauacaaaaaauuagcugggcaugguggcccaugccuguaaucccagcuacucaggaggcugaggcaagagaaacacuugaacccgggaggcagagguuucagugagccaagauugcaccacugcucuccagccugggagacagaguccgucucccaaaaaaaaaaaaaaaaaacccucaaaccccucuuuucuuaguacuuaauccaugaucaggaauggugauacaguugacuauuaucucaggcuucuuggccacuauugucuucugucuugacuauguguuggguaggaaauauguaucugucuguauauuaaguuuucaguauuaauacuuaaaguuaugucuucucugaugccugggcuuuuuauuucuuagauguuucauugcgacauucaguuauuuaauggaaauaucucaucugaaccacacucgaggaggauuuauuauacugucagauauaaaaauccaucuuguaucuguuguuaagauucaacaauaaacaaucuugcugcuugaauaggucuacaucagucaucauuguguuucagaaguaggauguacuaucacaucaauuuucuaaaaaaaaauuuaacguguuacucuugaaugacagcauauagucuuacaucucaccugagcagugcuucccauagccugcuaaaagacuauuuacagcaaugugauuuaagauacuacuuaauugaaacaaggcucauggucuauuucucuuagagaaaaggaaacagcaacuuagcuccauucaguucuucugacccuaaguuuucuuagagaauuaaucacaucuucuuuuaggagugaacuuucauuuagaggcagaucuugaaaaucuucaacuuuuugauuuauuguaccuuuugcggcuccaguuacauguaaguuuuuuuauuuguaauuuuuucccaucaauaagcauuucagauuacuaguuuuuugacaaacaugagguagacauucauuaccaacucuuaauagcuggcauuuuagauuauaaagaauccaauauaagaaucaaguauauuuuauucaggaaaauaaucuuacaucaacaacauacuuuucuuuugagcgggagauguaauaugcucuauagauuugcgguuuugcuaaaagcaugaaaguuuuugaaaggaaauugaguuucuuugucuucauaagcuuuuauguauauagccaaggauccuuaaguguacagcuuuaaaagaaacuuacuguauuucauggauaaauuaauuaccaguuuuucuagaauuugcaaaaggaagaaaaacauagaaucugaaaauaauuucugugaauuggauaggauguguggguuuaagguuugaggcuuuacuuucuuuuuuuugagauggagucuugcucuguugcccaggcugcagugcaauggcgcaaucucggcucacugcaaccucugccucccagguucaagcgauucuccugccucagccucucgaguagcugggauuacaggcaugugccaccaugccuggcuaauuuuuguauucuuaguagaggcaggguuucaccauguuggccaggcuggucucaaacucuugaccuugugauccacccgccucggccucccaaaguacugggauuacaggcgugagccacugcgcugggcccucacaucaacuuuuuaauaaauuacauuguaaauuuugucaguuuauaugaugaauuuuaaucaauaauccagaacagauuugguuaaaauauuguuaguaauuuguaucaauauuuuaaauaauguuuuaggcuaguaacacaugaaaacuaaaucauaucuuguuuauucuuccauuaaaauuaguuuuuccucugguaauguaacaggagaacuuauguauauaagaucugugaaauucugacaacaacauauagugugauuuguccucugcuuauuuuccuccuaauaucagguuacaagucauguuauuacaggggaugacaguggcagcaacuaaacuguaacaaguucuaacaaaagaugguuucacauuauuuuuaaaguugaauuuuccuaugauuucuaucuuuuucucuuucuccaggcucccagccaaccucugauaaacccucccagcggccaucagagagcacaaauuguagcccuacccggaaaaggucuucaucugagaguacuucuucaacaggcuagugcuauuuguuuuaccagauuuucaagauaguuucccauuuguuauuugugaauaaggaguuacaauauuguagaaaaaauaauggggacuguaucauauaugguauuuuauuuuuccauucaaaggaguugaaacaauagacuugguauuugagaaucaguaauguacauugaaacaauauaguagucuuccccuuuacaaagcugaauuaaaguaaaaguguguguugggaauaauaggggaauguggauuguagcuguuuaauaaagauuuagauacauauaaaauugcuuaaggccaggcgcuguggcuuacgccuauaaucccagcacuuugggaggcugagguggguggaucaccugagaucaggaguucgagaccacccuguucaacauggugaaaccccaucuguacuaaaaauacaaaaacuagccaggcaugguggcgugcaccuguaaucccagcuacuugggaggcugaggcaggagaaucucuugaaccugggaggcggagguugcagugagcggagaucacuccacugcuuuccagccugggugacagagugagacucugucugaaaaaaaaaaaaauuguuuaguaaacuaguaauuuccaaaguagcauucagaaaucucuagggauaugcaaaauaauuaagaguucaugaggagaaccucuauuaauaguuauuuuuaaacuucuuaauugcuaauguuuauauauuuacaaccuguuaauacauacaacauauuuguauaauuuauacagaaauuuaggguaugcuuccaauuuucuuuuuauggauaguuuguguguuuaccaaaaaaaaaaaaaaaaagagagaggaugauuuauaccuguuuucugccuuuuccugaugguugaagaguaagaaauaauuuuuuuaauguauuaauuuuacugagagagauggagagugauagauuaauuccagauagugaggaauauauuaaagagaauuuagaguguucaggaaaauaaauaaaaaagccaguguggucagacuaaagacgguugguugguugguugguugguugguugguugguugguuuugagaugagucccacucuguugcccaggcuggaguacaguggugcaaucucggcucacugcaaccacugacuccuggguucaagugauucucuugccucagccuccugaguagcuggaauuacaggugcccaccaugauacccggcuaauauuuuuguauuuuuaguagagacuaaaauucgccauguuggccaggcuggucucgaacuccugaccucagaugaucugccggccucagccuccaaaagugcugggauuacaggcaugagccaccgcacccagccaaagaugguuuuuuaauaugaggcuggaaacguaguagagaauuagugauguagagccuuaaacacaguuggaaguuguggaaacguaaacaaggaagugacauuaucuccugccuuucuaucucuaggucuuugaagaaguagaaggccuuucaaauuguaucaauaugguauuuguugaauuuaguugaugauuaucuuuagaagcucuuuguuaguccaguugucugcuuggcagcaagugauaguuguaucucucuuggugcuuuguuuuuauacuaccauggagagacuuuuguacucuaacaagaagugacuuaauuucucugauguuuaccuagaccaggguaaggaaacucagccuaugggccaaaugcaguccaaggccuguuuuuguguagcccucaagcuaagaauuauuuuuagguuuuuaaaggcuuggggagaaaagaugaaguauaauaugagguaagcauuauauauguccucaaaagccuaaaauauuuacucucuggccuuuuacagaaaaaguucaccaaccccugaacaaaugaaugagauuuugauaagggacauaucaauguugaaaaucaccaaaauauuuuacuuuuguaaacaaaagaaagaauaucuaaauucauaauguuucuuuugcaaugagacuauucuguucauugaauuagauuucuguugaggguugcugugaguagugagcacugggaauacaaauacgaguaagauugaguuacugcccucaauaauucagacauauucacugaaaagcaauguauuaaauucuguaacagagcaguguacaaaaugcuaugacacagagaaauucaagcacuaaccacuugaaaugacugaagaagauaucacugaauaagucacgcacacuacuguauauugaauuuacuuaaguaggcaagugggacaacauaaaggguaauaauguagcacaguaacaacagcacuuucgaagaaaggcacaaaaccaugaaauagcauaguguuuuugaagaauaacccauuguuggauaugacuaauguacauaagugguggugauggugguuggaaaaggagguuguaaaagcaauaauggggacuauaucauauaugguauguuuuuuucauucagaggaguuggaacuucauuguacaugcaauugggagcuacugaacaauuucuaacaaggaagauaaauuauuugauaugcucuaucaguaagaauaggauaggucuuggaguguuaaaaaaugauccccaaaucucagaggcuuaaaacaacaaaggcuuauuuuuuguucaugcugugugaccaucaagaguccacuccauguugccuucccucuaggaccccggcuaacagagaaccuguaccuugaauguugcuugucuucuggcggaggggaaagggccauaguaaagcacuaaguggcuauuaaaauuucugcauuaaauguuacuucucaguuucagugccaaagcaagucaugugguuaagucuugugucaaugggacuagaaaguauaauccuuuuggcggugggggguggauagcaaauauuuguaaguaauauuauagucuaucauauguguauguuaaaaaaugcuauaacauuacaauaugaagaauggagugugacaaaugcaugcagacagaguagauaagggcuucagauuuggauauauuaaauuuggacugucuuuggccuauuuagguagagauauugaauagaccguuagaagcagugguuuauacuuuuagagacaucugugguagagaucuaccaguauauauaugaacuugaauuuggcagugaaagagaucauccagggagaauguguuaagugaggugauggggacggagaccuaagaaacucgagcauuuuggagggaaguggaagaaaagauguuuagugaaggacacuuaaauaagaaacaucaaacuguauaugucacagaagccuaaacaagacuucagaauggaauagauuagucaacauuagaugucacaaagagaucaagaagaguucgaucagaaagugucaaaugauugagaaaauaagaaaaaauagucugagaaugugaaaguuuggagcuugaaagagggaaaggagacuuaaaauucagguggcauugaaauaaauuagagcucuuuauuuccagcaaugugguagauuaggugugcagagcaagcaaacaccuuguuaucuaaaaccugaaaauacauggacaacauuucuuacaguaugacugaacuuugaaguaacuaaauaggaaaccagaaacuucagaaaguucaauucaacagagauaaagagcauuagagcugcuugacaucugcuugaucccugguggcugggagucugguaauuggaacacauccagcuggaagagacaaaagacagagccuaggacucuaguagaacaaaaaaccacauaugcauaaaguuggaacccccaaaaggugacacuuaacaauguacgggaaaauagaaauaaaccuaucauagaaaaggacaguuucuuguuuuaguuuuggcuuuggaaggaggaagaaaaaggaguuccugaccacaagcucuuacuaauucucugccucuccuacagauuuauauuguuugucagacccagaaaaaaguuaaaauaaaauuugucauagguuuguaauguucccaguugcauugcagagccaaaugcaaauacucuagagaauugccauuaaauauaaaccugagcuuucaaaaucacuguauucacaauuuugguugaccuagcuuucucauauauuguagcaacacagggaaugacagccuuuauuuugcaauuuaaaggcaaagaaauaaaccagaaucauguccuaaccuucuagguauagucaaaggaauaccauaccucuagaaaccaucuguuuaguaaacugagguauguaaacaacuguagaaacaaaaagcaauuuguauuuuggauaagaugccucaaggcccauccuugaacuaaauuccuguuuuugagauaaauccaaagggauaauauacuaacaguauaugauuuuacugaaaucuguagucuuuauuaugcauaucaggaacccauaguaacaaaauuauuauugaugaguacaaucuaagccuuuucuggagguuuuuaauaucuuauuaggucuuuaggauguaauaugaggauaacuauuuucauuucugaaaugaguauuugcaaauacucuguuaaaguuuacaucucucuuagaggucuuuuuuuaaauauuuguagcuuuuaagauauuuaugucucuuugcucauuucucagguauuugacauaacugaagauuuuuauaauuaggacacaaauccaugguaauuuucacauucuagagaacauaaaucccuucaauaguguuucacagaaucauuucgucuuuuuauagcugguuuacaaauauuguuacauugaugagagagguaguucuuuuauaauuuuauuacugagcaacuauuauauucaggcuaccaaauucaacuacuauuuuaagccaaaagacuauaagagacauuccauaauaccaaggaacuuauguuaagaucaauuuaucuugagagcaacaauaaaauaugcuagugauuuuacauaaauuuauuuauuuauuuauuuauuauuuuugacagagucucgcucuugucacccaggcuggagugcagugucacgaucucagcucacugcaaccuccaccucccagguucaugcgauucuccugccucagccucucuuguagcugggauuauaggcaugugccaccacgccuggcuaauuuuuguauuuuuacuagagaugggguuucaccauguuggccaggcuggucucgaacuccugaccucaaguaaucagcccaccucggccuccgaaagugcugggauuacaggccugagccaccacuccugaccuguauaguauuauucuacacauaaccgaaugcugaaaugauggaaaguuaaucagaaaaugcuuccauaaucuuuguauugagguuuaaaagacaucauacauaugccaugacugaagagguaagugggagaagaggagaaggcauuuugauguaaugggaaaacuauguacuuuugacuuagaucuaguugauucacauuuagcaauaucauguaaccuuguggaaguuacauaaaccauucaacccauggcuuucuuaucuguaacaugaggcuacuacuucuauuuaucuugcagacuagugggaauuagaguaaguggauaagaaauucuuaucacugaauuaguuuuugaguaaaugguaacuucucuuauuuuuugagauggagucuugcuccgucgcucaggcuggagugcaguggugcgaucucggcucacugcaagcuccgccucccagguucaugccauucuccugccucagcuucccgaguagcugggacuacgggcgccugccaccacgccccgcuaauuucuuuuuguauuuuuaguagagacgggguuucaccguguuagccaggauggucuggaucuccugaccucgugaucugcccgccucagccucccaaagugcugggauuacaggcgugagccacugugcccggccuuuuuguuuuuucuuuuuuuuugacacgcagucucccucuguugcccaggcuagagugcaauggugcaaucucggcuuacugaagccucugccucccggguucaagugauucugcuaccucagccucccgaguagcugggacugcagaugugcaccaccacaccagcuaauuuuuauauuuuuaguagagaugggguuucacuauguuggccaggcugguuuugaacuccugaccucaggugauccaccugccuuggcuucccaaagugcugagauuagaggcgugagccacugcacccagccauaaaugguaacuucuguuguuacuguugcuaccguuggcccuccugccauuauuaugacgguauggaaugagaauuaggucauauacaagggagacggaguauagugguaaagcauaaaaaaagauugcaaaggcguuuagccacauuuuuuucuuuuuuaugggauggagucuugcucugucacccagacuggagugcaguugcaugaucauggcucacugcagccuuugccucccggguucaagugauucuccugacucaaccuccacaguagcugggacuauaggugugugcuaccacgccuggcuaaguuuuguauuuuuaguagggacaggguuuugccauguuagccaggcugaucuugaacuccuaaccacagaugaucugccugccucggccccccaaagugcugggauuucaggccugagccacugugccuggccuguuuagccacaugugaugaguagucuuaaaucuuugcuggcuacuaggcccuccuugcauagagugaaacuccaaaaaaauggccuaagaaaaacuagggaguuguauaugaaaaauuccuaagguuuacauguggcaugagacauuugaacucugacuaccaacuguagaguccuuggggacaauuaugaaggcccccauaaagauuacaucuuggucagacgugguggcucacaccuguuaucccagcacauugggagaccaaggcggguagaucacuugaggccaggaguucgagggcagccuggccaacauggcaaaaccccauuucuacuaaaaacacauauaaauuagccagacauggucacgcacaccuguagucccagcuacuugggaggcugaggcaggagaauugcuugaacccaggaggcagagguuguaaacccaagauuacaccacugcacuccagccugggcaacagagcaagacccugucucaaaaaggaaaaaaaaaaaaaaaagguuacaccuuagcagggcuaaaguaucucuggaaugaagauuacacuagacccuaguaaugauuuaaaacaggauucaaggaaucaaacugucaaacuguucuacaaauaacugauuuuuaaaacaaaguucaacauuuaaaaacauuuuaauugugaaaaaacaaaaauuuuuuuuaauuguggcaaaauacagacaauauaaaauuuaccggcaggacgcagucggucacgccuguaaucccagcacuuugggcggccgaggugggcagaucaccugagguccggaguuggagaccagccuggccaacauggcaaaaccccgucucuacuaaaaauacaaaaacuagccagguaugauggcgggcgccuguaaucccagcuacucgggaggcugaggcacgagaaucgcuugaacccaggagguggagguugcagugagccaagaucaugccacugcauucuagccugggugacagagugagacugucucaaaaaaaaaaaaaaaauuaccaucuuaaccauuucuaaagccgugugcaauggcucacgucuguaaucccagcacuuugggaggcugaggcaggcggaucaccugaggucaggaguucaagacuagucuggccaacauggugagaccccaucucuacuaaaaauauaaaaauuagccggccauggugacacaugccuguagucccagcuacucaggaggcugaggcaagagaaucguaugaacuuggaggcggaggcugccgugagcugagaucacaccagugcacuccagccuaggagauggagcuagacuccccauuucuuuucuuuucuuuuuuuuuuucagagucucgcuccugucgcccaggcuggauuccaaguacaagcgauucuccugccucagccuccaaguaacugggauuacagguguccaccaccacgccagccaauuuuuguauuuuuaguagagaugggguuuugccaugcuggccaggcuggucuugaacuccugaccucaggugauccgcuggccuuggccucccaaagugcugugauuacgggcgugagccaccgcgccugccuagacuccccauuucuaaguguacaguuaauucacuaguguuaaguacauuuacauuauugugcaaccaaucuccguaacuuuuuucaucuugcaaaacugaaacucuguauccauuaaauaagaacuucauauuccccugucccuucagucccuggcaaucacccacuaaaguggaaccauacgguguuuguuuuuuugugacuggcuuacuuaacuuagagcauaaguuccucaggguuuauuuuuuauuuauuuuuauuucuuuuuuuuuuuuuuuuugagguggaguuuugcucuuggugcccaggcugcagugcaauggagagaucucagcucacugcaaccucuaccuccuggguucaugugauucucccgccuuagccucccgaguagcugggauuacaggcaugugccaccaugccaagcuaauuuuguauuuuuaguagagauaggguuucuucaugcuggucaggcuggucucagacuccugaccucaggugauucgaccgccuuagccucccaaagugcugggauuacaggugugagccacugcacccagacaggguuuauccauuuuuuagcaugugucagaauugccuucccuuuuaaggcugaauaauauuccuuuguauguuuuaccacauuuuguuuauuguuauuuguuuauaaaugguuacuuggguugcuaccaaccuuggccauuugugaauaauacugcuaugagcaauggugaacagauaccucuuccagacccugcuuucaguucuuucugguauauacccagaaguggaauuccucgauuauaugguaauuccauuuuuaauuuuuugauggauuguccuacuguuuuccacaauggugugccauuuuacauucccaucaacaguguacaaauguuccaguuuuuucaacuucaacauuuuuuaaaggaagacaacaaaauccaaacacuuaauaguuauccaaaaugaaguacagaguggaauaaaagauugaccaaaaaaaugaaugaaacuuuagugaccugugguacaauaucaagagggcuaauauacaugggauagagucucauaaagaacaaauugggaauagcaguugaagaaauaauguuuaauauuucuuucacacuuucauuaaaacuauaucccacagaucgaugaaacucuacgaaucccacguaggauaaacacacugacagcauacauagacauauuaaaggacauuauuaccaaauuucuggaaaacgauuguaaagagaaaaucuuaaaauuaaccagcagaaagaaaauuaaaaacacauacauacaaacacauacagaggaacacaguaacaacuaucagcagacauauugucagaaauuuuacaagccaaaacacaauggaaugaugucuuuaaauguggaaaggaaaaauaacaucugucaacuuaaaauuuuuuaaccagcaaaaauaucuuucaaaaauggaggcaagauaaacauuaucagaaaaagaaaaguuuaaagaauuuguugccaguagaccuacaguagcagaaacacuaaaggacguucuucagauagaaagaaaacauaguagguagaaacauggaucuaccaaaggaguaaagagugccagaaauugucaaccaaugggaaaauauaaaacacauuuuucucggcugggcgcaguggcucacgccuguaaucccagcacuuugggaagcugagacgggcagaucaugaggucaggagaucgagaucauccuggcuaacauggugaaaccccaucucuaccaaaaauacaaaaaaguagccaggcaugguggcgggcgccuguagucccagcuacucaggaggcugagguaggagaauggcgugaaccugggaggcagagcuggcagugagccgagaucgugccacugcacugcagccugggugauagagcgagacucugucucaaaaaaaaaaaaaaacaaccacauuuuucucauauucuuuugaagugcguguggaauuauaccaagauaccauccuauucuggguaaucaaaugucuugauacguuuuaaaagauuaaacucaugcagaauauauuuucagaccacaacagaauuaaauuagaauucaguaacacaaguuaugaaauucucuaaauauguggaaauuaaauaacacacuucuaaauaauucauaaguaaaagaugaauccccaaaaaugaaaucagaaaauacuuugaaaugaauaaaaaugaaagacacauagggccgggcgugguggcucacgccuguaaucccagcacuuugggaggccaaggcgaguggaucaugaggucaagagaucgagaccauccuggccaacauggugaaacccuaucucugcuaaaaauacaaaaaaauuagcugggcgugguggcacaugccuguagucccggcugcuugggaggcugaggcaggagaaucacuugaccucgggagguggagguugcagugagacgagaucgugcuacugcacuccagccuggcaacaaagcgagacuccguuuaaaaaaaaaaacacacacacacauagaaauuugugggauaaucuaagaauauuuauagcugagauuauuaaacaccaaagaucuaucuaagucaguucucaccuuuaggaagcugaaaaaagaagagcaaguaaaaccugcauuagaaagaagauagugggcugggcgcaguugcucacgccuguaaucccagcacuuugggaggccgaggcgggcagaugaccaggucaggaguuugagaccagccugaccaacauggugaaacccagucucuacuaaaaaaauacaaaaauuagcugggcguggucacgcgcaccuguaaucccagcuacuuaggagucugaggcaggagaauugcuugaacugggaggcagagguugcagugagcugagaucgcaccauugcacuccagccugggugacggagcaagucuccgucucaaaaaagaagaaagugaaaguugggugguguggcaccccugugccugaagucuuagcuaccugcgugacugaggcagggaaaagacuacuuaagccaaggagguugaggcuagucugagcaccuuggcaagacccaucucaauacaacaacaacaacaacaacaacaaaacgaaaagaaaaauaaaaauuaacccagaauagccaaagcuauuucuaagcugaaagggagaaauaacuuuaccugacuucaguuaugcuacagagcuaugauaaccaaaacagcaugguacuagcauaaaaauagacacauagaccaguggaacaggagagagaacccagaaacaaauccacacaccuacagugaacuuauuuuugacaaaggucccaagagcauaaagucucuucaauaaauagugcugggaauacuggauauucauaugcaaaagaaaaacuugaccccugucucucagcacauacaaaaacugaaaucaaaauggaugaaaggcuuaaaucuaagaucucaaaaguaugaaacuacuauaagagaacauugggaaaacucucccggauauugaucugaacaaaaauuuaugagcaauaccccacaggcacaggcagccaaacaaauauggauaaaugugaucaaaucaaguaaaaaagcuucugcacagcaaaguauacaaucaauaaagugaagagacaacccacagaaugggagaaaauauuugcaaacuacacaucugacaaaguguucauaaccagaauauguaaauucaaaccacucuauagguaaaagucuaauaaucuguuuaaaaaauggacaaaagacugaagagauauuucucaaaagaagaugcuacaaauggcaacaggcauagguauucaacaucauugauuaucagaggaaugcaaaucaaaacuacaaugagauaucaucucaccccagguaaaaugguuuauacccaaaagacaggcaguaacaaggcugaguguggugguucacuccuguaauccugucacuuugggagccugaggcaugcggauugccugagcucaggaguucgagaccagccuugagcaacacaugaaaccccgucucuaccaaaaauauaaaaauuagccagucucauaacccagucucaaaucaauuaauaaauuaauauuuuuuaagaaaaacaauacaugagaaaaaucaccuaauugucuaaguagauuaagggaacauauuugacaaaauuugacauccauucaugguuuuuaaaaaaaagcucuuagaaaauaagacuagaauaguauuugcucaacccauuacaggguguuugcagaaaaaccuacagcuaaccuaacacuuaauguugaaagacugaaagcuuccucccuaagauuggggaaaagguauagauguccacuacuucuauucagcauuauagggaagucuuaaugucuuauucagaaauaauacaauuugcagaaaauucccaaggaauuuguuaaaaaguugcuggaacuuaauaaaugaguuuaacaguacaauuucuguguguuuaagcucaacauauagaaauaauuguauuucuacauacagugaacaauuagaaacugaaauguagcgccgggcgcgguggcucacgccuguaaucccagcacuuugagaggccgaagcgggcggaucacgaggucaggaucacgaugaaaccccgucucuacuaaaaauacaaaaaaaauuagccgggcgcgguggcgggcgccugaagucccagcugcuggggaggcugaggcaggagaauggugugaacccaggaggcggagcuugcagugagccgagaucgcgccacugcaguccagccuaggcgacagagcgagacuccgucucaaaaaaaaaaaaagaaaaaaaaaaaaaagaaacugaaauguagccaggcaugguggcucacaccuguaauaccagcacuuugggagacagaaguguguggaucgcuugagcccagaaguuccagaccagucuaggcaacauggugaaaccccaucucugcaaaaauuacaaaaauuagccgggcguggugccgcacaccuguagucucagcuacucgggaggcugagacaugagaauugcuugaacccgggagguggagguugcagugaaccaagaucaugccacugcacuccagcuuggaugagagcaagaccuugucucaaaaaaaaaaaaaaaaaauuuaauuaauuaauugaaauauaaauaauacuauuuacaguuguauuaaaagccauuaaagucuuaacgauaaauuuagaaaaacauguacgggaucuguauaauaaaaaguacaguggccgggugcgguggcucacgccuguaaucccagcaguuugggaggccgaggcagauggaucauuugaggucaggaguucgagaccagccuggccaacauggugaaaccccgucucuacuaaaaauaccaaaaaaaaaaaaaaaaaaaguacaguguaggcccagugguucaugccuguaguccuagcaacaugggggaaugaggcaggaagaucauuuggggccaggagauucagaccaguguggguaacagugagaccuugucccuuagggaaaaaauaaaaaauaaaaaauguacacacacacaaacacacacacacacaaucuauguacucacuaaaauuaaaauuaaaucacaaaaaauuaaaaaaauacaaagucuuuuugagaaaaauugaagaauaagugggagagauaugucagaggcauuuuugaaagacucauuauuguugagaugucaccuuucuccagaucacucuguagagucaguggacucaauacaguugcaacaggauuuuaauauaaacuggcagacugauucuaaaauuuacauagaggccagccgugguggcucacacauaaucgcagcacuuucggaggccacugcaggaagaucacuugagcccagaaguuaaagaccagccugggcgacagacacuucguggcuuauuuuuuuuuaauuauuaaaaaugaaauuuagaccagguguaguggcucaccccuguaaucucagcacuuuggaaugcugaggugggcagaucaccugaggucaggaguucgagaccagccuggccaacauggcaaaaccccaucucuacuaaaaauacaaaacauuagcugggcaugguggugggugcauguaaucccagcuacucgggaggcugaggcaggagaauugcuugaaccugggagguggagguugcagugagcagugaucacgcuauugcacuccagccugggcaacaagagugaaacuccgcuaacuuucaauugauuuuugacaaaugugacuauuucaaugggacaaggauagucuuuucaacaaauggugcuguaacuacuggauauccuuauggaauaaaaagaucacugacccuguuucauaccacaugaaaaauuuaaaucaaaaaagaucauauaccccuaugaaauuucggaaauaauaaaacuuuuagaagaauaggaaaaaaucuuuaagaccuugggggauggucaaagauuucuuaaauaguauaaaaagcaaggaccauuuaaaaaaauuugacuuggccgggcgcgguggcucacgccuguaaucccagcacuuugggaggccgaggcgggcggaucacgaggucaagagaucgagaccaucccggcuaaaacggugaaaccccgucucuacuaaaaauacaaaaaaauuagccgggcguaguggcaggcaccuguaaucucagcuccucaggaggcugaggcacaggaaucccgugaaccccgggagguggagguugcagugagccaagauugcaccacuguacuccggccugggugauaaagcgagacuucaucucagaaaacaaacaaacagaaaacauuauuuaagaaaaugaaaauguaagccaaaaaauaaaagaacccaauaaaaauaaucggcaaaagaucugaauagaauuuucucaaaagaaugcauaugaauugccaauaagcucaugaaaauaugcucaacaucagggaaaugcaaauuaaauuuauaaaugagaacacacccauuagaaugauuaaaauguaaaagacugcauaauaccaagucuuggugaggauguauaggaucuuuaacucagucauugaugaugggacuauaaaauagaacaaucacuuuguaaaaauuucuuaaacauacaauuaguugauuuaguaauucuaggcagguugcaguggcucacaccuguaaucccaggacuuugggaggccaaggcagguggaucauuugaggucaggaauucgagaccagccuggccaacauggugaaauucuaucucuacuaaaaacaaaaauuagccaggcaugguggcaggugccuguagucccagcuacucgggaggcugaggcaggagaaucacuugaacccgggaggcagagguugcagugagccaagaucacgccacugcccuccagccugagugacagagcgagacuccgucgcaaaaaaaaaaaaaaaaaaaaaagauuuaguaauuccagucuuagguauucacccaagagaaaugaaaauauguuuaaacaaaaugucaugugcacacauguucauaggauauuuuuucuuuaugacuaaaaacuggaaacaacgcagauuuccaggugaauauguaaagaaauugugguauauucauauaauucaguuguaaaaagaaauaugugaauaguaaaaaggaacaguaaaaagaaauguggcaaugugaaugauucucagauuuaugcugugugaaugaagccguacaauaaaauacauauucuuucuuuucauguauaugaacuucuagaaaagcaaacuuaauauauaacaggaagcagaucaguuguuucuucucugaggcuguggaugacaggcaauuuauuuucuuggaaaggacacacaguaacuuuuuagggugacagaaauguucuauauauugguuaugaugauggcuacaugguaaauuuuucaaaacucaaaaauguauauauaaaaaacaugcauugaauuuuaugugguacuuuaccacagugaaguuaauuuugaaaauaaguuacaucuaaaauauagugugcagcaucauguccuagacuaccaagaaacauaaauuggcaggccagaauuugugaagauaggaacaauucaaaaaugaagugugagguauuaauagcucuaggugaauggcccaggaaggaggcuucaaaaguguguacccauuuuaggauucucuuuuaaacugauauucauggauuaaaugcauugguagcucugaguaguugaugaagggauagaggagauaaaaauaauuccaagauuuugaucccaggauucauucuucaacuacguguuaaugaauuauguccuggucauuggagauaaaaagugauuuuggugaauauagucaccgcguuaauggaccaaacauuguuugagaauuacauacauuaaaccacuaauuugaagugugauuaguguuaggaaaggagaaaguauuaggauaauucuuaauaggggaccuaaauuaagaaugaagagggugcuuccuggucagguaaauaaccuuucaggaaauuauguccucacuguaaacuaaagaaugaauagucauuaagcagaugaauuuguggagaaagauuguuccagguagagagaaaggcagacucaaaggccuugaaucaagaaaaaacaugaugaguuuaaggaacugaaguuuauuauuacuagaauuagggucuaagauaauaugagauugaugcuagaagaaaagguaauaauaauuuugaaguuguuuuaugugguaagagccuuuuuaagaguuguaagcagaagcugaaaccugauaaaauuugugagguuuuuuuuuuuugauuuuuuuuuuuuuuuuuuuugagauggagucuugcucuugucgcccaggcuggagggcaguggcgugaucucggcucacugcaaccucugccucccagguucaagcaauucuccugccucagccucacaaguagcugggauuaaaggcgccugcgaccacacccggcuaauuuuuguauuuuuaguagagacggggcuucaccauguuggccaggcugguuucaaacuccugaccugauccgcccaccucagccucccaaagugcugggauuacaggcguaagccaccuugccgggccuuuguguuuuuuuuuuaaagaucacucaggcugcugucuaaagaaugaguuggaggauggugaaaguagaagcaggaagaacaauguuucaguuguccauugcugcauaacaaagcaccuugaacuuacugucaugaaacaguaauaaucaguuaucaucucacaguuucucaggauucccuuccuuugguuguaacuacaugguggugagguaaagucaucucaaaauauuccuuguuuggucaggcaggcggcucauaccuauaaucccaacacuuugggaagcugagguggucagaucauuugagcucaggaguuugagaccagccuaggcaacauggcaaaacuccaucucuacaaaaaauacaaaaaaguagcugggcauguuggugcaugccuguagucccagcuacucaggaggcugaggugggagggucgcuugagccugggagguggcgguugcggugagcugagauugugccacugcacuccaaccugguuaacauagugagacccugucuccaaaaaaaaaaaaaaaaaggccaggcgcaguggcucacaccuguaauuccagcacuuugggaggccgaggcgggcagaucaugaggucaggagaucaagaccauccuggcuaacauggugaaaccccgucucuacuaaaaaauacaaaaauaaauuagccaggugugaugcugggcgucuguagucccagcugcucaggaggcugaggcaggagaaugcugugaacccaggagguggagcuugcagugagccaaguucaugccacugcacuccagccugggugacagagcaagacuccgucucaaaaaaaaaaaaaaaaaaaaaaaaaaggauucuuuauucaaauaucuggugguugauacugguuguuggcugugaccucagcaggaucuguuggccaguaugccaacucauugcuugggcuuccuugcagcuuggaagcuugaauccaagggcuuguggcggggccggggugggagugggggguggagauagagagagagacagaccuuuucuaaccuaacauuggaaaucaucacauucuucuauugaauuucuuugcuaaggcaagucuucaguggcagcagagagggacuagacuacaacuugauagggaaacuucaagagauuaauguacguauuuuaauagccccacaaggaauuacacuauugcuucagggcagggagauaacauuaucuuagucuugauggcuguaguagaagaaaggaaaguggacagguucaagaguuuaaacuaacagaagacagaauuuuaugauuuguggggagggugaaggagccagaauaaaugauguggccugagcuuagauaaccaacguccugccacacgauggauggucaguauacauaauguuagcuuuaugguaucauucacugauguagggaaucuggauggaggagcuaguuugaagggagcgaaaaugaaaugagaugugaauaugaguuugagaaaucugugaaacaugcaaaaguagacaauuagaagaaaggucuauucagaaaauagaaauucaguagucaucagaauauagaugauaguuaaaagaauugcuaaagagagaauagagagucagacaggaaaaaagcucaggcuagaaaguuuuuaaaaacuauagcauuuaaagguuggagaaaaggaaggggucauuuuucguuuugguaauuuucagauaaaacugaagauugguaugaauauuuagaagucacuuacauacugaugauaauugagacuaugagaauaaacauguucccagugggaaaguaaguauaaaagguaaauaacaaguacucuguauugaggaccuccgcaguuaaauuuaauggaguugcaaguaauugaaaguuaaucaaaggauauuauagaaauaguguaggcaggauuuuaaagaauuaugaaaucaaauauagcugagaguuugaaauuuuuuccuuuuuuuaaauuuuauuauuuuucuagagacagggucuugcucugucauccaggcuggaaugcaguggcgugaucauagcucacugcagccucaaacuccauggcucaaacaauccacccgccucagccuccugaguagauaggacuacggguacaggaaaccacacugggcuaauuuuuauuuuuuguugagacagggucucaguacguugcccaggcuagucucgaacuccuggcaucaagugauccuuccaccucggccucccaaaaugcugagaguaccagugugagccaccguuccuggccugaaaauguuuaaauaucaaauugagacaagggucuauaggccagaguugaugauaaaauaaaaaaaaaagucuuaaaaauuuagacaaggcuauuggauauuauuugaagaaaguuauugguaauuugagaaaaauuccacagucugaugauauuggaaucuagaaugccugaggcuaauaaaggaauaucuaguauaguuaucacauuuaaaagucauauagauaagaaauccauuaauuaacuuuggagaaguaugacccaugaauaauaguaguaaacuaggcagcaugggaagugacuuauuuugaacugauuuuuaaauuauuaguauuuuuugagacagggucucgcucugucguccugauuagagugcagugacucacugcagccucgaccucccaggcucaagcagucuucccaacuuagccucauaaauagcugugaccauagguuucagccagcaugccuggcuaauuuuuuuauauuguuuguagagacaucuucuugcuauguuccuuagguugaucucgaauuccuuagcucaggcauuccuccugccuuggccucccagaauacugggauuacagacaugagccacugugcccacucuuuauccaacauuuaagucccuuagcuuaacuggaccuuaauuuauuuuuuauuuauuuuuuauuuuugaccuucauuuuugaagaauuaaauuuuuuucuuucuaauccuuaccucaaagugagaguuguucuuuuuaaauuuacauauuauuagagaaauauaggccaacuuugguuuuaucuuguuguaauaaccuuuuucaggaaaguaaaccaucaauuuaccuaugauguguaaucuugcuauggaaaauagaguaguacucccuuuuaucuguguaaaaacuuauuuaaauaacuagccguguccaauuuugucuaugugugauuuauugucucuuucaguaaacggaguucccucucgaaguccaagauuaguugcuucuggggaugacucuguggauagucugcugcagcggaugguacaaaaugaggaccaagagcccauggagaaaaguauugaugcugugauugcaacugccucugcaccaccuucuuccaguccaggccguagccacagcaaggaccgaacccugggaaaaccagacagccuuuuagugccugcagucacaagugacucuugcaauaauagcaucucacuccuaucugaaaaguugacaagcagcuguuccccccaucauaucaagagaaguguaguggaagcuaugcaacgccaagcucggaaaaugugcaauuacgacaaaaucuuggccacaaagaaaaaccuagaccaugucaauaaaaucuuaaaagccaaaaaacuucaaaggcaggccaggacagggaauaacuuugugaaacguaggccaggucgaccucggaaauguccccuucaggcugucguaucaaugcaagcauuccaggcugcucaguuugucaacccagaauugaacagagacgaggaaggagcagcacugcaccucaguccugacacaguuacagauguaauugaggcuguuguucagaguguaaaucugaacccagaacauaaaaagggguugaagagaaaagguuggcuauuggaagaacagaccagaaaaaagcagaagccauuaccagaggaagaagagcaagagaauaauaaaagguaauuccucauuuaacauauuaucugaguagaggaaacuagcuuugaaaaacuguaauguaacucuauagcugaauuauuucaucuuauaaccuuucauuuuuuacuauaugagaccauuucuuuucaaaaacuguucuuauguauugcuuuuacaaguuauaauuaagaaucagagaggcuaggugcaguggcucacaccuguaaucccagcacuuugggaggccgagguggauggaucacuugaggugaggaguucaagaccagccuggccaacaugguaaacccuuucucuacuaaaaauauaaaaauuagcuagauguggcagcgcauuccuguaaucccagcuacucaggaggcugaggagggagaauugcuugaauccaggaggcugcagugagccaagauugcaccgcugcacuccaaccugggcgacagagcgagacccugucucaaaaacaaacacaaaagaagcaaagggcaaguaaccauccacucugaacccacucacuuuacagacaaaggaaaucaaggcccagaaagauuauguauuuuauccaauauagagauguaugagcucugugaucauuuuaugugcauaccacauuuugcuuauccauucauccauugauggauaccugggguguuuccaugccguaacgccgcuaugacagcggguauacaaauaccucuuucagacccugcuuuaaccuugggcauauucucagaaguggaauugcuggaucaugugacauuucuauuuuuaauuuuuugaggaacugccauacuguuuuccagaagggcuguaccauuuugcaugcacaaagauuucaguuacaaugcacaaggauuucaguuuacauccucaccaacacuugcuauuuucaauuuuuuuuuuauagcagccauccaaaugaguaugagauggguaucucauuguaguuuuaauuugcuguucccuaaugauuagugacaaacauauuuucauacgcuuauuggccauuuauguaucuuuagagaagugucuacucaaucgcuuuuucaauuuuuugauugggcuauuugguuuguuguugaguuuuagcaguucucaauauauucuggauauuauucucuuaaccggcauauaagcaaaucuuuucuccuauucuguggauugcauuuuuacuuuguuuaugcugucuuuugacguacaaaauuuucugauaucuaugaaguccaauugucuguuuuaucuauaaagcuaugguaaucaaaaccguaugguaguagcauaaagagagacauauagaccagcgaaguagaauagagagcccagaaauaaaaccuugcaugcauggucagaugauuuuugacaaaggugccaaaaccauucagcaggguaaaagacagucuuuuugacaaaucaugcugggaaaacuggguaucugcaugcaaaagaaugaaguuguagucuuacuuuaaaccauauacaaaaucuaacucaaaauggaucaaagauguaaauguaaaaucuaaaaccagaaacucuuggccaggcgugguggcucacgccuguaauucuagcaguuugggaggccaaggugggcggaucacgaggucaggaguucaagaccagccuaaccaacauagugaaaccccgucucuacuaaaaauagaaaaauuagccaggcgugguggugugugccuguaaucccagcuacuugggaggcugaggcaggagaauugcuugaacccaggaggcggagguugugaugagccgagauugcgccacugcacuccagccugggugacaaagcgagacuccuucucaaaaaaaaaaaaaaaaaaaaaaaguccacgcaugguggcucacgccuguaaucccagcacuuugggaggcugaggcagcuggaucaccugagggucaggaguucgagaccggccugaucaacauggagaaaccccgucucuacuaaaaauacaaaauuagcugggcaugguggcacaugccuguaaucccggcuacucaggaggcugaggcaggagaaucccuugaacacgggagguggagagguugcagugagccgagauugcaccaucacacuccagccugggcaacaagagcgaaacuuugucucaaaauaaauaaauaaauaaauaaaaauaaaacuguaaacucuuaggagaaaauauagggcaaaagcuucacagcauugaauuuggccgugauuucuuagauguaauaacaaagccacaggcaauaaaccauucuuauuuuuauuuauuuauuuuuugagauggaguuucacucugucacccagccuggagugcaauggcacgaucuccacucacugcacccuccaccucgugguuucaagugauucuccugcuucagccucuugagcagcugugauuacaggugcgcaccaccaugccuggcuaauuuuuguauuuuuaguagagacgagguuucaccauguuggccaugcuagccucgaacuccugaccucaggugauccacccgucucagccucccaaagugcugggauuacaggcgugagccaccacgccuggcccauauuuaauauuuuuuaaugaaccaauuuaauguucaucauuuauaaauggcuuuucuuaauguggcauguucacucuuacucauauucucuaucaucucuccuggugaauccuguauagagaggguuuuuuuuuuuuuccauccaccuauauaaaaauaauugcuuuuuucuagagaauauauuuuuuaauuucaggagcaauacacgcugguaauaaauaauuuaauuaaacuaguaguuuacugauuuaaaaguaaaagucucuuuucacaugcucucacuugcucuuaucccauucuucucuccauggauaacgcuauuaacaguacauuguguauucuuuaaugcugagagcuugucaucagaacauacagaauuaccuuauacugugguaggaauauaucauaauuuauguaauuacacuguugugauugacuagaucuugcuuuuuuauauuuagcucuuuaugucacuuauguaauacugaauauuagcuaugaguuagagguuuaauuuucuuucaguacuauugauuaguuuagccauucccaacuuauuuggaaugauacauuuaucauacacuaaguuuuuguuguugcuguuguuguuauuguuuuugagaccgagucacccaggcuggaaugcaguggcgcaaucuuggcucacugcaaccucugucuccuggguucaagugauucucaugccucagccacccaaguagcugggauuacaagcaugcgccaccaugcccagcuaauuuuuguauuuuuaguagagacgggguuuccccauguuggccaggcuggucuugaacuccugaccucaagugauccgccugccuuggccucccaaaguacugugauuacaggcaugacucaccacacccagcacuaaauucuuuuuuucuuuuuuuuugagacggagucucgcucugucgcccaggcugguauacaguggcacaaucucggcucacugcaaccucugccucccagguucaagugauucuccuccugaguagcugggauuacaggcgcacaccaccacaccaccaugccuggcuaauuuuuuuguauuuuuaguagagacggguuuuuaccauauuggucaggcuggucucaaacuccugaccugaugauccucccgccucggccucccgaagugcugggauuacaggugugagcuacggcgccccaccauccuaaauucuuauauacuguuagaucuuagggucuuuucaauuuuuuuuuuuuuuuuuuuuuuuuacugugucccaggcuuaagaaaaaagugauacaugaugugggauuaaaaucaagaacaucauugaacuucaccuucccuccaaccaguugccccaaacuccccugcccccacccuuuguguucccaauuccuuccuuagugaaugaagaacuuaauuccaaaagcccuggcacaaacuccagguucucuuucccuagcuccuccccucccccugucccccauuccuagaagggcaggcaccucaguuugaaugcaugggagagcccaggguggugacggagacgggggaaaggcuucccccucagggaaagggaccgaggaguacagugcagugaagugagggcucccauagccugggguaccaaaauggggcccuggggccagaggaaaggauacugguaccccugagaaaggagacccagcagccucaaaauccucucguuaugcauagucgcugcuugauugcuugccuuucuggcaccgguuacagaaccacacucggaccacauccuucucgagcccaagcugcugggcgauguggcugaucugcugcaguguggguuucgggcacugcaggaacaaauucuccagguugccucucacucgguucucgauacugguucgcuuucucuuucgagccugcaagaggguuucugcuuugcaugucuccugaagauuuucauuguugucagcuuccuccacccacuucugcagcaagggccgcagcuuacacauguucuugaagcuaagcugcagacccucaaagcggcagauggucguuuggcugaacaccuucccaaauagaacccccagggugagccccacaucggccuguguauaucccagggugauccucuucugcuucaggagcuuggcaaauuguucgaguucuuucugcagagcuuugauguucugggacuccugcggguuuugcuccagcuucuccuucuccaguuucacggcaccaggggggacggugcagggcuccagggaggugccaucggaguugcucuccacccugacuccugcuucgcccucaggcugagaggucuccaagccgccuuggggcacuagccgcacuccaaccugaggcccacaguacgccauccccccacagaacucauacagcggggggcaugggggaaucccccacaccucagagccugacccaacucccggcccgauuccuggcccuccaggagggccuuggaagcuuagccagguccgaggaucaacccagcccggcuccggccccccuggcccaucaccuccaccgccuggagggggcaagaaggcaggcauccgaagccaggugucccgccauggggaaggaaggcgccccaagcugggggccuggugaaaugucaaauauuuuuauauuccuuucuaucagucuauuuugguaucucugucauagcaguuuaauuauugaagcuuuaaaacacugacaaggaggaugauuucugccuuuacuguaguuugagacaucuugaccauuuauguuaggaagggucaucuuuaaaaugugcuucaagaaaaggcuuucaucagccuggguaacauggugaaaccccgucuuuaccaaaaaauacaauaaauuagcugggcguggugguguugcacgccuguggucccagcuacuugggaggcugagguggggggaucgcuugagccagggaagcagagguugcagugagccuagauuguaccacugcacuccaaccuggaugacagaguaagacuucgucucaacaacgacaaaaaaggcuuuugaauagguuagccuuucuauuccagcaaauucuaguaucauggucagcaaaauuaaacacauacuuuuucacaagauuguauucugagauuugaagagauuauaaagagaaagauaaaauuucugcccucaagagauuguguagggaaggacaugacacacugaguucccagagauagcaacaguuuuucaacuuguucuaauuggagcuuacacuaguacuuguuauauaauauguauucauuuauuuuuucaauuaguauuuguuggaagauuauuauguuucauguacuuagaauugauagaguggugaauaaaucuagaaacuuuuccuaccuucauggauuuuaaccauccaagugcuauuaugaagaguuacuuagaguuauaagaguacuguauauaauagaaauaacuaacuuaguuucccagaaaaaguaaggacuaugcuaaaaaugugaagaauaggcuucaucuguuauuuaaaggagugaggagagagcauacacaaaagucugaaaaagcaugauaguuucaggcaagcgaaagaaagcuuuuguggucaaaacauggaguagaguagcaugggauacagauagagguuguagggaucagauugugccaagaaccuuguaugauauauuaaagauuuuggucacuauuuguugauuaauauaaaaccagaaugcacaggaagaauuuaaugguuaugaggugggcuucuagacucggaaaaccuagguucaaauccugguuuuaaaaagaaaaagguauauuuuuaaaacacuuauaaauuuuugcuguaaaaaauaaaaucaggccaggugugguggcucacaccuguaaucccagcaguuugucaggcugaggcaggaggaucacuugaggccaggaguucaagacagccugagcaguguggcugguuguagcuaccguuucuacaaagaacuguuuguuuguuuguuuauuuuagacagggucuugcugcgucccccaggcuggacuacaguggcacaaucucaguucacugcaaccuccaccucccgggcucaagcgucuccacccccaucccucccccacaguggcugggacugcaggcgggggccaccaggccuggcuaauuuuuguguuuuuuguagagauggggucucacuauguuacccaggcugguuuugaacuccugcacucaagcgauccucucaacuugaccucccaaagugcuaagauuacaggugugagcaccgcaccugguccaucucuacaaaacauuuaaaaauuaaaugagcgugguggcucgugucugugguucuagcuacuugggaggcugaggugggaggaucacuugcacucaggagguugaggcugcaaugagcuguguuccuucacugcacuccagccuuggugacagagugugaccuugccucuaaaaauacauauauauuauagcaagacuuugucucuaaaaauauguaucuuauaauguauauuauauguaaauauuauauauauauauauuuuuguuguuguugagacggcaucuugcucuguugcccaggcuggaguacaauggcuuggcucacugcaaccuccaccucuuggguucuagcgauuuuccugccucagccucuggaguagcugggauuacagguccugccaccaugcccggcuaauuuuugcauuuuuaguagagacaggguuucaccauauaggccaggguggucucgaacuccugaccucaagucugcccaccuuggccucccaaagugcugggauuacaggcgugagcuaccacaccugaccgaaaaaaauuguuaagagcuugcuggccacaccaauagucucagcuacucuggaggcugaggcuggaggauugguugaacccaggaguuugagaccagcuugggcaauggcaaaacccuauuucuaaaaacaauuuuaugaaaauaagaaauuaaaagaacaagugaaugagccugaaaaugauauuggaagaauguaaaacauacaccuuaaguuaauaaaauaaggcaaauguauaacaguaagagucacuuuuaagaccaaaguucuuugaaaacuaauaaaauagacaaacuucugguaaagccgaucaauaggaaugagaaagggaauaaauagggauuuaaaaggaaauaaaguguauauaagagauuaaaaauuuacuacugugagaacuuuaagcccaucaaaugggaaaacuguugaaauggacauguuccuagaaaaauacaauuuuaacaaaacauacucaaaagaaauuaccugagcacuccuauugccuaaauugaaucuauuauuuaaagucuugccccaagaacagcaucagacccaauuuuaacuucuaccacacuuucaagaaaaauauuauucccaucucauuaaagagaauaugggcugcaaacagaagaggauacaucuaaagagaauacauaaacaggccagaugagguggcucacaccuguagucccagcauuuugggaggcagaggcaggaguauugcuggagcccagggguugaagaccacccugggcaacauagggaaacuccaucucuacaaaaaacuuaaaaaucagccaagugugguggcgcaugccuguaaucccagcuacucgggaggcugaggcaggagaauugcuugaaccuggcaggcggagguugcagugagcugagaucgcaucagugcgcuccagccugggcgacagagugagacucugucucaaaaaaaaaaaaacuuaaaaaucagcuggacgugcugaugugugccuguagucccagcuacuagggaggcugagguguuaagggauugcuugagcuuguccaggaggucgaggcuacagugagccauaaucgugccaccacauuccauccugggugacaaagcgagaaccugucuuaaaaaacaaauaagagacaaacaagagaauacauaacauaagcuaaguaaauuuucuguagaggucguacccauauaaauauucaggaggugaccauacuuucccuguuuguaaaccccuuuucuugccagaagcuauaaccaaucuucugacuuuuaagguaaccacauauuuaccuuuuaaaauacuauuuaugugugcagcucuaaacaauacagcuuauucuuccugaauuucauguaaaucuaauuauacagguugggugccauaucaugccuguaauuucagcaauuuuggaagccgaggcguguggaucgcuugaacccaggaguuugagaguagccuaggcaacaucgucucuacuaagaauacaaaaaguuagccaguugugguagcacacgccuguaguccuagcuacucaggaagccaagugggagaaucacuugagcccaggagguagagauugcagugagccaagaucacaucacugcaauccacccagggugacagagugagacccugucucaaaaaagcaaaaacaaacaaacaaaauuaauuacagaggacauauacuauugugucucaccuuuuuuugcucaacauagucauguuaaauuauguauguuaaugcauguugcuguaguuuuaauguguuguuucauuguuuguguguaauacaguucuucgauuuuacucuuggauuauuuucaacuugagguuauugcccaaaaaaacugcuuuuaauauuccucuaauguccacugguggauauggacacuaauuucucuaaagcauuguauauauauauaugccgagaccagcucggucggggagacccuaacccaguggcgcuagaggaauuaaagacacacacacagaaauauagaggugugaagugggaaaucgggucucacagccuucagagcugagagccccgaacagagauuuacccgcguauuuauuaacagcaagccagucauuagcauuguuucuauagauauuagauuaacuaaaaguaucccuuaugggaaacgggauuaacuaaaaguaucucuuaugggaaacaaagggaugggccgaaauaaagggauggguuuggccaguuaccugcagcaggagcauguccuuaaggcacagaucgcucaugcuauuguuugugguuuaagaacgccuuuaagcgguuuuccagccugggugggccagguguuucuugcccuuauucugguaaacccacagccuuccagcgugggugucauggccaucaugaacaugucacagugcugaagagauuuuguuuauggccaguuuuggggccaguuuauggccagauuuuggggggccuguucccaacauauauauauauauuuuuuuuuuugagacggaauuucauuguugucgccuaagcuagagugcaguggcacaaucucggcuuacugcaaccuccaucuccuggguucaagcaauucuccugcccucagucucccgaguagcugggauuagaggcgcccaccaccacacccggcuaauuuuuuuguacuuuuaguagagacgggguuucaccauguuggucaggcuggucuugaacuccugaccucaggugauccaccugccuuggccucccaaagugcugggauuacaggcgugagccacugcacccagacuuaaggcauuauacuaauuuguucucacauugcuauaaauaccugagacuggguaauuuauaaagaaaagagguuuaauucguucaugguccugcaggcuguauaguaagcaugaugcuggcaucuccuaggcuucuggggaggcuucaggaaacuuacagucauggggaguauacugguuacagggcuagagcaggagcaagaaggagaaggacgaagugccauacacuuuuuaaagcaccagaucucaacagaacucacucacuauggcaacgacagcaucgggggauggugcuaaacugcuuaagagaaaaccacccccaugguccagucaccucccaccaggucucaccaccaauauuggugauuacauuccagcgugagaugugggcagggcgcacauccaaacuguaucaggggccgggugcaguggcuugugccuguaaucccagcaauuugggaggccgagguggguggaucaccugaggucaggaguuuaagaccagccuggccaacauagugaacacccaucucuacuaaaaauagaaaaauuagccgggcgcagucgcucuugccuguaaucccagcauuuugggaggccgaggugggcggaucaccugaggucaggaauuugagaccagccuggccaacacggcgaaacccugucucuacuaaaaaguacaaaaauuagccagguggugggcgccuauagucccagcuacucaggagccugaggcaggacaaucgcuuggacccgggaggcggagguugcagugagccgggaucuggccacugcacuccagccugggcaacaagagcgggacuccaucucaaaaaaaaaaagaaaaauuaaaauuagccagguguggugcugcaugccuguaaucccagcuacucaugaggcugaggcagcagaauugcuagaaccuuggaggugaagguugcagugagcugagaucagaccacuucacuccagccugggugacagagcgagacucugucucaaaaaaaaaaaaaaaaaaaauuauaucagaguauauaccuggaaagguaauuacugaauaaaauaaaggauuugucccaagacuuaauuucaagcuauggaguauuaaggugguguggaauugaauagauaaaagaaacagaccuacacauauauggaagcuugcuggguaacagaggcauauaaagaacuguucaacaaauugugcccaguaaguugaaaucccuggggaucagaaggaaauuggauucugucuuauccucuauacaaaaaaucaacucccaguugauuaaauacaguugacccuugaacaacacagauuugagauuugcgauacuuaaacucacagaugaacuguguagccuagaaaaaaauuuuuuaguuuuuaauuuuuauuuuuuguggauacauaguagguguagccuagaaauagucaaaaaaauuaaaaaguaugucaugaacggauaaaauauuuguagauguuaauccauuuuauuguuugcagaaagacauaagauauacacaaaucuauuauaaaaaguuaaaauuucacugggagucugaugugggcagaucaccugaggucagaaguucgagacuauccuggccaacauggugaaacccuaucucuauuaaaaauauaaaaauuaaugggccaggcgcggugucucacgccuguaaucccagcacuuugggaggccgaggcggucggaucacgaggucaggagaucgagaccauccuggcuaacacggugaaaccccgucucuacuaaaaaauacaaaaagcugggugcgguggcucaugccuguaauccuagcacuuugggaggccaaggcagguggauugcuugagcucaggaguucgagaccagccugggcaacauggugaaaccccaucucuacuaaaauacaaaaaaaaaaauuagccgggcaugauggcacacuccuguaaucccagcuacuagggaggcugaggcaggagaaucacuugaaccugggaggcagagguugcagugagccaagaucgugccauugcacuccagccugggugacagagugagacccugucuuaaaaaauaaauaaauaaauaaauaaaauuagccgggcaugguggcaggcgccuguagucccagcuacuugggaggcugaggcaggagaauggcgugaacccaggaggcagagcuugcagugagccgagaucgcgccacugcacugcagccugggugacagagcgagacuccgucucaaaaaaaaaaaacaccacaaaaaaaauuaggccaggcaugggggcucccaccuguaauccugguacuuugggaggcugagguggguggaucaccugaggucaggaguucgagccagccuggccaacguggugaaaccucuucucuacuaaaaauaaaaaaauuagcccugcuuggccgggugugguggcucacgccuguaaucccagcacuuugggaggccaaggcaggcagaucaugaggucaggaguucaagaccagccugaccaacauggugaaaccuggucucuacuaaaaauacaaaaaauuaagcaugguggcacaugccuguaaucccagcuacuuaggagucugaggcaggagaaucgcuugaacccaggaggcagagauugcagugagccaagaucgcaccauugcacuccagccugggcaacagagcgagacuccaccucaaaaaaaaaaaaaauagcccugcaugauggugagugccuguaaucccagcuaccuggaggcugaggcaggaaaaucacuugaacccaggaggcagaagcugcagugauccgagaucgcgccacugcacuccagccugggcgacagaggaagacucugucucaaaaaaaaaaaaaaaaaacuaggccgggcgugguggcccaugccuguaaucccagcacuuuugggagaccaagguggguggaucacuugaggucaggaguucgaguucgagaccagccugaccaacauggugacccugucucuacuaaaaauacaaaaauuagccgggcaugguugugcaugccuuuaaucacagcuacugaggaggcugaggcaggagaauaacuugaaccugggaggcggagauugcagugagcugauguugcuccaaugcacuccagccuggccacagaguaaggcucugucucaaaaaaaaaacacaaaaacuagccaggugagguggugggugucuauacucccagcuacuugugaggcugaggcagaaucauuugaacccuggguagcgaagguugcagugagccaacaucaugccauugcacuccagccugggcaaaaaagcaagacucugucucaaauaaaaaguuaaaauuuaucaaaauuuacaaacacaaacuauacaugacgccauucucaguuaugagaaauguaaacaaagacauacagcauuaaucauaaaauuaacuguaauaggccgagcaugguaguuuaugcuuguaauuccaggacuuugggaggccaaggcaggcggaucaccugagguugggaguuggagaccaaccugaccaacauggagaaaccccgucucuacuaaaaauacaaaauuagcccggcguaguggcgcaugcccguaaucccagguacucgggaggcugaggcaggagaaucgcuugaauccaggaggcggagguugcagugagccgagaucgcaccaucucacuccagcguggacaacaagagcgaaacucugucucaaaaaaaaaaaaacuguaauacauacuguacuacuguaauaauuucauagccaccucuuguuguuauugcaaugaagaaaguguugccagaauccacuucaaagccauaugacacuaaucaucuccaagugagcaguuuacuggaaucucuccaguaaauuacguaucacaguacaaagugaucucuugaaguucuuuauuucucaucguuuuuacuacgauuccauaaaccuugaaugacccuaugagaccuauaugaagugccauuagugauguuagaagggcuuccaagaacaagagaaaagucauggcauuacaagaaaacaaaaaguugaacugcuugauauguaccauagauuggggucugcagcugugguugcccaccauuucaagauaaaugggccgggcacgguggcucgcaccuauaaucccagcacuuugggaggccgaggcaggcggaucauggggucaggaguucgagaccagccuggccgacauggugaaacccugucucuacuaaaaauacaaaaaauuaggagugguggcgggcgccuguaauccuagcuacuccggaggcugaggcagguuaauugcuugaaccugggagguggagguugcagugcgccgaaucacgccauugcauugcagccugagcgagagacugagacuccgucucaaaagaagaaagauaaaugaaucuagcauaaggacuugaaaaaagaaaaggaauuuugcaaagccaucaccguagcugugccagcaagugcgaaaacuuaguacuuuuuccaagguaucuuuuuaucucauauugaaaaugcagggguuuuuuuguuuuuguuuuguuuuguuuuguuuuugagacagagucuugcucugucgccaggcuggagugcgguggcacgaucuuggcucacugcaaccucugccucccggguuccagcaauuccccgacgucagccucccgaguagcugggacuaccaccgcacccggcuaauuuuuugcauuuuaguagagacgggguuucaccauguuggccaggauggucacaaucuccugaacucgugaucugccugccucggccucccaacgugcugggauuacaggugugagccaccaugccuggccgaaaaugcaguuuuuauguggaugcaggauugccuuaaaaaagcauacauguccaggcgugguggcucacgccuguaaucccaacacuuugggaggccgagguggguagaucaccugaggucaggagauugugaucagccuggccagcaugacgaaacacugucucuacuaaaaaugcaaaaauuagcugggcauggugguagguaccuguaaucccagcuacucggaaggcuaaggcagggagaguugcuugagccugggaggcagagcuuacagagagccgagaucgcaccacugcacuccagccugggcaacaaagcgagacuccgucugaaaaaaaaaaaaaagaaaggccagcucaauggcucacgccuguaaucccagcacuuugggaggccgaggcaggcgaucauuugaagucaguaguucaagaccagccuggucaacauggugaaaccugucucuauuaaaaacacaaaaaaauagccaggcgugguagcgggugccuguagucucagcucuucaggaagcugaggcaggagaaaucgcuugaacccaggagguggaggcugcagugagccgagaucacgccacugcacuccagccucagcggcagaguaaaacucagucucaaaaaaaaaaaaacagaaagaaaaagaaaaaaucaagguaaaaggagaagcuucugccaaccaagaggcaguagacaaguucccagaugcuauuaagaaaaucauuagcagccggacgcaguggcucaugccuguaaucccaggcaugccucccacuuugggaggcagaggcauguaaaucaucugaggucaggaguucaagagcagccuggcaaacauggugaaaccccgcuucuacuaaaaauacaaaaauuagcagacccugguggcccggagguugcagugaggcgagaucaugccauugcacuccagccugggcuacaagagcaagaugccaucucaaaaaaaaaaaaaaaaaaaaaauuagcugggcgugguggugugacccuguaaucccagcuacucgggaggcugaggcaggagaaucgcuugaacccaggagguaggguugcagcgagccgagaucgugccacugcacuccagccugguugacggaaugagacucugacucaaaaaagaauaaaagugaaguaagccagacacaaguggacauauauuuuaugauuccacuaguaugaggaaccuggaauagacaaauucauacaggcggaaaguagaauauugguuauuagggguuggagggaggauggaauagaguuuuucuuuaauaggaucaguuauucugucugggaggaugaaaaagauguggagauggauggauacuggugaugguuguacaacaaugugaauguacuuugaugucacugaacuguccagaccacuuaaaaugguuuaaaagguagauauuaugguauaugcauuuuaccacaauuuuucaaaaaaaaaauuagucauauguguaucuauuucuacacucuauuacguuguucuacauuuauuuuguguagcuaguaucacauuguccugauuacaauacauuuacaguaagucuugaaauuagauaaauccuccaauuuuuuuuuaguuuuuuuuuuugagauggagucuugcucugucgcccaagauggagugcaguggcgugaucucggcucacugcaaccucugccucccggguucaugccauucuccugccucagccucccgaguagcugggacuacaggcacccaccaccaugcccggcuauuuuuucuauuuuuagaagagacgggguuucaccguguuagccaggauggucucaaucuucugaucucgugauccaccugccucggccucccaaagugcuggaauuacaggcgugagccaccaugccuggccuuagguuuugucuuuccauagcaauuugugaauuaucuuggcauuuucucaaaaaaaaaaaaaaaaaaaaaaacuguugguacuugagauuguguuagaucuauagaucaguuugggggaaaguugcaaucaccaacuuuuuuuuuuuuuuuuuuuuuuuaagacacagaaucuuccucuguugcccaggcuggagugcaauggcuuacugucagccuugaccuccuagguuuaagcagucuucccacuuuagccucuucaguagcugggacuacaaguguaagccaucacaccuggcuaguuuuuuaaaauuuuuugcaaagauggggucugacuauguugccucgguuggucuccaaccucugggcucaagugauccuccugccucagccucccaaagugcugggauuacaggugaaagcugccaagccuggacagaaauugccaucuuaaugacauucaguguuuaauuccauggacauccauggacaugguauguuacugcauuuauuuuagguuaucuuugauuuuuuuuuuuuuuuuaauggagccuugcucugucaccuaggcuaaagugcaguagugcgaucuuggcucacugcaaccuccaccucccgggcucaagugauucuccugccucagccucccgaguagcugagguuacaggugccuggcaccaugccuggcuaauuuuuauauuuuaguagagauggaguuucaccauguuggccaggcuggucucaaacuccugaccucaagugauccaccuacuucggccucccaaagugcugggauuacaggcaugagccaccacaccuggccuuuuuuuuuuuaaauucauuguuuuguuuauacucuuauguacugcauguauuuguuagauuuauauuuugguuuucuuuuaaauuuguacuuuauuauauuuauacauuuauaaagaaauuauauuucuguauuauuuuguuugauuuauaucuaagcauuuaaugcuuuucuuguuuuuuuguuuuuguuuuuuuuuuuuuuugagauggagucucauucuguugcccaggcuggaguguuuuuuuuugagauggagucucauucuguugcccagccaagauggaaccauuuuggcucaauucaaccuccaccuccuggguucaagcgauucuccugccucagcuuccugagaagcugggacuacaggugugugccaccacacccagcuaauuuuuguauuuuguauuuuaaguagagacgggguuucaccauguucaccaggcuggucucaaacuccugaccuuaggugguccgcccgccucauccucccacaguguugggauuauaggagugagucacccugccuggcuacuauucuacuguuuaaguagcauuguuuaauuuugauuucaguuuucucauugauagaacauacaaauacaguugaauuugaccuuggauucugcaacauuguuguguauuucacuaauuguaguacuuucucuuuuguagagucuuuggguguuuuuauauagacaaucacacaaugugugaguagagauaguuuguaauucuuccuuuucaauauuguuuucuuuuucuggccuuuuugcacuggcuaggaccucuguuaugauacugaacauauaugaugaaagcauauguuugccuuguccuuaauaauagggaaacuuuaugcaauuuaaccuguacauaugaggcaaaucaaauaucugggaaacuuccugccuggucauugccaguacauuugcuuauguuuauuuuauagacaauuuccagaguuuuuaguuguacuuaguaaaaugagagguagaugugcaucuguucgauuuuuguguggaacaagaaucaccuguauuauuuuuuaaguaaaaugcuuuguuuaaaaauauggaacacuucacaaguuugcauaucauucuugcaccagggccaugcucaucucuguauuguuccaauuuuaguauaugugcugcugaaucaagcacaucuuuuuuuuuuuuuaauguuuuuguuuuauuuugauuucuauuuugauaagcuuccccuuugccucuccuuuuaacacuguuugaugucauuacauugucuucugguuugcacuguuuuggauaugagaucuaaacuuuuuuauuauuauuauuuuuuuaagaaaugggucuugcuauguugcccaggcuggucuugaacuccugggcucaagcaauccuccugcgucagccacacaaagugcugggauuacaggcaugagccacugugcucggccccuuuuuauaacguguguuuucucuuuagcugcugcuuuuuuguuuaauuaauuaauuuauuuauuuauuugcccucccaggcuggagugcaguggugcgaucucagcucacugcaagcucucggguucacaccauucuccugccucagccucccgaguagcugggacuacaggcacccaccaccacgccuggcuaauuucuuuuuuauuuuuaguagagucgggguuucgccguguuagccaggauggucacaaucuccugaccucgugauccacccaccucggccucccaaagugcugggauuacaggcgugagccacugcgcccagccucuuuagcuucuuuuguuuucuucaucaguaguuuuuaacaaguuuauuacgauauacuggaccuuguuuuauuuauccugccuaugguuugcuuacuuucuucuaacucugagguuaugcuuuuuaucauuuugggaaacuuuuuagccauaauucucaauuuuuuucauugugaauuuuuuauuuugugaauguuacaucauuguauaucugguuuuuguuguuuuccuuuacaaguguccaauuguuuuaguaguaaguuuucuccuuucccgggauucuaagauucuguuaguauuauauucuuuacauaauuuauucuuuucuuuaaucucuaucaguuuguguuguuucuauugcugucuucaaguucacugaucuccagugccuuauuugcuguuaaguacucuccaguuuuucauuucagauuucguauuuaucaauucucaauauuccuuuuguuguuguuguuaagucuucucuuccucuccucauuaucuuuguauuuucuucuaaauuccugauuuaugcuuguagaguaguauuuuaaaguuauuuucuuuucuaucuuugugauuucuauuucuguugcuguuucuacugaaugauuuuuuccccugggucacauuuuccugcauuuuggcauauguaggaauuuauuauuggaugcaagacauugugaugucgcauuauuguaugucugguuuuuguugguuuccuuuacaaauauucaauuuuauuuugguaggcaguuaaguuacuuauggaucaguuuggauucucauauuguuuuuaaacuuagcuaaggcuagucuuuuuuuuuuuuuugagacggaguuuugcucuugucacccaggcuggagugcaauggcgcuaucugggcucaccacaaccuccgccucccagguucaagcgauuccccugcaucagccucccgaguagcugggacuacgggcuugcaccaccacacccgccuaauuuuguauuuuuaguagagacgggguuucuccauguuggucaggcuggucuugaacucccgaccucaggugauccgccugucucagccucccaaagugcugggauuacaggcgugagccacugcgccccaccagugaaggcuagucuuccuuucaggauaauuaagcccucuaacaguggauaacauuacccucugggcuugcuguuuaauguccccuauuguugaacaaugucuuucuacuuugccuaauggaaugaguaucugccaucaugugugaguugugugaauugcucagguuacaguuuucugguaguuccuuguucagccauauggaauuucacccuucacaugcacaacguaguguuuagcaguauacuaaaagagacacccauaguuagauuucuagaguuauaauucuccauagguuuuuccauucugauacucauuuccacaaauuccagcuaucucagucccucuguacucugauauaucccuuuucagcucaucaguuuggccauucucugcuugguuucuacuucugcaccacagucauucuuagaaaggcaagguggaggcugggcgugauggcucacgccuguaaucccaacccuuugggaagcugaggugggcagaucaccugagaucaggaguucaagaccauccuggacagcauggugaaacccugucuguacuaaaaauacaaaaaaaauaagcugggugugguggcacaugccuggaaucccagcuacucaggaggcugagguaggagaaucucuugaacccaggaggcggagguugcagugagccgagaucacaccacugcacuccagccugggagacagagcaagucuccgucucaaaaaagaaaaaaaaaaaagaaaaggaaagaaaagaaaaagaaaggaaggaaggagggaaggugggugggagggaaggaaggaaaggaagaaaaggaaggaaaggaaaggcaagguggggcugggcacaguggcucaugccuguaaucccagcacuuugggugggcggauuaccugauguuaggaguuugagaccagccuggccaacauggugaaacuaaaaaccgucucuacuaaaaauacaaaaauuauccagaugugguuacaggcgccuguaaucccagcuauucaggaggcugaggcaggagaaucgcuucaacccaggaagcagaaguugcagugagaugagaucaugccacugcacuccagccugggcaacagagcgagacuccaucucaauaaacaaaaaaagauaaaagaaaggcaaggugguugugugacucaccgcauuuuuuucagauuucucagggauaacagugcugcauuaacuguuguccaguaucugauaauaauugucuuuuaaaauuuucucaugccgggcacgguggcucaugccuauaaucccagcacuugggaggccaaggcagguggauuacuugaggucaagaguugaagaccagccuagccaacauggcaaaacccgucucuacuaaaaauacaaaacugguggcgugccccuguaauaucagcuacucgggaggcugaggcaggagaauugcuugaacccagaaagcggagguugccuugagccaagauugugccccugcacuccagccugggugacagagaaagauuccgacucaaaaaauaaaauaaaauaaaauuuucucuaaguaucuaguagacuaccauauuucuauuacuucuugucaggagaagucugguaccaguuauuuaaacauggccagauaaggaaguccccauaucucuuuuuuuaauugcuaugguuuuuuuuuuuuaaguagacaauuauuuguaggaaaacuuuuuuuucauaauaaaauuaucuuuaaacuucucuuucuagcuuuaaugaagcaccaguugagauucccaguccuucugaaaccccagcuaaaccuucugaaccugaaaguaccuugcagccugugcuuucucucaucccaagggaaaagaagcccccacgucccccaaagaagaaguaucagaaagcagggcuguauucugacguuuacaaaacuacagaguaaguaguaguaccuauuagcuaacaucccuuuuucuuccacauuuggaaaaauacuuugacuaucaaaaaacaauauagauucuuuuguguuucauaagcgugaugauuguguuuuugcacucauguaugagguacgccucccucaaacuuugugucaaggucaauacauuacccuuucugauguggggggaaaucaguacaaaaguaauaugcacaaauaccaguguucacuguacuacuguacugucuuauguuguaugagacuaauugucuuucugaugguuaucuucucucugccuuucuagauugagauucuaaugaugcuuuucuuuucuuuuuuuguuuuuuuuuuuuuuuuugagacggagucucgcccugucacccaggcuggagugcaguggugcgaucuuggcucacugcaaacucugccuccgggguucacgccauucuccuaccucagccucccgaguagcugggaguacagggcccgccaccacgcccagcuaauuuuguguauuuuuaguagagacgggguuucaccauguuagccaggauggucuagaucuccugaccucgugauccaccugccucggccucccaaagugcugggauuacaggcgugaaccaccgugccuggcccuaaugaugcuuuucuuauuaacuuaagcaauaaauggcucuguguaacuaaaaugauauuggugacuucauuuuuuauauuggugacuucauuuuucacugauuggacgcuguguuccaugagcuuugucagaugaauaaaauauuugccuugcuuuuaagaacuuuguauuaucuuggcagaguacaauuuaauaagcacucuaauugagaauuuuuaaagcaucaaagggauagcaaauuaucaucaauuaagaaauauuuucugguugaguuaggauuuagaggugugguaguaguuuaccagauggagaaggauauuccagucagaacagcauguaaaaaggauacaaagauuuuucauauaucaaaacaacuugaaaguuuagggcuucugaaauguaguggcccugugguaaauaagcauuauaugaugaggaacauauaaccauggacuuugagauauuuaguuaacuuuaagauauuugguuuuggaugggagugguggcucacaccuauaaucccaacacuuugggaggccagggcggguggaucaccugagguugggaguuugagaccagccugaccaacauggagaaaccccguuucuacuaaaaauacaaaauuagccgagugugguggcacaugccuguaaucccagcuacuugggaggcugaggcaggagaaucgcuugaaccugggaggcggagguugcagugagccgagaucgagccauugacuccagccugggcagcaagagcgaaacuccaucucaaaaaaaaaagaaauuuuuuuaaugcuauuuugcuauaggaaauaaaaaaugaguuugggggauggaugugaaagguauagguuuguuuaagauaacuccagcagcaggguggaaaauaaauggaaugaauuacuaguggcaaaaacucucaccucacaguuucugucaaaaagucaugaauaucugaauuuagacaaagagaagaauaagauugaaagaggaaaccuuagauuuuagagguacaucucguuuggugguguuaaaguaauugacauguaaaccauaccacuuuauuuugcauuuaaaagauuuuuauugauuugucacugagguagauaucacaaaauuuuuauacucugaacgugcuucuuaggucaugaaaacauuuuacuaaugaagcuuaaguuuagcuaauuauaauaauaaaucaucucaaauaaccaagacuuuaaaaagauaggcacuuaacuauuuuuuuuaauuuaagagaaguugugaaguauguaguucaaaguucauaaugguaccuucacaaugucuucagggaccuaggcuccuuuuucucccuucuaucucagcacuaauuaugcauuccuaagauucccucauguuccaagauaguuacuagaguccagccauuugauguuuguuacagacagaaaagaggaggaaaagcaugcuccuucuuuguuuuuuguuuucugguuuguuuguuuguugcgauggaguuucacucuuguugcccaggcuggagugcaauggcacgaucucggcucacugcaaccucugccuucuggguucaagcgauucuccugccucagccucccaaguagcugggauuacaggcacccaccaccgugcccagcuaauuguuuguaauuuuaguagagaugggcuuucaccauguuggccagacuggucuugaauuccugaccucaggugauccgcccuccucugccucccagagugcuaggauuacaggcgugagccaccaugccuggcccaugcuccuucuuuguaagaaaauuucaaacccgcauuuauauaaauuggcuagaauuuaaauugcauagccacacuuuagccauaagacagguugcggaaauaauggucauuacucuagguguuaauagcuguuaaggaaaaaaaaaaucaacauucugucaguagaaaugagaaaguagaaauacacuuugggacacaucuaauucagucauaauuuuggaacagagucugcuaaauagagcagaaauauaauuaucaacuuuucugcuaaauaaaauucaaguuuuauuucuugcuuagggagaaccucucagacuguguuuuuccucugcugucacaucacaauaaucaucaacaaagaagucuguaagagcaaacugcugguuuaaaaaaaaccauuuuuuucaauaaaauuaaaaaaaaaaaaaacacacagaagacuucuguaaccaaagguaugaggguuuucccauacaccaagcaauaggcagcagcuggguguccucaauucaauucugucacuguuuuccuggauauagggucagauccuauagguugggugcucaguucccaagaccgccacccucccuuuagaccagucacaacucuggcucucuagaacuucugaccaaccagcuucaaguugggguuuccacaauccccccuuuggguuugauuaauuugcuagaauggcucacaaaacucaaggaaacauguacuuccauuuacugguuuguuauaaaggauauuacagacgcuauagaugaagacauauacuggggaaggagcauagagcuuucauucccuccuugggcgcacuacccuccaggaaccuccacauguucagcuauccagaaacucucugaaccuuucuuuuugaguuuuguuuuuugugguuuuguuuguuuuuuugagaugggguuucgcucuugucaaccaggcuggagugcaaugguaugaucuuggcucacugcaggcucugccuccuagguucaagugauucuccugccucagccuccagaguagcugggauuacaggcaccugucaccacacccagcuaaauuuuuuuuuuuuuuuuugagacggagucgugcucuguugcccaagcuggggugcaguggcaagaucuuggcucacugcaaccuccaccuccuggguucaagcaguucuccuaccucagccuccugaguagcugggacuacaggcacacaccgccaugcccagccaauuuuuuguauuuuaguagagacgggguuucaccauguugcccagucugguugcgaaauccugagcucaggcaguccgcccaccucagccucccaaagugcugggauuacaggagugagccacagcgcccggccucuuuuugaguuuuuauggaagcuucauaggcgucaaugacagccauguagaaaugugauugaacaaaauguagaggauguaaacccagcauguccugucuagacuucuuggccucucugugucacauuccuuucucuaggguauggggcaggacccucucuggagugaggguuuucuuggcccagaaucagauuagaguccugccuuagguaggugaaaggaagacaggagaaggucaaagagagauucuaucuccugaggcccacuccugagacuuaaagugccccaacauuauaacagggacuaugggaguuaagagccaggaaccauggaugaaaacauauauauauauauauauauauauauauauauuuauuuauuuauuuauauucauauuuauauuuauauauaucauaagaccacacuucuguuuuuuacuuuugugcuuuuucuugauuaaagauuuaaaaauggaagauucugaucuuuugauguaauuugauuucacaucaaauuauacaaccguaucagugauuuguaagugucucuggucauacaaaagauuugaccugaaaauggacugaaauaucacuuuauguauguuagaacuagcucuuccucucccaaaaauaaguaggaagaaaaugguuuauucuuuaagcauuuuuaagaacauugaucaguuuaguacauguaugcauucuugaaagaugugaagccaggauauuauugugggcuggcuauuuuguuguuagcaguuucauuaauaaacuuauguuuagagcaguuucaguuucacagcaaaauugaguggaaaguacagaguuuucauauacacccuguucuucauacacacaaccugcccacuguuacaccacaccauugugauacauguguuaugauccauguaccuacauugauauaccauuauuacccaaaguccguaguuacuuuaggguucacucuuggugaaauacauucuauggguuuugacaaauguauacugacauguaucuacuauuguaauaucauacaauagaauaaaaauaaaggggccaggugcgauugcucacgccuguaaucccagcacuuuaggccgcuggagcuggaggauugcuugagcccaggaguucaagaccaaccugggcaacauagcaagaccuugucucuacuaaaaauuuaagaauucaggccagacgcaguggcucaggccuguaauccuguauaucauucuuggugauauacauucuauggguuucgacaaauguauacugacauguaucuacuguuguaauaucauacaacagaauaaaaauaaaggccaggugcgauugcucacgccuguaaucccagcacuuuaggcggcuggagcuggaggauugcuugaggccacuuuggaaggcaaggcaggcagacuacuugaggucaggaguucaagaccagucaggccaacaugacacaacccugucucugcuaaaaauacaaaaauuagcugggcgcaguggcaggcaccuguaaucccagcuccuugggaggcugaggcagaagaauccuuugaccuccggaggcagagguugcagugagccgagaucgcaccauugcacuccagccugggugacagagcaaaacucugucucagaaauaaauaaguaaauaaaauaaaaauccagcaggugugguggcgcacagcuguagucccagcugcuugugagacugaagugagcagaucacuugaguccagggguccgaggcugcagugaguuguguucaugacauuacauuccagccuaagugacaaagcguuuuuuuugaaacccugucucagaaaaagaaagagaaaauaauacgaacuuuuuuuuuuuugagauggaguucaagcaauucuccugccucagccucccgaguagcugagauuacaggugcccaccaccacgccuggcuaauuuuuguauuuuuagcagagacgggguuucacauauuggccaggcuggucucaaacuccugaccucaagugaucugcccgccccagcuucccaaagugcugggauuacaggucugagccaccacgccuggccaagaucgaccauuuuuuaagaacucaggcuuuuguugucuuuuagaaugcccuucauuuuggauuucuuugauccuaucuucaugauuaaauuuagguuuaaaaaaaucuuggcagaggccugggaaagauggcuuaugccuguaaucucaacauuuugggaggcugaggcuggaggaucacuugaggccuggaguucaagaccagccugggcaacauagugagauccagucucuacaaaaauaaaaauaaauaaaacuuaauaaaauuuaaaaaucauggcaggaauauugcauaugugauacuuuauacuucuuuuugcaucccacuuauugucccagcauugauggugccauuuuugauuacuuagugaaggugguauccaccaagucuuuucauugcaaagauacuacauuuuuucccauuguaauugguacauaaaccauggguugauauuuaaggcuauggcuuguucucuaucagucuuuuuuaaucuaacauuuaaucauccauuaauguuuuuucccuaaguuuaauaauuacauugaugguugaaaaaugacaauuuuugcugggugugguugcucaucccuguaauccgagaacuguaggaggcagaucaccugaggucaggaguucaagaacacccuggccaacauggugaaaccccaucucuaccaaaaaugcaaaaauuagccaggccuggugacaugcaaccuguagucccagcuauuugggaggcugaggcaggagaaucgcuugaacccaggaagcagagguuguagugagcugagauugcgccacugaacuccagccugggcgacagagcaagacuccgucucaaaaaaaaagaaagaaaagaaaauuuucuaauuccauuauuucuugauuuuuagcugacauuuucuggugaagaugagcuucucuuuuuuuuucuccguaaacucucuguuuguuuuguuuuguuuuguuuuuuugaauaccuuauagacucaugaauuuuuuuuguuugggugguuuuguuuguuuuucuccagagacagggucucccuauguugcccaggcuugacucuaacuccugggcucaagaaguccuucugccucagccucccaaagugcuaggaggcauaagcuaucaugcuuggcauaaaauugacuauauuauaaucuauuagcauuuuauaggaaacugcucaaaauucccugauuuuaccacaggagccccuuuaaacuggccccuguuuccuuuauacaugucuucagauuacuuaucuuugagcacuucccugcuuucugcuguucggaguagugaggauuuaguuuuuuguuuugguuuacuuuucugcuguuguuuaucagacuuguucuuucuuuggccuguaucuggaaucaacuauuucccucaaggagcuuugguuucuuuuagugaggauuauuauuuagaagucaaaaucugaauuuuucaugugcuuuuucuacuaggguauuuguuacugcuaugaugccaugcuucuagccccuuucaguaccauggaaugaaaaaaaugugcguacacacaaguguauaaauuuuauauugcuguugaagaaauuaucacaaauuuagcagcuuaaauaucauccauuuauuaucucacagauuccaguuuagucuuggcuuaguuggauccucuguucugaguuucauaagccagaaucaagguaccauccgaggcuggggcuguauuccagacucacauggauguagguaaaacucauuucuuugcaguuguguaacucaugguugguggcuugcuucuucaagucuucaacaaagacagucugcuucuuuaagacucuggacugagagcaauccuaagccuuuauugagauauuaaguguacaguaaucaguuuuaaaacauuguuauuauuccagaaagaaacccacaucacuaggcaaucacucccuaauuuccccaccauuaggcaacuguccauuuagauauuuaauguguggaauauauguaauauaaauacaauuuuuuuuuuuuaaccaguccuggauauuuaguaucauacaauauguguuuuuuugugacugaguuuuuucacuuagcauauuguuuucagguuucaugcauguuguaguauauauaauuccugucuuuuuugccaaauaauauuccauugugcauauguauaccacauuuuauuuauccauucaucaguuaaugaacauuuggguuguuucugcuuuuggcuaucacaaguaaugcugcuaugaacauuuguguacauccacguuuuuauuuuuuauagcuguaugauauuagauuauauagauacuucauagucuaucuaaccagucuaguaaggaaggguuguucuaauauuugcuccuauagauaaugcccagugaauaaauuuauccacacauuguuugauauuuuggagguauaucuuaaggguaaguuccuagaaauugaauuacuggguuaaauaguaauuguauauauaauauuguaaauauugcuaaauucugcuuccaugggaauuguauccuuuuguaguccuagaaauuuaugagucugucuuacuuuuccacagcccguccuauguugucaaacgauuauauguuuauuaaucuaauaggugaggaauuucaauuuacuuuuuuuuuugagacggagucucgcucugucucccaggcuggagugcaguggcgcaaucuuggcucacugcaaccucugccucccggguucaagcaauucuccugcccgaaccucccgaguagcugggaccacaggugugcaccaccacgccuggcuaauuuuuguauucuuaguagagaugggguuucaccauguuggccaggcugguucaauuccccuuuuuuuuguaaguaauacugucaagcaucuuuuuauaucuuugaaggccauuuaauuaucuuuuucuuuuaacugucuuuucauguguguuuccccauuuucuaucaggggaaauucuauccucgauuuuuaagaguucuuuaucuauuagauuugccuuuguccgugauauaaauuguagauauauuuugucaauuuguuauuugacuuuugugcuuauugaccgugacuauuguuaugccaguaauaauauauuguuacuguucaaacacuguguugauuacuauagcuuuuuuauuuauuuauuuuuuagaaacagggucucacucuaaggcccagccuggaguauaguggcacaaacagcucacuucagccucuuucucccaggcucaaaccauccuccuuccucagccucccgaguagcuggacuauaggcauucaccaccacacccagcuauuuuuuaaauuuuuuguaaagacaaggccucauuauguugcccaggcugucucgaacucuuggccucaagcaauccuccccucuuggcuucccaaagugcuaggauuauaggcgugagccacugcuccuggccaaauaccggaguuuuguaagaaagccugaaaucagaaagugugauuccuucaacuuuguucuuuuucaagauuguuuuggcuauuccuggauuccuugccauuucucugugauuuuuuaggaucagcuuaucuauuucugcaaaaaaugcaacuggaaucuucacagacucuagaucaauuugggaaguuuugucaucuuuuuuuuuuuuuuuuuuuuugagacagagucucacucugucgcccaggcuggagugcaguggcaccaucuuagcucacugcaaccuucgcccccuggguuuaagcaauucucuucugucagccucccuaguaguuuggauuacaggcaugugcuaccaugcccaucuacuuuuuguauuuuuaguagauccaggguuuugccauguuggccaggcuggucucgaacuccggaccucaagugauccauccgccucggccucccaaaccgcugggauuacagacgugagcuacagcaccuggccaaguuuugcugucuuaacaguauuuggucaucaccauaucugugaauaugggaugucuuuccauuuauuuugacuuuuuuuuuuuuuuuuuugacacagagaaucgcucucucacccagacuggagugcaguggccugaucuuggcucacugcaaccuccaccucccagguucaggugauucuccugccucagccucccaaacagauggggcuacaggcccacaccaccaugcccggcuaauuuuuuguaguuuuguagagacaggguuucaucauguuggucaagcugaucuugaacuccugaccucaggugauucacucaccuaggccucccaaauugcuaagauuacagggaugagugaccaugcccgaccuauuuugaucuuuaaccaaaacuuuuaacaguguuuguuguuguuguuuuguuuguuuguuuuaaugagacugagucucacucugucgccuaggcuugagggcagcggcuucaucucggcucacugcaacuucccccucuuggguucaagugauucucgugccucagccuccugauuagcuaggaauaugggugcaugccaacacaccuggcuaauuuuuauauuuuuguagagacaggguuucaccauguuggccaggcuggucucgaacuccugaccucaagugaucugccccccccucagcccccuaaagugcugggauuacaggcacgagucacugccccuggccucaaaacuuuuaacaguguuuuauaguuuuuaguguacaggugcuauucuucuuuuguuaaucuuguucccaagaauuuuuuuuuaauuuacugcuauuguaauuguuguaauuggaauuggauuuuuuauuuuuauuuuuuuauuuuuauucuauuauuauuauuuuuuuuuagauggagucucacucugucaccaggcuggcgugcaguggugcggucucagcuuacugcaaccucuguuucccagguucaagcgauucuccugccucagccucccgaguagcugggaccacaggcacgcaccaccacacucagcugauuuuuguguuuuuaguagagaaagaguuucaccguguuggccaggacggucucgaucucuugaccucgugauccgccugccucagccucccaaagugcugggaugacaggcaugccaccacgcccagcccuccaauuggauauuuuaaauuaaauuuuuggauuguuuauugcuauguauagaaauacaauugauuuuuuuuucccaccaguuuacccugacagauguguuucauguauugaguuugucuccuguaaccuagguguuaguccuaagagucuuuuaguggauuccgucaugugugucuugacuuugcuuaagaucauucacaucgucaccacaucuagcuaauuuuuuuauuuuuuguagagacaaugaggucuugccauguugccugagcuggucuugagcuccuggccucaagugauccuccugccuuguccuuccaaaguguugggauuacagggguuagccacuauaucuggccuuuauuuuuaaauugcuucuggauuuuuuucuuuuuuaaagacagagucuaccucucauccagacuagaguacaguggcauaauaccagcucacuacagucuccaccuccuagacucaagcguucaucuuaccucagccuccuccaguagcugggacuacagguacaugccaccacacuggacuaauuuuuuuauuuuuucagagacagggucucucuauguugcccaggcuggucuugaacucuugagucaagucccucuuuggccucccaaagugcuaggauuguaggugugagccaccgugcccagguugcuuccuuuuuuuuuuuuuuuuugagacggaguuucguucuuguugcccaggcuggagugcaauggugcguucuuggcucacugcaaccucugccuuccagguucaagcgauucuccugccucagccucccgaguagcugggauuacaggcauggcaucaccauaccuggcuauuuuuuuuuuuuuuuaaugguaggaacggccuuuauuggcugcagcaggaagugaaagaggggauacagcuucugcagaauagaucgccgcccuccaaaaaaagcuucuguauuucaagucauuagaaaagcucucccacacacaaauuuuaagcaaguaagaaauuuacuuuuguuuucuucugguaauugcuuggauucaauuuuugcaucuaguucccuaauauauuuggaauuuuuucagguauauuagucugggcuaauacugaagaaguaaaaagaaaguuaauacuucuugcauaccuauuaugugccaguuacugugcuaaugaguuuauauauguuaucuuauaaauuuauucaagaaccuugugagagaacagguauuauuaauauuauugaagaagcuaaggcuuagagaauuagagaaacuuaaguaauuugucuagaguuuuacaguuagucaauagcauaguuaacauuugaguucuggcaauaauuggcugcagaguuguuuguacuuuucccuacuuuacuuagcuucuacaguacugacauaucuuuuguggguuuuuuugguuuuuuuugaaacaggaguuucacuccauugccuaggcuggucugaaacuccugggauccuuccacaaugauccuucagcugcaaccuccaaaaggcugggauuagaggcauuugcaccaccaccagcucuuuuuuuuuuuugagauggaguuucgcucuugucacccagacuggagugcaauggcacgaucuuggcucacuguaaccucugccucccagguucaagcgauucuccugucucagccucccaaguagcugggauuacaggcgugcgcuaccacaccuggcuaauuuguguauuuuuuuuuuuuuaguagagacggguuucaccauguuggccaggcuggucuugaacuccugaccuuaggugauccacccaccucagcuucccaaagugcugggauuacaggcaaccauacccggccuucaaugucuuuuuaugcugaaaaaaaaaaaaaaaaaaaguauaacuuggcugggugugguggcucauacuuguaaucccaguacuucgggaggccaagguaggaggauugcuugaggccaggaguuugagaccagccuagacaucauggugaggaccccaucucuacaaaaaguuuuuaaauaauuauccaggcauaguggcacacagaccuguaguccuaguuacucaguagacugggauggugggauugcuugagccuuaggaguucaaggcugcauugaauuaugauugcaccacuguacaaccuggguggcagaacaaggcccugucuuuaaaaacaaaacaaagcaguaaaacauggauaacuugucuggaccauuugauuaauuccuuuuuuuuauuuaaaagauuagcucuagaauaacauguccauuuuuuacauucuguacuuuuuagcauaaaguuuauauaguaaucugaaauauaauuuuaccuuuuuaucuaaaagugccguauuccuugaggauuuuaaguugugcaguaaaauggucuggauuggagcaagguuagggaaaggugacauuaugaaaaaaugaugccucccccuucuucaaauucauauccccagggcaaaaguugccauauuguuuaugaaagaacauuaagggagucuguuuuccuguugucuguagaugauguucagaaguauuuuaacccugauaugauguuuguuuguuuguuuguuuguuuguuugagacggagucuggcaguggcacaaucaccaugcccagcuaguaugauuuuuuuuuuuuagacagucuugcucugucacccaggcuggugugcaguggugcaaccuuggcucacugcaaccuccaccuccuggguucaagcaguuuuccugcuucagccucucaaguagcugagauaacaggcgccugccaccacgcccagcuaauuuuuuguaucuuuaguagaggcgggguuucaccauguuggccaggcuggucucaaacuccugaccucaggugauccaccugccuuggccucccaaagugcugggauuacaggcaugagccacuguucccggaagccaguaugcucuuuuuuuuucuuagagucucacucugucacccaggcuggugugcaauagcacgaucuuggcuuucuguaaccuccaccuccgggguucaggcaauucuccuaccucagccucccaaguaggugagauuacaggugcccaccaccacucccggcuaauuuuuuguauuuuuaguagagacaagauaucaccauguucgccagguuggucuccaccucuugaccugaccucuggugauccacccaccuuggccuuccagugugcugggauuacaggcgugagccaccgugcccuaccaaucuuuuuuuuuuuuuuuuuugagauggagucuugcugugucacccaggcuggaguccaguggcaugacuuuggcucgcugcaaucuccgccucccagguucaggcaauucuccugccucagccucuugaguagcugggauuacaggugcccacgaccaugccuggcuaauuuuuuguauuuuuaguagagaagggauuucaccauguuggccaggcugguuuugaacuccugaccucaagugauccgccugccuuggccucccaaagugcuaggauuacaggugugagccaccaugcccggccaccggcgaucuuuuuuaacacuuuuuuuuuuugagacagagagucucacucugucacccuggcuggcgugcaguggcacgaucucagcucacugcaaccuccaccucccugguucaaaugauucucgugccucagccucaugagcagcuaggauuagaggcguacaccacuacgcccuacuaauuuuuguauuuuuaguaaagaugggguuucaccuucuuggccaaggcuggucucaaacuccuugccucaagugaucugccugacucagccucccaaagugcugggauuacaggcgugagccaccacaucacuggcaugaucuuaauuuaucuuuugucugggucuggaccgucucucccuguaaauaggugauuaugcugaaguauguaaauuuauguuuaucuaaauuuaguaaaauuagcaaaauaaaucuguuccagaaaguagacuguacuuugguggauagauuguuuugagagaaauguuaacaucuuuaggaagguaauuuaugaaaacaguauuuucagaaaaguuuaacugccaguggaauauagaauagaauugucauuugugguuauagaauuuaucagauccuagcuucgucaguuacuaguuauaugaauuugggcaaguuauugauuugggcaacccuugauccucaguguccucagcuuuaaaauggcaaugauaaauaguaccuguuacucaguuaucaaugucagaaugcuuuccauacaugaaguaggcauucaaaauauuauuuaaugucuuacuccacaaucacuauauugugaccuuggacaaauuacuccucuaagacucuuccucuuuagaaguaauauguccucuuuuuuuuuuuuuugagacagucucgcucuaucacccaggcuggauugcagugaugcgaucucggcucacuacaaccucugccuccuagauucaagcgauucuccuucucagccucccagguagcugggacuacaugccuggcuaauuuuuuauaauuuuaguagagacgggguuucaccguguuagccaggauggucucaaucuccugaccucgugauuugcccgccucagccucccaaacuguugggauuacaggcgugagccaccacgcccagcauauguccucauuggggucguuauucccuacccagauuccuuugaaaucuuguuacuuccugcagaacuguugcauaauauuuaagucccacccuuaucuuguguaaccuauuuuucuaguuauuuguccagucauaguccucaaauacuuguuccuuuagccacaucugaucauuuuccuuacuuccuccauccuacacuuuucuccugggguuuauccuagaugucugcucuguguaguaugaacuaccuucccuacuucaccuuuccuugucaaaaucccauuuaucuuuucaaauaaguuuucuuaauucuuuccuaauuacaauuacuuuucuuucuccuuuuguagaacuuaguaucuccuccuaguaaguaguguuaugaguuuuaucacauucuguuuuuuuugggggguggggguuggggugggacagccucacuuuaucacccagacuggagugcgguggugccaucucagcucacugcaaccucugucuccuguguucaagcaguucucaugccucagccucccaaguagcugaaauuacaggugccaccacgccuagcuaauuuuuguauuuuuaguagagauaagguuuagccauguuagccagucuggucuugaacucccgaccucagguaaucugcccgccccuacuucccaaagugcuuggauuacaugcuuggauuacauaugugagccacugcucccggccucaaaguuuuaucacauucugauagauaaucuagauaucuacauacauacuuguugucccaccaaauuguaaacuucuuauggccagggccacccuuuguucaacuuggaugccuuguagaacccagcagcauuuucuacauauaauuacuaaaauaucuaugacuuaaaaucuccuuaaagagauuuaaaugcaucugcccucucaugugguaacaaauaugaggaaauuauuuugguucaucaauuucauaucuacccaagauagacauuucaaaauggauuaagugccaaauuuuauccugaaaaguuuguaggcugggcacaauggcucacaccgguaauccuagcacuuugggaggccagggcaggcaagucgcuugagcccaggaguugaagaccagccugggcaacauggugaaacaccgugucuacaaaaauaaauaaauaaauaaaaugucccaucccuucgugguagcaugcaccuguaguuccagcuacucggagggcaaggaggcugaggcgagagguucacuugagucugggagguugaggcugcagcugcagugagcugagaucucgccacugcacucuacccugggagacagaaugagacccugucucaaaaaagcaaaaaaauaaaaauuccuaucaccuagugaugucauagcuuuccuagcauuuuggcuuuuuuguacauuuuuuuguacaauguacaguaauuuccuaggcuuucacauucauucaccacacacucacugacucacccagagcaacuuccaguccugcaagguccauucaugguaaguacucuauacuauaaaguguaccacuuuuuaucuuuuacaaccguauuuuuacucuaucuuucuuauguuuagaaauguuuagauacacaaauacuuaccauuguguuacaacugccugcaauauucaguacaguuacaugcuaaacagguuuguagccuaggaccuauaagcuauaccaucuagguuuguguaaguauauucuaugauguucacacagcauuugucagaauguaucacuaucaaaugacaaaugacuuuauauuucuauccaaaacaguuucugugagcaacauuuauuacaucuauuaaguuauguuuguguucuccuuugcuguuuauaaagugcuuuuacauauaucugcguuugagugagcugugcuguguuuaaguacaucuauguuauaguccuagauguauauuaauagacucagaucauaacagucuuuauaaauauauuguuuuuacuggaacauuguuuuaaauccaagacaguuuuucuuucccugucaguaugauuuugauccuauuuuuccucugguuauuugguacuaaauaauuuuauacuuguuuaaauauuaaucauaauaaauuaugagaguaaauaaauuaaaaaucauuuaauauuuuccuaaagcacaugauguuuauuaccuguuuuaugaauuauuaagauaaccuggccaggugccguggcucacgccuguaaucccaagacuuugggagcugaggcaaguggaucaccugaggucaggaguucaagaccagccuggccaaugugauaaaacccugucucuacuaaaaauacaaaaaauagccaggcauaguguaaucccaguaguuggcaucuguaaucccagcuacucgggaggcugaggcacaagaauuacuugaaccugggaggcagaguugcagugaaccaagaucaugccacugcacuccagccugggcaacagagugagacucugucucaagaaaaaaauaaauaaaugaagguugucuucauaaugauggcaaucuuucuuucuuuuuuuuuuuuuuucugagacagaguuucgcucuuguugucuaggcuguaguacaauggcacaaucucggcucacugcaaccuccgucucccggagucaagcgauucuccagcugcagccucuugaguagcugggauuaccagcgcgcuccaccacacccagauaauuuuuguauuuuuaguagagacaggguuuuaucacauuggccaggcuggucuugaacuccugaccucaggugauccacccgccuuggccucccacagugcuaggauugcaggcaugagccacccuguccggucagcaaucuuucuuacacugauucaggauauaauccaugaucaugcauugccuuuuguuaccaugcuuuuuuuuuuuuuuuuucuuuuuuugacagagucuggcucugucacucaggcuggagugcagugugcuaucugggcuuacugcagccucugccccaccccgggcucaagugauccuuucacuuuagccucucgaguagcuggggccaaaggcaugcacuaccacacccagcuuuuuuuuuuuuuuuuugagauggugucuagcugugucucccaggcuggaguacaguggcacgaucucggcucacugcaaccucugccuccuggguucaagcaauucuccugccucagccucccaaguagcugggauuacaggcaccuaccacuaugcucagcuaauuuuuguauuuuuaguagagaugggguuucacuguguuggccaggccugucucgaacuccugacuucauaacccacccgccucggccuuccaaagugcugggauuacaagcgugagccacugcgcccggccaaaagucaguauguuauaauuucguuaaaggaaauaaauauaucagcuuugucuuauucacuggaacuuuaggccaggcacaguugcucacgccuguaaucccagcacuuuggcugaggcggaugcaucaccugaggucaggaguucaagaccagccugaccaacauggugaaaccccaucucuacuaaaaauacaaaaauuagccaggcguggugccgcaugccuguaaucccagcuacuugggaagcuaaggcaggagaaccgcuuaaaccugggagguggagguugcagugagccaagaucacaccauugcacuccggccugggugacaagagcgaaacuccaucugaaaaaaacaaaaaaaagaauuaauuggaacuuuaagcuaaaauauagucauaauaucuuaaaugagacucuucuaaggcccuuuuuucucauuuuccuuuuuuguuuuccuucuuuuuuucccccuuuuauauauuuaugaaaucucuugagaucgcauuuuaaacuuuaggaaacaaaccaauaaugugaguagaagacacaagcccagagagacaugguggaauaaaagcaagagaauaauauagaauaauauagugaguagauguugagcaagaaacugagguuuugaagcuuaaaucuccuucccaacuacuaaaaucaaggcaagucacucagucuuauagagcaucuuuccucuuaccuacuucacaguauugauauaaaguaaccaaauauaaggcagucauuauaauccgaucuaaaauuuguguuccuucuccaaaacuguuggagaaaauaaaagagcaucuuucuuuucuuucuuuuuuuuuaaaaguagagacagggucucacuuguuacccaggccagucucaaauuccugggcucaggcaguccuuccaccucagcuuccaaaaguauugggauuacaggcgugaacccccacgcccagccaggagccucuuucuuaaggacaguuucagaaguaaagauuuuuuuuuuuaauuuaucaauguacuugguacccucuccucauaggaugaucuguuaucuguauuugaccacaggaggaaauuucuuugccucuugacuguuucccauucuuuuuuuaucacagcccaaagagucgauugauccaauuaaagaaagagaagcuggaguauacuccaggagagcaugaauauggauuauuuccagcgcccauucauguugguaaguaccgaguccacacaauguauugcugagaagaaacaguauuuccuggguuugagggaaaugucuuuuuaaucuuguuauuauuucuauuucuccagugggaucaagcucuuucuuuaccauuuuacuuaaacuuacucugaagaauuuuauacacuguuugauagucagggggucacaguggcauaaaucuuguucauuggagccuuaauaaauaacacugggccaggcaugguggcucaugccuauaauccuagcacuuugggaggcugaagcagguggauugcuugagcccaggaguugauggccugggcaacuuggugacacccugucucuacaaaaaauaugaaaauuagcuggacgugguggcacaggucuguagucccagccacucuggaggcugaggugagaggaucacccaagccuaggauuuugaggcuaugguguagucaugauccuuccacugcacucuagccugaguugacagagagaaauccugucucuaaaaaaaauuaaauaaauaacacuaugucuguaccuuuuguuuccauagguaugucaccuaggaaaaaccaaguaguagccauucagugucaaauauuuuccacguucaaaaauagaugauuuauacacacauaugaucagaguaagaagccccacugcuuuuacugaguauuuaucugcuugaaaguggagugauauuuauucuacuguucauucuuggcaaaaaugucaagacuuuguuuagcauuuggauaguaguaccuuccaggacccuauuauugagcuuaucagauaaguaaaaaguaccaagaagucauucuaaguuccucccauuuuuuucugucccuuauccaguucaucucaaguucuguuguguuucuaucccugaaauauauccuacuccucuccaaaucucauugcuaucucucaagucugugacaguaguaucuuuucuucaggcugcugcaauagccaucuaacagaucuauuuccaguuguguuuccauguggcccagccuccauucaguaaaaacagaaauuauuuuuuaacuuaacccagaucauacuuaaaagcuuugcauggcuuaccaucagauuaaaaugcaaacuucuugacuugaaugaucugguuccugauuaccccaucucucuccuuuuauucauucccaucucaaccuuauucacuauauugugucauacuggccuucuuucaguuuuuagaacauagcaagcuuuuucccacuggagggucauuauacuuguuauucccauugccugaaaagcucuuuuucagucuucccaugguugguuucugcucaucuuuuaaggaugaucuuaauguuaguaucagcuucaauacgauuuauuuucuuuaaaauaauuuuccugauagucucaucaaaagaggcuucgucucucuuuguucuagauaacaucacucucuauaucuauaauuacaauauuuauuuggcuccuccauuagauuauaaucuccggcaguacaggaucauugucuuucuuacucucccuggauuucccagcaccugguacauaauagaaguuuaucaaauauuugccguacaaaugaaagaaaaggagaaggcugggugcgguggcucacaccuguaaccccagcaguuugggagaccuaggcagguggaucacgaggucacgagauugagacuauccugacuaacagugaaacccugucucuacuaaaaauauaaaaaauuagcugggcaugguggcaggcaccuguagucccagcuacuugggaggcugaggcaggagaauggcgugaacccaggaggcggagugugcagugagccgagauugcaccacugcacuccagccuggacgacagagugagacucagucucaaaaaaaaaaaaaagaaaagaaauaaggauaaaauauugaauguaaaugucagguuuucuucauauauucaguuuguuuaaacaaaauugcuuuaaagggguucauuaaacacauaguaugaaaccaggaacaccuuaauuguauacuugauguugauccuaugucuuguaguguuuucuucaacuaugauucucuuaacucucuugacuguggagcucuuguuuauauucugauuaacuaaucuccuuuucucccugagagaguucaguaccagcagaguuuuuuaaucagcagacauaaacaaguucuucaguaaagauuaguuugcuugaauuauucuguauuggguggcuggagacagauuuaacuacaacaugaaguuacaagguuuaauucucagcuacauaaacuuuacgugugcuuacuuaaugaagguaagaguaaguuccuuauucucuaggauuagugccaaagcucuuuugaaagagucuuuuguauuuacuagugagaucauagcagcggaagcaggcucucagcaaauuuaaaaucugcuaaugauaaauaggcuuugaaaauaagaacaaggcuggacgcgguggcucacacuuguaaucccagcacuuugggaggcugaggugggcggaucccuugaauccaggaguucaagaucaccccauugcacuccggcaugggugacaagagugagacuccaucucaaaaaaaaaaaaagacgaggaauucuacuuuugguauugaaagaguagauuacaucaggcuaacccucccgggaauaacaauuauccaccuguaaucccagcacuuugggaggccgaggcagguggaucaccugaggucaggaguucaagaccagccuggccaacauggugaaaccccaucugcacuaaaaauacaaaaauuagcuggacauaauggugugugccuguagucccagcuccucaagaggcugaggcacgagaaucacuugaaccugggaggcagagguugcagagagccgagaucaugcuacuauacuccagccugggcaacagagcaagacucucaaaaaaauaaauaaauaaauaagaaaaaaaugcaucaacuggacaaauuuaaaacauaguaauccuaagucacuggagagcaaccaaaagcaggcacaaacugaagaaaaaucaauaauuagaagaggagaagcacacugguugcauuucccgcuuguauagcucuuuuuaucuguggccaggucccaguuagcaguacaaguaagcacuuagaaaccuugaaucuuacugauuauuuaagggccauguuucaggacagcuacagcagcaggaaagugagggauaaaaugcuaauaggggaaacugcaaauuuugcauauaaacucaagccacuuaucuagguaacugacccccuaaacuauguauaugcagccagaauccaguauaguuaguugagacuaaagauacuaaguagggauuucagcugcugccuaccccacggaagagaguguuacagauuuugguuaacccacaguaacugguugcucuaaugcaaagaaaaacuuauuuucuuuuauuucuuucuuauuuuuuuauuuuuauuucuauuuuuuugagauggaaucucauuguguuguugaggcucaagugcaguagugcaaucuuggcucacugcagccucuaccuccuaggcucaagugauucucccacuucagccucccaaguagcugggaccacaggcaugcacuaccacacuuggcuaauuuuuuguacuuuugauaaagauaggguuucaccauguugcucaggcuagucucaaacucuugaguucaagcaguuugcccaccucagccucccaaagugcugggauuacaggcaugagccacugugcccggccgaaaccaguuauuuucauaggauaauaacacaauugagaaucucuguaacguauuacuuauaauguccauaauucaauccaaaauuacuggacguuaauaaacaugaaaauauaauucauauuaagagagaaggcagucaacacugacaauuuccaaggucauccagaugcugaaaauagcagacaaggauuuuaaagucauuguuauaacuguguucaaggauguaaaggaaaauaugcuuauaaugaacaagcagauaaaucuuaaaaauggaaacauaaaaauuuuaaaaugaacaauagcaaaugaaagucccagaacuaaaacauauaugucugauuuuaaaacacaaaauguagguuuaauaacagauugaagauggcagaagugucaguugaacuugaaaguauaugaauauaaauugucagccaggugugaugguucacaccuguaaugccagcacuuugggaggcugaggcagguggaucaccugaggucaggaguucgagaccagccuggccaacauggcaaaaccccaucucugccaaaaauacaaaaauuagccaggugugguggcaugcacuuguauucccagcuacucaggaggcugaggcaggacaaucgcuugaacccaggaggcagagguuacagugagcagagauugcgccacuguacuccagccugggcaacagagcaagacuccgucucaaaaaaaaaaaacacaggcaggugugguggcucacgccuauaaucccagcacuuugggaagccaaggcgggcagaucaugaggucaggagaucgaaaccauccuggcuaacacggugaaaccacgucucuacuaaaaauacaaaaaaauaauuagccaggcgugguggcgggcgcacguagucccagcuacucaggaggcugaggcaggagaauggugugaacccgggagguggagcuugcagugagccgagaucacgccacugcacuccagccugggugacagagcgagacuccgucucaaaaaaaagaaagaaaaaaggggggggggggagaaugauauuaacuacagauaucuuuaauaagauaaggaaauuccuuuuuaguucugagagcuuucugcagaagucuuuagaauuaauuuuguucuauaguuguuuuuucuuuuaaagucuuugucaaguuuuguauuaggcauacacuagcuucauuaaaugaguuggaaaauuauuuuccuccucuguuuucuggaagacugguauuacuucuuucucaaacauauaccagacuucacuagggaagccauuuagaacugaaauuuuuuaugugaauaauaugguaagguacucaauuuauuuaaaagaucuagacuauucagauguucaucuugacucaguuuugauacguuguauuucuaaaggaauuuguccauuuuaucuaaauuauuaaagauacuggcauaacauuauuuauaacauucccuuauuagucucuuaaugagucuaggaccuauagugagaucaacuuuuuuuauuuuggauacugguaagccaccacaccuggccuaauaucauucuuaauggugaaauguugaauguuuccuccuaagauugggaagaagauagaguuguccacucugacucagcauuacauggauguucuaggcaguguauuaagucaagaagaugaguaagagucaucauaaugaucaggaaggaagaaaugaaacuguuucuguuuauagaugacaugauuguuuauauaaaaaaaaaauccaaagagauccacaccaaaaaaaaaaaaaaaaagcuacugguaguaguagcagcaagguuacuggaaaaucaucaguauuaaaaaaucaauuguauucuuauaaaacuuaauauacucugaacauuugauguggcagucaugcuccuugguauuuucucaaauaauuugaaaacauaucuauugaaaagaaaaaccugcauauagauguguguuuuguuuuuguuuuuguuuucuuuugagauggagucucgcucuguugcccaggcuggagugcaguggcgugaucuuggcucucugcauucuccuccuccuggguucaagcaauucuugcaccucagccuccugaguaucugggacugcaggcaugcgccaccaugcccagcuaauuuuuguauuuuuaguagagacgggguuucaccauguugcccaggcuggucucagacuccuaaccuuaagugauccacccaccucguccuuccaaagugcugggauuacaggcaugagccaccgcgccuagccucuuuuuuaaagucuuaaauaaacauauauucagauaauauaaauauauaucuccaaguaaaggguuuauuugggaauaauauacaauaauuaggcuuggcgugguggcucacaccuguaaucccaacacuuugggaggccgaggcaggcagaucaccugaggucagaaguucgagaccagccuggccaacauggucucuacuaaaaauagaaaaaaauuagccaggagugauaguggaugccuguaaucccaguuacucaggaggcugagacaggaggaucacuugaacucaggagguggagguugcaaugagccaggaucacaccauugcacuccagccugcgugacagagcaagacucugucucaaaaaaaaagaauuaguccaggcaugguggcucaugccuguaaucccagcacuuugggaggccgaggagagaagaucgcuugaggccaggaguuugagaccaacuuaggcaauguagugagaaccucucucuauaaagcaauaacaacauuugcugggugcggugguacaugccuacucaggaggcugaggcaggaggaucacuugagcccaggagaucgaggcugcagugaguuaugauugcaccagcgcacuccagccugggugauggaucaagucccuguuuucuaugaaaaaaaaaaaaaaaaagaaucgcaauucaggacacauagaccaggguagucccuaagugugucugaaaaacaaagagaaaggcugggguuguauugagcaaaagaggaagguuggaagaaggucagccaggcccaguggcucaagccuauaaucccagcacuuugggaggcugaggcugaggcuguuggauugcuugagcucaggaauucgagaccagccuggacaacauaaugaaaacccauguauacaaaaauuuaaaaagaaaagaaaaauuuagccagguauggugacaugcaccugugguccagcuacuuaggagccugaggcaggaggaucaccugagccugggagcuugaggcugcaaugagcugagauugcaccagugcacuccagccugaaagacagagugagauccugucucaaaaacaaagaaagaaaagaaaaaggucacugguacaguugucauuggugaguggcagcaguuacuauauaagacauagucuuaauuauaguuagagugaauuuucuguugaaaugcaaaaucaguuccuggaucagggaccuuagugcccucccccauggccuccugacuccauuuuaguuggauaugguaugaaugauuccguuuugucuaaucaacuuucacaccucucucaaacuuacaccagcaaacacccacuggggaguguuugcuuaagcaaaaguuccuuaagcugauaaacaacuuuagcaaagucucaggauacaaaaucaauguacaaaaaucacuagcauuccuauacaccaauaacaguuaagccaagagccaaaucaugauugaacucucauucacaauugccacaaaaagaauaaaauaccuaggaauacagcuaacuagggaagcgaaggaucucuauaaggagaacuacaaaccacugcucaaagaaaucagcgaagacacaaauggaaaaauauuccaugcuuauggauuggaagaauaaauaccguuaaaauggccauauugcccaaagcaauuuauagauucaaugcuauucccauuaaacuaccauugaaauucuucauagagcuagaaaaaaacuauuuuaacauucauauggaaccaaaaaagaaccuaaauagccaaggcaauccuacacacaaaaaaagaacaaagcugaaggcaucaugcuaccugacuucaaacuauacuacagggcuacaguaaucaaaacagcaugguacugauacaagagcagacacauagaccagugaaacagaauagagaacccagaaauaagacugcacaccuacaacugcgugaucuuuaacaaaccugacaaaaacaagcaauuggguaaggauucccuauucaguaaauggugcugggauaacugguuagccauaugcagaagguugaaacuggaccccuuccuuacagcauauacaaaaacaaaauauggauuaaaaacuucaauguaggccaggcgugguggcucacgccuguaaucccagcacuuugggaggcugaggcacguggaucacuugaggccagcaguucgagaccagccugaucaacauggcaaaaucccaucucuaacaaaaaugcaaaaauuagcugggugugguggcacaugccuauaaucccagcuacuugagaggcugaggcaugagaaucacuugaacccuggagguggagguugcauugagcugagaucgcugcacuccagccugggcaacacagcaaaacucugucucaaaaaaaaaaaaagacuuaauuguaaaacccaaaacuauaaaaacccugaaagacaaucuaggcaguaccauucaggacauaggcacaggcaaagacuucaugacgaugccaaaagcaauuguaacaaaagcaaaaauggacaaauaguaugaacuucugcgcagcaaaauaaacuaugaacagaguaaacaaccuauaaaaugggagaaaaauuuugcaaacugcuucugacaaagaucuaauauccagcaucuauaaggaacuuaaauauacaagaaaaaaaaccauugagaagugggcaaggccuggugugguggcucacgccugucaucccagcacuuugggaaaccaaggcaggcagaucacuugagaucaggaguuugagaccagccuggccaacauggugaaaccccgucucuacuaaaaaaaaaaaauagaaaaaauuagcugggcaugguggcacgugccuguaaucccagcuauucaggaggcugagacagaauugcuugaacuccggguggcagagguugcaaugagcugagaacaugccacuccacuccagccuaggcaaaaaaguaagacuccgucucaaaacaacaauaauaauaaaauuuuuuuaaagacucuuggccaggcgcaguggcucacaucuguaaacccagcacuuugggagaccaaggcaggcagaucaccugaggucaggaguuugagaccauuggccaacauggugaaacccugucucuacuuaaaauacaaaaaaauuaguugggcacgguggugggcuccuguaaucccagcuacuugggaggcugaggcgggagaaucgcuugaacucaggaggcacagguugcagugagcugagauuacaccacugcacuccagccugggugacaagagugagacuccaucuccaaaaaaaaaaaaaaugggcaagggacaugaacagacacuucucaaaagacauauacguggccaacaaucauaugucucucccuccacugccauggugucagaggaggucuagccgagucagacuuuuaccaacaccuagcaguaacauaacuaccccaccacaaugucaguggagaccccuugggaaauuggaauucuaaccauucccuagcaguaauggggagcuuccccaucccccaacacucagguuucaguggaggccuaguaggcaacuuggucuuuuacuuacagcuggcaguaaugaggcagcuuuaucccuuuucugcuggagcaguuucagaaaaagccagcuaaaauacaaauuucauaaaaucuagaaccuuauacuacuacaaaaguguuuaacuuugaauuuaaaaucauauguuauuugccaagcaugguggcucaugccuugaaaucccagcacuuugggaagacaauuuauguccacaccaagacauuagaauuaucuggcagauuuuuaaagcagucuugauaaaaaugccuuagugagcaauugugaacaugcuugaaacaaaucaagaaauagaagaagauaauuuuucauauuuuauuuuauuuauuauuuuaauuuuuugagacagguucuugcucuguugcccagucuggagugcaguggcacaaucucugcccaccguagccucuaccucccagguucaagugauuucuccugccucagccucccgaguagcuggaguuacaggcaugugccaccauaccuggcuaauuuuuguauuuuuaguaaagacgggguuuuaccacguuggccagacuggucuggaacuccugaccucaagugaucugcccgccucaccucccaaagugcuggguuuacaggcgugagccacugcaccuggccaauaauuuuuuuaaauuagaauuuuuauaacugacucaguaauugaaauaaaaaguucagagcuuuuaugagagaaauugaaccagaaaaaaaaauacauucagagauagacuuaacagcagaaugaaugggacagaggaaauaaucuaugcacuagaagauagaauaauacauauuacucagcguauacaacaacauagaaaauagaauuaaaaacagaaagacugaggagcuugugagaauaugacaaaaaaagcaaauuuguguuaucggagucauggaaggagggaaaaaaaagggcauagaugaaaagcaccuuaguaaauaacaacuggaaacuuaccaaauuuggcaggagacagaaaucucuguauucaagaagauuagcagacuccgaacaggauaaacucaaacaaauauaugccgagacacauaaucacauuucaguacacuaacaaaacaauuuuaggcugggcgagauagguugcuccuguaauaccaaauaccuugggaggcugauugcuugagcucagaaguuugagaccacccugagcaacauggugaaacccugucucuacaaaaaauacaaaaaaaauuagccaggcaugguuggcaaaugcuugucaucccaacuacucaggagaacgaaucucagaaaaaauaaaaaaaacaaaaaaaaaccacaccaauuuuaaagcaaugacagagaaauuacccuuaccuauaaggauaaaacaauucaaaugacaguagauuucucaucugaaucuauggaggccaaauggaagugauacagcauuuuucacauccuaaaagcaaagaauugucaacuccgaaucuucuaaccaaugaaaauaucugucaggaauuaagaagaaaugaaggcauucuuagauuaaggaaaacuaagagaguuuguugccagcagauguacccuaugaguaaagcaaguucugugaacagaaaggaaacaauuuuaaaaaaaagacacuuuggaacauuaggaaggaagaauacaguaagcaaaaacauggauauauacaauaggcuuuccuucucuugaguuuuuucuaaguuacguuuaaucauugaagcaaaaaguuuuaacacugcuguauuguuuuagcaacuuuauuaagauacaauucacagaccauccaauuuacucuuuuaaaauagacuauaguuuuugauauauuacauuuuuuuuaacuuccaguaaaauauacauaacacaauuugcauuuugaucauuuuuaaguggacaauucagugucauuagguacauucgcauuguuguaugaccaugacugcuauccauccccggaacuuuuucauuauccccuacuguaacucuguacccauuaaacuguaacucuccauucucuguuccccucagccucugguaaucacugucuauuucuuugaaagugggguuguauaauaccuguucuuuuguaucugccuuaauucacuuagcauaaugucuuuaagguucauccauguuguaguaccaucauguguugcuuaacgaugaggauacauucugagaaaugcauuguuaggcaaucuuauaauuaugcaaacagaauauacuaaccaggcuguaugguauagccucuugcuccuaagcuacaaaccuguauaucauguuaguauacugaauacaguagucaguugugacacagugguaaguauuuacauaucuaaauguagaaaagguacaguaaaaauacaauauaaaggauaaaaaauggcagcccacuaugggacacuuaccugaauggagcuuacaggauuguaaguuccucucugugggucagugauugaguggagagugaaugugaaggccuaggacaucacuguuaaacuacuguagauuuuauaaacacugcacacuuaggcuacacuaaauuuuuauuuuuuguuccucaauaguuaaguuaaucuuagcuuucuguagcuuuuuuacuuuauaaacuuaauuuuuuaacacuuugacucauaauaacuuagcuuuaaacaugaacacauuguacagcuguacaagaaaauauuuucuuuauguccuuauuuuauaagcuuuauuuuuaacauuuuuucuucuuuuuaaacuuuuuuaguuaaaagcgaaaagagggccaggcauggcggcuuacgccuguaaucccaacacuuugggaggccagggcaggcagaucgcuugagcccaggaguuugagaccagccugggcaacauggcaagacccugucuacaaaaaauaaaaaaucagccaggcaugguggcacaugccuguagugccagcaacuuggcagguagaagugagaggaucgcuuuagucugggagguugaggcagcagugagccaugauccugcuauuguacuccaggcugggugacagagcgagacacugucuugaaaaaaaaaaaagagcuaagacacaaacccacauuagccuaggcccacucaggggcaagaucaucaauaucacuguuuucucgcuguaugucuuguucuacugaaaggucuucaggggcaguaacacucauggagcugucaucugauaugguaauaaugucuucuggaauaucuccugaaggaucugccuaagacuguuuuuugguuugguuuggguuuuuguuuguucguuuguuuguuuguuugagacagagucuugcucugucgcccaggcuggagugcaguggcacaaucucagcucacugcaagcuccaucuccuggguucacaccauucuccugccucagccucccgaguagcugggacuacagaugcccgccaccacgcccagcuaauuuuuuguauuuuuaguagagacaggguuucaccauguuagccaggauggucuugaucuccugaccucaugaucugcccaccucggccucccaaacugcugggauuacaggcgugagccaccacgcccagccugguuugguuuuuugagacagagucugugucguugccugcuggaguguaauggcacgaucugggcucacugcaaccuccaccucccaguucaaacaauucuccugccucagccuccugaguagcugggacuacaggugugcgccaccacacccagcuaauuuuuguauuuuuagcagagacaggcuuucaccauguuggccaggcuguucucgaacuccugaccucaagugauccacccaccucggccucccaaagugcugggauuacaggugugggccagcacuccuggcaaggcuguuuuuuuguuuuguuuuguuuuccuuuuuuuuugagaccgugucucacucuguugccuaggcuggagugcaguacgugaucuugacacacugcaaccuccaccucuaccucugccucccagguucaagcgauucuccuauuucagccucccaaguagcugggauuacaggcgugugccaccacacccagcuaauuuuuguauuuuuaguagaguugggguuucaccauguuggccaggcuggucuugaacuccugaccucaagugaucugccugccucagccucccaaaguguuguugggauuacaggcaugaaccauugcgcccagccaagguugguuuuuuuguuuguuugauuuuuguuuuuuuuugagacggagucucgcacuauuguccaggcuggagugcaguggugcaaucuuggcucacugcaaccucugccucccagguucaagcaauucuccugccucagccuccugaguagcugggauuacaggcgcccaccaccacacccggcuaauuuuuuguauuuuuaauacaggguuucacuauguuggccagccuugucucuaaugccugaccucgugaucuaccugccucggccucccaaagugcugggauuacaggcaugagccacugcacccagccaaggaugucuuuuaauaagcaggaguauacucuaaaauaaugaugaaaaguauaguauauuaauuauaaaaccagcaacaaagacauuuuaucaaguauuauguauuauaccuaauuaugucugcuaugcuuguauucaacugguagcgcuauagguuuauuugcaccagcaucaccacaaacacaugauuaacacuuugcacugcaaaguuaugacagcuaggaggaauuuuucagcucccuuauuaccuucuggguccaccaucauauaugcaguccauuguugacuaaaacauuggcacaugacuauauguauaagaauuucauucuuuuggccaggugcgguggcucaugccuguaaucccagcacuuugggaggcugaagcagguggaccaccuuaggucaggaguucaagaccagccugaccaacauggagaaacccugucucuacuaaaaaaaaaaaaaaaauacaaauuagcugggugugguagcacaugccuguaaucccagcuacucaagaagcugaggcaggagaaucgcuuaaacccaggaggcggagguuacagugagccgagaucgcaccauugcacucuagccugggcagcaagagcgaaaccucaucucaaaaaaaaaaagaauuucauucuuuuuaaggcugaauaauuuuauauaagacaaaaacaaaaaaaucaaacaaaaauacuauuucaauagguaggaaaaaauguuaaaagaucauaaauuugccuggaaaacuucucgaguuauuuaaacacaagaauuucuccuuuuuguaaucaaccuuagguuauguguaauaaugaagagcaggugccagaugcuguacccuuaauaauuuuuaauaauaauaaaauauuuaauaagcuucauaaugaccuguguguuuuugguuguaguuuugcuguauuuguuguuuuauguagacuauuauacuuaaaauauaucuucggcauauaucguguggaguauagugggaaagaagagcuaaaauuaaaaauuggugauggaaaaauccuuaaagaauuaaaucuuuauuuuuuuagucaguacauguuaguucuuguagcuguuugacaccuuuguauaagcaaauauuagaaaagguauugaaauuaauaguguuuuuuguuucaggaaaguaucuaagacaaaagagaauugacuuccagcuuccuuaugauauccuuuggcaguggaaacacaaucagguacagagagccuguuuuaccagguuucauucuuaagugguaaagggggagggguggaaaugcaaguguuuuucucuccccuuguuauguuuucaucuuaggagguuuucagaagugucccugugaagguuaggacuaagaaaaaugaauuugcauccaucuuuaaugugaccuauuugccuuuacucuuacugcaaaauagcaguaaguuccugcuuuccuaggcaaccuucuguuguuauucuggacuuuuauuuugguagcaaagauuuuguucuguaagaauucuauuugaugcaggucucaggagaauuuagauguacugccagcagcacuaagaaauuucagacuuuauuuuuguuggcuccuucuuaucaguuugaaauuuauuuuucacaugcaaaagagauucuucuaucaaaggaagcagggaaauguuuaacacucuugcacuuuuaaaaaaucuuuaaauauauugguaacuaaaaacaggaagaugccguguuuuuucucuugcuucccaaauugaaaaguuucccguagugauuuuuguauuagcuuauagcccccaggucucauauugagaacaaccauugggaaauagaaauagucaugcaauugaggugaauagauuucuugaguucugccaaaaugccaccaaagguuuauuuuggaaagccaaaauugacauuccccucugcguugucuucuccaauggccucucuugaauucugagaguauuaauauguuagguauuugucucagaguuuuuaacaaugaaggagagaaugcuuugaacauacugacuagaaaauaauggugggauuauuccaauauauuaauaaacagucuagcuuugugcaaguugcuguuuguuuuguacagucccuuauggcaaaaugcuggaagacugccucucuucuaaugcauucuuuuuuuuuuucuuucuaauaucuucuugauuauaaugugagagcuccauuuugccugccugcccucucuccuuuauucacuaaauuaauugccuuaauuaaaauuugaaauguuuuccuauaauucucaaccugaaaagccaggguacucaucuuuuuaauuucauguacccacccagacaucuaaguaaguccuaugcauguuguuuuccuuucuuuugauagaagcaaauagaaucuuaauuuguccaaaugaauagcuuuggucuccagugugauuuucauuuaagucuauccaacaacaugcugaagaaacauguaauuccacuuguauaaacuauuuagugcuucuucuguugaaucuuauucucucaccuuuuauuucagaguaaaaagagaucacaccaagaguuucccucaaauguauccaacccaaaaugucuuguaaauauuuccagaugagcagagcacauagaaaauuuccuguauuuuuagugauugaugcugccgucuggcauuugaaguuaaaugcuauaucaagauuuuucuucuuuucuucuagcuauacaaaaagccagaugucccacuauauaagaaaauucguucaagugaguaacuuaggagcuauuuuuucugccucuauacguuaauguucuucugagccuagcacuugaaaaauuauccuguauguucacaaacuauucuuugcuuucuuuucaagaugucuacguugaugucaaaccccuuucugguuacgaagcuaccaccuguaacuguaagaagccagaugaugacaccaggaagggcuguguugaugacugccucaauagguacugucaugcuuugauuucucuaaagcauaggcuuuaagguauacauacaacacuuccuuuggaggguacaguuaaauaggcucuuugauuuuuuucaagaaguugcacaaagauauauaaaccauaaugggugggcggaauacagaaacagaaaaugaaugagauuuagagucuugugugugccuucguugguuuaaauccuuuuacuuuuuuuuuguuuguuuuuuuuguuuuguuuuguuuuguuuuuuuuuugagacggagucucccucugucgcccaggcuggagugcaguggcgcgaucucggcucacugcaagcuccgccucccggguucacaccauucuccugccucagccucccugguagccagcacugcaggcacccaccaccacacccagcuaauuuuuuuuguauuuuuaguagagaugggauuucaccguauuagccaggaugaucucaaucugaccucgugauccaccagccucggccucccaaagugcugggauuacaggcgugagccaccgcgcccagccaauccuuuuacuauuuaugagaccugagaaaaguuauuuaaugcaucuaauaaaaguaauaccuuaccuucucuauggaggguuuguggagauuauaugagacuguugauaaacaauguuugugaaguuuuggcuuucuuguuuugggguuuuuguuuuguuuuguuuuguuuuuuuuagagauagggucucacuguguugcccaggcuggauucaaacuccugggcucaaguaguccuccuaccucaaccuccugaguagcuggaacuauagguaugugauacugugcccagcucauaaaacauuaagcacaguccuagguaccuuccuagcucucaauauaugguugccacaaugaggaagcagaauaggacaguggcagugagagugaagaggaagggcauaauauauuuuagaagaaaaguauguugauaaaccaucggcauauaggggauaugcucuucauauggggauauauucucucucugaaaauaaaguguggaaucuaacugaauuggagauaagaauuaugaauuuggcuggcaugguggcucaugccuauaauccaagcacuuugggaggcugaggcaggcaggucaccugaggucgggaguucaagaccagccugaccaacauggagaaaccccaucucuacuaaaaauacagaauuagccgggcaugguggcucaugccuauaaucccagcuacgugggaggcugaggcaggaaaauugcuugaaccugggaggcagagguugcagugagccaagguccugccauugcacuccagccugggcaacaagagggaaacuccaucucccccccaaaaaaaaagaauuaugaguuaugacuuugauuugagucuguaauuuuuuuuuuuucuuuuucugagauggagucuagcucuguuacccaggcuggagugcaguggcgcgaucuuggcucacugcaaccucugccucccggguucaagagauucuccugccucagccucccaaguagcugggauuacaggugccccccaccaugccuggcuaauuuuuguauuuuuuuaauuuauuuuuuugagacagagucgcgcucugucgccaggcuggagugcgguggcacgaucucagcucacugcaaccuccacuucccagguucaagugauucuccuaccucagccucccgaguagcugggacuacaggcaugagccaccacaccuggccaagagaguauauaauuuuaaacggcacugaaauuucaaaauagaaaugucuaauagacaaaggaguggauauagaauuuguuguuuuaguaacaaugcacaugugcagcaaaauaaaaaagaaucagugaauuuuacaucaguauuuccuguucuggauaguucucauggccaaaaguagcuucuuugaucucuagucagcuguccauguggucugaagggaaucaauguuuuaguucuuccugcuucagcaugccaguugggaaauucuaccuuaccugcaucacuguaaauucacaccuuaucauuuuauguacauacagguucacauaguguuuugcauacugauuuucuuuacucacaaauauuuuaaaugcacacuuuuauuaaacagugugguccacaagcucaguauuuuuauuuauuuaugacacaggauaucacucuguugcccaggcuggagugcagugucgccaucacagcucacuacaacuucuaccuuccggacucaagcaauccucccauguuagccuccugaguagcugagacuaaagacgcgugucaccacgccuggcuaauuuauuuauuuuauuuauuuuuaaaguagagacgggaucucgauacuuagccgaggccgguccugaacccuuaaaucucacuauaugaaggacaaccuagaucuacguuuaguagcuggcuggggugcgacugucucauuuuucuuuuuuuuuuuugagacgaaguuucauucucguugcccaggcuggagugcaauggcacaaucucagcucacugcagccuccaccucccggguucaagcgauucuccugccucauccuucauccuugcgaguagcugggauuuacaggcaccugccacugcacccggcuaauaauuuuuguauuuuuaguagagacaggguuuugccauguugaccacgcuggucucgaacuccugaccucaggugauccucuugccucagccucccaaagugcugggauuacaggugugagccacugcauccagcccaacucucguuuuucaagggcauuaucuggcuaaagauaaugacaaauuguacuaaaucaaagaccucacauuguaguuuacagcaucuaauuucagauuuugguaaauuuaguuugguuuccagacacaacaaauagaaacauguuuugguuuuauauaauuuaaggacuuauucugguugucaaaacaaauggggaauauauuucaaugccuugaacucuagaaacuacaaauuuucaguaaccucugaaugauuguucccuggaagaaaucuuuuaaaauuuaaaucucucuuaucugagcacucuuuuauuuauacuucaggguuuuuuuaaauccggaugcaguuuauaguauguguuauuagguauuaugaaaauacuuggugccagccaagcacaguggcucacgucuguaaucccaacacuuugggaggcugagguaggcagaucacuugaggucaggaguuugagaccagccugggcaacauggcaaaaccccaccucuacaaaaaauacaaaaguuagcaggcauaguggugcaugccugcagucccagcuacuugggaggcugaggugggaggaucgcuugagccuggagguugaggcuacaguaagcugugaucacgccacuguacuccaggcugggugacagagugagacccugugucaaaaaaagaaaagaagaaaauauagguguggaauauuaugaacuagagguuacauuugaagccaugauuauagaucagcucucuagaaaaaggaauaugguagaggaaaaaaggauuucuaccagaaaagacaggaauugguauuggcaaggugggaaauccaguaucauaaaaaaugaggaaagccaaaaaaggaaggcauuucaagagggguauucaauaauauucauguaccaaagaagucagcaaacggaagaguaaaggugguugaauuugauguuaaggcacugucuucuuuacagcugaagcugauuaucuuaaauugaagaauaauccagucgauacuuucucugcuccuauuuacaugauuugacacugugugccgugugcccuuuagaaucguggugguauuuuuguuuagaguaagucagauuacucugaaaguacuuuaagguauaaacuguuauauauuuucuuuacaaaacuuuucacuuuuuuuuuuccuuuuuuugagacagucucgcucugucacccaggcuggagugcaguggcaccaucucggcucacugcagccucugccucccagguucaagcgauucuccuaccuccgccucccaaguagcugggauuacaguugccaccacgccuggcuaauuuuuguauuuuuaauagagacgagguuucgccguguuggccaggcugaucucgaacuccugaccucacgugauccucccgccucugccccccaaagugcugggauuacaggcaugagccaccgugcccggccuuuaaaauuauuauuauaaauauaacaugauauuuugacgauuauuuucuugaucauuccuuguuuuagucaugcuuaaggccaggcauguuggcuuacgccuguaauccagcauuuuggaaggccagggugggcggaucacuugaguccaggaguuugugaccagccugggcaacauggaaaaaccccaucuuuacuaaaaauacaaaacaucaacugggcaugguggcgugugccuauagucccagcuauucuggaggcugaggugagaaaaucaccugagcccaggaggucgaggcugcagugagccaagaucaugccacugcacuccagccugggcaaccagaaugagacccuguauccaaaaaacaaaccaaaaaauaaugcuuaacagccuagaugagauuucaaaccauacaccaaaacuaaacagcucccauuaaaacagccaggugcauuggcucacaaaaugcuguaaucccuagcauuuugggaggccgaugagggaggaucccaugacccccaggaauuugagaccagccuaagcaacauagcagcaagaccucaccucuacaaauaauuuuuuuuuuaaguagucagaugcgguggugcgcgccuguguucccagcuacccaggaagcugaggugggagaauugcuugagcccagguggucagagcugcagcgagccauuauugugccacuguacuucaaccugggugacagagcgagacccugucuccaaaaaaaaaguaaagaaagcagugacaagaugugugugacuucuuuugucuucuauguucaguuuuuuuuuguuuuuuuuuuguuuuuuuuuuagacagagccucacucuuuugcccaggcuggaguacaguggugcaaucucagcucacggcaacguccgccggacaaguucaagcaauucuccugucucagccucccgaguagcugggacuauaggcacauaccaccacgcccagcuaauuuuuguauuuuuaguagagaugggguuucgccaccuuggucaggcuggucuugaacuccugaccucacaugauccuccugccucugcccccuaaagugcugggauuacaggcaugagccacugcacccaucuagaauuuuuaacuuguuaauucccuaacuacuauggguucagcuagucauauagccuggaaaugucauuucaauuaauguaauauaaaauuccuguaauacaacagcagcaaauauaccuaaugucacugaacuguacucuuaaaaaugguuaaggcugggugugguaguucaugccuguaaucccaccuacucaggaggccgaggcaggauggaucccuugagccaaggaguucgaggcuacaguaggcugugaucaggccacugcaccccagucugggugacagagggagacuucccccucuuuaauuaaaaaaaaaaaaggccaggcacaauggcucacgccuguaaucccagaacuuugagaggcugaggugggcggaucacuugaggccaggaguucgagaccagccuggccaacauggcaaaaccucgucucuacuacaaauacgaaaauuagcugggcguaguggugcaugucuguaaucccagcuacuugggaagcugaggcaggagaaucccuugaauccaggaggcagagguuguagugagcugaaauuuagccacugcacuccagccugggugacagagcgagacuuugccucaaaaaaauaaaaauaaauuaaaaaaaaaaaaaacuggcugggcacaguggcucaugccaguaaucccagcauuuugggaggcugagguggguggaucauuuggggucaggaguucgaaaccagccuggccaacauggugaaaccccaucucuacuaaaaauacaaaaauuacccggguguugugguaugcgccuguaaucccagauaaggcaguagaauugcuugaacccagaggacagagguugcagugagcugagaucaugccacugcacuccagccugggcaauggagugagacuccgucucaaaaaaauaaauaagaguaaauuagcggccgggugcagugguucacaagcuuguaauccuagcacuuugggaggccgaggcaggcggaucaccugagguugggaguuugagaccagccuggccaacaugguaaaacccugucucuacugaaaauacaaaaaauagccggguguggugacacacaucuguaaucccagcuacucgggaggcugaggcaggagaaucucuugaaccugggaagcggaguuugcagugagccgagauugugccaauauacuccagccugggcaacagagccagauuccaucucaaaaaaaaaaaaaaaaaguaaauuagguauucuaccacaauuuuuuuuuaaaucaguaaaugggcaugagugcuucaaaauaagaguacagugaaaucaucaucaaauuacugauucuucuuuggaucacaguuauuuauuuauuuauuuuauuuauuuauuuugagacggagucucacucugucgcccaggcuggagcgcaguggugcgaucucugcuuacugcgaccuccaccucacagguucaagggacucuccugccucagccucccaaguagcugggauuacaggugcacaccaccacacccagcuaauuuuuguauuuuuaguagagacaggguuucaccauguuggccaggcuagucuugaacuccugaccucagguaauccacccaccucagccucccaaagugcugggauuacaggcaugagccaccuugcccagccuuauucuuggaauagauaaauaugauaauguuuacccaggaugcugaguggacaguuagcuuaaucauuuacaagaagcauucaggauuugcagcccgacuuggaaauucugaauauuauuaauuuuugacauuuauuauuuuaaucuuagugauucggguacuuuuauuaaauaaaaauugauuucauguauucauuuuuaaauguuuguaaaauuuaaaaauggaugcaucaagguauguaucauguaaguugauguacaguuauuccuuuuuuuucuagaaugaucuuugcugaguguucccccaacacuugcccauguggcgagcaaugcuguaaccagaggauacagaggcaugaaugggugcaaugucuagaacgauuucgagcugaggaaaaagguuggggaaucagaaccaaagagccccuaaaagcugggcaguucaucauugaauaccuaggggaggucgucagugaacaggaguucagguacggugguaaaugaugauacucuaauaaaaugccaagguauaagauuagaauggagaauggaagaugugaaauuuacuuucagcuacucuuuaauugucuuucaaucauuuaucuucucuuuaggaacaggaugauugagcaguaucauaaucacagugaccacuacugccugaaccuggauagugggauggugauugacaguuaccgcaugggaaaugaggcccgauucaucaaccauagcugugacccaaauugugaaaugcagaaaugguaaggaagcaaaagaaggugaagacaagaauccagcagaauaagcauugagugcagcaagggauugaucuuuccagugucagucagcuuacacaaagcagcucaggcuguuccccauuaccccagaucccacgggcagaguaagcugcuucguuuucacccuaacuucucacucccagacagauauuuuuguuuuuauuuguguucuguuuuuuuguuuugcuuuuuugguuuuuuuguuuggcaugcaaguaguuucaggaucuauguccuagaaaaauauaauaaugaugaugaugauagccaggguggugguacacaccuguagucccagcuauuugagagguugaggugagaggaucacuugagcccaggaguuucaggccagucugggcaacauagcaagaaaaaaucaaaaacaaaaaauaaugauaauaggccggguguguuggcucaugccuguaaucccagcacuuugggaggccaaggugggcggaucacgaggucaagaguuugagaccagccugaccaacauggugaaacccaucucuacuaaacauacaaaaauuagccacucaugguagcgugcaccuauaaucccagcuacuugggaggcugaggcaggagaauuacuugaacccgggaggccgagguugcagugagcugagaucacaccaguguacuccaaucugggugacagagcaagacuccaucucaaaaaaauaauaauaauaccuaauauuuauugaguucuuacuaugugcuaggcacuguguuacauggaucaucucauaucaguucauucagccacucuacugcaugcuuauuaaauaccuggugcauuucucacaaagagaaauaaaaaaagugaaucuggaggucccuuccccucaaauagauuagcaucuaauugagaaggaaaaaagucacaccuaaaaaauaauuuuaaaaagauaauaugaggauaguaugaacaacuuugggguuuuuuguuaaguuuuuaaaaauuaaaguguaauucauauacagagaaauacauagacuuuuuuuuuuuuuugagacggagucucgcucuguugcccaggcuggagugcaguggcgcgaucucagcucacugcaagcucugccuccuggguucaugccacucuccugccucagccugcccaguagcugggacuacaggcaccugccaccacgcccggcuaauuucuuuuuuguauuuuuaguagagacgggguuucacuguguuagccaggauggucucgaucuccugaccuugugauccgcccgccucggccucccaaagugcugggauuacaggcgugagccaccgcgcccgucuagaaauacauagaucuuaaguguacauuuccauuaauuuuuucaaauguauacacccauauaaccaacaccccuaugaaaauaugacauacuuugucauuucagaaaguuaccuuuuaagucaaucucccaaucccccaaagcaagcacugaucugauuuccauugccacagaugaguuuuaccuauuccagaacuucaugugaauguauucuuuugugucuggcgucuuuuuuguuaaaaacauguuuuugcaguucauccauguugaaugcauuagugguuuguuacuuuuuaauguggaguaauacuucuuugugugaauuuaccaguuuguuuaucaauuacugugaacaacuuuauauuugaaaaguuagaugaaaugaacaaauccuuugaaaaacauuccagccgggcacaguggcucacgccuauaaucccagcacuuugggaggccgagguggguggaucacaaggucaggaguucaagaccagccuggccaagacggugaaaccccaucucuaccaaaaauacaaaaauuagccgggcguggugguaggcgcuuguaaucccagcugcucaggaggcuguggcagagaauugcuugaacccgcgaggcggagguugcagugagccaagauggugccacuacaccccagccugggcaacagagugagacucagucucaaaaaaaaaaaagaagaaagaaaaagaaaaacauaccuuuccaaaacugacauaagacaaaauagaaaaucugcacauguacccccaaaauugaaaauguaacuaaaauaucuaacaaaagaaccuggagaaccagaugucuucacugauaauucuuccacauacuuaaagaacaaauaggcugggugcaguggcucacaccugcaaucccagcacuuugggagguagaggugggaggauugcuugagcccaggaguucaagaccagccuaggcaagauggugagaccugucucaacaaaaauuuaaagauaaaauuuaaauauuagcugggugugauggugcuacuugggagacugaggugguaggaucgccugagcccagaaguucgaggcuguaguuuccugugaucaugcaacugcacuccagccugggugacagagacccugugucuauuuaaaaaaaugaagacgaagaagaagaaauaauggcaguaccacuuauaaacucuuugcuucuauaaaacuagcauuaccuucuucuaaaaucuaaccaggaaaaaauauaggccaguguguuccaugaacauagacacaaaaauccuaaauaaaauaucaacaaauaaaauuuaacaauaaauaaaaagcuuaauacaucaugacuaugugggguuuauuccaggaauaaaagauuguuugguuuaacauucaaaaaucaguguaaaccaauguaauuuuaucacaauaauggacuaaagacaaaaaaucauauauugucucaauagaagcagaaaaagcauuaaacaguauucaacacucauugauaauuaaaacucagcaaacuaggaauaaaaaggaacuaacaaaucugccaaaggaaauccauuuuuaaaaaaucuuuagcuaccauuauacauaaauaaggauauccacugucauaucuacauuugaagagucuaaccaauacaauaagaaaaggaaaaaaguauaaagauuagaaaugaaaaaaaauuuaacuaccauuauucgcagaugacauuauuauacacaugggaaauuucuacagacauaagugaauuuagcaagauuaauggaaagauggucaguauauaaaaauuaauguauugaguacauuuuaauauauuagcaacaaccaaguagaaagugaaauuuaaaaaccauuacaaggccaggugcaguggcuuacgccuauaaucccagcacuuugggaggccaaggcgagcggaucaugaggucaggaguuugagaccagucugaccaacauggugaaacccugucucuacuaaaaauauaaaaauuagccgggcaugguggcaugcaccuguagucccagcuacuugggaggcugaggcaagagaaucacuugaaccugggaggcggagguuguagugaacugagauugcaccaaugcacuccagccugugugacagagcaagacuccaucucaaaaaaaaaaaaaaaaaaaaaaccaaacccauuacaggcuaguugcaauggcucacgccuguaaucucagcacuuucagaggccaagaugcacagauugccugaggucaggaguucgagaccacccuagccaacaugaugacugaaacccugucucuacuuaaaauacaaaaauuagcugguugugguggcacacgccuauagucccagcuauuggaggcuggggcaggagaauugcuucaacuccggaggcagaguuugcagugagccgagaucgugccacugcacuccagccugugugacacaccaagacuccgugucaaaauaaauaaauaaauaaaaaccaauacaauuuacaauagcuucauaaaagacuagucccuaagaauaaaucuuaugaaaguuuguaggaccucuauacuagaagcugucagaaguugggaaaaaauaaagaugaccuaaauuaauggaaaaauacacaauguucaaggguugaguguuggcaguuuuuuuuaagugaaaggaaguuuauuaagaaaguaaaggaauaaaagaaaagaaaggcuauuccauaaacagagcagccccgagggcugcugguugcccaucuuuaugguucuuuauagauuauaugcuaaacacggguuggauuaugcaugaguuuucugggaaagugguggacaauucgcagaccuaaggguuccuccacuuuuuagaccauauagaguaacuuucugacguugccauaguguuuguuaacugucauggcacugaugggaguguaguagugaggacgcccagaugucacucucguugccaucuuaguuuugauggguuuuggcuagcgucuuuacugcagccuguuuugucagcaaggucuuuaugaccuguauuuugugccaaccuccugucuuauccuguaacuaagaaugccuaaccuauugggaaugcaacccagcagaucucagccuaauuuuacccaaccucuauacaagauggagucgcucugguuuaaacgcuucugacauuuucccccucccuuuuauaagagaacccuuaauccuuagggguaaacagggaugaagauccaucuuuaguaauuucuucagguugaauagcggugaugauauuccugccuauuagggucucuuguauccaagguagagaagagaucagucagaaagugucaguaugguaagggccauucauaguucugacaaaaggugauaucacgggucaggaacccuauacagggacuuuguggaaaagguaugaggccaguuuucccaaggggcuuuuauuggcucucuaagccaaguuugguuccuuaauagaaagcacuccauuccaaucaaagccuugguaaaauaaccaguuucuccaauuguaucaucugguuuccagauuuuggagaaaugagguagagggaaacaaacauccuuuaaauuuuguucacaggaguuuuacucaauuguuaagaacugucaauaugccaggcaugguggcucaugccuguaaucccagcacuuugggaggcugaggcagguugaucaccugaggucaggaguucgagacuagccuggccaaaauggugaaaccccaucucuacuaaaaauacaaaaaaaaaaaaaaaaaaaaaaucagccgggcauaguggcauacaccuguagucccagcuacucaggaggcugaggcaggagaaucgcuugaacccaggagguggagguugcagugagcugagauugugccacugcacuccagccugagcgacaagagcaaaacuccaucucaaaaaaaaacaaagcugucaguaacucaaaaguuucagccaaucaguguugcagucuauuuccuuuggguugugggucucuuaaguaucaucccuucgugaucgccagaaagaugccagaaagggguucugauccagacuccaagggaggguucuuggaucucgcacaagaaagaacacaagaaagaauucaaggugaguccauagaauaaagugaaagcaaguuuauuaagaaaguaaaggaauaaaagaauggcuacuccauaggcgcagagcagccuuuuuuuuuuuuuuuuuuuuuaagacagagcuggaguacagugguaugaucuuggcucacugcagccuccuccucccagguucaagccguucaccugccucagccuccugaguagcugagacuacaggcacacaccaccaugccugguuaauuuuuuuguauuuuuuguagagacaggguugugccauguuguccaggcuggucuugaacuccugggcucaauaagucagcccgcuucagccuuccaaaguguugggauugcaagugugagccaccaugccgggccugacaagccaguuuuuaaaauagguaaaagaauggguacuuuaaaaaagaauaucaaaguggucaauaaauauacaacagcgcuuaauauguuagauacaguuauuaggggaaauauuaaacuaaauuggaaaaccacuacauacccuccaaaauguaaaaaauuaaagacugacaguauuggcaaagguagagcagcauaaaugcucuuagauuugcugguagaaguguaaauugguauaaccacuuucaaaaaauggcacaaccuaccaaagcuaaacauaaccgguaaaccagcaacucuaauccuaaguauguccccagcggaaauuaguguuugugcuagacuugugcaagaaugucaacuagaagauaucuuuuucuccccuucuuuuggagacaaggucucacucugucaccaggguugaaguacagugggacgaucuugacucacugcaaccucagcuucccaaguagcugggaccacaggugcaugccacccugcccggcuaauuuuuguauuuuuugauagggauggaguuuugccauguugcccaggcuggucucaaacucuugggcucaagcgauccucauugcucagucucccaaagugcugggauuacagguaugagccacaacacccggccagaagauaccuuuuuuugguuuuuuguuuuuguuuuuuugagacagagucuugcucugucgcccaggcuggaaugcaguggcaccauuuuggcucaccacaacuuccgccuccuggguucaagcgauucucgugccucagccuccugaguagcuguaacuaaaggcaugcgucccuacacccggcuaauuuuuauauuuuuaguagagacaguguuucgccauguuguccaggcuggucucgaacuccuggccucaagugaucugcccaccuaggccucccaaagugcugggauuacaggcaugaagguaggugacagaucaagacucugucucaaaaaaaaagaaaaguuacaguauauaucagcaaacuuguuggcuuugcaccuauaaaacuauucacaaagaugggagcaguggccuguggagcaguuugccaacuccugguauacauuuaaaaugcuuucugcagccaggcuccgugggucaugccuguaaucgcagcacuuugggaggccgaggcaagcagaucaucugagcucaggaguuugagaccagccugggcaacauggcuaaacccugucuuuacuaaaaauacaaaaauuagcuagucgugguggcgaggugggaggaucacuucagcccaggaggcagagguugcagggagcugagauugcgccacuguacuccagccuauacaagagugagauacuguuuaaaaauaaaaaauuagccaggcgcgguggcucacgccuauaaucccagcauuuugggaggccaaggcaggcggaucacgagaggucaggaguucgagaccagccugaccaacguggagaaaucccgucuguacuaaaaauacaaaauuagccaggcgugguggcaugugccuguaaucccagcuacuugggaggcugaggcaggagaaucgcuugaacacaggaggcggagguugcagugagccaaguucccgccauuacacuccagccugggcaacaagagcaaaacuccauuucaaaaaauaaauaaauaaauaaaaauuuuuaaaugcuuucugaauucaggauggaaaaauacuaaaaauuaaaaauuuuaggcaagguuacauguaauagggcaguaucuaagcuaacccuuaauguguuccacauugguaaggagacaagaagaaaaaggcugagucaaacagccuggguuuuaauccccuggguuugaaugccacuuaauugcuauauaacuaaacaaacucugaggcguauauacuucauauauaaaauagauaucauaaugccuaucuuacaggauugggguuuuuucuauaggauuguuuugagaauugaugauauaacuuguuaucaguauggcaugguaguuaagauuuugaagccacaaugucaauuugaaacuugauucccuaaguuaucagcuguguaacuuugggcaaguggcucccugugugccucaguugccuuauuuguaguaugaggguuauaauaacuaauaauauuacauauuuuuauauaauuguuaggaggaugaaauaauauaaaauguuauaaaaagcauucaguaaauguuagcuauaaugauaaugacuauauucuuuuuuuuuuuuuaauauauuaagauaaggucucacuauguugcccaggcgagucacaaacuccugaacaccuaaaacaaagucaagcacgguggcucaugccuguaaucucagcacuuugggaggccaaggcgggcggaucacgagcucaggagauugagaccguacuggccaacaugaugaaacccugucucuacuaaaaauaugaaaaaguagcugggcgugguggcacgugccuauauuccagcuacucaggaagcugagguaggagaaucucuugaacccgggaguuggagguugcagugagccgagauucugccacugcacuccagccuggggacagagcaagacuaugucucaaaaacaauaaacaaaaaaacaccuaaaauccuaaaugaucauuaccuuacauauaauagaacaagagaggcacucaugugauagagauugguagaacuggaagauuuguauagguaagccauaaaaaguaauuuuaacucauuuaauaagugaacuaagccuuuuuuuuuuuuuuuuuuuugagacggagucucgcucuguugccuaggcuggaaugcaguggcaugaucucagcucacugcaaccucugccucagggguucaagucauucuccugccucagccucccaaguagcugggauugcagacaugcgccaccacaccugucuaguuuuuguuuguuuguuuuuugagauggagucucguccuguugcccaggcuaggcuagagugcaguggcaggaucuuggcucaccgcaaccuccgccucccggguucaagcgauucuccugccucagccucccgaguagcugggaguauaggcacaugccaccaugccuggcuaauuuuuuuuuuuuuuuuuuuuuuuuuuuuuuugugagauggagucucacucugucacccaggcuggagugcaguggugcaaucuugacucacugcaaccuccgccucccagguucaagcuauucuccugccucaaccuccuaaguagcugggauuacaggugcacaccaccaugcccggcuaauuuuuguguuuuuaguagagaugggguuucaccauauuggucaggcuggucucgaacuccugacuucgugaucugccugccucagccucccaaagugcugauauuacaggugugagccaccauacccggccuuaauuuuuguauuuuuaguagagacgggguuucacuauguuggccuggcuggucuugaacuccugaccucaugaucugcccuccucggccucccaaaaugcugggauuacaggugugagccacugcauguggccucgccuggcuaauuuuuauauuuuuaguagagacgguuuugcccuguuggccacgcuggucucaaacucccgaccucaggugauccaccugccucggacucccaaagugcugggauuacaggcgugagcuacggcgccuggucuggucuugaacucuuggccucaggugauccucccaccucaaccucccaaagugcggggaauacaggcaagccauauuuuaggacuuugaauaccaagcaggaaaaguugaagccuaauugacaacauagaacauguuuucaagaaaaauuauuuaggauucuuacucuggcaguauuauacaggcugccaaggauagaaaagagauuaaaaguggaggccaggcgugguggcucauaccuauaauucuagcacuugggaggccgaggcgggcagaucaccugaggucaggaguucaagaccagccuggccaacauggugaaaccccaucucuacuaaaaauacaaaaauuagccaggcgugguggcuuacaccuguagucccagcuacucaggaggcugaggcaggagaaucgcuugaauccgggaagcggagguugcggugagccaagaucgcaccacugcacuccagccuaggcaacagagggagacuccgucucaaaaaaaaaaaaaaauuuccagccuuuauaacucuguuuucucucuuuacaggucuguuaauggaguauaccggauuggacucuaugcucuuaaagacaugccagcugggacugaacucacuuaugauuauaacuuucauuccuucaauguggaaaaacagguaagaauaauaaauccuagagggagauugaacuuuaucccuuacaaugcuguaauaacaugagcuuucuguaaacaugauugacuuggagccauuaagaaguaugugggaggcuggacacagugguucacaccuuuaaucccagcacuuugugaggcugaugugggcagaucacuugagcucagaauuucaagaccagccuggccaacaugacaaaacccugucuaucaaaaauacaaagauuagcuggaugugguggcgcgcaccuguaaucccaguuuauuggaggcuaaggcaggagaauugcuucaaccuuggaggcggagguugcguuacguugagccgagauugcaccacugugcuccagccugggcgacaaagcaagacugacucugucucaaaaaaaaaaaaaguauaugggaggucaggcgcaauggcuuauuccuguaaucccagcacuuugugaggcugaggcaagcggauuacuuguagucugggaguucaagacccgccuggguaacauggugcaacccugucucuaccaaaaaaaugcaaaaacuagccaaguguggucgcaugugccuguggucccagcuacuugggaggcugaggugggaagauugcuugagcccgggagguggagguugcagugagccaggaccacgccaaugcacugcagccuguggaacagagcaagacccugucucaaacacaaaaaaagaaaaagucugggcaugguggcucgcgccuguaaucccggcacuuugggaggccaaggcaggcagaucacaaggucgggaguucgagauuagccugaccaauauagugaaacccucucucuacuaaaaauacaaaaaucagcugggcaugguguuacaugcuuguagucccagcuacucaggaggcugaggcaggagaaucgcuugaacccaggagguggagguugcagagaucgcgccaaugcacuccauccugggcgacagagcgagacuucagcucaaaaaaagaaaaaagggagaaaagaaguacaugggagccugggcacaguagugcauaccuaccuacagucccacauacucaagaggcugagacaggaguaucacuugagcccaggaguucaaggccaaccugggccacagaacgggaccccuucucuaaaauguuuaaaguuuuuuguuauuaagacaggaucucguucuguggcccacacuagaaugcagugaugugaucauggcucacugcagccuuaaucuccugggcuuaagcaaucuucccaccauaaccuucugaguagcugggaccgcaggcguguaccacugugcgucgcuaauuuuuuuuuaaauuuuuuguagagauggggucucccucuuuugucagggcuggucacagacuccuggacuuaagcgauccucccaccucagccucccacagugcugggacuacagaccugagccaccaugcccagccaaauuuuuuaauuaagugcuugcuuugacagcauauauacuaaaauuggaaugauacagagaagauuagcauggccccugugcaaggaugacaaacagauuacugaagcauuucauguuuuuuuuuuuuuuuauuaauuuuuuuuugagguggagucucacucugucucccaggcuagagugcaguggcgugaucucggcuugcugcaagcuccgccucccagguucacgccauucuccugccucagccuaccgaguagcugggacuacaggugccugucaccacacccagcuaauuuuuuguauuuuuuuuaguagagacuggguuuuaccauguuagccaggauggucucgaucugcugaccuugugauccgcccgccuuggccucccaaagugcuggauuacaggcaugagccaccaugccuggccuuuuuaaaauuuuuuuuuaaagaaguauauaggagaggacaguuuuuuacucuguacuccaccuuucugagauacauagugcccaauuacuuugaagaaagagauugcccugugauuuuuggucuccacucaguuaacuuuucuggggaagaaguuuuccuaaaauuuaauccaucauuucuauuccaguggaaacccauuucuauuuauacucucaaucaguuguuuuccccuauaugcaaauuucuugauuuauacuuaauguguguccaaaugcucaggaauccucuuuaagcuaguaaaugagacugcaagcuaaaaaaaaauuauucucagcuggucacaguggcucacaccuguaaucccagcacuuugggaggccaaggugggagaguugcucgagcccuggaguucgagaccagccuggucaacauggcgaaacccugucucuacacaaaauacaaaaauuagccuggcauaguggcacgcaccuguaaugucagcuacuggggaggcugagauaggaggaucaguugagcccaggagguugagacugcagugagccaugaucauacuauuguacuucagccugagugacaggaaagacccugccuuaaaaaaauaaaaauaaaaaaauuauucucucccuucaaagcaacuuuguaaguguggcuuugagaaaugucgaggaaucaucggaggcaagagucagcgugugaauggacucaccagcagcaaaaacagccagcccauggccacacacaaaaaaucuggacggucaaaagagaagagaaagucuaagcacaagcugaagaaaagggugaauaauuaucuaaugacuuuccccaaaagcuguucaugagaugcuuugaggcaauugcuggaauaagggaauuaccagaggguggcaucuuaagagugguuuuaauauucuuggagauuauuucugacugauauuuuuuuaaaucucuaaucugauccaucucuuuuucagagaggccaucucucugaggaacccagugaaaauaucaacaccccaacuagauugaccccccaauuacagaugaagccaauguccaaucgugaaagguaaaaaggaaauauccuuauccauguucuuuguaaguuacaugauugcuuaucuguguaaaaaauuaugaaacuucuauauuguugauccacuuucuuuugucuuaagccaaaggguucaggggaucuaugaaccuggauggaagaaauacaaucuuuuuuuuuuuuuuuuuuuuuuuuuuaagucuuacccuuuuguguguguguguguguguguguguguguguguguguguguagagcugggaucuuacucugucacccaggcuggaauacagaggccuggcucaacuccugggcuuaagugaucccccugcaucauccucccaaguagcuggggcugcaggcacaugccaccacaccuggcuaauuuuuuuuuuuuaaauuuuuuguagagacaaggucucacuauguugcccagguugguccuaaacuccugggcucaagcuauccuccugccccgaucucccaaggcauugggauuacagauacgagccagcacaccaaaccaucuuauguucccuaauuucuaaaugaaauaacauuuccacauaucccuguagacccaucuacucaggaggcugaggcaggaaaauuacuugagcccaggaauucaagaccaucuucggcaacauggaaagaccuugguuuuuuguuguuuuuuuuuuuuuuuugagacggagucucgcugugucgcccaggcuggagugcaguagugcaguggugcaaucucggcucacugcaagcuccgccuccuggguucacaccauucuccugccucagccucccgaguagcugggacuacaggcacgugccaccacgccuggcuaauuuuuuauacuuuuuaguagagacaggguuucaccauguuagccaggauggucucgaucuccugaccuugugauccaccugccucagccuccccaagugcugggauuacaggcgugagccuccacaccuggccaauaauuuaaauuuuuugaaguaauuuaaaaauaauuguucagagaaugguuccauaggcuucaucagacugucaaaggaguccgcaguagagaaaaaauuaagaauaccugcuuuggcagggcgcaguggcucacaccuguaauccuaccacuuugggaggccaaggcaggcggaucaccugaggucgggaguuugaggccagccuggccaacauggagaaacccugucucuacuaaaaauacaaaauuagccaggcaugguggugcaugccugucaucucagcuacucaggaggcugaggcaggagaauugcuugaacccaggagguggagguugcagugaaccaagaucacgccauugcacucuagccugggcagcaagagcaaaacuccgucucaaaaaacaaaaaaaaacaaaaagcaaaaaaaaaaaaaaacagaauaccugcuuuguugacauauuaacagagcaauagaaaggaucuuuagugguaauuucugcuguucccuguauucagauaagaauugucucuuucagaagcaaacaagugaguauguccuauuuguugaaaguuuaucuuuauuuauaaccauuguguaauuuuagccccuuucauucuauuucccuuugaguuguagaaauuuuaaauuucggaaaaaccaguccagugguucucuacuuuggcugccuauuagcauggggaacuuugaaaaacucccaaggcccaggccacacccuagaccacuuaaaugagaauuugcagagguagaacccagguaucaguaguuuuuaaagucucccaggggauuccaaugugcaggaacuagaaaauuagucuaaucuucauuuaagugagaagugagacccauaccuugagauuuauccaagaucacaucuauuuacauauguccuguuguggaaauugaauaauggaaucaucaaaauuguauaggaucagucaagauacacauaauucauuuaaguuuagggaaccagggccaggcacgguggcucacgccaccacuguaaucccagcacuuugggaggccaaggcggguggaucaccugaugucaggaguucaagaccagccuggccaacauggggaaaccccgucucuacuaaaaauacaaaaauuagcugggcgugguggcaggcaccuauaaccccagcuauucaggaggcugagagaaucgcuugaacccgggaagcagagguugcagugagcugagaucaugccacuguacuccagccuaggcaacagagggagacgucgacucaaaaaaaaaguaguaaguuuagggaaccauauggcagcacugcaccuaacauaguuugcccagugcguauccaucuuacgugucuuugccuucauuugccaguccaguucuccuuguuauagcugauccugagacccuacuucaucuugacaacuauauuuagaauuuguacaaauaaaucucugccuucuggucaggcuguuucacuugccagcauuuuugcagccuuuaauuguuguuugccagauguauguaaauauuauguguuuuauguaauguaaaaaaauugaagauacaaaauugaguaaugcuuugcccauauaauucucuuuacaacagcucaauucacguauaucgucuaacaauggcuuccauagaguagacauguaauacaugcuuauuuaauuaaugaauaaaggaagauuuuuuuuccuuccuugcaggaacuuuguguuaaagcaucauguauucuugguccgaaacugggagaagauucgucaaaaacaggaggaaguaaagcacaccagugauaauauucacucagcaucauuauauacccguuggaaugggaucugccgagaugaugggaauaucaagucugguaaggcauuugaaacauuucuuuuuuuugagacagaguuucacucuuguugcccagacuggagugcaauggcaugaucuaggcucacugcaaccucugccuccuggguucaagcaauuauccugccucagccuccugaguagcugggauuacaggcgcccgccaccaugcccggcuaauuuuuguauuuuuaguagagaggggguuuugccauguuggccaggcuggucucgaacuccugaccuccugccuuggaaucaaggugauucgccugccuuggccucccaaaguguugggauuacaggcguaagccaccacacucagccgaauuucuauuaauuuauuuuaguugcuuuccagcagauaaucuauuuaacaacuccuuuuaguauugaccaaaaaaguuaugauccaaauauguacacaucagucaguaauaaccuauccaucccaguucuucagcuuuccucucuuuagggaauagaaagaaaccuccuacagccuuucaaacaugaccuguagucugaaauagucauuagguaucagauagauagugggcccucuuuguuacuuccuaccuugaaaauaacuugcagacagaguaaauagugauaccaaauccacuggggaaauuggggugggggacggguaauuaucaguggguggacaggucauuaucaguuugaagaccuuuuuaucucacauucagauucagcuggggacgggucauuucucacauucagauucagugggggacgggucauuaucaguuugaagaccuuuuuuucucacauucagauuagcacuguacucacaaaccaucagauuuccuuucuguaaccuucaauaacagcacuccugaguucagauauuauccagaagagacugaaagcagaggaacuagcauguccaagcauccuuucuaacugaaaacagaguguucaaaagaucaugcucuuuuuuuuaauccuuuccuucuuccccucaaaagguagaagcaauucuaugugaugugugagggauaugcugaaugcuaacuagauagauuuaaaaauuugcccauaaucuuacauccugucaaugauuugauuggcauaaauucuuugaaguuauauccuaacuaguuuacuucuucuaauaauaacagauaucauuuacagagugcuuacaugucaggcacugagcaaaacacauuaaaagcauuaucucauuuaaccugcauuauuuccuuaugagggaaguacuaccauuguucucauuuuauguuugagaagcugacccauggguuaaauaacuugcccaagaucacacaacuaauaagcagugacaccagaauucagaugcugauagauucauuuugaagcccagacuuacaacugcuauacuguauugcauuugagcacuaagcuaaggucccucuugcagcauuuugucuccaguaaauuccaguguuuccugauuuuucauuacagaagauagaaagaacucugugcccacuaaucuaccuaaucacuucaggggaaaauagagcaaauggcaggaauccauugggaaagagaaagacauguagagcuccuuguuuccuguaacuuaauuuucacuuuauuuuuccagaugucuucaugacccaguucucugcccugcagacagcucgaucuguucgaacaagacgguuggcagcugcagaggaaaauauugaaguggcucgggcagcccgccuagcccagaucuucaaagaaauuugugaugguaucaucucuuauaaaggugacuauaaccaccuucaaauucguucuuuuuuucuuuuucuuuuucuuuuuuuuuuaaauaaauagagauagggucuugcuauauugcccaggcuagucucagacuccugggcucaagugauccuucugucuaggccucccaaagugcugggauuacagguaugagcuacugcucgugggcauuucuuuucuuuuucauuucuuuuucugucuccugauuaucuuugauauuauaguggcuuuuugcaguuuucuuaaccuaaggauauaaagagaaaaauggggaccaaacugcccuaagauguaagauguaaaguuuugaauuuugaggcaccuauuccauuuacauucccaaaauaaaucacacucucugcauucugucuuuuuuuuuuuuuuuuuuuuuuuugagauggaggucucgcuauguugcccaggcuggucuugaacuccuggccucaagcgauccuucugccucgaccucccaaaguucugggauuauaagcaugagccaccaugucugucuugcauucucaaguaggcucaucucaccgaacaugaaacugcaguaaguaugucuaccaugucacugcauucugagcaugaaacacgggcucuuuuacucugcuagugaaauugccagaaauuaaguaugguagcaaaugagaaguggccccucaccguaaauuccauuuucauaauacagaguaacuguuacaggaaaaaucaauuacagaaaauauucacaguacaguacuaaauuauucaauaucuggaauuuaauuggauccauacccaacagaguaauaguaauuaauuuauuuauuuauuuauuuuauuuuacuuuuuuuuuuuugagacaaagucucacucugucacgcaggcuggagugcaguggcaugaucucggcucacugcaaccuccaccuccuggguuccagcgauucuccugccucagccuucuugaguagcugggacuacaggcgcacaccaccacaccugccuaaguuuuguauuuuuuaguagagacaguguuucaccauauuggccaggcuggucuugaacuccugaccucgugauccaccugccucggccucccaaagugaugggauuacaggcgugagccagcaugcccggccuuuauuuuuauuguuuuagacagggucucagucugucgcccagguuggaguucaguggugcaaucuuggcucaccacauccuccgccucaaggguucagaugauucucccaccucagccuccugaguagcugggacuccaggugugcgccacuaugcccagcuaaauuuuguauuuuuugguagugagacgggguuucaacauguuagccaagccguuuucgaacuccugaccucaaguucucugcccaccucagccucccaaagugcugggauuacaggcgugagccacugugccccgccaaacuaauuuuuuuuuuuuuuuugagacagagucucauucuguugcccaggcuggagugcaguggcacaaucuuggcucacugcaaccucugccucccagguucaagcaauucuccugccucagccucccaaguagcugggauugcaggcgugugccaccacggccagcuaauuuuguguguguguguguuuuuaguagagacaggguuucaccauguuggccaggauggucucaaucucuugaccucgugaucugcccaccucagccucccaaagugcugggauuauaggcgugugccaucgcgcccggucuuuuuuuuuuucuuuuucuuuuucuuuuuuuuuuuaggacggaguccuguucugucgcccaggcuggagugcaguggcacaaucucuguucacugcaaccuccgccucccggcuucaagcaacucuccugccucagccugccgaguagcugggacuacaggugcaugccaccacgcccggcuaauuuuuuuauuuauagcagagauggaguuuccccauguuagccaggauggucuugaucuccugaccucaugaucugcccgccuugaccucucaaagugcugggauuacaggugugagccaccgcacccauucccagccaaacaaauuacuauuaauuaagggcaguuaaugagaacuagaaagcacuuuuuggauaagauauucuuuuugcuauuauaagauuuguugaguaguaauuugcccuaagcagauuacccucaauaaguucccaucucucauucuucacaggaaguucuucucauuacccaacuaacauugugcuaccuuucaagcagaugcaacuauaucuuucauauccuagacaaucuuagaauugucauuugaucccugccuuuaucuacauaucugaaaaaguggcuuuuucacaggccuuaaaaagacuuggauuuuuggccaggcgcaguggcucaugccuguaaucccagcacuuugggaggccgaggcaggugaaucaccugagggucaggaguucgagacuauccuggccaacauggugaaacccugucucuauuaaaaauacaaaaauuggccggacacgguggcucacgccuguaaucccagcacuuugggaggcugaggcgggcagaucacgaggucagaucgagaccagccuggcuaacauggugaaaccucgucucuacuaaaaauacaaaaaauuagccgggcaugguggcggguaccuguagucccagcuacucgggaggcugaggcaggagaauggcaugaacccgggagguggagcuugcagugagcaaagaucacgccacugcacuccagccugggcaacagagcgaaacucuugucucaaaaaaaaaaaaaaaaaaaaaaguagcuuggcguggugguacacgccuguagucccagcugcucgggaggcugaggcaggagaaucgcuugaacucaggagguggagguugcagugagcugagaucaugccauugcacaccagccugggcgacaagagugagacucugucucaaaaaaaaaaaaaaaaaaaaaaaaagacuuggauuuuucucucacuuuuaauuugagggauucuauucuuccaguuaggagaugcuugccucccuuguaugguggaaucuuucuacuaaaccucacauucuuuugcagauucuucccggcaagcacuggcagcuccacuuuugaaccuucccccaaagaaaaaguagguucacauuugugggaaucaucugaguuuuuaaaaagugcuaagugugccagauugacacccuggcuuuguguuccaggaaugcugauuauuaugagaagaucucugauccccuagaucuuaucaccauagagaagcagauccucacugguuacuauaagacaguggaagcuuuugaugcugacaugcucaaagucuuucggaaugcugagguauuuuucacugacuucaaacagauuucacaaguuuguucugaaaagaauuagucuagaaguuuaagauuuuuacccuccucuaucagccauauuucugguuggaaaagccagucauuuuugaguauccuugggguauguguuacaguauacuaaauauuauagaaggcuaucuaugaagacauugauaggacuagaauggaagguuaaaucauucccccccaaaaaaauaauuuuuguaaaaaacuaauuuaguauuaaaccuuuaugacugcguuauauagauauuuuaauacauuuaacuaauaucuguaguuucuuuccucaagaaaauaaguacaugugaaauauacagaaauaugcauagguaaauguuuauauguguguguguguguguguguguguguguguguguauauauauauauuuuuuuuuuuuuuuuaaaugagacagaaucuugcucugucacccaggcuggagcgcaauagcgugaucucagcucacugcaaccuccaccucccggguucaagcgauucuccugccucagccuccugaguagcugggauuauaggcgccugccaccaugccuggcuaauuuuguauuuuuaguagagacaggguuucaccauguuggccaggcuggucuugaacuccugaccucaggugaucugccugccuuggccucccagaguguugggauuacaggcgugagccacggcuccuggccaguaauauaucuugaggauggaauugaggaguaucacagugauagauuauggaauagcugaagcucauuggagagaaaguggccuugaacugauuuaaaggacaggauggacuauuguauggugcauagaagagaggaaauuauucaguaauuuugacaugccuuggagagguguuuggaagacaaaagauccuacuagauaaaggaauaauagaaguugaaagacaaaaugagaaagaaaaauagacaagcgggagaagaguuagagcaaucuuaaauuguaacauucuuccuacugaaacccagcuuccacauagauucaacaccuguagaucugucacagauauccacaagacaaagguguauguugaacuucuacaguacauuaugcuugugauaucaauucauauuucaugaucucuguguauuugaucuggggacaagaaggcccgugacaggaauugaaugacagaucaguugagcaaauggaaaaauaacaugcagauucuaacuugaauucauuuuaguucaguuuaaguuguuaccaacuaucuggccauauauuugauacuauugaaaaucuguuaaccaaaaugggaggguaaagaaagucaugcuaccuugcuaccucuuuagguaaauuguuaagccacauugagagaaccaaacaugauuucuuuauuugcuuucuucagaaguacuaugggcguaaauccccaguugggagagauguuugucgucuacgaaaggccuauuacaaugcccggcaugaggcaucagcccagauugaugagauugugggagagacagcaagugaggcagacagcagugagaccucagucucugaaaaggagaaugggcaugagaaggacgacgauguuauucgcuguaucuguggccucuacaaggaugaaggucucaugauccagugugacaagugcauggugagggucaggaaaugaagcagaagcuugguccugaugaacacggugaccauauucaaagaagaagcccaugccucuuuuggauuggcuugaaagacuguuuaugaacuguaacuuagccuugguuucuguuagguuucuguguuuacuauauugccuuucuccuuuuaucuuucuuucacuuuauccuucccuucuuuuucuuuccuucucuccucucuucuuguuuuuuuguuuuguuuuguuuauaagauaggaucuugcucugucauccacacuggagugugguggcacgaucucagcucucugcaaccucugccucccaggcucaagcaauccucccaccucagccucucgaguagcugggauuauaggcaugugccacgugccaccaugcccggcuaauuuuuuguacuuuuuguagagauggggugucaccauguugcccaggcuggucuugaacuccugagcucaagugaucugcccaccucggccucccagagcguugggauuacaggcaugagccaccacgccuggcucuuuccuucuuucugcccacuuuccacuguacacuucucacauaaucuggaucaaggaaaaugacaguauuucauauagugcuuugccuuuugaaucauuagugauaauacacucuauuaauugaauccucugauagagugaaauauguuaauacauguagggcuccugaugaagaagucaaagccuggauuugagccuuaguguccccacuaauauaugugaaugcauaacuuuauguguaaaguggcuguaaguaacgcacaggauuguugggaggcuaaaguuagacaggaguaaauaaaacauuuuguagcuguauucugaaagcagaauagcuguagcauuuacuuaaauuacuuaguaauaguucaguagucuauuuguuuuccuauucucuguccaucuccccauuuuauuugcccagaucuauagauuaugagucaaucgguauacuuuugcuuagaacagucauuauuuuguuuuccuccuauuuuaccauuuaucucuaauuuaucauucacccaguuaucccuuaguuccucuuuuacuuuacccugaccuauugcuaauuuuuuauucugggcucccaggacacucucaauaagucauagccuccauguuccccaaacuguauguuuuucuacagguauggcagcacugugauuguaugggagugaacucagauguggagcacuaccuuugugagcagugugacccaaggccuguggacaggguaagcugaaccucugauaaaacucugaucuauaaguaggagagguagcacaugguaucucaccuguccugcuccugcuuugcagaauuuccuuuaauagguuguucagccucucugggccuugguuucuuaaacuuuacauuaagggucauaauucuguucuucccuauuucaggaguaugaccaaagggaaaauaaaauacuuagaaaucuguggaaggaauggcacuauauaaaacuaagguuuuuggccgggcacggucgcucaugccuguaauccuagcacacugggaggcuaaggcggauggauugccugagcucaggaguucgagaccagccugggcaacacggugaaaccccaucucuacuaaaauacaaaaaaaauuagccgggcauggaggcgugcaccugaagucucagguacuuggguggcugaggcaagagaacugcuagaacccgggaggcagauguugcaguaagccaagaucaugccagugcacuccagccugggcgacagagcaagaccccaucucuuagaaaaaaaaaaaaaaaaaggccgggugcaguggaucaugaggucaggaguuugagaccagccuggccaagauggugaaacccugucucuacuaaaaauucaaaacuuagccaggcacaguggcaggugccuguaaucccagcuacucaggagucugaggcaggcaaaucacuugaacccaggaggcagagguugcagugagccaagaucgcaucacugcauucuagccugggcaacagagcaagacacugucucaaaaaaaaaaaaaaaaaaaaagcugggcaugguggcucacaccuauaaucccagcacuuugggaggccgaggcgggcagaucacaaggucaagagauaaagaccauccucggccgggcgcaguggcucacggcugcaaucccagcauuuugagaggcuaaggcggguggaucaugggguuaggaguucaagaccagccuggccaauauggugaaaccccaucucuacuaaaaacugcaaaaaaaauuagccgggugcaguggcaggcgccuguaaucccaucuacuugggagucugaggcaggggaaucacuugaaccugggcggcagagguugcaaugagccaagaucacgccacugcacucuagcccgggugacggagugagacucagucuccaaaaaaaaaaaaaaaaaaaaaaagaccauccuggcuaacauggugaaaccccgucucuacuaaaaauacaaaaauuagcugggcgugguguugcgugccuguagucccagcuacucgggaggcuaaggcaggagaauucacuugaaucuggaggcggaaguugcagugggucgagaucgcaccacugcaccccagccugccaacagagcgagacuccauuucaaaaaaaaacaaaacugagguuuuuauaaacacuaucagauguccaugaaaggaauagcuuacaaaauccagaacuugguacccuuaacgucauuuauguuagacagugguuuaagugaaaagagcacuggacucagaaucagcaaagguuaguguuaggcucacuucauaggagagaggguaaguggcuugccuaagucauuaaguggguucugugcuuggcucugcuaucuuuauaugugugauuuugggcaagucauuuuuaaaaaaagaagagauuuaggcaguauuucuuaacaauguugcuguugucauguuuaggugaauaguucuuguugugagggaugcauuucagaauguuuggcuuccuuggacccugggcauuaaauaccaguagcauaccccaaucauuguaauaauuagucucccuucacacauuuucauauggccccuagauuacguagagcaacuacacaauuagugcuucauaaaacauagauugagauacuuagccuaucaguuuuguccucuaccuucacuuuuccagguuuaacagcucuaguugcuuucaucuuuuuuguauaucugugguauauugaaaugacuaaacaguaaguuuugauugagaauucuagguugagaaauaaguaggcugaauguaguaauuccagcccuuauacauuggcuuucugcuccuaucaggagguucccaugaucccucggccccacuaugcccaaccuggcugugucuacuucaucuguuugcuccgagaugacuugcugcuucgucaggguauguauacaggagcuaauccuacuugucagaggugaccuuucugaauaguaggaagucucugcugucuccaucauagucauugucuccauacggccucgaauagcaauagaauauaaguuuuuauaucuguaguccuugugcuuacaugcaucaccucuccaccaaauaauacuaauuugaaaugauagacauguuacaaagcuaauuuuaagacugggaaaaacauauaggaagcucaagaaauggaaugccucccuuauauuauugucauagucuagaauugauuaucaucacuuaacacugcugcuuuuagcucucuguauuuauacuguuucagauuaugaguucuauguagacccugagucagauaaacagaugccuaacagaauucauacaagaauuguuuuauguuucuucuguguucugggucuuccuaggugacuguguguaucugaugagggauagucggcgcaccccugauggccacccgguccgucaguccuaucgacuguuaucucacauuaaccgagauaaacuugacaucuuucgcauugagaagcuuuggaagaaugaaaaguacgugcugagguccuguccuuuucuuccagccgugcuguaccaguggagcugaauguucacuaggaucuugcuaaucagcuaaaccucucccuucucacuuuuccauuguuuuagagaggaacgguuugccuuuggucaccauuauuuccguccccacgaaacacaccacucuccaucccgucgguucuaucauaaugaacuauuucgggugccacucuaugagaucauucccuuggaggcuguaguggggaccugcuguguguuggaccuuuauacguauuguaaagguaagugaucugggcuaguuaaaaaaugaccucggccaagugcaguggcucacgcugauaaucccagcggugugggaggccgaggcaggcagauugcuuaagcccaggagugugagaccagccuggccaacguggcaaaacucugccucuguagcugggcauggcaguguaggccuguagucccaacuacugggaggauugcugagccugggaggcagagguugcagugagccaagaucgcaccacugcacuccaaccugugcaacagaaugaaacccugccucaaaaaaaaaaaaaagacuucaaugaccucaugucuccuguucauugcccaccccauucuuguugccuguauaugauugccuguauaugaugaaagauucuccaaggcuagcuaugaaacuucagagagcucuacuauauuuuuuccuuucuuuuaccuagggcuuaguacucaauaaaaguuuauucuuuuuuauuaaauuuaguuaauuuuguuaauacuguguacuaauuucaaauuccagcucuaccacauuuuaucuauguuccuuuguggaauuuacuuaaucuaaguaucaguuucccauugaaaauaaggacuaucuauuuuaaagaguucuuaaaagauuauauaaaauaaucuacaaaagcacucagccuaguuuauggcuuagaguaaaagcucaauauauguuauuugucacuauuagcagaguucaguugccuagacuguucucucagaaucauagcaaaauagucuaaaagacuacguauuccauuccaaaacugacagacugcuugcaguucugugugauacugaugaguccuccuugucucaguuaaaaaguguucauguacaaaugugcuucccucaaauuuaugccucuguucuuuucuuguaacuccucguaaccugcucaguuuuucccucaaaauacucccucacacaucccugcagcacucaguuuacauuucugguuuauuuccauccauucugcuguauauuuacuuuauccuuuguugacacuagugucugagaacucuuuguccagcaacuaccaaaugcuuaguuguccugccucucuacauagcuaccauguaggguuuuaagggucuagcugcucucccauugguguguauggggucuuugggcagcucagggggagaaauggcuaaauaggauuccuuaacacugguuggacccauagggagacccaaaggaguaaaggagcaagauguguacaucugugauuaucggcuugacaagucagcacaccuguuuuacaagauccaccggaaccgcuauccugucugcaccaaacccuaugcuuuugaucacuuccccaagaagcucacucccaaaaaagauuucucggugagucuccuuccuuucuuaacacuacauguuaggacaaucugguucaugcaugaaauucacugagcgaaaaucuucacguaguucucugcuucuucauccaaauuccaucccaaacuauggauaucucugucucuauuugggacauuugaacagcauaaguacauuuccucacauagacuguaucucagaaaauuguugauauaguguuauaccuuuccucuuuucucuuucgucuguuuaaccuuugcuggcgagccccauucuguagauuuuuguuuuguuuugucuuucacacccauaauuuuaagaagcaagaacccugaaaaacuccuuuuuuuccucucucucauugagaacacacccguaaaagaagaaccuucacagaaaauaauucagugcuuuuucuuuuuaugccugcauuaaaaauggaagacacgaucauuauauaaaauuugugagccaggcgcgguggcucacgccuguaaucccagcacuuugggaggccaaggugggcggaucaugaggucaggagaucaagaccauccuggcuaacacggugaaacccccucucuacuaaaaauacaacaaauuagccaggugugguggcaggugccuguggucccagcuacucgggaggcugaggcaggagaauagcgugaacccaggaggcagagcuugcagugagccaagaucacgccacugcacuccagccugggugacagagcgagacuccgucucaaaaaaaaaaaaaaauugugaacauugaaaccccgucucuacuaaaaauacaaaaauuagccaggugugguggcgcgcaccuguaauccuagcuacucaggagacugaggcaggagaaucgcuugaaccugggaggcagagauugcagugagccaagaucgcgccauugcacuccagcuugggugacagagcgagacuccaucucaaaacaaaacaacaacaacaacaaaacaaaauuugugguggugguguuuauuguauaaacaucaugguggcucacguguguaaucucagcaccuugggaggcugagacaggaggaucacuugagcccaggaguuugagguuacaguaagcugauugugccacugcacuccagccugagugacagagacccugucucaaaaaaaaaaaaaaaauuaaguauagaagcauaagaggaaaaaaguuauauauauacuccacuauccagaaaauaaccauuauuaacauuuucauugucaggcuuuuuccugguauuuuuucuuucaaauuguugagaaccgugugccaauuauacguuuugucauucaucauuccauaaagauuuugaucauccauucaucuguuugcucuaauaaaacccuggcugagcuccucaucuuugagucuucuuuuagugggccugucaaaagucauagcugucacccuggaauccuuagcaauaaucuaaccagggccaggcgcgguggcucacaccuguaaucccagaacuuugggaggcugaggcggguggaucacaaagucaggagauugagaccagccuggucgacauggugaaaccccaucucuacuaaaaauacaaaaauuagccgggcaugguggcaugcaccuguaaucccaguuacucaggaggcugaggcagaagaaucgcuugaacccagaggcagagauugcagugagccaagaucgcaccacuguacuccagccuggcaacaggacaagacucucaaaaaauaaaaagaaagaaaaauaagcuaaccagaaaacaaagcaauauguuccuauuuucccuauuuuuuuuuuuuaauuuuccagaccgucuuuuguauucucugcccaccaccaggucuuuccucgcaucuagacuuauuugguuuugcuugcucaaucaauagcuuacugacuagcuuugaaaccccagccuuaacuacagucaugugcaacauguuucagucaacauuggacugcauauacaacggugaucccguaagauuauaauggagcugaagaauuccuuccuaucaucuagugaugucauagcugucguaacauacugcaauguaauaccuuuucuauguuuagauacacaauacuuaccaugguauuacaacugccuacaguauucaguacaguauugugcuguauauauaggcuuguagccuaggagcaauaggcuauacuaaauagccuagguguauaguaggcuauacuaucuagguuugcguaaggaugcuuuaugauguuuacauaacaaucaaaucacgugaugacauauuucucagaacauauccccguaugaccccaagcgacauaugacuguauuuaaaaggugaaaugggauagagaaaauugugcacuuaucccucccauugucauccugggagcacaaaaugcugauaaucauuguggccugcauauucauagaaguacuaaauuucucaucuuaaaacaaagucacccaacuugucuacugcccuacuguguuccuuauccugacuggccccagagaagagcuagcucucccagcuucuacaauaugcuuaccucuuccuuuucuucucugcagccucauuacgucccagacaacuacaagaggaauggaggacgguaagucccauggggggauaugaggauccuaagggauugacuaagagcuugaauggaucaagaaaacaaacaacuacccacucagcuccacuucuaggacuggguauucucugcagaguagcccaguguagugccagcacuauggaagaacuaaauuucaguagauguggucccauuauggagccuuaauuggagcaacagagagaugugcagggaguagagacagagauuuggaacagaacuccagacucagaaaaguuucuuuuagaugucuguaagcuuuccccauuaccucaagguauaucagcucuugguaccucuaucaaggaacagauguagccaguacaguuuucacugagcuaugaacuauggguucauaguuuuuauuuuugcuuauuuuguacgugaggauuauuccugaagaaagaugacagaaggcuuuuucuucagucuccucaucuguugaaugggggcauaacaacugcuuuaccuacaccaauagcuuaccauaagggagaaaauauuagacuauugauaugaaaaagggaagcacgaaaauuuaaaacuccauuuaaauauuuauuauuguaguuggauuauuggcaucacaagguugugccgugcuucucuagucaugaagcagucauuuagaaccagcuaagcaauuuuauuagcccuuguauauuuuauggauuccuauaccauuugugaauauuccuaagagaaauaauaaaaguugaauuuuacaaauaaauuucugguaaagguaguguuuuauucaaauaauauaaagugaaaacgagagucaaguuucuuaccucaagcuaaggcucuaacugcuggacuccaggaucucaagccaucuugaggccuccuacccuucauccccuuuuccuccucaagugucuuacacuaaauucagauauccuucuggcagaucauccuggaagucugagcgcucaaagccaccccuaaaagacuugggccaggaggaugaugcucuacccuugauugaagagguucuagccagucaagagcaagcagccaaugagauacccagccuggaggagccagaacgggaaggggccacugcuaacgucagugagggugaaaaaaaaacagaggaaaguagucaagaaccccagucaaccuguaccccugaggaacgacggcauaaccaacgggaacgacucaaccagaucuugcucaaucuccuugaaaaaaucccuggaaaaaaugguaagaagaaucagguucauaucuaggguuuaagauaaaugcgaaaugagagggaauggaaaaaaauuguaauuacugguucagcauccaaaguauucuaagaaaaugguauaguucuuuuauaggcuugcuuuuaguuguaucuugguagugaaacuggaaggugagaugaucuccucuaaagaaccaccuuuuucacguaggguuggaggaugggcuaaauugcuuauaggucagaaaaggaaucauugaguucgugugcucuccuuagagcucaaaucuggaauaaggaguaggagauugguauuuugaugagccuccuugguucuguuuucagccauugaugugaccuacuugcuggaggaaggaucaggcaggaaacugcgaaggcguacuuuguuuaucccagaaaacagcuuucgaaagugacccucaaagaaugagaaccucaagcaucugggauccaguggagcuaaucaguccugccuccugcucucuggguauagacaggggugggaaggguccaucugggcaaggggaauggggccauguuguugacauuagguacuuaauaagccuuggagcuaguggagagggagaggaaaggguucuguccaagacaguucagguuaauuaauuuucuucuccauugcuucaccuuaaggguuaauaauguagagaggagggaggaccacauugaugaccagaaccuacugguacuuuauagcauuugccccaccccacagcuuagguuuuucugucauccucagaucccacaggcauugcgaagaagcugcuuccuauacccagguauaacucaaaauccaaagggauagggccaggaucccuauuccuaccccaucuauucucuguuggcuccaagagcuaccccagagaccuuaaacagaaacaguagcugaggcuucuuccuagauaccugacuagggaaguuugucucuccuuucuugcccaaccaggucaaaguaaaaugugaguugacagcucaaagcacuuguaacugcugcccccucccuaccucuacuccccaaaauggaaucaugggauagggaaggcccccauggggucagaagggcacgguaguucuugcaauuauuuuuguuuuacccuucauaaccugucaaacauauuuuuuucuaaugagaaagccaggcccccgccagcacacaugcuguuuuuaaugcgcuguaguucuugugugucugcugugcugugcaaauggagauucaguucaaaauaaaaucauuuaaaaaccuacauaaaaagaacucuaaacccaccccugcaacaaaagucacuacauaaacuguucagcaguauucaccuaucagaguauuuguugugaguauagauuaucaauugaaaacacuacucuuguuuucuuaauuguacaguuuucaaugucccuuucuuaaagagacaguauauuucucuucaccccuagcccaucuucccucacccuccugaaugacaucaggagguauauccagggugucuccuuccuuccuacucucuugaccagaaguuaacagacuauacugucucuuuaaaaauaaaauuuaaaaagcuuuguugucuuuucagacauacauaugcauauauguuuuagauguucuuauaagagaaaagaugguuuuuaaaugugccaaguuguguguguguguguauauauauguguguauguguguguauauauauauguguguguguauauauauacacacacacacacacaccugcugugugauugguaagcaauacaauaguaaacauguccccauuacuuuuuucuaauauuggaccaaugcuguccuaauuguacauuuccccuuauggugacgaugcucugacucguuuagguagacacauugaccaccuuccauuccauuaaauauuuuuuccuuuuuccccuuucugugucauucuugaggaaaaaacaaaagagagaggggaugccaaugauccccuugagcagagaaaaagcaaaauaaauauuuuauuaaagaaaaaagagaauuaagaaaauaguuuggaguauuuucuuacuguagagaagcacuguacauuacuaagagaccuggguauaagauacucacauguggagcuggaaaaaucgcauguccaagcccguuugagugguuucuuuuguuuuucauugcagggagugggugggagggaggugggacuaggggcacuuugggggucuccuuuuagucaaaagcgagaaaaugacaagaaagagauuaaaauucaauguuuccuuuauaguguuaaacacuaaaauuuuaaaaaagaugaaaaagaaaaaaaaacuuuguaaaaugcgagaacagaagcaaaagacacuacgcucugucauuuuaucuuucuuuuguugaaagacuaaaaaaaaacugaaauguuuuuuagacaaucaaauguuagguaagugcaaaaacuuguuuuuucuuacugguguagaaauuaaugccuuuuuuuauuuuucaguuauuuuauaauaacgaaauaaaaagaaccccccagcugccaggcggguuuugguguuugaaaugcggggcaaagcacuacaucacugcaaauagauacagaguuagucugcaugucuguaggcugugugauugcggaaaauauaaaugcugcuaauauauuuccuuuuuacaaaagcauaucuaaauagaugauuguuuugauguuaaucuuuguaaauuauguauuaccaauuuuaacauuggauguaauugcauacaaagcuugcaucucaauccuugaaagucuaguauuaaauggaaaaaacuuuuccuaacugugga

SEQ ID NO: 191304 - RNA, 14091 nt, Homo sapiens
acugauucauacguuuuauuugauaauaguucauuuuauuaaauaauuuauaaagucagaccagugcauugggcuuguuaggggaaaccauuccuuccuacugucacauagccuggcagauuauaucaggugccaaaacauucccuuuuauucaauuuauuaaugagaguguggaauuaaaguagauccuugcaugucaggaaagcugcaacacaucugguuuaaguggagcacaaagguaaguuauuccacauucaccaacuuccccacuugaccucccaccaguuccugucugcuuuuuccaucaaucaacucuaagaugcccuaaacccaaacaguucccauucaacugugcacaaagguauagauauggaagacaucucacuccaacucucaccuuuggaauuaaauaaaccuggaacagggaaggugaacuauggcugaaaccaagugaagauuuuuaagaagcuuugacagaaacauuaagaauaacaccugaaugcaaauccagaaaaaagcgcuacugggggaaaauagucuuagccaauguucuaaaaaugcucauaaggaaggguuggggaauuacccuuuagacacaagcucuaagaacucuggauacaacgggaacuuggauggauacagucugggccugcugggccagauguuccgagggcggcccggcaagcagccugucuugcacauugcaacugacuggcuuaaucuacggcaagaguccuucagcuccgucacagaguacucuccaauguguuauaguuauccuuaaagcucuucaauucaaggaagugcuuggcacguuuacucuucugacuggaggggagguaugucaccuggaugguuguuggggagaccucaggggacugaguuaggucuuuggcugcugacuggugaugucgcugagagcucccaauucgugcuuuaacccugaagaacagagaggggaggucauugacagaaugaggacuaaucaaagaaaucagggcuuaucccaggccauaaaugcagcaauagucacaaauaguuauuuguguccuaucuguccuauuuuguaaacuaguuacuaaaaccccaucuaguagcuuagaaauacaagaggcugagcgcgguggcucacgccuguaaucccagcacuuugggaggcccaggcagguggauuguuugaggucaggaguucgagaccagccuggccaacauggugaaacccugucucuacuaaaaauacaaaaauuagcugggagugguggcgggugccuguaaucccagcuacucgggaggcugaggcaagagaaucacuugaacccaggaggcagagguugcaagccaagauugcgccacugcacuucagccugggugacagagcaagacuccaucucaaaaaaaaaaaaaguagcagagaggcugggcauggucacuuauaccuguaaucccagcacuucaggaggcagaggccagagaucgcuugagcccaggggaguuugagaccagucugggaaacaaagugagacccuaucucugcaaaaaauuagccagguaugguggcaagcaccuguaguccugguuccucaggaggcugaggcaggaggaucgcuugaacccagaauucgaggcugcagugagccaugaaugugccacugcacuccagucugggcgacagacugagacccugucucucucucucacacacacccuaaaaaaguagcagcacuccagccugggugacagaauaaaggcccuguuuggguacccugacacacaccuacucauaccaaaaacaacuagcagcagagaaaccaauuucccagaguucuugccucuggcucaagcuuuuuuuucagagacagguauccccaauauagguaucaccuuguuuugcagauuaggaaacuaaggguccaauaauuagcuuguaugaggucacaaaacuaguuaagugacagaccugggauucaaaccuaaguuugucagauuucaaagccuauacucuucacuaaacccaaugaacauuccuagaaacuacaaaucaaacauaauuuuuuguuuuugagauggagucuuuuucucuguugcucaggcuggagugcaguggcacaaucuuggcucacugcaaccucugccuccuagguugaagcgaccugucucggccucccgaguagcuggggauugcaggugcauaccacaaugcccagccaauuuuucuauuuuuaguagagacaggguuucaccauguuggccaggcuggucuugaacuccugaccucaggugauccacccgccucagccucccaaagugcugggauuacagccgugagccaccaugccuggccuucagaaauaauuuuuaaaaagauugugguaaaauacauguaacauaaaauuuaccaucuuaagaauuuuuaaauguaugguucaguaguguuaaguauauucacaguguugugcaaccaaccuccacauuuucaucuugcaaaacugaaacuauacccagugaacaacucccuauuucccccacucuccagccccugcaaccaucauucuacuuucugucucugaguuugacuaccuagguaucucauauaacuggaaucaucuaguauuuaucuuucaaagaaagugaauuuugaacaggcuucugcugacuucuagaccaaaugcccuuuuccagccuuucuacauguucauuuucaucagugcucuaagcaguuuuuuuuuuuuuuuuuuuugagacagugucucacucuguugcccagguuagagggcaguggcaugaucuuggcucacugcaaccucugccucccaggcacaagugguacacgcaccucagcuccugaguagcugggacuacagguagguggucgccaccacucccagcuaauuuuuuuucgagauggagucuugcucuguugcccaggcuggagugcaguggcgcgaucuuggcucacugcaagcuccgccuccuggguucaugccauucuccugccccagccucccacguagcugggacuacaggcacccgccaccacgcccggcuaauuuuuuuuuuuuuguauuuuuaguagagacugguuuucacguuagccaggauguucccgcucuccugauuucaugaaccgcccgccucggccucuccaaguguugggauuacaggcgugagccaccacaccuggccuaauuuuuuuauuuuuaguagagacaggguuacacuaugaugcccagguuggucucaaucuccugggcucaaguaauccacccaucucagccucccaaaguguugggauuacaaguacgaaccacugcagcuggccuucuaagcaguuuuuacuaggaccuuucaucuuuucgagacagacucuugcucugucacccacgcuggaguggcacaaucucggcucacugcaaccucugcuuccuggguucaagcaauucuccugccucagccucuggaauagcugggauuacaggcaugugccaccacaccaggcuaauuuuuauauuuuuaguagagaugagguuuugucauguuggccaggcuggucuccaacuccuggccucaagugauccgcccaccuuggccucccaaagugcugggauuauagacgugagccacugcuccaggccuuggcccuuucaucuuuuaagacaacguagcucauuuuuagggacagagagaagacaggagagacauaccccuuaagcucuugaaaaagagcaauauucaacauagcagaaaacagauuauuuuuauggcugguaacuaacuguuuauuauuauuuugagauggagucucgcucugucgccuaggcuggaguggaauggcacgaucuuggcucacugcaaccuccaccucccagguucaagcgauucuccugccucaccuuccugaguggcuggcauuacaggugcgcacaucaucaugcccggcuaauuuuuguauuuuuguagagaugggguuucaccauguugguuaagcuggucuugaacuccugaccuuagaugauccaccugccucggccucccaguguugggauuacaggugugagccacugcgcccggccuaaguuuuuacucuagauuggcuuuccuuucucgccaagaacuuugauuuuaacauuugcaugaaaauacgagacuauguuuaguguguauuaaaaacauucccaaacaaaagccaugaauccucuccugugacacaaaugcucaacagcugacucuauagcgauggccuuuguuucagacaugguuacuaauacuuuaagugguaguaaaaauagauuuuuuuaauuuuuaauuuuuauuuuuuuuuugagacagucaugcucuugucaccccagcugaagugcaauggcaugauaucggcucauugcaaccuccaccucccggguucaagugauuucugccucagccucccgaguagcugguauuacaggagcccgccagcaugcccagcuaauuuuuguauuuucaguaaagacgagguuucaccauguuggccaggcuggucuugaacuccugaccuugugauccacccuccucggccucccaaagugcugggauuauaggcgugagccaccgcgcccggccaaaaauagauguuauuuaauucuuuuuuuuuuuuuuuuuuuuuuuuuuuuuuugagauggagucuugcucugucaccaggcuggagugcaguggcgugaucucagcucacugcaaccucugccuccuggggucaagcgauucuccugccucagccacccgaguagcugagauuacaggcacgcaccaccaugcccagcuaauuuuuguauuuuuaguagagacaggguuucaccuuguuggcuaggauggucuugaucucuugaccucaugauucgccugccucggccucccaaagugcugggauuacaggcgugagccaccgcgcccggcccaauguuauuuaauucuuacuuuuauugggccaagacacaaaagggacgcugagacucugaagagaaggaaucccugugugugcugaaaaacuauucccuuugcuaggcuacaccaauuuugacauuuuauugggcuaaacaaaagacaagaaaaaugcacacaagaaaaaugcuaguaaaaacuucuuuuacuagcuuguauaguugcaucugcuuucuuuucuucuuuuuuuuuuuugagacagaguuucacuuuuguugcccaggcuggaguauaauggcacgaucuuggcucaccgcaaccuccgccucccggguucaagagauucuccugccucagccuccccagaagcuaggauuacaggcaugcgccaccacgcccggcuaauuuuguauuuuuaguagagaacgggguuucuccauguuggucaggcuggucucggauucccaaccucagaugauccucccgccucggccucccaaagugcugggauuauaggcgugaaccacugugcccggccgcaucugcuuucuaauguaagagacugaucuaauagucuagaaccugacaacucuuaugguaucauggauuuuguuuauaugcuuuaugaaggucacugcacuguggcaacaguccaacacuacuguaccagcucccucugacacguuccccuccaaacucacgcaguggccagcucacucagggccuccugauagcguagguacucauucuggccaaagaccuuaggaaagagaaaggaagagugaggaucucucagucugagggaucucuuuagugccccgaagaaaaaacuggcuuaccccugucccauagcgggcuguuucauagccauccaaaaggguaucaaugagugcuuugcguacacccuugaaaggcguacuaguguuucgcagauccagcagguaggagcggaaauucuugcccauuaaggaacggggaugccggccuucagaaugaaaugggaucucuguggagaaaacagcacaaugauaucucuucucauucuuuagucuuuuuuuuugagauggagucucgcucugucacccgggcuggagugcaguggcagugaucuuggcucacugcaaccuccaccuccuagguuugagcaauucucuagucucagccuccugauuagcugggauuacagaugugcaccaccaugccaggcuuauuuuuguauuuuuaguagagacaaaaauacaaaaggguuucaccuuguuggcuagguuggucuugaacuccuggccuccugugaucugucugccucgcccucccaaagcguugggauuacaggcaugagccacugcgccugccccauucuuuagucuuucuaguuaauuccccaaacuuagaaguaggucuaaugaagcugggcgcaguggcucacgccuguaauuacagcaauuugggaggccggggcaggcagaucaccugaggucaggaguuugagaccagccuggccaacauggugaaaaccugucccuacuaaaaauacaaaaauuaaccaggcauggugguagguaccuguaaucccagcuacucgggaggcugaggcaggagaaccgcuugaacccaggagguggagguuguggugagccaagaucgugcuacugcacuccagccugggcaacagagcaagacuccgucucaaaaauaaaaagaaauaggucuaaugaaaugagcaaguugaguuagagggagauucugauugagaccaaagguauaaagcugugccugaguggucauuuggugguaacaccacaguuguaagcuacaucuaugacacaugauagugucaucacacauuuuaccauccugcuuacucauccauccuagguuuaagauauaaacuguuuucauagagauaaagcauauaugacaaguguugacagaauggaaaaaauucaagaacaaucuaucuugggcuuagugaaaaagcaggugccaccuguccuuuguggaaaaacaagcaaauuacuaucaucuacuucaugaaacuaaaggucucaagagaagaacuuuaaaaaacaaaacacccagacucuuuggagaauaaccugcuuauaucauuuccuucagcaaaaucucuaaucuaguacuuucaaaacucuagaauuuccuacuagccagggaugugcagaaaggacaaauccuaacauacaaaguggguucauuacucuguucccuaggugggcuuucaggauccuagaauggacccugucagguagcccuuaccagagguacgaauggcauccagagcuuucauccuauacagauaguuguagcaaccuguugaggaaaagacugguguuaggcauaacccuaaaaauauuccccaggcugggcgugguggcucaugccuguaaucccaacacuuugggaggcugagguggguggaucaccugaggucaggaguuugagaccagccugaccaacauggagaaaccccgucucuaguaaaaacacaaaauuagccaggcgugguggcgcaugccuguaaucccagcuacucaggaggcugagguagaagaauugcuugaacaaggggguggagguugcagugagcugagacugcaccauugcacuccagccugggcaacaagagugaaacuccaucucaaaaaagaaaaaaaaaauuccccaaacuccagcaagcuaauaaaugggcucugcaucuaacauauauccaauaacaggaauaacuaaggcuuugccagcagcuuuugacaacucugagagaaaaggaauucuggacuugugggacuccucacugaagcauuccaagagcuugccacauacuuugauuucccuggguuuccaguuguaguagucuagcaucaucaucugcaaggagcuggggcucauacuugauauccugaacccuggagagucgaauaucaaucuccucuuucaaguccuguucacauaaaaaaagaauacacaaucauuuacccugcacucugcuuuccaccaaugugaaaauggggcagaguuaaugaauaacuaagacaacagaaauagagaccaugcucauguaguuaauaaaauuaccagauaagagguaagaauuuaggaaagaacgggauuggguuuuccaauaaccucuccaagcugcacaucucuaagcuagaacauuuaacuugugccagaaauccuucaagcuauacagcaccaacauuauuuccaauuuuuuuuuuuuuuuuuugagacagagucuugcucuaucacccaggcuggagugcaguggcgcaaucucaguucacugcaaccuccgccucccagguucaagcaauucuccugccucagccuccagaguagcugggauuauaggcgcguacgaccaugucuggcuaauuuuucuauucuuaguagagaugggguuucaccauguuggccaggcuggucucaaacuccugaccucaagugauccgccugccuuggccucccaaagugcugggauuacaggugugagcuacugcgcccagccucucuugccucagccuucugagcagcuaggauuacagguaugcaccuagcuagaggcuacuuuaaaaaaaaauuaacacauauuucuuuuaaaauagccaagucaaauucaugguauacaaauuuuaaagauaguaaaggggccgggugcuguggcucacgccuguaaucccaacacuuugggaggccgagguggguggaucacaaggucaggagaucgagaccauccuggcuaacacggugaaacccugucucuacuaaaaauacaaaaaauuagccgggcguuguggcgggguccuguagucccagcuacucgggaggccgaggcaggagaauggcgugaacccgggaggcagagcuugcagugagccgagauugcgccacugcacuccagccugcgugacagagugagacgucuccaaaaaaaaaaaaaaagauacuaaagguagcaccucucaguuacccagcagcaacuacuauuuucaguuucauauuaaucucucuuaccuaagaggguuaccagagccccaggaaauaaauuuuuuguuguaacuuuuuacaaacucccauugugaaacauaagauacacaaaauacagguaacauagauguacauuuuaaauaauuauaaaaagcauaauaaugaacaccuauaaccaauauccaguuuaugcaauggaacauuaccacuaacuuucuuuuuuuuuuuuuuugagacggagucucgcucugucgcccaggcuggagugcaguggcgcaaucucagcucacugcaagcuccgccucccggguucacgccauucuccugccucagccucccgaguagcugggacuacaggcgcccgccaccacgccuggcuaauuuuuuguauuuuuaguagagacgggguuucaccuuguuagccagguuggucucgaucugcugaccucaugauccacccgccucggccucccaaagugcugggauuacaggcgugagccaccgcgcccggcccuaccacuaacuuucaagucuugugugcccaucccucauugaaugcuccgcaccccaaaccuuaacuugucaauaguccucauacacuucuucacuguuuuaucgugucacccuaaaaaagaugcuuagcuuugccugguuuucaacuugauacaaauggaaaaauacuuuaagaaucccucugcaacuuguuuaaaaaaaaaauuuuuuuuuuuugagacagggucacacucugucacccaggcuggagugcaauggcacaaucucagcucacuauaaccuccaccuccugagcucagaugauccuccugccuuagccuccugaguagcugggguuacaggcacacaccaccaugcauggcuaauuauuaaacauuuuuuuuuuuugagauggagucuugcucugucacccagacuggaguacaguggcaugaucuuggcucauugcaaccucugccugcuggguucaagcaauucuccuugcccuccugccucagccucccaaguagcugggacuacaggcgcaugccaccaugcccagcuaauuuuuuguauuuuucguagagauggggucucaccaugcucgccaggcuggucucaaacuccugaccuugugaucuucucaugugggccucccaaagugcugggauuacaggcgugaaccaccgcgccuggcccauuuuuaaacuuuuuauagagacaggguuuccccauauugccuacgcuggucucgaacuccugagcugacgugaucagccugccucggccucccaaagugcuaggauuacagguguaaaccaccucgccuggccuuaaauuuuuuuuuuuuuugauacagagacucacucugucacccaggcuggagugcaauggugugaucucugcucacugcaaccuccgccggggcucaagugauucuccugccucagccuccugaguagcugggauuacaggcacacaccgccacgcccagcuaauuuuuuugcauuuuuaguacagucgggguuucaccguguuggccaggcuggucuugaacuccugaccucaggugauccaccugccucagccucccaaagugcugggauuacaggcguuagccaccgcacccagcaaaauuuuucaaauauacuuuauugagguugaauuuacauacaauaaaugcauucauuuuauguauauaaauugaugaguuugacaaaugaacauacccccuucaccaccacgucaaucaaaguaaagaauauuuucaucaccuggaaaucuccccucucccagcccaggcaacaugauguacucuuuuacaguucugccuguucuagaauuucauauaaaugggguggaagcacaugguacauauucucuugugaacggcauuuuggcuuucuucacucagcaugguuuuuuuguuuuuggugagacagagucucgcucugucacccaggcuggagugcagugguuugaucucagcuuacuacaaccucugccaccuggguucaagggauucuccuaccucagcgucccgaguaguuaggauuuuuuucuuguauuuuuaguagagauuggguuucaccauguuggcuggucuggucucgaacuccugaccucaaguguuaucugcccaacucggccucccuaagugcugggauuaccggcaugagcuaccaugcccggcccacucagcauguuuuugagauucauguuugcaauuuuuuucauucagaaguauuuugaggacuugucuucauauauuuaucuucaguuuuucauuuuuuacacuauuccagaauaugaauauaccacuaccuauuuuuuagaaacaaggucuugcucuugcccaugcuggagugcaucagugcaaucauagcucacugcagucuguaacuccugggcucacaugaucuucuggccucagccucccaaagugcuaggacuacagguaugagccacugcacucagccuauauaauaauugaaaaguggacauuugaauuaaguuucuucuucaaauauuaugaacaaugccccuauaaauaaucuugcacauguuucuugguacacaugagcaaaacuuaauuucucuaugguaggagagaaacuguuggaccauggauuagguacaugugcaaucuuaccagacaaugaccaguuauuuuccaaagugguuuuacuaauuuauacuuucacuagcaaugguugagaauuuagaaaaaauuuuuaagcaaaaggaauauugcucugaacuagaccaagggaccccugaauagccaaaguauugauugguucaugaugugcuagaaacuaacccuaugucuuucucaugaggcaggcaggacuguuaagguuucaagccaggacauccuccuagagccuuuucauguacuaugucagcaaagaacaaagaggggaagguuaauagcacuuguuaaugaaaguacagugcucuaggaguugagggagucaugagcucuagcucuacaacuaaccuguuuuucauucagcaacaaauuacagaguaccugcuauguguaggcccuggcacuaaccuguuuuucauucaacaagaaauuacugaguaccuacuauguguagguccuggcuuuauagucgugaacaaaacuggcauggugccugcauucuugaagcuuacggucuagcggaagagagaggcauguuuuaaacaaauggacaaacauaaaaauuaugguaaaugcuaugaaggaaaaaucaggguaccaugugaaaauaaagagagggggaaccuacuuuaaaauagguaauaagcauuccuuuuuuggaaguaacauuuaagcuaagaucaaaagaaugaaugagcuagccaauugaagaccauuccagaucacaggagcaaaaaggguggaaaauucagccaguggagcugggucccagugaucuggggagagccacacaaaaggggguugguaagggaagcaggugucuuuuacuuagaagcgaaagacuaaagaagcagaaugagaguggcagugggauagcaauaauucugauucacaaauguuggguuugagaugucuacuacaaaucuaaguggaaaugucagguaaucaguuggcaauauauguaaggaacucaggaaagaguucuaggauagagauaaaauuucaucuguagcuaaagccaaggaaaggaagacagucaccuaaggagaaaguacagacaaagauaaaagaccacuggguuauucacuuccuauacgucuucugguaaacugccuccuuuucuugggcuucuugguaacaugaaugguggaauuagaugauuuauggagcuccucuuaagucuaaaauuauguaaagguaacccuucucauugcucuuggguuaaccuuaaugaucucaaccccauccuaaucaaacaaaaaacacuggguaguuuaagaugagcugggaaauauuuuacuacaaacaguugggaacuucgacccaagcccuucauucugcagauacaaaaacagaaguuccaggaugagccacaugcuugccacagcacugagcagguaagccaaguuccaaagcgcacagugccugcucaacuuaguaaguacaaggacaagugcacgcaaagaaacaugagaauuaaagucaucacuaaaggcagaggaaaucucauucuugacccuaaaagaucuggagaaguauguuuaacuugugcccuaaggaccuaccuugggggcauugugucccacagggacaugagguccccuucgagauuucauugcaaagcgcaugauuugccucuucacaaaaauaaauagcaguacaaacaccuguccaaaaagauguaaaaauccuuuaauaaaaagucaguuuuguuuuguuuuuuuuuuaaaaaagcaugccuucauuccaaauccccagauuccggcucucaggaauguuucaggguaaaacuuggggcaaagcaaggccguuaugauggggguggaucuaagaagccagcagcagggaggcguggggucugugcucuagcguuaaagggaggguucuagacuaacgagggcgggucggcccgacuaagugacuuaaacucccaccuacuccuggaauaaggagucaaagcccggauaggcgcaggugaguggguggagaaugcagacgggguacagcucaaaaggagggucucuacuggguaagaugcgacagcaggaauggggugggguaaucuccucaccaggcucccguaggccaucaccagcacgacauucaccccggagagccaguuacugccggacgccauggccucccuaccucgcgcagaauuguucggguuuaccccgcuguccuggcuggucagcccaggcuccgccgaagcgacggcgccuggguccccuggagcuccccggccauuuccuuacgggggaagaccaagccagacccggccugaaaacauggcggacaggcaggagagcugggaaaggagaacgacgccuuccagcuucccccugacacgugacucaggcaggcaauggcacccaggagcgucgagcgcucagacgcggaacuacgacaguaagaggaagcggcggccauccgugcgucacgugguggaggcagggccgccgugaaggaggcgggguggacucgcggagccggaaagaggugucucguggcgaggcggcacgcgcac

SEQ ID NO: 191305 - RNA, 3707 nt, Homo sapiens
acacagcuucuccacuggaucaucgguggcgaugaaggggcggcuggggaaggaugucagagaaaccagaagcuugacggugaauccucggguuuuaaggagagagcaaaguccugagagggcgacguauugucccugcucaccuagcccagaaugaacaaacacgcgccagccagggagcagcgagccgagaauucggacgagccucugcaaccgccauuugccguucucgcaaagacuaccaagaccacaaugcaacggggcgccgagcuaauucccagugagcagcaggcgaggcgccaccgacgcggaagacuauaagccccagcgggcgacgaccgaacgcccccgggaacaccgggccccgagcucggucccgcgcccgaggauccuccacggggcuagauggcugcgucgggggcgggagcggaggugagcgggcgcuagggccgcgagcccccgccggcccuuccuccagcgcccugcggaccccgcagaaggcgcucgccucccuagcccgcaaaaacauaucgauuuuucucgcuguggcaacggggacguccugauagauccucugcuccaauaggcaacuccggccuucccugcccugaccuggaaccucugggagggcugcagaguaagugccgccucugcgcuccgacggaggcacgaggccuguggaguaggucccucuguuccgacaggugcgacacuuggcgcuccaugcuugcgggugccgggaggccuggccucccccagggccgccaccucugcugguugcucugugcuuucaccuuaaagcucugguaaggaggagguaaggggagggaaaaggaggucacuggaggacaggaucguucccggccucggggcugggggagaucuuauccauggacagcgcaggagggggugcccuauuuucuggguuuugacuuuugucccuucccccaacuccgcuacagccaagcagaggcucccgugcaggaagagaagcugucaggugggugauugucugggaacccgacacgucccgucguuuguuuuugguuuuaguaucuuccccauauaccaagagcacagguggaaaaggccggcaccacauggaaugagggcaagcgcugugccgggaaguuggaugggcagagccugggagaaauguuuucugaauggccuggggcuggcauuuaucuuuccuuucagcaagcaccucaaauuugccaugcuggcugguggaagaguuugugguagcagaagagugcucuccaugcucuaauuuccgggcugugaguaucuauuucucuacccuuuuuuuuuuuaaacaucuaagcaaacacuuaagcaacaucuuaacauccaagucuuauuaagcugccuuugcaucaucuuuuuuucuuucuucuugcagucucaguguauguccaaaucuguacuugucuuuccccugaaaaugugccccuuucuuuccaagcuaauggcaguauucaacugauaacuaugguuuuuuuguuuguuuuugagacggagucucacucuguugcccaggcuggagugcaguggcgagaucucggcucaccacaaccuccgccucccggguucaagcgauucuccugccucagccuccugaguagcugugacuaaaggcgcguugcaccaugccuggcuaauuuuuguauuuuuaguagacucggguuucacuguguuggccaggcuagucucuaacuccuuaccucgugaucugcccgccucggccucccaaagugcugggauuauaggcgugagccgccacacccggccucaaauaacuauguuuuauucacuuuuaguauaguaggcucuggaauggaauguaucuuugccacuccuagacuguugccccugaaguguucuaacauacauucguaaucaugcaaccaccaccuccaccauccgcaucagaacucuuucauuagcucucuguugccuaccacuccaaaccauagcaguugggcaccugcaccuucugaauggcagccuuuuuguuuauccuguugccccuuccuaacauguacuuugcuccuuuucuccuggcagaaaacuaccccugaguguggucccacaggauauguagagaaaaucacaugcagcucaucuaagagaaaugaguucaaaaggugagugcuguuucucuucucugagaucaccuccuuugcuccuaugacuuuagauggauggucccaccuuuuccccuggucuggggguagcauggaauaucugaaagaagagggggccgggcucacaccuauaaucccaguacuuagggaggcugaggcuaacagaucaccugaggucaggaguucgagaucagccuggccaacguggugaaaccccaucucuacuaaaaauacaaaaauuagcugguguggugggugcccauaaucccagcuacuugggaggcugaggcagggagaaucacuugaacccaggaggcagagguuagagugagccaagaucaugccacugcacuccagccugggcaauggagcgagacugugugucaaaaaaaaaaaaaaaaaaaagaggcugggagggguggcucacgccuguaaucccagcacuuugggaggccgaggcggguggaucacgagguuaggaguucaagaccagccuggccaagauggugaaaccucaucucucuuaaagauacaaaaauuagcugggcaugauggcgggcaccuguaaucccagcuacuugggaggcugaagcagaaaacugcuuaaacccgggagguggagguugcagugagccaaggucacgccacugcacuccagucugggugacagagcgagacaccaucucaaaaauaauaagaaagaagacgggauuuggagccaaauuacuugaacccaagucccagcucuacuccucagcacuauguuauuggccauauuuucucaucaguaaaauugguuaauacuagcucugcuuauccagagaauaaauuaaaugaucuauuugagagggauuuauguacuauacacacaauagaagccuggcucugauuuccucuugaguguauccuggcuaggcugaaguagaagggaaauuagagggagaagcugucuggccuuccuugggaauaacuauuccuuccugcccucagcugccgcucagcuuugauggaacaacgcuuauuuuggaaguucgaaggggcugucguguguguggcccugaucuucgcuugucuugucaucauucgucagcgacaauuggacagaaaggcucuggaaaagguccggaagcaaaucgaguccauauagcuacauuccacccuuguauccugggucuuagagacccuaucucagacagugaaagugaaauggacugauuugcacucuugguucuuuggagccuugugguggaauccccuuuuccccaucuucuucuuucagaucauuaaugagcagaauaaaaagaguaaaaugguuuccuucccuucuguaacuuggagcaggaagucaugggggcagagagggaaaggaggugguuacuuaaggccccaaucuaccaagucuuccccaccacuucucccuuguuuucccccucuucuacuacuuauuucaaacuucugggauacaauuucagcuaaaacguuuauuucucacucaaaacuuauuuccccucaacccuauacccaaagaagaaauaaaaucacagauacauaacagaa

SEQ ID NO: 191306 - RNA, 15293 nt, Homo sapiens
cgguguccaaaacaaaauggccgccacguccagugcuugucugaccggcuaaaauggcgucuacgcaauuacgucaggcgucagauccgcgcacgacuagagggcgggaaagauuugagcuacgccugcgcagaggucagaggcggagccuuagggcgaaggcggggcuuuccaugcagugccccgccccuaggggcguggccaaugguccuguuguuggggcgugccggggacuucacguuccaguagugguugcgcugcaaccucuuggggguaguuauuaaugugggccuuagaggggauuugggucccgaauucccucgccccuccguucccuagccaagguacaccgucuaaaaaucuuuacgcggacuugccucgucuucuuccggacaauugggccuggggaauuugcacugguuuuccccucauggccacucgcccagucugagaguugugaagugccguaaaugcuccagccaaggcccaggaggccaguauuaggagcaaauuccucucccauccugcaccggccaacaccaccgcccguccauguuuuccuccucacuuccuccccuccccaacuuggccuagauacuguuuacuccuucuugggguggggcaccuuugcguccucgauugcguuuccauguccuccccccacaccugccauccguguuuauuuuguugcagaccuacauagggauuucucuuuucucucucugauuuguuguuguuauuuugagacggggucuggcucuguuguccaggcuggagucaguggcgcaaugaaucacggaucacugcagccuugaccuacugggcucaggugauccucucaccucagccucccgacuccuaggauuaugggcauaagcuauguuuccugcucaauaagggauuuuucucucuuucuuuuuuuuuucuuuuugcagauggagucucgcugugucacccagacuggagugcagugguaccaucucggcucacugcaaccuccgccucccagguucaagcgauucuccugccucagccuccugaguagcuggaauuacaggcgcguaccaccaugccccgcuaauuuuuguauuuuuaguagagaugggguuucaccaggcuggucuccaacuccugaccucaagugaucugcccgccucugucucccaaagugcugggacuacagucgugagccacugugcccggccucaauaagggauuuuucuaaugacuaugugcacaauacaguguacauauguuugaggaaugagagaaugacacaucugcaacccuuccucugcuccacuggcacgucaagacccuuucauuuuccuuccuggcacuugggcgugugcguguguguauguguuugugugugucuguguguaaguaauggcccagcauccuuacccaugugaggguaaggaucgugguuauuuugcuuaaugcuggagccucaguuccuacaguguuuacacauaguaccacuuaaguaaauguucguugauugaaagaagauucuuucggccuagcgcgguggcucaugccuguaaucucagcacuuugggaggccgaggcggggggaucacgaggucaggagaucgagaccauccuggccaacauggugaaaccccgucuguacuaaaaauacaaaaaauuagccgggcgugguggcaggcgccuguagucccagcugcucgggaggcugaggcaggugaaucgcuugaaccugggaggcggagguugcagugagccgagaucgugccacugcccuccagccugggugacagagccagacugugucuccaaaaaaaaaaaaaaaaaaaaaagauuauuucuuccucugguuuuauaguugagaagcugaugucuccucgacuuccaacuggaaccuugaacccccacauuucuggaccuugagcauuccucaaguaggaagauguaaugcaccuugaccucuuucuaaauaagacacuuccccaaauaaggggaguugagagugaacagucuucacgucuccacccacuuccagaucccagaggagacagacaucggauggcuggugagagagaagccuuuaaugaaagaugaguugcaggcuuggaccgcuacucuugcgcccuugguggggguggggguggggugggcaagggugggguuauggagagggauaaguggggugagguggaagcagggggaagaggcaggucugggaggguggagaggaagggcgcugcccaauguggcugucugcucaacuguucucccagaagaaauuguuacaggccacugugagagcagccacaagcaccacauacuccuggaaguccaccuccccgucuccauucucgucuagcuccuucaucaccuuguccacagcauccacauccuucugggccuguggugggaggagaggaagagggagguguauagggaaggguacagcacugagucagaggcaagggggugguugaggagcaggaggcaaagaugagcgagaggaacugcauugaauuaugggacucuucuaggccuccucaaaggucuugagggcuucuguugccuacagcauaagcucuuucaccuggcagaaugaauaauaaugacaccaguuaccguauguucagugccuauaauaaagcaagcacuacacuaggagcuuuacaagcacugucuaauuuaauucuaauacaaauaaugugagguauguuucauuauuuccauucuagagaagaaacaaauugguaaucggugguuaaauaaauaugcccaaagucccacagcuagaaaguagcagggcuggaauuugaacccaguccaauaaaaccucaaaaccggugcacuuucuaccguauccugaggcuucuuuacuuuggggcccugguuagccuuagcagccuaguuuucuacauccuucaugccaguugaaugaaacuacugacaugcuccacauucuucuuucucccaugcuuuuguucauucaguuaccuccuccuaaaaugucugcauuuacccagauaaucuuccaauggaaauccaugguucaagugccaccucuucaggaaagccaucugacuucaaucagguuaauaaucucucauaacccuuucugguacaucuguuaaggcucuguguauuuccuggaguucaugguuuacuuuuaagugucaaucuuucccuucuaagucugugugucuuauuauugaugaaucuacacagggccuaacacuuaacaggugaucaauaaaccagggcauuuugacuugacccaggaggaguaggggagccuggaaaaacccaggagagaagccugggaaaggaaagaaagaggcuaggcugagcuggaggugggguggggagauagcaaggggguguccaccccauucccccaaccuucacccacuccacucccacuccaccacucuaugcucacauccaggaagccagagagcuccgucugcagcagcucuuucagcuccuucuugcucagcuuguacuugucccccucuuugcccgagugggcguggaacacguugaugagggucuccaucgccgucuccagcucagagcccauugcagcagugcaccuacccacccccaucauggaagugagcugaggaccaggcccggaguaccuggggucuaggugaggggaacccucaggacuggcccuggcugacagcucaaauagcugugggauuagagcccuacugcaauugaucuuucccugagauuuuacaaugugagggaaaccccaagagaccuaagugcaggccuguucucugugucccucagucuguaccccagccagagggaaucaggguuggggcauggagagagagcaguuggagcugggcuggcuccagaggccugugguagaugucugcaguggcugcccaggcagggauugaggaggguggggcaggcagggguggucacaggacugggccaugcuuccucuggcucuauuuuuacccuggaccuugccugucuagcauagccaagcucugcuguugaggguggugggcugggguguccacuacagccuuccuucugcugcccaccccuagcaaggagucagucugguacccucggucagccugguagaggggauggcagccccaguggguggcguacgccuucugggggagggaggucucacugacucugaguuuccugucagcagcugggggccccuuuugguccuucaacucuguucucuccugaacaugucauuuuggcuucuuugggauaugcucccauugccucugcaaaauuaucccuuccaucugguggguggcagaaggggagagaggaaugucugagccuuuuccuuggagccagaguucccagggagugggagaggagaccugcaggcguugucccugcaacugcucacuccugguugauucggggauagugggagcaaggggaauggggcugcuguguguugggggagagaaagggcugaaagcaugcgguccuuugaguucaaggggcugggagagaguaggagaagaaaggagaaaggaguggucuguugagagagaagacugccaagccggggggccucuuucccuuggcccugggacagucuggccuuccacaaccccagagggggcagcucaggugucucggaucagauguccccauccuuccccaggccuagggggcuggacaauggccccugaucgaaugacaucccaguucuucaauggggcccuugugagugucaucugaacuccggaccugagaagcaguugucacagagacaugggggagauggaacccaagcuguggcugaugaggggauaaggggugcuugagggaggggugcugguagcuugauuaccugcuccaugccagaggggcagcuggaggucaccuggagcccuaaagcagccugggauuuuacgugguggcaguucugagaggacuugggggcaggggagauggggaaacaaagagguaagaauggggggaaagaggagucaagaggucugggccaaaaaugggaggaggagaaaggggagguccuguggaggucgaguugggaaggggcacagcacccuacaucucugcuuccccauaucaugggagcuuugcccugccacccccagacucccccgggaccugagcucuuggcaaggcaggguggggguggcagagacuaaggcuggcaggagaggugggggcagaaacagcuguuguaucugcucucuucuuaccccacaggaggcgaggcaggggagggcugggacccuucccaacaccugggagacagagggggccuuggcagggacuugagggcucccugugggagggccaggcggucaggaagcucaugguggguuccccacuggcuuccuccuuugcugagcugccagcucucucuccgaccuucaguucauuugucucucaucaccaccuuccaaacccugucucccccaaaucccaaacugcccucacccugacugacuccucccagauccucagugcuccacagugcuaugguccccagccucuuggagcccuucugaagaccccucucccugaagcuggcaggccagggacuagcccaguggggcaggguacucacgguuggccugggccugaggugggagcagguucuggacagauggccaagguugcaaauguggcugcuggagcuguguguggagaccugucuucaacagucccucccccgcugacccccccaccgacuccaccccuucacagacgaacacccuguggggcaaggggccaggagcagacagaggcgcccucugucuccugggcuggaacaggcggcccuugucucuuucccagccuugcuugccccguuccuuucucuccaggcagcaguggauggugcaggggaaagaggugggaaggagguccugggagggacacuggaugucuuaccccaagcugggccuugcaguaccuguggcuggcugugcugguugagcccgguaaggggggaauucugcugagggggucuuagucuguggcuccuccauggggccucacugagaggacccucagugagaaacuuagucuugggagucugagaacccacagagggauuucaauccaggacucuucucugggggucucaaccuggaucccccucuguguguggggccucagccugggguucucugagggaucuuggucuguagcauccuuugugggaucucauuccaaggggccucugugugugucucagauugggccucucaguguugagcucccuugauugguugccucccucuuccccccucagcauacacacuccugauuagacauggguaugguggcagcagcccccaguauugagaggacuaggacccugggaccccugccgaacgagaucuguccaggcagcuccucucccugaccaagugggggcgcucguguggcuggcagggagcccggguccagaccugagggcucagggcaagcggccugauugggcugucucuggucuucagaaucgaccacggaaauuugacaccuccgggcuuggaagcagcucucuccuccuuccccgcugcuuauaaaccucagcccugaggcuccagcucacucuaccccaucuccuugccgggugagucucauggcugacccuggagggaggcuggagaucauuuuuucuuccugggcucccaggucccucccccagagccagcucagacaggaauucaggaaggagcuuuggaugaucgagcaacagcgcgugcaggagugugugacgggguggacagaaaagagaaugccucuuccagccccacccgccgcaccccaggggguugugagugccuguacuaaacccguccuggagcagggagucagagacgccccguuccaggacccuugucaccgggagacaggagcggggaggaucugugggguccuggguucagcacucugcccugcugccgcugaggagagguaaggguggagcggggcagagaaaaugggucuguucagacggagccagcucugaccacaggggacauuugccagacccugugcuucucugcugggaggagcgguuagagugugugugggcggaugcgaguggccggagaccagggcccaacauaaacaagcuuuggagacaaacaaccuuaugaccugugagucugggugagacaagaagggauucuugagacagacacgccacagaggggccaccagacuugaaggacuccaagaaggaccuucaacugaagaccuccucucaaguagaggggucuccagaucgagggaucaccacagaggggucccuaagccacagacauuuaaaaaggaucccggauugugagaccuacagaagaggggguuucuggagcugaaucuccugcccccaccaaaacugagaugccguugccuggucugcugccccaagcucaaccccuguccucucccucuuuccccauaugcccccuccaggcugagacugaugugauaacaccaaggcagggaccuucugaaccauuccugcaucuuggggcucccugacucucccucucugcuccuucucucuuccacaggucagcccugacaaaggucagcuagccccuugaggacaucagcuuuggccucaggguccuaauggcagcagaaccacugacagagcuagaggaguccauugagaccguggucaccaccuucuucaccuuugcaaggcaggagggccggaaggauagccucagcgucaacgaguucaaagagcugguuacccagcaguugccccaucugcucaagguaggcagaagucugggacugagauuuugugagaugaugauuaugggacacuguguuuaggacgugauggugccgaguacggugaggugaccacaagaaaggguguggguggcugcaugugucaaugguugcagguuuucuuuuguuuuuucgagacaaagucucacucuguugcccaggccggagugcaguggugugaucuuggcucacugcaaccuccaucuccgggguucaagugauucuccugccucagccuccugaguagcugggauuacaggugugugccaccacgccgagccuauuucuguauuuuuaguagagacaggguuucaccagguuggccaggcuggucucgaacuccugaccucaggugauccacccgccucggccucccaaagugcugugguuacaggcgcaagccacugcgccugacccgguugugaguuuucuugccugguguguacauguguguguuuguguguccaugcauauaauuagguaagcaaagauacuaugugccagugggaguauggucuugugucagaagaugcuguuggguucuuguguaugcucugugccuuucuggucuaauuuccccaagacaggacuggacccagagcuggcuuccaggagauucacagacugucagagcuggaaggaggccaagagaaaacacaguccgcauuccucacuucacauauauggaaacugaggccuagcaguggaaaggggcuuaucaaaaaugaaaacacagccaaauucauggagucauagaccucaguguagggggucugugggugcaucugugaagacucccuacccgcuaugggcauccccuuacuaggguguaagagucauuccuucucucgcacucacaggcuggagucaggucuuaaauuucaucgacucuggccucgaagaggccuggucauucuggcuguugacaguuuguuuuacauccuuucugaaaauccacaggcacguugaagugugugaauauggacuccuugaacacagugagucucugaaacucauggucuuucaucugcaaaauccccuacaacuuccaacuucucagacuuuuuuuugagacaggguuucucacucuguugcccaggccacugugcgaucacagcucauugcauccuugaccuuccgggcucaggcaauccuccugccccagccucacaaguagcugggaccacaggcgcaugccacacugccuggcuaauuuuuucuuuuuuugugacagagucucacucugucaccgaggcuggagugcaauggugcgaucuuggcucacugcaaccucugccuccuggguucaagugguucucuuaccucagccucaugaguagcugggauuacaggcaaccgccaccaugccuggauaauuuuuguauuuuuaguagagacgggguuucacuauguuggccaggcugguuucgaacuccugaucucaggugauccaccugccucggccucucaaagugcuggaauuacaggcgugagccaccgcgccuggccuaauuuuuaaguuacuuguagagauguggucucucuguguuucccaagcuggucucaaacucuaggccucaagugauccuccugcauuggccuuccaaaguguugggauuacagucaugagccacugugcccagccagacguuuccuuuuucaucuuuuuuacuggaaacuucagguucucuccugaagggacagcauuccuuauauccuugucaagcagugauugugguuuuuuuuuuuuuuuuccuaaauucaacuuccucugggccuggaaauggaggaagugaccucucugcuuuccauuaucucuagauuuuaguuucuucuucuuucuaagacuucccagcgccuuggaagaucaucugccaccugccauucuucuuauugcgcuccuuacagcucuucagcuccuggcucacuguuuucuucucaucacugcuucuguuguuauucucaguggcuucagcauccgcacagacaauucauccaacaucugggccuuucaauuuucucaacuccucauuuccaaaaagauuugucuucuuacaucucagcaucccacuccucuguucaugcuuuagacugugucauuaacaaaauaacgcacaacuuccaaaaucuugauuucaaguuucccuuuaucugcugaccuccuccugucauuccaguucuguuccccucucuagcuucuccacuucagcacuucccugacuccucagguaccuucagucucucgacccucucacuuuugcaucuuccaucaacaucccucggguccucauugcccuuccuccucaccucagguucuaaggcuucuaauuguaaucacugccuuaaccccguugauucugucucucucuguucucaacccaguuaauccaccauuucaccuauaguaacuugccaguuaaauccacuguucugcaccugcacuuggauagcugaaucuggcuggagaaaaaugcauagcuuuguugacuugucucacuuuaaaucuauaaccacagaccccaaaagggacccuuggcaauaccuggcgguucuguguuucccugguugauucauuuaccaguucuuucagauaauuauuucacaauuugucuucucuccucaaagcucaguacaucuuuccacguucucccuuuuccugagaaguuuacucacugagaaguucaggacuucgagaccagccuggccaacauagugaaaccccaucucuacuaaaaauauauuuaaaaaauuagcugggcaugguugugugcgccuguaaucccagcuacuugggaggcugaagcaggaaaauugcuugaacccaggaggcagagguugcagggagcugagauugcaccacugcacuccagccugggcaacagagggagacugucucaaaggaaaaaaaaaaaaaaggaaacgaaaauaggagcaaucaggaaacuuguaugugcucccuccccgaaaucagcagucuucuguuaugcaaaugauacgucacugccccuaaggccaacccuucacuggugcccuggaucccauccccucucacccacugcacuccagucugggugaccgacagagcgagacuccgucucaaaaaaaaagacuuuccucuugaaauuacuccucucuuucuuguguccucaaauuuuccuucuccacuguaucguucuuaccagcuuacaacugauaccucuuuuuuuuuuuuugagacagagucucacuuuguugcccaggcuagagugcaauggcgugauuacaguucacugcagccucuaccuccuacgcucaagugauccuuccaccucagccuucugaguagcugggacuacaggcaugugccaccaugucuggcuaauuuuuuaauuuuuuuguagagacagggccucuguacgugugcgugcauguaauuagguaagcaaagauacugugugccagugggaguaugggcuuguaucagaugaugcuguuggguucuuguguauguucugugcuuuucuggucuaauuuccccaagacaggacuggacccagagcuggcuuccaggagauucacagaccaucacagcuggaaggaggccaagagaaaacacaguccccauuccucacuucacauauauggaaacugaggccuaauuuuuaaauguuuuuguagaggcagggccucauuauauugcccaugcuggucuugaacuccuaggcuuaagugauccuccugcccuggccucccaaaguguugggauuacaggcaugagccacuaugcccagcccaauccuuuauugauggaaauuuuucuuauguccauuucuuccuucuugcaaauaucuguuuguauaccuacauacugguggaaaaauaacaacauaagguaaauguuuggcaguagaaauauuagguuaaguggcauguucauuuuuaauuuguuuuugagaaaggaucuugcucuuucacccaggcuggagugcaguggcaugaucucgggucacugcaaccucugccucccagguucaagcgauuuuccuggcucagccucccugaguagcugggacuacaggcuugugccaccacgccuggcuaauuuuuguauuuuuaguagagacgagguuucgccauguuggccaggcuggucucgcacuccugacuucagaugaucugccugccucggccucccaaagugcugggauuacaggggugagccaccgagaccagcuuucauuuuuaauuuuugugauuaccaauuugccuccuaaaaaaguuguaccaguuuauauggcuacccacacuucaugcgaugccuguguacuuguccaaacuggguguuauugagcuuuuacuuuuugcuaaucuaugaugugaaaaugauaucuuuuucugauuuacgcuuauauaauucugagugaaauggaacuucaauuuuuuuuuuuuuuaauuuuuuugagacgaggucucacucugucacccaggcugggcuggagugcaguggugugaucucggcucacugcaaccuccaccucuuggguucgagcgauucuugaaccgugcaucaccaugccuggcugauuuuugcauuuuuaguagagaugggguuucuuucuuucuuucuuucuuuuuuuuuuugagcagcagcaagauuuauugcaaagagcgaaagaacaaagcuuccacagugugagagacccgagcggguugcccgagaugggguuucaucacguuggccaggcuggucuugaacgccugaccucgaguuauccacccgccuuggccucccaaaguucugggauuacaggcaugagccaccaugcccagccaguaacauuuuauaauguuaaaaagaauccuguaggccgggcgugguggcucaugccuguaaucccagaccuuuuggaggcugagguggguggaucaccugaggucaggaguuugagacuagccuggcaaacauggugaaaccccaucucuacuaaaaauagaaaaauuagcaaggcgugguggugggugccuauaaucccagcuccucgggaggcugaggcaggagaauugcuugaacccagaagguggggguugcagugagcugagaucauacuacugcacgccagccugggcgacagaguaagacuccaucucaaaaaaaaaaaaaaauccuguagauaguuuaauugggaucauauaaaagauauauuuuagggaaaaucaacauuuuuagcugauugagccuuucucuuuaagaaaaauauauguuuauuccauuuucuauuuauucaagguuuuuuuuaauaucccugugguauaauaugaaauauauaguugucauuuuguauccaugggaauuguucccagaacccccuuggaugccaaaauccuuggaugcucaauuaccuuuuuuuguccuuuucuuguagagaugggugucucacaauguugcccuggcuggucuugaacuccugggcucaagcgauccucucaccuuggccuccccaaagugcugagauugcaggugugagccaccaugccuggccucaaaucccuuauauaaaaucagauaguacuugcauauaaccuaugcacauccuccuguauacuuuaaauuacaaguaacucuagguuacuuguaauacauaaugcagugccuacucaucacuucauucacauggauucaacuuaguacuuagcauggggcaaaauuuaaguuuugcuuuuuggaacuuuguggauuuuuuucuucaaauauuuuugguucuagguugguugaauccagggcuguggaacccacugauacugguaugguauuugguauuuggccuuuguuuuguuucugucacagcucuuuuuuuuuuuuuuuuuagauagucucacucugucacccaggcuggagggcaguggcuugaucucggcucacuacagccucugccucccacacucaagcgauucuucugauucagccucccaaguaguugggacuacgggugugcacuaucacaccgagcuaauuuuuguauuuuuuuuucuuuuuuugagacagagucccacucuguagcccagacuggagugcaauggcgcgaucucugcucaccacaaccuccgccucccagguucaagcaauucuccugucucagccuaccgaguagcugggauuacaggcucccaccaccauaucuggcuaauuuuuguauuuuuaguagaggcaggguuucaccauguuggccaggcuggucucaaacuccugaccucaagugauccgcccaccucagccucccaaagcguugagauuacaggcgugagccaccgcacccuuccugcuucuucuuucuuaauacuuauuuauuucucuuuacugauugaaugcacccccaauauaauguuacaguagccauccuugccuuccacuggcagugcuuauaguauuuuauaauuaaacgugguuguaacuuaaaaaaaagucuuuuuuaguucuucugugaaucagcuuuguucccuuuagagauucagugagucuucucugucugcauccaaauguugguucaaaccuugagccucacacccugccugaggcacccuucucugguuugauguugaacuauuguucaacagucaacuuuuugguugugcuuguuuaucuggcaacagguccuucgaucaggacauccaguuuacuguugccauugauuucacaggccuaugagagauacccugucaagggccccuaaaaacccagauacuccaugcccuugccauuccccugaucuagugacccagcuggauaaaugaaaagacacaaggguugugcaaaugagcagcuaaguacugggagcuucuccagcuuucugagaaagaggaggguggccccagaaggcucugacuggguccaacccugcagcaucucccugagaugcuggcauuccuugggccgaucccacagcagcugcaguggugugcuggugagagaagauuguguggauuucuuuccagcuuuguauucagcgacaaccuguuugugguuuguaagcagccaucguggaaguauuuacacaacggcaagcacuaggacucaggcccccccaccuuucucugcuggugcuccuuggagaggcaccccguggcggugcaguuuuggggcugcagccuccuucuuuagagaaggggcaggugccacugcucucugagggaagggccuugagagaauagcagcugacaguucuucccucccuacuuucucaagaaccccaguuucuaacucuacccuucccuuuggugucuccucaggaugugggcucucuugaugagaagaugaagagcuuggaugugaaucaggacucggagcucaaguucaaugaguacuggagauugauuggggagcuggccaaggaaaucaggaagaagaaagaccugaagaucaggaagaaguaaagccgccuggcugagauggggugggcagggcagagcugaucagggccgagcagaaccgcacucuucccaaauaaagcuuccuccuugaaacacaa

SEQ ID NO: 191307 - RNA, 1926 nt, Homo sapiens
agucucagauugguaaacacccgaacuggucaacucucaagagaccaucugguucagguuccugacugggccagcgaggugagaugaaccccaacuuacagaucaggccccgccccugagacccagagagacaaauggcucaccaagguugcacagcuggcgacaggcagagaggaucccacaaguuuuucuucugggugcagcuuccucgaguucagggcaggaggcagggugagggcagugguggugaggcugugggggcgccucucagaccugccccucccugcuaaggccuagcuucuccaagggcugagggcagagaagcacagggccaggcucuccuugugcaaguuccugcagggagggaggcuucuagggcaucucaugggcuggggcagacugggaccgagccaucccuggguguuggggauaagaagagguggcagauaaucugagagugcuuaaggagccccacggugggguguguggguggugggguaggaugcugucucucugaggaguuuacagcgauguuggggcaaugagaccucuacauggggaaauaacaacaggacagcagggggauaaauuaggaggggcugguguggucugggagggcuacucagaggagggggagacugcggggccugaagccugauggagguuaagaugggucugggaacagucucugagaaacacagagggcagaggugagcuggggggcuggccuggaacucugcugugagccacacccuuguucugugacagugaggauggccaggccucuggagcaggcgguagcugccaucgugugcaccuuccaggaauacgcagggcgcuguggggacaaauacaagcucugccaggcggagcucaaggagcugcugcagaaggagcuggccaccuggaccccggugagcagucagaguguccguccccuccuccuccggggggaggcacugccuagacucugcaaagagagaccuggggacaacaagcaugagcacaggacagcaagggagggggcuggauugugaggagggagugggagggggagaacugacacagcagaaaccucagcuuccucaucuguaaaaugggaugacaaucaucccugcugccuugcagagcuguugagaggacugagugagagcaccaugaagaaugccuaacacuugguaggcacucaguagcaaauaguaggugcucgauuaauaaucugagaggacagauuugggaggggauugcaacgagugcauuaucagagcagggagguugaagucggcccucagaaggguguaguuuggggugggguggguccacuugggagaggaaggagggagguggcgugugaggcuguucugcccuccucauccuacucccuuaccucucccaacccuucccuugcacagacugaguuucgggaaugugacuacaacaaauucaugaguguucuggacaccaacaaggacugcgagguggacuuuguggaguaugugcgcucacuugccugccucugucucuacugccacgaguacuucaaggacugccccucagagccccccugcucccaguagccucugcuccagggggugcgcuggcugucgggggcugggcaugucucccacacccccuccuacccucucuccuguaccccuuucaaucuggacuugcccaggucuucugcgaucaguuaacccauuuuaccuaggaggcccagagaugugagggcuccuuccucaggaugcccagcgaaugagggguagagccacucuggggcccagccugccugccgcaccccuguggccucccuuguggaugggaggaggcgggaucugcucugaggcccucgaggcucagcagagcgugcaccaaugagaccacgaugggaaagggccuauuuaacuccuaauaaaaaacuggcau

SEQ ID NO: 191308 - RNA, 1642 nt, Homo sapiens
cugcgcagaugaggggagacucgucaccaggcgugcagugggcacugcugggcucccccaucccguccuaacccggaacagccccgggcaggaggcguggaaagucgaggggguaaaccgcgaaugugcguuguguaagccacggcgcaggguggggcgcgggcgggacuugggcgggcggggugggcuuggccgagcuggccuccggggcaccgaccgcuauaaggccagucggacugcgacacagcccauccccucgaccgcucgcgucgcauuuggccgccucccuaccggugaguucucuccaggagcccuggguacuuuccagggccagcugcccucacgcuggggguccagccauccccugcccaguucagccgcuggauccagacuggggccaucuguggcgcucccccgcuggagggauagucaggagcagcagugcugugccaggcaggccuugggcuaagggaucgcaauggggugugcucuuuuggggugcggaagggagugcccugggugugucauugccaccauguguggcccugugaagcuguguuuaagcugccuuugcagccuccauuccccuccccugcccagccauacuccucaacuucuggauccccugaaggacaguucucagcugugcccaaagcuacuguuccuauaugcuucuuagaauccuuaagccaccucucuugccuuggcccuagugugcucucuccuuccccuucaagcccugggcugucuccugaugccauuguguguggccugagacugggugguuccaaaggaggcggggcuagugcaggcagcauuauuggggugugugggugagaaguccuugcucccauggcacugacuaggcccucugcugccagcuccaagcccagcccucagccauggcaugcccccuggaucaggccauuggccuccucguggccaucuuccacaaguacuccggcagggagggugacaagcacacccugagcaagaaggagcugaaggagcugauccagaaggagcucaccauuggcucggugaguggccuccuccccaggaccccuuuucccacccuuguccuuuggaagcaggauuaggggagagagaggugccaggugcaucugacucacauuuacccacauucugaggcccugguccacauguagacccugagcuguagacccacucucccagcggguaggggaugcuuccagccggauauccaucucuccaaaugaggaccaguaacugagaaguagcugaggagaagcaaugccaaagugacauggguccuuggugaugagggagcacagagccacuugcagagaggauugccugggagggggaaggggaagaauccaggguugucaucaccacugaguauggauuucacauucuaacacauuagaagcugcaggaugcugaaauugcaaggcugauggaagacuuggaccggaacaaggaccaggaggugaacuuccaggaguaugucaccuuccugggggccuuggcuuugaucuacaaugaagcccucaagggcugaaaauaaauagggaagauggagacacccucuggggguccucucugagucaaauccagugguggguaauuguacaauaaauuuuuuuuggucaaauuu

SEQ ID NO: 191309 - RNA, 1642 nt, Homo sapiens
aaauuugaccaaaaaaaauuuauuguacaauuacccaccacuggauuugacucagagaggacccccagagggugucuccaucuucccuauuuauuuucagcccuugagggcuucauuguagaucaaagccaaggcccccaggaaggugacauacuccuggaaguucaccuccugguccuuguuccgguccaagucuuccaucagccuugcaauuucagcauccugcagcuucuaauguguuagaaugugaaauccauacucaguggugaugacaacccuggauucuuccccuucccccucccaggcaauccucucugcaaguggcucugugcucccucaucaccaaggacccaugucacuuuggcauugcuucuccucagcuacuucucaguuacugguccucauuuggagagauggauauccggcuggaagcauccccuacccgcugggagagugggucuacagcucagggucuacauguggaccagggccucagaauguggguaaaugugagucagaugcaccuggcaccucucucuccccuaauccugcuuccaaaggacaagggugggaaaagggguccuggggaggaggccacucaccgagccaauggugagcuccuucuggaucagcuccuucagcuccuucuugcucagggugugcuugucacccucccugccggaguacuuguggaagauggccacgaggaggccaauggccugauccagggggcaugccauggcugagggcugggcuuggagcuggcagcagagggccuagucagugccaugggagcaaggacuucucacccacacaccccaauaaugcugccugcacuagccccgccuccuuuggaaccacccagucucaggccacacacaauggcaucaggagacagcccagggcuugaaggggaaggagagagcacacuagggccaaggcaagagagguggcuuaaggauucuaagaagcauauaggaacaguagcuuugggcacagcugagaacuguccuucaggggauccagaaguugaggaguauggcugggcaggggaggggaauggaggcugcaaaggcagcuuaaacacagcuucacagggccacacaugguggcaaugacacacccagggcacucccuuccgcaccccaaaagagcacaccccauugcgaucccuuagcccaaggccugccuggcacagcacugcugcuccugacuaucccuccagcgggggagcgccacagauggccccagucuggauccagcggcugaacugggcaggggauggcuggacccccagcgugagggcagcuggcccuggaaaguacccagggcuccuggagagaacucaccgguagggaggcggccaaaugcgacgcgagcggucgaggggaugggcugugucgcaguccgacuggccuuauagcggucggugccccggaggccagcucggccaagcccaccccgcccgcccaagucccgcccgcgccccacccugcgccguggcuuacacaacgcacauucgcgguuuacccccucgacuuuccacgccuccugcccggggcuguuccggguuaggacgggaugggggagcccagcagugcccacugcacgccuggugacgagucuccccucaucugcgcag

SEQ ID NO: 191310 - RNA, 12758 nt, Homo sapiens
uugaagcaaaaaaggaaaaaaaguugccaagcuuuauuuaggcuguaaugguuacagauaacacacaucuaacccuauauuccgugcuucccaugcaguccccuaagcagacucagcuacccuuucccuccagucucacuucuugucuuccuccuucuuguccuucuugccguccuugguggccugggaggccagggagcccauagcauuucgaauggcuucauuguugggauccacaccugggagguucucuaggacacucugaaggaacucgggguccugcaucacgucguaaucauccuccuccugcaaacaggcagugugagcucaagggaggguauggagcggcaggaaguaagcagguguuaaggacaggagcaugccgcugccagaggcccccugccuucugacuguguggggaucugggcaccucuggucgacguaaggaaaggacaagucagcaaaauccuuuauacagcaugaaugcaguuauuacuaaccaaauagaggggccugcugagaacucuguuaauugagcucugaggagaaaaacagaugccaucacauugagguuuccugcucucaagacacccaguucuccuuuuucuuuuucccagacccgcuuuuuucccuccugggaagacauccuagagaacugcccaggcugcucccaccagcaagaaaggaaaauuacagaacaagaggacauuucuccaacucugaccauuagcauugcuaccuuagcaagguuuacauguaagaaaugcaaauccauguguuucccucugcuccucaaaggacuuagcuaugguagaaauacucccagccccagagggaugaggaucuaaauucaaggacuuuaaaccugaugggggcaggguugggucucaccuuggcuggcucagauguguccauagcugagcuggcaucaaugucugcugauuccgccuggccaaacucugaggaagagaggucagucuguucaguuacacuuccucaccccaaccucugccuaggcaccacccaggcucuggcucaccugcucccugcagggacaucugcauggcauaagcaaucugcucuuccucagucauacugcuuaggucaggaagcccagugcggccaaacucuugcuggcugauggucaucuucagcagggcaucgucugagucugggaaaaggaaaagaggagcaggguagaauuggugccauauccacacaggccagccuccaaggccauuccuagcccagcccucccacauauuccuacccugucagaccuccacacucucccugcagugccuacacccagcuuucaauguuuagcaucccgcagucccaggacuucggauuccaccucuuucaccuucagucccagucguagcaaucccggccucagcagcagaagcugcagcugcccgccgggccuccuccuccugccgcugccgcugcucuuccauagauacacgaagggccuggugaagggcagggcauaaucagggcuccccugcccucacuccuacagggagcugggaaagucaguuggggugugggaaaggaacauaaaggggcagcuucugguuuaucacacagagaagaagcuggagggauaagcagugguacgggauuaaaaaguaaggacuugggagaagccucgguuuucaucagaagugaacaagaaagcaucugacacuggugccccuagagaucagacagcauuauagggaagaggcggcaaaaggaggucuuggaaaaugagugauugguagugucuaggacuauccagccugauagaagcucugugaugugugugccagaagagaacaaagagggaccuuuggacucuaccuggggucaacauuugcucaccaaggccagcucaggaucagcacugggaucuacuccaaauucaaagucacuggcaccaagacccagcauggcaccaccuucaccagccaaaaucggagaacugaugagagcaucagccaaacugggcccaggaggcacugucaccagaugagaaccgguuccaucuuugccauucaacguguuuacaaaggcugucagcuuuucuguguucaccuccuggggaggaaagaacacaugaugcccuucuucaggccuugcucccuguucuuucccauuucugcacuacucugccacaguacccgcacuccucaggguuaaggaccauucuguuuaugaccaaauuaagucaaugcccuccaaucagucccuacucaccucuuccccaaaauugauaaugucaacauuuacuuucuccuucuugaggcguuuagccaguuucaccagcugggaagaaggggagaaaaaucaagaaaucuguuccauacucgagggggggaaaggacccgccgcauaaaagcauacagaaaucuauugaccuccccaagguccuccaacagaaucacugaauucuccacauucaccuuuccccaaagugaugagccugaugccucugccagguucuccugagggcuggaagaccucagucccaaacaugggcuccccacauuccccagcugccacuuggacucacauccuucucauuguccuccacugggcuucccacaaaggcaaugaugcgcaucuugugauucuugccuugucggugcuucagagccagcuuguaaagggagaggaaguucucagaguuaaccagaggaaucacucagcucuuuccucugucacucgguucccuuuuucuuacaguuucuuuguaccugaaguacaccaucuaccaucacguucacacaagauuuaacacccccaccuccucccuuuuugcuaugacucucugugcauaaagaagggagguuaauucucuuucucucuuuuuuuuuuuuugagauggagucucgcucugucgcccagucuggagugcaguggcgugaucucaguucacugcaaccuccaccucccggguuccagcgauuauccugccucagccuuccuaguacuggcuaauuuuuauauuuucaguagagaugggguuucaccacguuggccagauuggucucgaacucgugacgucaggugaucugcccguguuagccucccaaagugcugggauuacaggugugagccaccgcgcccggccuuuuuuuuuuuuuuuuuagagaaacagggucucccuaugugcccaggcuggucuugaacugcuagccuucagcaauccuccuccccuggccucccaaagugaugggauuacaggcaugaacuaccacgcccagccuuaauucucaauucuagggauuuuucccuucacaacccucaacuacccugggauucaucccccauauccuuucuacuccaaguuagcuuucucuugcucugguccuagcucaggauuccaggggagaaaugaguaugauggaggcaggaccucagagcagggaggaaagguccagggaacccaguaggacucacaugggccacgcggaugcccgugcagaaggugaucuugcccuuggguuggacaguauguagcuuggacaggauacggccagugucuggggugaguguggucagcacuucacagucacugggauguaggaaaagcauuucagugaauucaggucagcacaaguaccucuaaacugugucuaacuuuuauuuauuuauuuuuuagacggagucucacucugucacccaggcuggagugcguggcgugaucucgggucacugcaagcuccgccucccggguucacgccauucuccugccucagacucccaaguagcugggacuacgggcacccacuaccacgccuggcuaauuuuuuguauuuuuuuuaguagagacgggguuucacuguguuagccaggauggucucgaucuccugaccucguaauccgcccaccuuggccuuccaaagugcugggauuacaggcgugagccaccgcaccuggccugugucugacuuuucuuuaaagaccuggauaauaaccauuauuucuauucuaauuguaaucucuauucuucuuuuuuauuuuuugagacagagucucgcucugucacccaggcuggcgugcaguggcgaaucucagcucacugcaaccuccgccucccggguucaaguaauucucgugcaucagccuccugaguagcugggauuacagaucuacaccaccacgcccggcuaauuuuuguauuuuuaguagagacgggguuuugccauguuggucaggcuggucucgaaauccugaccucaagugauccgucugccuuggccucccagaaugcagggauuacaggcgugagccacugugcuuggccucuauucuucucaaucaaacaucuaguauuuaauggaaaccaagcacagaaauaauuaaguggcuggcuuuguaagaaagcugcccucuacuuccaaauauuuuccccuaacuccuuuuaaaggcucacagggcccugagaauccaccaaaauaacgaugcuaauuuguaucucuccuguccucuccaccuccagacccauucuccuagcuaacaguauguacacuggagugggaggcuacucauuuaagaauuaucaguuccuaaaacaaaacacuuucaggguaaaaggaugagugauauaugcccaggggcucugauccaaaaauuacuuuuuucuuuuuuuuugaaauggagucucauucugucgcccaagcuggugugcaguggugugaucuuggcucacugcaaccuccgccucccgaguucaagcgauucuccugccucagccuccugaguagcugguauuacagguagccaccaccaugccuggcuaauuuuuguauuuuuaguagagacaggguuuuguccuguugcccaggcuggucucaaacucuugggauuacagacaugagccacugugcccagcccaaaaucacuuuucacugacuuuaaaauauauuaugaaauuucacccccuacccuagcccugcccaacaaacaauaaaaagaaacagaaauuucaccccaggagauuuagcuuccguacuacauuaaauacagguuaauacaaaaaacaaguugcuauugacauuuacacuaaauagugcagaaggcagucuaggaaggugaugggcaaaagcagcuucauggaaucuaaagaagaguagcauguaacaaccacccaccuacugaguccccuccuccucugucccccauacuuagccagugugauaaggcccacguuguucucaggguugcugcgggucuuugaaugacaaacuauguugacagcauccugcugggccugcagccugguggguaagaagucuccauuccgcauauacucacuguuguccacacugucagauuaggguugaaggacaagagagaagaaauguagaaguuuuccaaaaccuucucuccaguuccagaggcccccuauagcagcagucuucauagcaucaccuguagcuuuuuuucuuuuuuaaauauacagaugaucaagccuuagcccacauuuauugacucagaauaaccaaugaggaauuuuuuuuuuuuuuuuuuugagauagggucuugcucugucacucaggcuggaguagaguggugcacuaauggcucacugcagcuuccaccuccugggcucaagugauccucucaccucagccucccaaguagcugggacuauaggugcaagccaccacgcagcuaccuuuuaaauuuuuuuuguagagacagggaucuagcuauguugcccaagcuggucuugaacuucugagcucaagagauccuccugccuccaccuccccaagugcugggauaacaggugugagccaccuggugcccagccgaaaaaauuuuuaaauccuuacaaaaugauucugaugagcaccaaagguggugaucuacugaugaaccacagcaauuucuuacaagcugcacuuaagugcuacuaagcuuugucauggauaaauacucuaagucugccauuaaauggcaguaauccaaauauaggaaaugaagaagguaacuuaaaaauaucuauagcugggcgcgguggcucaugucuguaaucccagcacuuugggaggccgaggcagguggaucaccugaggucaggaguucaagaccagccugaccaacauggagaaacccugucucuacuaaaaguagaaaauuagcugggcgugguggcacaugccuguaaucccagcuacucgggaggcugaggcagaagaaucgccugaacccaggagacggagguuguggugaucacaccauuguacuccagccugggcaacaagagcaaaacuucgucucaaaaaaaaaaaaaaaaaaagaaaaagaaaaaaaaaaucuauaaaauaggcugggcacagugacuuaugccucccaagugcaucccagcacuuugggagguggaggcggguguaucaccugaagucaggaguuagagaccaguguuggcuaacauugugaaaccccgucucuacuaaaaauacaauaauuagccagguaugguggcgcacacuuguaguccuagcuacucaggagguugaggcaggagaauugcuugaacccgggaggccgagguugcagugagucaagaucacgccacugcacuccagccugggugacagagugagacuccaucaaaaaaaaaaaaaaaaaucuauaaaauagggccaggcaugguggcucacaacuguaaucccagcacuuuggggggccgaggugggcagaucucuugagcucaggaguuugagaccagccuggcaaacauggugaaacccuaucucuacuaaaaaauauaaaaguuagccgggcgugguggcaggcaccuguaaucccagcuauucggguggcugaggcaggagaaucaccugaaccugagagguggaggcugcauugagccaagaucgugccacugccucaaaaaaaagaggucuauaaaauaacacacacuuggcagcacugagugcagaaaaguacaaugcaaucaucucauuaaaugcuuaacagcuuugacagcugaacugaacgguaaaaaugagguuuuguggaucugaagucucaccucuuagaucccugcaacuuuucaugaucuaaaaguauccagcuaaugugaaauauaaucucgaguuucccaaagaccagaagaaggcagguaagugaugcaguuauauaagcuccuguaaggaucaauucuugaugaccucugaggucccugagagcucuaauaguuaagguucuaccugugcuaauggacggaagcagugccuuagaugagauaccucauuucuuucuuuuuuuuuuuuuugagacagaguuucgcucuuguugcccaggcuggagugcaauggcucgaucucggcucaccgcaaccuccgccuaccagguucaagcaauucuccucccucagccuccuaaguagcugggauaacaggcaugcaaccaccauacccggcuaauuuuguauuuuuaguagagacgggguuccuccauguuggucagguuggucucaaacucccaaccucaggugauccacccaccucaaucuaccaaagugcugggauuacaggcaugagccaccacacuuggcccucauuucuucuuuuuagaauuuuaucuauuuuuuaggcugggcaugguggcucacgucuguaaucccagcacuuugggaggccgagaagggagaaucgcuugagcccaggaguuggagaacagccugggcaacacaggaagacccagucucuaccaaaaaaaaccacauuuuuuauuuauuuuuuauuuuauagagauggagucucacuuuguugcccaggcuagucacaaacuccuagacucauguaguccuccugccuuggccucucaaagugcugggauuacaggugugagccacggcaccuagccaagacaucucauuucuauuggcaagcaaaaugugagccuggggcaauuuuuuuuucuuuaguaugcuuuguuuggcaauaaaccaaaaaugguaaagagaaguaauuaagaagguacuggaaaacaaguauuaacagaaaagggaauauauagguuaaguacacuuaaucagaaacucuugagauccgaaaugccccaaaucagaaaguuuuugaguuuugagugcugacaugauguucaaaggaaauuaucacuggagcacuucagacuuccagauuagggauacuccgcugguuaaguauaauguacauauucuaaaaucugacaaaaauccaaaaucugaaacacuuaugguccuagccauuucagauagggaauacucaaccugucuaggguaguauucaggcacagguucaagcgcaggcacagguucaagcgcagucacagcucacuguagccucaaccucccaggcucaauagaucuucccacuucagcuucccggguagcugggaccacaggcgugcaccaccaugccagcuaauuuuuguauuuuuaguagagacgggguuucacuauguuggccagguuggucuugagcuccugaccucugaugauccgcccaccucaaccucucaaagugcugggauuacagguguaagccaccgcaccuggccauuucacauauuuuuuugagacaggaucuugcucugucacccaggcuggaggccaguggugaaaucauagcucacuguaaccucaaacuccugggcuuaaccccuucuccugccucagccuccuaaguagcugggauuaccgccaaaaccuuuauuuuaaaagagaauacaggcugggugugaugguucaugccuguaaucccagcacuuagggaguccaaggagggaggcucucuugagcccaagaguucgagaccagccuaaucaauaugacaaaaccccaucucuacaaaaaauacaaaaaauagcugggcauggugguaagugccuguagucccagcuauucaggaggcugaggcaggaggaucacuugagccccggaggucgaggcugcagugagccaagaucacacuacugcacuccagccugggugacagaaugagacccugucucccccaaaaaaaaaaaaaaaaaaaaaaacacucgaaaaggguaauacaauggcacaugugcaaggcagucacaucaacagcagguuccccaugaugcacuacauggggccaagaacuaugugcauacugccacaaaaagaauaaaauaccuuggcuggguguuguggcucaugccuguaaucucagcacuuugggaggcugaggcugguggaucaccugaggucaaguguucgagaccagccugaccaauaugaugaaaccucaucucuacuaaaaauacagaaaaaaauuacccgggcaugguggcacgcaccuguaaucccagcuacucgggaggcugagacaggagaaucauuugaacccgggagguggagguugcagugagccgagauggcgccacugcacuccagccugggcaacaaaagcgagacuccaucucaaaaaaacaaacaaauagacaaacaaaccuaggaauacaacuaaccagggagaugaaagagcucuacaaugagaauuacaaaauaccgcucaaauaaaucaaagaagauauaaacaaguggaaaaacaucucaugcucaugaauaggaagaaucaauaucauuaaaauggccauacugccgagcaugguggcucacaccuguaauuccagcacuuugggaggcugaggugggcagaucacuugaggccaggaguucaagaccagccuggccacauggccaaaccccaucuuuacuaaaaauacaaaaaaaaaaaaaaaaaaaaaagaaagccagguaugguggcgggugccuggaaucccagcuacucagaaggcugaggcacaauaaucacuugaaccugagaggcggagguugcaaugagccgagaucacaccacugcacuccagccugggagacagagcaagacucugucucauaaauuaauuaauuaauuaauuaaaauuggccauucuucccacagcaauuuacagauucaaugcuacuccuaucaaacuaccaaaaacauucuucaaagaacuagaaaaaacuauuugaaaauucauauggaaccaacaaagagccagaaaagccaaggcaauccuaagcuaaaagaacaaagcuggaggcaacuuuacccaacuucaaacuauuacuuagggcuacaauaaccaaaaccgcauggcacugguacaaaaacaggcacagagaccaaugggacagaauagagagucuagaaauaaagccgcacaccuaugaccaucuauucuuugacaaagcugacaaaacaagcagugaggaaaaagagucccuauucaauaacuggggauacuggcuaggcuagccauaugcagaagauugaagcuggacuccuuucuuauaccauacacaaaaauuaacugaagauggauuaaagacaagguaaaacccaaaacuauaaaaauccuggaagaccggccgggcacaguggcucacgccuauaaugccagcacuuugggaggcugaggcgggcggaucaccugagggugggaguucgagaccagccugaccaacauggagaaaccuggucucuacuaaaaacacaaaauuagcugggcgugguggcgcaugccuguaaucccagcuacuaaggaggcugaggcaggagaaucgcuugaacacgggaggcggagguugcggugagccgaagguugcggggagcugagauugugucauugcacuccagccugggcaauaagagcgaaaaaaaaaaaaagugggcaaaggagccgggcacaguggcucaacgccuguaaucccugcacuuugggaggcugaggcggguggaucaccugagcucagcaguuugagacuagccuggccaacaugaugaaaccccgucucuaccaaaaauacaaaaaagcugggcgugguggcgggcaccuguaaucccaguuacucaggaggcugaggcaggagaaucacuugaaccagggaggcggagguugcagugagcugagauggcgccacuguacuccaaccugggcaacaagagcaaaacuccuucucaaagagaaaaaaaaaaaaaaaagugggcaaaggacaugaacagacaucagacacuuuauuuuuauuuauuuauuuauuuauuuauuuauuuuauuauuauuuuuuuuuuuuugagagggagucucacucugucgcccaggcuagagugcaguggcgccaucucggcucacugcaaccuccaccuccgggguucaaacgauucucccaccucagccucuggaguagcugggacuacaggcguccaccaccacgccuggcuaauuuuuguauuuuuaguagagaugggguuucaccauguuggccaggcuggucaguaacuccugaccucaggugauacacccacuucagccuuccaaagugcugggauuacaggccugagccacgccccagccagacacuuuucaaaagacgauauacauacagccaacaagccuauuaaaaaaaccucaauaucacugaucauuagagaaaugcaaauaaaucaaaaccacaacgagauaccaccuaacaccagucagaauggcuauuacuaaaaacuaaaaaaauaacagaugcuggcaagguugcgagaaaagagaacacuguucuaucguuggugcaaguguaaauuaguucaaucacugggaaucacuugaaccagggaggcggaggcugcagugagccagacugggccacugcacuccaguccgggagacagagcgagaccgucucaaaaaaaaauuauucaucguuuaucugaaacucaaauuucacugggcauccuguauguuaucuggcaaugcuaugcucccccgagaaaauaaaaagaagaaaucucauaggugccuguuucacccaaucggugauuuguguucgucaacuauucuguauuacauucagugauuacacuuagaaggaacucuugaaacccugcaaaaauuuauguccuccucuucuaaugugacucguaauagguacucagcccaagccugaaacugacaaagagagcuaccucaccggauaaagccuuugugucagacagccguggguuuaaaucuugacuccaccacuuaacuagcuguaugauuuuggacaaaucacuuaaaaucgcugagacucgguauccugaaccguaaaauggagagauaauuuaccuuaaggugugguugugagguauaagugagauaaacaaaaugacugauacauaaaaagcaaucuguaaaugguaccuuugaagaugauacagggaaagguaaugaaguuagagacgagggaauggggagaggaagggauuaauaaucuauuuuccuaauagacguuauuuugcaaagaaaggagggcagaaaacuauuacgaugaguccgaaaagcagaacuguagcuaaagacagacccgggcugcucuagagaagacggcgcuagaacagagaaaggaagcaggaaugaccagucaaugaccgucccccuggggguaacagugguaacccgggacuauccgccacuccagggccccgggaugacucagggaguccagcgggcuccuuaccuccggggccagggccgccucucgcccaugagccccuggcccccaccccaggcccucccugccuuggcgcuacacgcgcccggaacccagcucugccccuccugccccgaaguagcuccucaccacaccauagugcuuuccaacaccaucuugccaccuuccucccucccgaccgggucuccgggacggccuaacaacaacuccuccaauu

SEQ ID NO: 191311 - RNA, 13707 nt, Homo sapiens
cuggugaggggcugcagguggcggcgcagucucgguaggcgguaugaguuuggcugggggccgggcaccccggaagaccgcugggaaccggcuuucugggcuuuuggaggcagaggaggaagaugaguucuaccagacgacuuauggggguuucacagaggcaagauccgggccugggaaaagggaggggaggaggcaaagaggagcccugaagggagaaaccccggacaaagaagaagagggcggggaauagagaggagcucugggagcugauacucgaguugggugggugaaucggagccggggggcgaggcgggggaacggauaguguggaguccuagaagggagagcucuggauggggucaaaggggccugagacggagaagcucuccggaggcacuccagagaacagagaacggcagaaaccuaccguauacuugcgugguugcaucuuucacuguacuucugacguccagcauacacgaggcacacacauaguaguagacaguugcucgauguauacucguuggcccacugcuggauuauucaccugagacauggaaaggaaccgcuccaaaaguagaggagcuuagcccacuucuuuuucagcuuucaggucucaguguaaauguuuucucaggaagauaacccuuccuugacuauccuaacaaguguccccauuuauuucuuccacagaacauauuucaauuugcaauuagauuugguuugcuuacuugcuuaugcuuuucuauugcauuguaaacuguauaaaguuagagauggucuguuuuguucaacauuaugugugagguguccggacugggcugccacuugcuaaauuuuuauuaguugaaucuacccguuuauuaaauguguugaguacccagagcaugccaucgguaauagguuguuuuaggcucuagggaaacagaauauuaaaaacagugcucuguccuuacauacuccaugccccagugggguaacugccuggguuaacaguuaaaauacugugugauaggccgagcacaguggcuuuggccgggcacaguggcucacgccuguaaucccagcacuuuggaaggccgaggcggguggaucacaaggucaggaaaucgagaccauccuggccaacaugguaaaacccccugucucuauuaaaauacaaaaauuagccaagcgugguggugugcgccuauagucccagcuacucaggaggcugaggcagagaaucgcuugaaccugggaggaggagguugcagugagccgagaucguaccacugcacuccagccugggcgacagagcaggacuccgucucaaaaacaaacaaaaaaugugugauaaggacuaaaacaagguguaagaguguuaagguaauacaucugaaccaaaguuguugaucaggauaggcaucccuggagggaugauguuuaagcugaggacaguuugaaaaguagaccuuagcuugaugaaaagcaggagaaggagaaagguuaguccacagagcaggaugggcugaguauguaaagacauugagauccuggucuaggaccugcaagucuacuuucauucuccagagcaugaaggagacuaaagauugauaagccugcagggaguaggcaugggccagauccuuuagggccuugugagcuauguuaaggaauuuugcucuucauccagaggacugagaagagucaucagaauuccacgaugaaauuuguacuuuaggaagguuacuuacucuguaaugagaauggcuugaagggggcauggcaguagagaaacagaaagauucaagagaaauuaaggaauagaacccacaggacuuaggggcugggugugguggcucacgccuguaauuccagcacuuugggaggcugaggcggguggaucacgaggucaggaguucgagaccagccugaccaacauggugaaacccugucacuacuaaaaaugcaaaaaauuagcugguugugguggcgugugccuguaauuccagcuacuuaggaggcugaggcaggagaaucacuugaacccaggaggcagagguugcaguggauugcgccacugcccuccagccugggcgacagagugagacucugucucaaaaaaaaaaaaaacccacaucacugacagagucauuacugacacagcccuaaccaacuaguuuaaaauagaacuuucucaucccuccucuaaggccauuuuccuauuucugucauuuuacgacuuguuauuuaauauguacccuucaugcuuccaaaaaggauuuaaggaggcuuacaauauaaacaaaaaguaggaacaguaaaaauagagacagaucagaaguaauuguaccaggaaccucugcuaaaaugguaauagcaauugauauuaaauuuaguugugagcuuccugguagccaaaccuuguauuucuuuuuuuaguaagaaagaagcauacaaguucuucaagagacacaaacuuuuucagccuuaaauccuagggagcauuuaucauuauauccuuauauuauaaaaaguaaugguuuucauagaugauauacaaacauucucuuuucuagugaugucucuuaaugacucucaauaaaagccgaaggaaugguaguaaauccuuaauuuagugcaaguauguugauugggcacuaagcuaaugugugguugaucuacuacccucuggugauauggcuuaauaccagauuaaagcugaggggauuaauguguucccaggcugucuuuuacaaacaucaguuaggaggaaaugauggucaucagugcaaaauugaacucuggcuggcuuggagugucagccaucuguguuauuugcuugcuuuggcaucauguguaccaagauuagcccauuagucugcaucacugauugaagagagaaccacauaugugaggugucagccagcccaguugacucccucucccucaaguggcuuuuuucccuuuucuuuauaauauggcugccauucuagcccuaaccaguucaccugaggucuaggcuguacuucacguucucuacuccaggccaucuaacugcccccagagcuuucugaaauacccauuguacauaccauuaccccuccccuaaaucuucaguggcccuccauuauccauaguagcaguacucagcuguuuuucugucccaacacgccugaggaaugacacauauuucucucaguaacuuuaguuuaccucaacaaugauuaucaaugguagggaaaauaaggagauggaggggauugagaaucacuggccugcagguuaaaagcguguuuauuagugugacauuuaaguuucuccauaaauggaaugcaaccuucuuuucaaaucauacaguccuacagugcaaucaguguuggaaggaggcagugcuggagccaaaugcaguuggcuaacaagguuucuugacagagaaaaguuuuacuuagaucuaaauccuuauuccauaaacaugcuauacacauuaccauuucugugccuuuguuucugcuauuucaucugcccaugauuccuuccucccucuuggcugucuaaauacuaacaguguuuucaaucauaguuuaaguccucuucauccuuuuuuuuuuuuuucuuuuugagacugugucucgcccugucgcccaggcuggagugcaguggcacuaucucagcucacugcaaccuaugccuccuggguucaagcaguucuccugccucaaccucccaaguagcugggacuacaggugugcgucaccaugcccagcuaauuuuuguauuuuuaguagagacagaguuucaccauguuggccaggcuggucucgaacuccuggccucaagugaucugcccaccucggccucccaaagugcugggauuacaggcgugagccaccaagccuguucgagauccacaucucaaaaaaaaaaaaguaagauuauguccuccccuuuacuguaagccccugaagguagagaccaaaccauauccuuuuguuccccaguacuuaacaguguguugcagguaaagggcuaucaauuaauguuggaaggaggugguacuggagccaaaggccauuagcuagaaaguuuucuugccugaggaaaaugaagggcuggauuaggaaggagaguagggcagcccuuaucaagaaagucgagagauucuguuccuccugaaggggcauuaaggcuuccauugccagccaacccuuaucucccuguguccuuaggaauccggagaugaugaguaucaaggggaccagucagacacagaggacgaaguggacucugacuuugacauugaugaaggggaugaaccauccagugauggagaagcagaagagccaagaaggaagcgccgaguagucaccaaggccuauaagguacagggggaguccuaguugucuuggauuuccucaauuccuauucucucuuucaucaggucccaguacucccuaugccacuuccauuucuggcaaugcuaguuuucucucauugagauccucauauuucuccugacuucuucuguuccccaguaucugauuccaaucuguccucaggaaccucucaagagcuuaaggccucgaaaggucaacaccccggcugguagcucucagaaggcgcgagaagagaaggcacuacugccauuagaacuacaagaugacggcucugacagugaguagggauguuagggucaauuggcaaaauuggaauauaauaauaaaguaucauaucaguguuaaauuuacugauguugcugggugcgguggcucacuccuagaaucccagcacuuugggaggccuaggcggguagaucaccugaggucaggaguucgauaccagccuggccaacauggugaaauuccgucucuacuaaaaauacaaaaauuaaccaggugugguggugggccccuguaaucccagcuacuugggaggcugaggcaggagaauugcuugaaccugggagguggagguuacaccauugcacuccagccugggcaacaagagcaaaacucugucaccagaaaaaaguaauaaaaagaagaaaaaauuuacugauguugauaacuuacuauggguaggaaaauccucauucuuaggaaauacacacugaaauauuuagggauaaaggccaugauguguacaacuuuaguuaccuaauuuagaucauucagaaaaaaaccacacauaacaaaaugcaaaagggccaaaauauuaccaauaggugaugggguaaaagauacaugaguauuccuuguacuauucuugcaacuucguagguuugaaauuauuucaggccaggcacgguugcucaugccuguaaucccagcauuuugggaggccgaggcaggcagaucacgaggucaguaguucaagaccauccuggcuaacaugaugaaaccccaucucuacuaaaaauacaaaaaauuagcuggaugugguggcaugcaccuguacucccagcuacucgggagucugaggcaggagaauuguuugaacccaggaagcagagguuggagugagccgagaucgugccacuguacuccagccugggcgacagagcgagauuccaucucaaaaaaaaaaaaagaaaaaaaaauuauuuccaaguacaacauuucaaaauaaauaaauaaaauauguggacaugaauucaaagauuucuucuuaucucacucucuuccaggucggaagucuaugcgucagucuacagcugagcauacacgacaaacguuccuucggguacaggagaggcagggccagucaagacggcgaaaggggccccacugugagcggccacuaacccaggaggaacugcuccgggaggccaagaucacagaagagcuuaauuuacggucacuggguaagucugugguuucagaaaaagugaguagaggggcugaggggcaugagaaaaaccaugagaccuggaggaccaaagaacuggagagauggaaauuugggaugauggaaucagaaggaagaaauggcggagaguagguaauuaggugcaagagucuaggcaguuaugagcacucugaagaacaagcuaagguacuuugguguaaaauaagaguuguauagaacugaggucaaauccucguucugcuauucauuugcuuuaagucuguagguaaauuacuuauucacauuuugcuuuucuuguuuauaaaaugggguauauaccuaaugacucaggaaauuuaggcaggaggaucacuugaggccaggaguucauaaccagccuggacaacauagugaaaccccaucucuuaaaaaaaaaaaaagcagggggugauaauguugacuuuaaugauaaucaugagaacgugaagucagcagauuaguccuucaugagauaaauugcuuuaaaaaucucuucauuuuaugguauugcuuuaaaaaucucuucaguuugggccaagcgcaguggcucauaccuguaaucccggcacuuugggaggccaagguggguggaucacuugcaguugggaguuccagaccagccuggccaacauggugaaacccugucucuaccaaaaauacaaaaauuagcugggcaugguggcgcaugucuguaaucccagguacuugggaggcugaggcaagagaaucauuugaaccugggagguggaaguugcaaugagccgagaucacaccacugcacuccagccagggcuacagagcgauugguuuggaccacuguaaggagagugacucccagguuuuccuuucuuuuuuuuuuuuuuuuuuuuuuugagacagagucuuacucugucgcccaggcuggagugcagugguaugaucucggcucacugcaagcuccgccuccugagcuggagauucucuugccucagccucccaaguagcugggauuacaggugcccgccaccaugcccagcuaauuuuuuuguauuuuuaguugagaugggguuucaccauguuggccaggcuggucuugaacuccugaccucaggugauccacccgccucacccucccaaagugcugggauuacaggcuugggccaccccgcggcaauucccagguuuucaacaucaguaacuggcuuaggagacccugaaggaggagcaaguucaguggggaaaaaacaaauuuauuuuugaacauguugaauuuaaggaguuugugagcaauucaugcagugaugagaggucaguuaaauaugcaaaucugguguuccaauaagagaucugggcugaaaauacaaauuuggaagucuuuagaauaugggugguaauugacaauauuggagugcaucugagcauguagggagaaagcucagagugagaaaacagaggccugauagaguccugcagacacuaaaaugugauaguuucauacaagaggaggagcuuugaaaagagccuggaagugaccaacgaguuggagaaacccaggagaguuuguguuaaaaaugccaggaaagagaaugucucaagagaguaauugcugcugagacgaugauuaguagaacugagaagugcccauugguuuuggugagauagaggucagacauuaccuuagcacuuuuuggggaccaagucgaaucaaaguauauuggggagcaaaacuuuucaagcuuggccaugaaggguagaagagggaauggaagcuacagaggggugugagauuaagguaaaguuguuuuuauuuuauucgaagauauuagaaauuaugucuuucaugagaaagaacugaguuuaaagaaagagaagaaaaaacgguuauuaauaguguagguuuuuggagaugggaggcaaggcugggaaccagagcagcaugguggaggaauuggcuucagaugggggaagggagaaagaaagugugguggccgggcgccguggcucacaccuguaaucccagcacuuuggaaggcugcggcggguggaucaucugaggucaggaguucgagaccagccugaccaacauggagaaacccugucucuacuaaaaauacaaaauauuagcugagugugguggcacaugccuguaaucccagcuacuugggaggcugaggcaggagaaucacuugaacccgggaggcggggguugcggugagccgagaucgugccauugcacuccagccuggguaacaagagugaaacucugucucaaaaaaaaagaaagaaaguguggcuuagcugagugcaguggcucaugccuguaaucccagcacuuugggaggccaaggaaggaggaucgcuugagcccaggaguucaagaccagccugggcaacauagugagacccugucucuguuuaaaaauguggcuuacaguuguagguuuguaauccagagggagggcauggcggagguucucaccugaugucuuuuucauuaugcagcaccaucugucaaacauuaaggauacagcuggaagcuugaggagacugaggagcauuuaaauaguuauugaugugggauauugagcaguauugagggaccugcugaaggcuaggaccaugaauuuauggugguuccagucugugcuguuauuuuucuccaguagcacucagcaguccagaucagggcaagggaauuauugacaggagagugacugaagugauugaaaugauacagugagcaaccuaagcaugauuuaaaaaggaaaaugugacugggcgcgguggcucacaucuguaaucccagcacuuugggaggccgaggcaggcggaucacaagguaaggaguucgagaccagccuggccaacauggugaaaccccgucucuacuaaacauacaaaaaauuagccaggcaugguggugcgugccuguaguccuggcuacucggggggcugagaaucacugaggagaaucacuugaacccgggaggcggagguugcagugaguggagaucgugucgcuacacuccagccugggcaacagagugagacucaaaaaaaaaaaaaaaguaaagugacauggaaaagaagguuguuagagaugaggugauaaacuguggccaugcaguguugaaggggcuacccaugugcacuucgaagucaccagggugacccuaagaugaugggaauugggguagagacgaagaguggaaaccacugccaaagucuucagugaaugaaggagugaccaugacuaggaaggagagaaguuaaucuagacucuuggcacaggucucaaaagagaagggaguuugcugguaggcagaaaagcagugcucugaaagcuacaggguggggcccaguaggacauagguauauccuguagggauguaagagaaugagcaaccuccaccagaggucugcagagaggagugguggccucagugaaugaccagguuucuguuaaggcaagucauggaaggaaugcugagugaggagcuugaggauauagaugaguuggcagauuacagagcacgaguuccagaggguguaggcaaguguuugaaaguagagggguugggccaggcgugguggcucacgccuguaaucccagcacuuugggaggcugaggugggcggaucacgaggucaggaguuccagaccauccuggucaacauggugaaaccccgucucuacuaaaaauacaaauauuagcugggcaugguggcacgugccuauagucccugcuacucaggaggcugaggcaggagaauugcuugaaccugggagggggagguugcagggagccgagauugugccacuguacuccaaccuggcgacagagcaagacucugucucaaaaaagaaaaagaaaguaaagggguugaggcguuggaagacuggcucaaaggagagaaagcaguauuaucaaacaguucaagugcaagagagguucaaucauuggaaggguuuccagaguacucuuuuuuuuuuuuugagacggagucuugcucugucacccaggcuggagugcgauggcacaaucucagcucacugcaaccuccgccucccagguucaagugauuguccugccucagccucccgaguagcugagauuacaggugcaagccaccacgcccagcuaauuuuuguauuauuaguagagacagggucucaccauguugaccaggucugucucaaacuccugaccucaggugauccacccgccuaggccucccaaagugcuguaauuacaggcaugagccaccgcaccuggccuccagaguacucuuuuauggucagacuuuagggaauuguguucaucauaaccauauuuaaggacacagaaaucuggaguucauucagaggaaggggacgaggaauauuuugauucauuuuuuuucguauguuuguuuugucuuuggagauggaguuucacucuuguuucccaggcuacagugcgaugguaugaucuuggcgcaccgcaaccuccgccucccagguucaagcaauucuccugccucagccucccgguagcugggauuauaggcauacaccaccacaucuggcucauuugguauuuuuaguagagacgggguuucuccaaguuggucaggcuggucucaaacucccgaccucaggugcucugcccaccucagccucccaaagugcugggauuacaggcgugagccaccgugcauggugauucuuuuuuuugagacggagucucacucuuuugcccaggcuggagugcaguggcgcgaucucagcucacugcaagcucugccuccuggguucacgccauucuccugccccagccucccgaguagcugggacuacaggugcucaccaccacguccagcuaauuuuuuguauuuuuaguagagacaggguuucucuauguuggccaagauggucuugaucuccugaccucaugauccgcacaccuuggccucccaaagugcugggguuacaggugugagccaccaaaaaaagcccagcccuuuuuuuuaaauuuuuaaaauuauuuauuuuuuugagacagaguuucgcucuuauugcccgcguuggagugcaauaaugcaaucucacuucaaccucugccucccagguucaagcaauucuucugucucagccucccaaguagcugggauuauagucaugugcuaccacgcccggauaguuuuuguauuuuuaguagagacgggguuucaccauguuggucaggcuggucuugaacuccuuuccuuaggugauccacccaccucggccucccaaagugcugggauuacaggcaugagccacugugcccagccuugauucauuuauucauuaacaaauauuuaaugagugccuguaauguggaaaaugcuguaucacccugauaauauuuaggcaauaugaguuauagucacugcccuuaaggaggagacauauauaccaauagugcaucgccauggagcaguaucacggagaccaggcagguaacaugaagugugcagccagccagagggaugguggugaacuggagaggagugccugaaaggaggaacaguuacucagcucagcuaauuguuccccuguaagaaugcagacccaggguugcgagauuuucuuguuguuuaagagcgaccagaaaucucuauauuuaaauauaauuuccuaccuuacuaauuuuuuuuuuggagauaugaucucacucugcugccuaggcuggagugcaauguggugccaucucagcucacugcaaccuccaccucccuggcucaagcgauccuuccaccucagcuucccaaguagcugggauuacaggcgugugccagcacacccagcuguaggagugaauugacagggcauuuguagaggagauuuugguaucugggaaagcaaauaagcuccucaucaaaggguaccuuccaacucugagguacuauagagggcccagguguacuugagaaaugagcagagaggaugucaagaaaaaacuuauaagcagaaaacuuacaaaaugggaggugccagacggccuuaggggacuuccauaguugucucugguaguuggcagugacuagauagccaggaagauaauugagagaucgugggacaguacugggauaugggaaaaagggacauucugaucauccccucauuucuuccuuugacccuaaagagacauaugagcggcucgaggcugauaaaaagaagcagguucauaagaagcggaagugccccgggcccauaaucaccuaucauucagugacagugccacuuguuggggagccaggccccaaggaagagaacguugacauagaagggugagugaaucucaagaggaaaagagauuguguguucagcucauguucucuuggccccauuuugcuugcuuuucucacacagcucuccuuaacacuuggagauuucuuucagauuccuaacucccuucagcucaauuucuuuuucuuuuuuuuuuuuugagacaugaugcugcucugucaccuaggcuggaaugcaguggugcagucucggcucacugcaaccuccaccuccugugcucaggcgauccucccaccuuagccucccaaguagcugggaguacagccacacaugcuaauuuuuguauuuuuuguagagacgguuucgcuguguugcccagacuccuggguuaaaguaaucgucccgcuucaucuuccuaaaauacugggauuacaggugugagccaccgcgcccagcccagcuuauuucuuucuuauuccuuuuucuuuuagcuucucuguucuucucuuuccuguuuuuccuucuagccuagcuuucuuuucccaucagucacuuaguacguuccucagaauguucccaacacccugccuccuuuuucucuuuccucaucucucugauuuccuucuuucuuucuuuucuuuuuuuuuuuuuuuugagauggagucucgcugcucugucacccaggcuggaguguaauggcacgaucuugguuccaugcaaccuccgccuccuggcuucaagugauucuccugccucaaccuccugaguagcugugauuacaggcauccgccaccacgcccggcuaauuuuuguauuuuuaguagagacaggguuucaccuuguuagucaggcuggucucgaacuccugaccucgucaucugccugccucagccucccaaagugcuggaauuacaggugugagccacugcacccagccugauuuccuucuuucuguaucuguugucuucucuccucagcucuuuguguuuuuccuugucuuuuguccucagacuugauccugcucccucggugucugcauugacuccucaugcugggacuggacccgucaaccccccugcucgcugcucacguaccuucaucacuuuuagugaugaugcaacuuucgaggaaugguucccccaagggcggcccccaaaagucccuguucgugaggucuguccagugacccaucguccagcccuauaccgggacccuguuacagacauacccuaugccacugcucgagccuucaagaucauucgugaggcuuacaagaaguacauuacugcccauggacugccgcccacugccucagcccugggccccggcccgccaccuccugagccccucccuggcucugggccccgagccuugcgccagaaaauugucauuaaaugaagagaugucuaguccucagaaacuucuuuccugcccugauuggggcucuugcuguuccguuucuucucccugcuucuccccuuugucaucucugaucuuugccuaaucuguuucuuuuuccuuuuccccuaguucuuacagguuucguuguguuuuuuaaucuaauaaaauagaaagaucccuuuu

SEQ ID NO: 191312 - RNA, 38406 nt, Homo sapiens
ggcacuaaagguuugcuuccgggcguuucuuuugcuuccccuucccucuuucacgcuuccuccccucccccuccucccuuaucccuucgcuuucgcucuuuuccgucgaggccgaccccugaguugugagucuggggucugguuggugaaaaagagcccuugaagcuggaagacgggaggugcggggaauacuguugaguuauuuggugaccaaaggcuuaucugggacguuuuguuugugggagggggucgggcgagggugggaaggaagucuuccccagaggcgaacgggggcggggcugaacuggguuugcgaauggguaggacgcaccccuagaauggguagcacgggggugggcuggugugugggcagaggaaaauggaggcgcugaaaaucagauuuucuuuaaccguuugauuaaaaaagcaguucacacgaaugugugaaguauuuggauuguggauauuagguacccacguuuuauucccagguugcuuuacuucucuguacuuugggggaaaccuuuuugcugcaagcuuucguguguuugaauaucauagacuuuuuaaaaaguaaaauuccacauggaagcaaaguaauauaaggggaacaaguaaugaaagagaaaacacugaguuagugaguuccaaaucaacuccauccccaggugggguuuuguuuaaauuaggcauagcauacaaagauuuaucacauuaguuaaggaacacauauagaccacaaaaauaucuuauagauugguucucuucaguaucccaaaagauuauuuuuaaaguucgguuuguuuugagacagggucucacuuugucacccaagcuggaaugcauggcgcgaacauagcucacuacagcagcuacuccugggcucaagcgauccucccacuucagccuccugaguagcuggaacuaaaggcgugcaccaccacacguggcuaauuuuuguauuuuuuuguaaagacgagucuugccauguugcccaggcuggucuugaacuccugcccucaagcgacccuccugccucggccucuaaaagugcugagauuacagguguaagccacugugccagcccaaaacauuauuuucaguagcucucuacugcuuaaugaauguucuccaugccgucucaaacucuuaaaucuuuuucaggaguguuagcguacagcagaagauaagaacucuuaaaaaucucagcaucagauucuggagaauagggagggagaacauggaauauuugaauagaauaacaggcagcagaguaggaauuaguuuuauuagggaacugaaauucucuauugauugauuguaguuauaaggacuccaauuuaauuuguuuucuguuccaugcagaggacaaaagcaugucuucccuuccugggugcauugguuuggaugcagcaacagcuacaguggagucugaagagauugcagagcugcaacaggcagugguugaggaacuggguaucucuauggaggaacuucggcauuucaucgaugaggaacuggagaagauggauuguguacagcaacgcaagaagcagcuagcagaguuagagacauggguaauacagaaagaaucugagguggcucacguugaccaacucuuugaugaugcauccaggugagaacuccauggaaaauagaaggaaaucucuccauugggagauguuuuuagagaauaauuguucaugacauugaaccaagcauuuuauuuuauguuuugagacggagucucgcucugucacccaagcuagagugcaguggagugauccuggcucacugcaaccuccaccucucggguucaagugauucucccaccucccccucccgaguagcuggaauuauaggcauccgccaccacacccagcuaauuuuuuauauuuuuaguagagacaggguuucaccauguuggccaggcuguguaccaaacauuuuauacuuuaugaaguacagauguuuagaaccuuacucuuccucaaaguuuauggucaaaaaucugaccuuacaaucagccguaaauauaauuuucaucugucagcagcuaauacaugaucagcaguaagggaguccaagucuuaaguccuuuccccuucuuccuccugugcucuaucuuagaacaauugcuucauuucccuaguaagaucauccagggagugaggauuguaaagaauuucugucuuacguaacucugaagcauuaguaaguucccauacccccaaaagauuuguuucuggugcucuaguugucacuuagaauacauuguuuuuaaauuuauuauacuuuaaguucuaggguauaugugcacaacgugcagguuuauuacauauguauacaugugccauguuggugucacuuacauuagguauaucuccuaauacuaucccucccccuuccccccaccccacgacaggccccaguaugugacguuccccauccuguguccagguguucucauuguucaauucccaccuaugaaugagaacgugcgguguuugguuuucuguccuugcuauaguuugcucagaaugaugguuuccagcuucauccaugugccuacaaaggacaugaacucauccuuuuuuauggcugcauaguauuccaugguguauaugugccacauuucuuaauccagucuaucauugauggacauuuggguugguuuaaagucuuugcuauuguggauagugccgcaauaaacauacgugugcaugugucuuuauagcagcaugauuuauaauccuuuggguauauacccaguaaugggauugcugggucaaaugguauuucuaguucuagauccuugaggaaucgccacacugucuuccacaaugguugaacaaguuuacagucccaccaacaguguaaaaguguuccuguuucucuacauccucuccagcaccuguuguuuccugacuuuuuaaugaucgccauucuaacuggugugagacgguaucucauggugguuuugauuugcauuucucugauggccacugauaaugagcauuuuuuuauuuuauuuuuauuuuauuuuauuuuuuuuuuagacagagacuugcucugucucacccaggcuggaguacagugacgugaucucggcucacugcagccuccgccucccgaguucaagcagcucuccugucucagccuccggaguagcugggacgacaagcgugugccaccacacccggcuaauuuuuguauuuuuaguagagauggaguuuuaccaugucggccaggcuggggaggucaaauuccugaccucaagugaucuaccugccucagccucccaaauugcugggauugcaggugugagccaccacugccagccaggauacauuuucagauaacagcaagguaaauaaugagguaagggugaaaguacuguacuuugggcuuacuuuggauuuuugaggaacuagucuggaaacuaaaccacuauuuaaaacauuuuucuauagaaaaagcauucuaaauucuaaacagagacacuuuggaauguggcccauuuaaauugaggacugucuauacuuaaauauauauacaucguaauggauucuauaucucuuaauuccucuacuggcuuugaccuuuucugcauguguuccaauauuagggcagugacuaauugugagucuuuggugaaggacuucuacuccaagcugggacuacaauaccgggacaguagcucugaggacgaaucuucccggccuacagaaauaauugagauuccugaugaagaugaugauguccucaguauugauucagguaagggaugagcuuuggauaggagagucucaggacugaaguugaaacacuggaagaugagcaaauagaagauaauagaagagaggagaaaccauugucacuaacuccauauuucuaacugccugaguuggcuauuaaagaaaaaaaugcaacauuguuaguaucauagauguucccuaugugcuacacccugauuguauuacuuugcuuuccucauucuguguaaccccuauuuugggguauuccaucaaagaguggaauugccaggacuuauagugaguguauguucuguuauuagaauauaaaaaauacaguugguuuuuguguauugaucuuguagcccgcaaccgcauuaaacucacauaguucuagaagcuuuuuguugauuccuuaggauuuucuuuuuuuuuuuuuuuuuuuuuuuuuuugagauggagucucgcucuguugcccaggcuggagugcaguggcgcaaucucagcucacugcaaccucugccuccuggguucaagcaauucucugcuucgaccucccaacuagcugggauuacaggcaaacccccugccccaccaccacacccagcuaauuuuuguauuuuuaguagagacaggguuucaucaucuuggccaggcuggucuugaacuccugaccuugugauccacuugccuuggccucccaaagugcugggauuacaggcaugagcugcugcacccagccaauuccuuagguuuuucuaaaacuaauucaugcaaguaaagucuguuuuacuucuuccuuucuacccuggauaucuuucuuuuucuuuucuuauuguacucacuaaaaccuucaguacaguguugaauaaguuuuaagagcaggccagauacaguggcucauaccuguaaucccagcacuuugggagguugaggugggaggauccccugaucccaggaauuugagaccagccuggccaacguagcaagaccucaucucuacuaaaaauaaaaaaauuagccaggcaugguggugcaccccaguaaucccagcuacuugggaggcugagguggaaggaucucuuaagcauaggaaguugaggcugcagugagcugugauugugccacugcacuccagccugggugacaaagcaagacucuugucuucaaaaaaaaaaaaaaaaaaaaggguuuccagaacagacauccuggccaggcgugguggcucacgccuguaaucccagcacuuugggaggccaaggagggcggaucaugaggucaggagauccagaccauccuggcuaacacggugaaaccccaucucuacuaaaaauacaaaaaauuagcugggcguggcggcggacgccuguagucccagcuacuugggaggcugaggcaggagaauggcgugaacccaggagguggagcuugcagugaacagaaaccacacuacuacauguauacauauguaacuaaccugcacaaugugcacauguacccuaaaacuuaaaguauaauaaaaaaaaauuaaaaaauaaaaaauaaaaaaaauaaagauaaaccaaaaaaaaaaaaaaagaaaccacacuacugcacuccagccugggcgacagagugagacucugucucacccaaaaaaaaaaaaaaaaaaaacagacauccuuuucuucuuccugauguugauaugaaagcauuugguguuuaaccauuaauuauguuagcaguagguuuucuauagaugucauuuauuaaauuaaaggaauccccuucuaauccuaguuugagagauuuuaucauagccuaauuggauuuuggauuuugucagcuuuuucuguaucauucuccuauguuccuuuugucuuuuaucauauuaagaauguauuacaguaguuguuuuuuuagauguuaaaccaaccuugcauuccuggaguaaaccagccuuggucuugauguauaauucuuuuuauauguugcuggauuggauuugcugauuuaaaaaaaaaagaucuuggcuggaugcugugacucaugccugaaaucccagcaccuugggaggccgaguugggcagauugcuugagcccaggaguucaagacuagccugggcaacauggugaaaccccuucucuaauuuuuuuuuuuuuaaaaaaaaagaaagaaaaaaauuuuuacaucuguuucaugagggcuauugguuuauaguucuguugugguguccuuguuuggcuuugguagcaggguaauauaggccuuguaaaugaguugagaaguguucccuccucugaguuuguauggaaugauauuucuuccuaaaaaguuugauaaauucagugcugaggccauuuaggcuuggacuuuucuuuguggauuuuuaaaaucuuuuauuuuggaauaauuuuagauuuauagaaaaauugaaaaaguaauagaguuccuauauaucccucaucuaguacauaugucaaaacuaagaagcaaacacugguauauuacuuuuauauaaacuucaggcuuuauucagcuucuggacuuuuucuguuccaugaucuaauccaggauaucacauuaaauauauuuccagugugauguuuauuuucuuccuuuuacuuacuggguuugauuuguucuucuuuuucuagccucucaaaguggaagcuuacaggauugauuuuagaccuuucuuccuuucuaauauaagcucuaaagcuauuuauuuccccguaagcauugcuuugcugcaucucauaaauuuuuuuccauacagugucacucucaggauaucauacuuuuuuuauguuguguuuucagcuucauuaaacuuggcaucauuuuuaauuuuccuugugguuguuugauuucuaaauauuugggguuuuuuugauaucuuucuguuguuaauuuuuaauuaauuuuauuguguucagagaauauacuuuguauaauuuuagucuuuuugaaugaaugaaugaaugaaugaauugauugauugacaaggucucacucuguuccccaggcuggagugugauagcaugaucauaguucacugcagccucaaccuccugggcucaagugauccucccacgucagccuccugaguagcuggaacuaaaaguacaugccgccacgcccagcuaacuuuuuuuuuuguaguagagauaaggucucacuauguugcccaggcuggucucgaacuccugagcucaggcaauccuccugccuuggccucccaaggugcugggauuauaggccuuagcuaccaugccuggccuauuuugucuuuuuuuuuuuuuuuuugagacagucuugcuccauugcccuggcugaagugcaguggcaugaucucacugcaacuucugcucacugcaaccuuugccuccuggguucaagcaauucuccugucucagcuuccugaguagcugggaccacaggcacgcgccaucacacccagcuaauuuuuguacuuuuaguagagacaggauuucucuguguuggccagucuugucuuaaacuucugaccuuaggugaucuguccaccuaagccucucaaagugcuagaauuacaggcgugagccacugugccuagcccuauuucuucuuuguugccuucuuaaagucaaacaaacauuucagaaaaccacugucauucuucugauuuuucuuuuucuuuuucuuuuucuuuuucuuuuucuuuuuuuuuuuuuuuuuuuugagauggaguuuucgcucuuguugucuaggcuggagugcaauggcaggaucucugcucacugcaaccuccgccucuuggguucaagcgauucuccugccucagccuccuaaguagcugggauuacaggcaugcaccaccaugccuggcuaauuuuguauuuuuaguagagacaggguuucuccauguuggucagauugaucucaagcucccaaccucaggugauccaccugcuucggcuucccaaagugcuaggauuacaggagugagccaccacacccggccccugauuuuucuuuuuuuuagcuuucauaaaagggguugcaucuguaccuaaucauaaucuauuacaaauuaauacugacuuaauucugguaaaaauacagccauuuuggcugggcgcgguggcugacgccuguaaucccagcacuuugggaggccgagacgggcagaucacgaggucaggagaucgaaaccaucccggcuaacacggugaaaccccgucucuacuaaaaauacaaaaaaauuagcugggcguaguggcgggcaccuguagucccagcuacuugggaggcugaggcaggagaauggcgugaaccugggaggcggagcuugcagugagccaagaucgcaccgcugcacuccagccugggcgacagagcgagacuccaucucaaaaaauauauauauauacacagccacuuugcaccagcauacuucuacuuucacucucuuccugugugauacuauugucaaauauauuauagcuacauguuuaaagccaauaaucuaguguuauaauuacugcuuuaagcagucucauguuuaaagaagguaagggaagaaaagaaaaauauguauuuacccagauauuuaucacuucuguugcucuucauuccuuccuguggaucugaguuaucauccagugucauguuuuuccagccagacgguuuccuuuaauauuucuugcaguacaguucugcugacaguggauucccucaaucuucguuuacccaggauauagaauuuuuuuuuuuuuuugugacagagcuuuauucuuguugcccaggcuggagugcaguggugagaucucagcucacugcauccuccaccuuccagguucaagcaauucuccugccucagccucccaaguaguugggacuacaggugugcaccaccacgcccggcuaauuuugucuuuuuaguagagacaggguuucgucauguaguucaggcuggucucaaacuccuggccucaggugauccacacgccuuggccucccaaaguacugggauuacaggcgugagccacugugcccggcccuaccugggauauagaauucuugauugacagaguuuucuuucaguacuucaaauacgccaucccugugcccucuggccucuauuauuuuugauggaaagucagaggaaauuauuuuuguaucauguauaugagucaguuuugucuugcugguuuuaagguuuucuuuuugucuucugguguuaguuugacugggauguauccaaguucuuucuuaauccuacuugagguccauuuaacuucuuggguauguagauucaaguuuuucaccaaauuuggaaguauuucaucuguuauuucuucaugguuuuuuuuuucuguucccuuuugucucucccugcuuucugggauuuccauuacauauaugguggaaugcuugacauucaucuuuucacaagucucugaagcuuuguucauuuuucuucaauuuucucucugugcuuuggauuggauaauuucucuauauggguaucuauauauucuaguucauugacuccuguugugacucugccacuuagccccucuaauauguauuucauuucaguuuuugcauuuucaacucuggaauuucuauuugguuccuuauuucauaguuucaguuucucuugagauucucuuguugauuaaguauuaguauauuuucauuuaaccuuuuaacuuaauuuccuaucguucuuugagcauauuuauaaauccaguaucugggaucacugagagucaguuuuauugacaggguuuuuugucuugaguguaggucacacuuucauguuucuuugcaugucucuuaucuuuuuguugaauauugacuuuuagauaaucuagcaacucugaguuuuaauuuauuuuccugagaguuccauauccuaguuauucuuuucuuuuuuuugagacggagucucgcucugucgcccaggcuggagugcaauggcgcaaucucggcucacugcaagcuccacuucccgguuucacaccauucuccugccucagccucccgaguagcugggacuacaggugcccgccaccaugccuggcuaauuuuuuucuauuuuuuuaguagagacaggguuucaccauguuagccaggauggucucgaucuccugaccucguaaucugcccgucucggccucccaaagugcugggauuacaggcgugagccacccuguaggccucuguucaguuuuuuuauuuuaacuuuuaauuuuuuagcuuggcuuccaaguauugacuuuuuuauuucuauuuuuuggaauaguuuagcuagugaggcgaaugcauucagaguuacauuuaguucugacgucucccuuggcuuugacuucuucaacauuguguugaugcaugaugauuagcuuauuugcuuuuugcagcaugguauuccauuguaugaauaugccacaguuuaucaguuuuccugauuguggacauugauuuacauuuuuugagauuacagauaacacuacugcaaauauucuuguacaugucuccugaugcacaugugcaggagucuuuuuaguguauauacuguaagagagucacuaguucuuaggauauagaaaccucaacuuuauuugauauauauuuuuuuagacaguaucucacucuguaacccaggcuggagcacaguagugcuaucauagcucacuucgacuucagccucccaaguagcugagacuacaggcaagugccaccacgccugccugauuuaaaaaaaaaaaaauuuguagguugcucacaguggcucacaccuguaaucucagcacuuugggaggccgaggcggguggaucgccugaggucaggaguucgagaccagccuggccaguauggcgaaaucccaucucuacuaaaaauacaaaaauuagcuggguaugguggugggugccuguaaucccagcuacuggggaggcagcggcacaagaauugcuugaacccgggaggcggagguugcugugagccaagauugggccaccgcacuccagccuggaugacagaguaagaaucugucucaaagaaaaaauauauguguauauauauaguauuaccacccaagggauuauuacacagccacuaaaaaaaaaaagaaaaaaaaaagacaaacauaggugaacguugaggacauuaugcuaagugaaauaagccagucacaaaaagacaaaugauuucacuuagaugagauaucuagcauucagugguggcugccaggggcuggagggaggggaaaauggggaguguuuaauagguacagaguuucaguuuugcaaaaugaaaagaguucuggaaauggauggcgguuaugguugcacaacaauauaaauauacuuaauaccacugaauuguacacuuaaaaaugauuagagucagguguuggguuuugcuuacgguccuggcuacucaggagguugaggcagguggaucauuuaaacccaggaguucaaggccagccugggcaacguaacgagaaccugucucuuuaaaaagacaauaacaaauguugacaaggauauggaggaauugaaaaccucauaaauuguuuauggaaauauaaaaugcuauagccacuuuggaaaauagucuuuugguuccucaaaagguuaaacauagaauuaccauaacccacccacugcuggccauauacccaagagaaaugagaacauuuguugauguaaaaacugauaaaugaauguucauaucagcauuauucauaauaggcaaaaguagaaacagcccaaauguuuaucaacugaugaauggauaaaccaaaugugguauacacauacacccauguauugacugcuauaaaauauuauucagccauaaaaaggaaugaaggggccagucacgguggcucaugccuguaauccuagcacuuugggagccugagguggguggaucacgaagucaggaguuggagaccagccuggccaauauggcugucucuacuaaaaauacaaaauuuagcugggugugguggcgcgugccuguaaccccagcuacucaugagacugagccagaagaaucacuugaacccaggagguggagguugcagugaguugagaucacacuacugcacuccagucuggcgacagagcaagauuccaucucaaaaaaaaaaaaaggaaugaaguacugauacgugguacaacauagaugaaccuuguuugaggaaccgcauauuacaugauucucuuuauaugagauguucagaauaggcaaauccauagagacagaaaguaaauuugugauugccagaguuugggggagggaggaaugagaaaugacugcuauagguaugaggaaauuuuuggagugaugaaauucuucaucacuccagaauucgauagugauguuaguuuaauuaccaaaaaccacugaauuacacuuauuuuuucuuguuuuuugagacagagucucgcucuguagcccaggcuggagugcaguggcacgaucucagcucacuacaaccuccgccucccaggucccgguucaagugauucuccugccucagccucccgaguagcugggauaacaggcacgugccaccaugcccagcuaauuuuuguauuuuuaguagagaugggguuucaccauguuggccaggcuggucuggaauuccugaccucaggugaucugcccaccuuggccucccaaagugcugggauuauaggcuugagccaccaccaucggccuacacguuuuauuuuuauccuacuuuuuuuuuuuuuuuuuugagacggggucuuacucugucaccuguagucccagccgcuuuggagguugaggcaggugaaucacuugaacccgagaggcagagguugcggugagccuagaucacgccacugcacuccacuggucuuacgcugcaccaagcuggagugcaauggugcagucuuggcuuacugcaacccuugccuccuugguucaagcgauuuucuugccucagcuucucgugaagccauguagcugggauuacaggugccugcuaccacgcuuggcuaauuuuuguguuuuuaauagagaagggguuugguuucaccauguugcccaggcuggucuggaacuccugacauuaggugauccacccaccucggccucccaaagugcuagaaguacaggugugagccacugcacccagcauuuuuuuuuuuuuuuuuuuuugguaaagacaggguuuugcuguguuguucaggcuugaacuauacauuuuuauuuuuuauuauuauuguuuuuugagccagagucucguucugucaaccaggcuggagugcaguggugcagucucagcucguugcagccucugccucccggauuccagcacuucugccucagcuucccaaguagcugggauuacaggcaugugccaccaugcccaucuaauuuuuguauuuuuaguagaaacgggguuucaccauguugaccaggcugaucucaaacuccugaccucaggugauccacccaccuuggccuuccaaagugcugggauuacaggcaugagccacugcgccuggccuaauuuuuuuuuuaagagacaggcucuuguuauguugcccaggcuagucuugaacuggccucagucaguccucccaccuaagccuuccaaguagcagggauuacaggugugagccaccacaccuggcuauuuacuuugugucuuuccagacccuuuugaguacuuuauauuuguguguauaccuauaucaagauuauuuucaguuauuguugauaaugcucccauaauaaugcuuuugaguaaguuaguucuuaauuucccagaaguuccucuguguaagucucugacacucauuagaguucuucucguccauaggugaugcugggagcagaacuccaaaagaccagaagguaaguuaggaugguaagggaagggugagagauaagaauaugaaaauaggagaauuuuuuggccuaaccauuuaaucaguuuagcugucaguaucuaaucauucacccugugaucagcccuuugcguugcaguccucugauugaugcuguaagaauucaaaaagagguuagcaaaaaaugcuuucacuagaaaggaguguuguaugaaaguggaauuuagcaguguuugcuagguaaauuaaucaagaaaagcuuccuaacauugaaacguugauuuuugaacuagguuucuaagcaagggcagcuuugggcugggcacauuggcucacgacuguaaucccagcacuuggggaguuucagguggguggaucaccugaggucaggaguucaagaccagccuggccaaaauggcgaaaccccaucucuacuaaaaaaauauaaaaauuagcugggcaugguggugcaugccuguaaucccagcugcuugggaggcugagacaggagaaucaguggaacccaggaggcagagguugcaaugagcugagaucgcaccaccgcacucuagccugggggacagagcaagacucugucucagaaaaaaaaaaaaaagaggcuaggcgugguggcuuacgccuguaaucccagcacuuugggaggcugaggcagguggaucaccuuaggucggcaguucaagagcagccuaaccauggagaaaccccaucucuacuaaaaacacaaaaucaggcugggcacaguggcucacgccuguaaucccaggacuuugggaggcugaggcggguggaacacgaggucaggaguuugagaccagccuggcuaacauagugaaacccugucucuacuaaaaauacaaaaauuagcugggcaugguggcacgugccuguagucccagcugcuuuggagguugagacaggugaaucgcuugaacccgagaggcagagguugcggugaaccuaaaucaugccauugcacuccaggcugggcaacagagccagacuccaucucaaaaaaaaaaaaaaaauuagcugggcaugguggcgcaugcuuguaauuccagcuacuccggaggcugaggcaggagaaucgcuugaacccaggaaguggagguuauggugagccgagauugugccauugcacuccagccugggcaacaauagcuaaacuccauaucaaaaaaaaagaguaagggcagcuuugccagauaaaguaaccauaagcuuccaaacauaacucacuccauuuuguuuugugaaauacaaguuguuucuuauucugaaguuauuuguaacccaugcuacuguuucaaaacuuguuuuccucauccccuuuucuacagcuccgugaagcuauggcugccuuaagaaagucagcucaagauguucagaaguucauggaugcugucaacaagaagagcaguucccaggaucugcauaaagguuagggucaagaaauaccuggguacagaugggaggugaauucuuacagagauuuugucuuaagucuuaugucugcuaauuguuugugacaugccagacucaguauccuuaguaguuaugaaaucccaguuacauugauggugauuuuuccagucugugaugguuuuaucucaauaccucuuuagcguccuacauuuaggcuguuuccauccucaugacugcuuccagguggagauuagggagaagagaaucacucagacucuuguuacaaaaagguuugaggccaggugugguggcucauaucuguaauucuagcagcuuugggaggcugaggcaggaggaucacuugaggcccagcauuaaagaccagccucggcaacauagugaaaccccaucucuacaaaaaaaaauguuuaaaaauucuccagaugggccaggcacgguggcucacgccuguaaucccagcacuuugggaggccgaggugggcggaucacaaggucaggaguucgacaccagccugaccaacauggugaaacucugucucuauuaaaaauacaaaaauuagccaggcgugguggcgcacgccuguaaucucagcuacucaggagcccgaggcaggagaaucgcuugaacccggaaggugaagguugcagugagccgagaucaugccacugcacuccagccugggcaacagaacgagacuccaucucaaaaaaaaaaaaaaaaauuggccgggcacaguggcucaugccuauaaucccagcacuuugggagaccgaggcaggcggaucaugaggucaaaagauagagaccauccuggcuaacauggugaaaccccgucucuacuaaaaauauaaaaauuagcuggguguaguggugccaccuugcgugccuguagucccagcuacucgggaggcugaggcaggagaaucgcuggaacccagggaggcggagguuccagugagccaagaucgcaccacugcacuccagccuggugacagagugagacuccaucucaaaaaaaaaaaaaaaauuaccccacuuucccuaauuaccauacuacccucuuuaccuucccguucucuaccgaaucuaugucauaacucuugagaauaacuuugcuucuucuauaggaaccuugagucagaugucuggagaacuaagcaaagauggugaccugauagucagcaugcgaauucugggcaagaagagaacuaagacuuggcacaaaggcacccuuauugccauccagacaguugguaugugcaaacuuggaggaaccacuccugaaaggcaaccugcacccuccacugcugauuguuucuuuuccccauaaccuucccauuugucucucacauagcagccuggauuuauacagaaacuggcaguguuuaaaaagauuuaucuuucccuuuuacucagggccagggaagaaauacaaggugaaauuugacaacaaaggaaagagucuacugucggggaaccauauugccuaugauuaccacccuccugcugacaagcuguaugugggcagucggguggucgccaaauacaaagaugggaaucaggucuggcucuaugcuggcauuguagcugagacaccaaacgucaaaaacaagcucagguaccuggacagaggacuguaaagggguagaggcugggagcacagcaccugcccuguucgugccauagaccagauaccacaauuagcuuuugucuucuuaguccccaguggacugaaacccuuacucuuucuuuaccacaggagucaugugggugauucuuucuuccucuuucuccuccuguuuuuuuuccuuuucuuuccucaaagagaaaacuaggaagagaauaaugaggauugauuaauggucaggggaauacaauucacacagaagaaagaaauggagacuaaaugguuauuggcagcauaggaaucugauagaggaaaaagaauauauguuuuuuggccgggcccagugucucaucccuguaaucuuagcacuuugggaggccaaggcaagugaaucaccugaggucaggaguucgagaccagcuuggccaacuggugaaacccugucucuacuaaaaauacaaaaauuagcugggugugguggcgcaugccuguaaucccagcuacuugggaggcugaggcaggagaauuccuugaaccugggaggcagugguugccaugagccgagauugcaccacugcaccccagccugggcgacagaaggagacuccgucucaaaaauauuuauauguauauguguuuuuuuaaaaguagggagguauugguuaaauuaagggagaacuccuaacucucaaguugagaagaaagaaaaacaggaagaaaguaguggacuggauugucuucccuggagugcaucguguugugauccagagaaguagaagcuaugauaaaauaauuucuguggaucauguuaaauaucauaacccccagaucuuucugcugucacucuucuuuuauagguuucucauuuucuuugaugauggcuaugcuuccuaugucacacagucggaacuguaucccauuugccggccacgugaguguuucucccuuauuccuuagcucaguuuucuccucuaccuuguauuucuucuuaggacauccaguugaaaagcccuaguguuuuugguauuucagucucaaagagcauaaguuugguugaugucuuuugcucccaaaggucaguuugcucccaaaagagauacaguuuuauuguucaucuccaggacugggucuuuguagacaaagagugagacacuagaagaucaugaauggccuugaguagacugcucacguuauagaugugcuucaauuucauuucuaagugaguuacguuggaaaagguguuacuucuuuccuagugucauacugcaccuaacauuuguauaaauguguagucugcauaaugcuuuccacagaagcuguguuagauggaaccucauaguguccacuauauuuguuacccuggcuugggagcagacuccuauggaaacaaucauuuuuaacugcagaagaaucaacuaacacuuuuguuuacacauaacaugacaguaaacacauucugagucucuuaaaaaccugauagagaaugagaaggaaggacuaauuuuuuucauuucaugaugccaccugaucuuuuuaaauuuaccacuagacugaucaacaagugagcaagaauuuccacuugaauuuuccagaggagaaacauccauuuguguaaaauaagugaaucaccuauauuguacauuucuuauuuaguauuuacuugauuuguaaguauguacaguuuguacauuagguuuauuacuuagguggucuuggcuuugcuucccuugagguucugauuuuacuuuuucucuccuuuucaacuuaaaaaguaucaaaugucuccuggccaagucuuuucccuaucaagacaugcccuaccugcccucucaguucuacuucuuccuugaaacagugaaaaagacuugggaggacauagaagacaucuccugccgugacuucauagaggaguaugucacugccuaccccaaccgccccaugguacugcucaagaguggccagcuuaucaagacugagugggaaggcacgugguggaagucccgaguugaggagguggauggcagccuagucaggauccucuuccugguacuguucuucucuacaauuuuggaggcagagguugguggggggggaacuuaagaagcaguaaugaggaugguuuuauagcuauuccauagccuuccucuuucuuauccucguauguguucucacuguuuuuggucaaauuuuacuuugcccuuuuuguuguuccucugcaggucauuguugaaaauaaauuaucugaauuauaauacgaaucugcaugguuuugauuuauuuauuuuuuuucuuuaggaguauucacauuguguguagguacagaaagggcagccaauuccauuuuuccaggguuaagguuuuaguaggauagugggacgaagaagagggaucaaggaguccugauuaucuuucaaggcucaguuuaacucuuagguauuuuguacucauccuuuucucccuucucucucccuucuuagaaucauauuucuuauuuuuaaaaguuuuaaaaacauuuuuuaauacugcugcuugcagaacaaggcuaccugauaggcagugugcccagaguagccagaagaaauuagaaguuauauuucuucuugguguuaccucagcccguuacuucuaaggccuuaugauccuuaucaugcuuuuuguuugguguuuuguuuuguuuucagacggaguuucacucuuguugcccaggcuagagugcaauggcacgaucucggcucacugcaucuuccgccuccuggguucaagugauucuccugccucagccucucggguagcugggacuggcuaauuuuuuguauuuuuaguagagacgggguuucaccauguuggcaggcuggucccgaacuccugaccucaagugauccaccugccuuguccucccaaagugcugggauuacaggcgugagccaccacgccuggccuguuuuguuuuguuuuguuuuguuuuguuuuguuuuuugagacagucucacucugccacccaggcuggagugcaguggugcaaucacagcucacugcagccucaaccuccaggguucaagugguccucccacaucagccucccaaguagcugugacuacaagugcaugccaccacaccuggcugauuuuuguauuuuuaguagagacggguuucgccauguugcccaggcuggucucgaacuccugagcucaagcagucugucugccucauccuuucgacauaccaggauuauaggugugagcuauugugcccagcugucauaccucuuauacucaguauagauaucuguugcuccuguaauuccuuaaacaaggaguauauauuuuucauuguuguguuccugauacccaucauggauccuggcacauacuuuauuaaguagauaaggaauuuuuuuuugggggggauggaguuucgcuccuguugcccaggcuggaguacgauggugcagucucggcucaccacaaccuccgccucccugguucaagcaauucuccugccucagccucccgaguaacugggauuacaggcaugcgccaccacacccggcuaauuuuguauuuuuaguagagacgggguuucuccauguuggucaggcuggucuugaacucccaaccucgggugauccaccugccucagccucccaaagugcugggauuacaagcuacaggcgugagccacugugcuuagcuuagacuaaggaauuuaaggcucaucagggaggauucccagaggugacacaugguauauauccucuacacaggacaggauagauucuagccuuuaagcuauuucccuucauucuuuucucucaauuccccaggaugacaaaagaugugaguggaucuaucgaggcucuacacggcuggagcccauguucagcaugaaaacauccucagccucugcacuggagaagaagcaaggacagcucaggacacguccaaauauggguauguccugaaagauuccuggaggaaggaagaaacaggccaaccagcaaaggagauuauauacaauggcuauccuuugauuagcaugguuacacuguauacucauuggaaacaggauaugugcccugaguuguuuccaaucauggugaucaauuugugcugcugcuuccacaugcuguggcucuaauuuguucuaaacaaccacauaaaaaucugaaacaguuggcuuuagguuagggugauaguaguuacccucuguuauccacaugagaauugucaguuuuguguguuaucuaugguuaguuuuuucuuuuucuuuuuuuuuuaaauagacccggggcuugauauguuacccaggcuggucuugaacuccugggcucaagcugucuaccugccucggcugcccaaagugcuaggauuacaaguaugagcuaccacauccagcguauagucaguuuucuuuaaaacccagaccuggccaggcacaguggcugacaucuauaaucccaacacuuuaggaagcugagacagguaggugguuugcuugagcugaggaauucaagaccagccugggcaacauggugaaacccuguuucuacaaaaaaacacaaaaauuagcuggguacaguggcauuaagcuguaguccaggcuacucaagaaguugaggugggaggaucaauugaagccaggaggucgagguugcagugagcuagaucgugccacugcacuccagccugggugacagaacgagacccugucucagaaacaaacaaaaaacagauuugguuuucuuuuuuaauauuacugucauacuuucugguugauuuuuccugccaaaauuaguugguuaaagaauauauuucugaaaauauuuccccaaaguauaacauaauuagguaaaucaucugagauaggaagauauaaagucuuaucuaaggcccagcaugguggcucgugucuguagucucagcacuuugggaggcugaggugggaguaucacuugaggccaggaguuggagaucagucugggcaacauagaaagacucuuaucucuuaaaaaaaaaaaaugcugagugugguggugugcaccuguagccuuagcuacucuggaggcugaggcaggaggauugcuugaagcccaggauuucaagguuacaaugagcuaaggucacaccgcugcacuucagccugaguaacaaaguggaacacugucuauaaaaagaaaaaaaagaggcuacucugccgacagaguagcaauuuuuuuuuuuuuuuuuugagauggagucugguucuuuugcccaggcuggagugcaguggcaccaucucagcucacugcaaccuccgccucccggguuccagcaauucuccugccucagccuuccgaguaacugggguuacaggcgacugcuaccaugccaggcuaauuuuuguauuguuaguagagacgggauuucuccauguuggccaggcuggucuugaacuccugaccucaggugaucugcccgccucagccucccaaagugcugggauuaaaggcaugagccaccgcgccuggccguuauucuuuuauuccuuuacuuugugaauaaacuugcuuucacuuuaauaaaagaaaaaguauuaucuaagucaaaaaacaauguaugccagcguccaugccagucaauaaugggaacugagagucuaagcacuuacucaaaauguguccauugcugcuuuuuuuuuuugagacgaagucuuguucuguugcccaggcuggaguacagugaugugaucucggcucacugcaaccuccaccuccugguuucaagugauuguccugcgccuuccgagcagcuggaauuacagaugugcaccaccaugcccaucuaauuuuuguauuuuuaguagagacgggguuucaccauguuggccaggcuggucucaaacucaugaccucaagcaaccugcccacuucggccucccaaacugcugggauuacaggcaagagccacugcgcccagccauugcuuccuuuuuauauuguauaaguuaaggaucagaugugugacugaauacaagcgucauagcuaucaucuucucagugcucaauuuccuuuuuccuauaggugcugugaggagcaaaggcccuguuguccaguacacacaggaucugaccgguacuggaacccaguucaagccaguggaacccccacagccuacagcuccaccugccccaccuuucccaccugcuccaccucuauccccccaagcaggugacagugagugaguguuauucuuucuuuuucuucaguuucuuucauauuauauuuuccacaucccuuacuauaugcccucuucucuaaucuccuagaagcuuggaaagccagcuugcccagucacggaagcagguagccaaaaagagcacguccuuucgaccaggaucugugggcucuggucauuccuccccuacaucuccugcacucagugaaaaugucucuggugggaaaccugggaucaaccagacauauaggugagaaaaucugaggcucucuguaggcaggauagcaaugaguggucacuguguaggggaagguuccuuggcuguaagcgaagggcuuaguuuaagcuuaugauagugaggaguuuggacuugaaaaggaagcuuuacccauagaaguuccuaagaaauagaaaguaagaauaauugaauuggaagcugggugcuuggaaauaugguaucaucugaaagccauuuguuaaaacuucuuguugaacauggugccaucauugcuaaaauagaaaggaaacaccacagccucuuuccuuggaguuaguaaggacauuuuuagaacacgcagcagaccaaaaaaacauugguagaagacuggauucuacuuccauaauucacaggcaaauacauuuuaggaaaagguauacuguugaaauagagauguuaggccgggcgcgguggcucaugccuguaaucccagcacuuugggaggccgaggcggguggaucaccugaggucgggaguucgagaccagccuggccaacauggagaaacccugucucuacuaaaaaauacaaaauuagccaggcgugguggcgcaugccuguaaucccagcuacucaggacgcugaggcaggagaaucgcuugaacccaggaggcagagguuguggugagccaagaucgugccauuguacuccagccuaggcaaaaagagcgaaacuugucucaaaaaaaaaaagagaaauagagauguuaucagucagugaagaguaaccagggaguuucauuguccagguuugguagggcaagggaagaucuuucuugaaucaucuuuagcuucaggagcacagcuguuugaaagaugagagaaauggcuuagcuaccuggaggguuaauuauaaaacagagguccuguugccuuccgaucugaucacuugcaucucauuugcagaucaccuuuaggcuccacagccucugccccagcacccucagcacucccggccccuccagcacccccagucuuccauggcaugcuggagcgggccccagcagagcccuccuaccgugcucccauggagaagcuuuucuacuuaccucaugucugcagcuauaccugucugucucgagucagaccuaugaggaaugagcaguaccggggcaagaacccucugcuggucccguuacuauaugacuuccggcggaugacagcccggcgucgaguuaaccgcaagaugggcuuucauguuaucuauaagacaccuuguggucucugccuucggacaaugcaggagauagaacgcuaccuuuucgagacuggcugugacuuccucuuccuggagauguucuguuuggauccauauguucuuguggaccgaaaguuucagcccuauaagccuuuuuacuauauuuuggacaucacuuaugggaaggaagauguuccccuauccugugucaaugagauugacacaaccccuccaccccagguggccuacagcaaggaacguaucccgggcaaggguguuuucauuaacacaggcccugaauuucugguuggcugugacugcaaggaugggugucgggacaagugaguugguggggggaauugcugccccugcuuccaacuuuguuauggugucuguuucaccucuuccuuugccuuguaucuguacugcuuuccccaucuuccuuuaccuccucccucaccuggaacuccugcuauaaggccuccaugaaagcuaugagguagggaggcuggagucugacauggccacacugagcaaccuuggguacauguguauuguguuauuuuuguucucugauccccccgcuccuuuccuuuauuucccucugucauauagguccaagugugccugccaucaacuaacuauccaggcuacagccuguaccccaggaggccaaaucaacccuaacucuggcuaccaguacaagagacuagaagagugucuacccacaggguaaguggucaaggaauggcacaguaccucagagagacugaggagcauguucuuguuuuucugugcuuauagaaaucaucagaaaucuaaaaauuggaaccaaaaauagaauaccagaugaggcauuuuauuaauuagaucuuauuucaugacuuccaaaacacauuuuuuuucuuggaccuuccuugaaaugaagacauagaaugauugaauaguaucuagcaauuuucuguugcaaaaaaagauuaucuuaauuucauagcuaaaugaaugucuuaacagauugugauuuacacuuguaagugaaauguguucagagaggagaaguaggcagggaccugauuacauagggcuuuguaaaucagaaugaaaaaaguuagaaucaggcuggcacaguggcucacaccuguaaucccagcacuuucggaggccaagguggguggaucaccugaggucaggaguuugagaccagccuggccaaccuggugaaacccugucucuacuaaaaauacaaaaauuagccgggggugguggcgggugccugcagucccaacuacuugggaggcugaggcaggagaaucgcuugaauccaggaggcagagguugcagugagccaagaucaugccacugcacuucagccugggugacaagagcgagacucugccuuaaaaaaaaaaaaagaaaaguuagaaucaaauucauggugcucuuacaggauuuuaagcugccaagugaugugaccugccuuuuucagauuacucuggcuucuuuguagaucauaggucuuaggauggcaaaaguagauuuuggaagaccaauuaggagaucguuauaggaguacagcagagagagacauuguugcagcuaugacuugcaauagaauggaggugauaguagagguaagaaggauagauuugggcuguauuaauagguagagcuacagaauuggauagauuauggaguggggggaaagaguagaaucaaggacaauuccuaaauuuuuggcuugagcaucuuagugguuguuggugcuuuuuacugagauggaagaccgaaggaguaguagguuugagugaaauucaguuuuuguuuuggccauguuaaguuugaaaugccgccgggcgcaguggcucacgccuguaaucccagcacuuugggaggcugaggcgggcggaucaccugaggucgggaguucaagaccagccuugaccaacauggagaaaucccgucucuacuaaaaauacaaaaaaaaaaaauuagccgggcaugguggcgcaugccuguaaucucagcuacucgggaggcugaggcaggagaauugcuugaaucugggaggcggagguuguggugagcuaagaucgcaccauugcacuccagccugggcaacaagagcgaaacucagucucagaaaacaaaacaaaacaaaaaguuugaaaugccugucaggcaauccaaguagaaaugucaagaagacacugggauuucuggagagagugggauauaaaaauuuaggaaucaucagcacaggaguauuuaaagccugaauaaguucaccuagagacaauguugauaauagagaaggcggcucaggaguaagcccugggugccccaacauuuaaagguugagcagaggagguggaaccagcaugagguugaggacagcuacugaggagggugaggccgaaagauuacuugaggccuggaguuugagaccagacugggcaacauaguaagacccugugucuaaaaaaaaauuguuggggcugggcgugguggcucacgccuguaaucccagcacuuuucgaggcugaggcaggcagaucacuugaggucaggaguucaagaccagccuggccaauauggugaaaccccaucucuacuaaaaauacaaaaaacuugccagggaugguggcgagcaccuguaaucccagcuacuugggaggcugagacaggagaaucacuuggacccaggagguggagguugcagugagccaagaccgcaccauugcacuccagccugggcaagaaaagcaaaauucuaucucaaaaaaaaaaaaaaauuguuggccaugcgcgguggcucaugccuguaaucccaacacuuugggaggccaagguggguggaucaccugaggucaggaguucaagaacagccuggccaacauggugaaaccccaucuguaauaaaaauacaaaaauuagccaggcgugauugugcacgccuguaaucucagcuauuugggaggcugaggcaagagaaucgcuugaagcugggaggcagagauuacaguaagcugagauugcaccacugcacuccagucuggacaacacaacaagacuccgucucaaaaaaaaugauuuaaaaauuaaaaaaaaaauuuuuuuuuuuuuuagauggagucuugcucugucgcccaggcuggagugcaguggcgugaucucagcucacugcaagcuccgccuuccggguucacgccauucuccugccucagccucccgagaagcugggacuacagucgcccaccaccacgccugacuacuuuuuuguauuuuuaguagagacaggguuucaccauguuagccaggauggucucuaucuccugaccucaugauccgucugccucagccucccaaagugcugggauuacaggcgugagccaccgcgcccagccuaaauuauuuuuuaaaaaauuagccgggcaugguagaugcaugccuguagucccagcuacuugagaggcagaggcagaaagaucacuugagcccaguaguucaaggcugcagugagcuaugaucacaccacuacacucuagccuggggugacagagcaugacucuuaucucuaaaacaagaggaggacaacaaaagagugggguauagcaugguaaacugguauauauaaacacgugaacuaauaaaccuagugaucagaauacauaauuaacagaacagaggagaaaagcaucagugaaauaauucagaaagugucccauaauugaaggaucuuuguuucugaauugaaagggccaguuaggucccaacauaaugaaggauaaagguagguucccauuaagagacauuaucauaaaaugucagaacacugagggaaaaaaaaauccuaaaagcuucuagagaagagaaauagaacacguuaaaaaauagacuugaaaugacuucagccuucccugaaaguagcacuagaagcuagauagcaauuggagaaucuguucagaauucuaagggaaaauuauuuccaaccuggaauuuuaaacucgggcaaacuaucaauuugguguuacaguaggcuaaauacauuuuuuuagacaugcaguaccucagaguuuuucaucauuccccuucucagaaaguuucuggaaauauuugcaaaaaugagagggaaaggcaggaaaggggaagacaggugacagugcagugaaagaggcuuccaggcugacagcuguguacuaggcauagagaagagccacugcaggagcaggucagaugcuguaggagcgacuucuucaggaaaauugguuuaacagaaaaccugaggugccugaauacauucagaggagaucgagacuacuggggagaucauaggaugaauuuguacugauaacauugaaaaacuaaacaaaggaauagacaguuguuuaguugcauugcuguaucauguauguuuuaauuauuaacaaaauuuugaaucuaacaauagcguuuagauuugauaaugcugggugguacaugaguguucauaucuuuuuuacacguuugaaauguuucauaaaaauauuuucaaauaaucacaaauaauauaucacuccccugcuuaacucuauaauauagucccucugcuguuuggauuuuauucugacucuuaaccuuagguuauauauuuggcccuuuccugucucccuccaaagucauuccaaccacacugauauuuuucaguuccuggauccaguucaaccaguguuuuccagccugccucuggagacuugcacaugcugugccuucuucuuggcauccuuccacuuuucuuuguguggcuaucuucuuuaaccuugagcuuucagcuguaaagucaccuccucagagagaccuucccugaccacuuuaaaacuaggucauuuuacucccuuaauucucucauugagcaccauguuuguguucuuuauagcauuuaugacaacuuuuguugacuuguuuuucuuuuuuucuauuauauaagcuccuucaugagggcaaggaucuuaucugucucuuugucuugcuaaccauuguaucaccaguuuacccaaugccuggcacauaguaaucacuuaggccaggugcaguggcugaugccuguaaucccagcacuuugggaggccaaggcgggcagaucacuugaggucaggaguucgagaccagccuagccaacauggugaaacccugucucuacuaauaaaguauaaaaaauuagccaggcgugguggcacaugccuguagugcuagcuacucaggaggcugagaugggagaauugguugaacccaggaggcagagguugcagugagccgagauugcaccauugcacuccagccugggcgacagaaggagacuucgucucaaaaaaaaaaaaaaagccaagcgcaguggcucacgccuguaaucccagcacuuugggaggccgagacagguggauuacgaggucaggaauucaagaucagccuggccaagauguugaaaccccgucucuacuaaaaauacaaaaauuagccaugugcgguggcaggcgccuguaaucccagcuacuccagaggcugaggcaggagaaucacuugaacccgcgagguggagguugcagugagccaagaucccaccacugcacuccggccuaggcaauagagugagacuccgccucaaaaaaaaaaaaaaaaguaaccacuuaaauuuuguggaaugaaugaaugauaguauagcuacuguaaagguuucaugugguaauaaugacaccugaguucaaauuccagcccugccccuacugagcugaucuuuuuugaucagcuguaaacagaggauauuaacauaaacacccccauguccccagugggguuuuaagggaccuaacaaaguuguuucuugaucuggugcagguuacaugguaugcugaguuuguaaaauucauugaucuguauagacuuacguguacuuuccucuguguauauuacguuucaauaaucuuuuauuucccccuacccacuagaccaccagggaaauaaucucuuuuuuuuuuuugcuauggagucuugcucccaaagugcugggauuaccgacaugggaaauaaucuuuuuuaaaguuagaaaaaaaagcuagacaugguggcucacaccuguaaucccagcacuuugggaggccgugguggggggauggcuugaguucaguaguuccagacuugccugggcaaugugaugagaccuugucucuacaaaaaaaguuuuaaaaauuagcugggcauguggcaugcagcuguggucccagcuacuuaggagacugaggcaggaggaucacuugagcccaggaggucaaggcugcagugagcuguguuugugccgcugcacuauggucugggugacagagcaagaccaugacucaaaaaaaaaaaaaaugggaggucgaagcagguggaucaccugaggucaggaguucaagaccagccuggccaacaugguaaaacccugucuccaauacaaaaauuagcaggguaugauggcaugcaccuauaaucccagcuacuugggaggcugaggcaggagaaucgcuugaacccaggaagcggagguugggcgacaaagcgagacugugucucaaaaagaaaaaacaccaccuguauuagggcagcuuuaaggauagaauauguauauauaaggcauucacacaaugccaaacacaaaaguauaugcuuaguaacuagaagcugcucuuaccaucuuuaucuggagagaggauaugacuaaaaucgugaacuaacugagcuguugauacauuuccaaaguaaauuucuuccauugauuuuacauaccaagaaaauaaguaaaauucuaacacugggcaaauagagcaaaaacauuguuaccugaaacaauuaguuuucuuaguauaacuguguuaucuuccuuuaauguugguaugugcuagaucccucugauuaccuuuaaugguuguuuaaaaauaauuaaaauuuuuuucuuuuucagagaugggguggacuugcuuugucauucaggcuggagcgcagugguaugaucauagcucacugaaaccucgaacuccugagcucaagugaucuucucaccucagcauccucaguagcugggauuacaggcaugagccacugcgccuggcccaaauucuuaaauuagauagaauaugagcuccccugggcugggcacgguggcucacaccuguacucccagcccuuugguucgcuaaggcaggcggaucacaugaggucgggaauucgagaccagccugaucaacauggauaaacuccaucucuacuaaaaauacaaaauuagcaaggcacgguggcgcgugccuguaaucucagcuacuugggaggcugaggcaggagaaucacuugaacacgggagguggagguugugagcugagauugcgccauugcacuccagccugggcaaugagagcgaaacucugucuccaaaaaaaaaaaaaagagcucccugaggguagaaauuaugaccuuuuuuuuuuucuuuuuuuucuuuuuucuuuuuuuuuuuuuuugugacagagucucacccugucgcccagauuggagugcaguggcuugauuuuggcucacugcaaccuccgccuccuggguucaaggaauucuccuaccucagccucccaaguagcugggacuacagaugcaugccaccacacccggcuaauuuuuuaauuuuuauuagagacgggguuuuacuguguuagccaggauggucucacucuccugaccucgugauccacccaccuuggccucccaaagugcugggauuauaggcaugagccaccacgcccagcacgaucuuuuucauuguuauguuuccaguguuuaguagagcucuugguguuuaauaauuguuuacugaaugaaagaaugaaaaucaacuuuaccaugaacauuagucacaguuccuccuaucucuuuauucccuuucguaucuguuauguuggccucuguuuuucucacauuuauuuauuuuuauuauuauuauuauuuuugcuguuguuaguaagaaaccucaccaggaauuucucacaugucuuuauuuugugcaucuauuucuacaaauugaccguccauauagugcuuauuuuaauggcucuguaaucuguauucccauuauaguuuacuuagcuuuucuccagguguuaggcacucuagcauucacuuuuaugagcugucuugcuauagacaucuuuauaaauauuucuccgcccucuaaauuuuuuccuugggcuacauuuccaaaugaaucaaagagcauagaugguucaauagauccacucacuuagaucauuaccuaauuuuuaaucuuuauccacaacacauuauaaaugaugauagcuuaagaauuauaauaguuuuauggauuuuuuugugcucuagugaucauaccgugauugauuuuauucuaaccuccucccaggguauaugaguguaacaaacgcugcaaaugugacccaaacaugugcacaaaccgguuggugcaacauggacuacaaguucggcuacagcuauucaagacacagaacaagggcugggguauccgcugcuuggaugacauugccaaaggcucuuuuguuuguauuuaugcagguuggugauaaaauauaaggguuguuuccugagacugggacaugguagggaauugaaccagagacaaauugaacauaagaagaaagugcuugacaugugaacuggaguaagaggaggccagggacuucuacaaagaacgugaugagugauguaccugucuagcuagaccagagagggacacaaguguuucacaaauaagagaaugaaaagggaugaaauuuuggacauggugauauuucagagaacagacaugauuauagaguccaguguaucauuuucucccaugucacuccacucagagaucuuuuagcauagcccaguacucuguuucaauaaaguagaagaaauggaaagacagaaagggcaagauuuaaaaugacaguaaguucuccauacuuucauaguuaagauacaaagggagguauuaucaaagagaaacacugggccggcgugguggcucaugccuguaaucccaaaacuuugggaggccgaaguggguggaucaccugaggucaggaguuggagaccagccuggccaacauaguugaaaccccaucucuacuaaaaauacaaaaauuagccagguguggugguggaugccuguaaucccagcuacuugggaggcugaggcaggagaaucacuugaacccuugaggcagagauugcagugagccgagaucaugccacugcacuccagccugggugacaaaagcgaaacucugucucaaaaacaaaacaaaaaaaaaaacagaaaugagagaccagaauggaggcuuuuugacucuauaugcugguagagcggguauugauggaauaauccuuauucuuucuaauagguccccguggccgggugcgguggcuaacaccuguaaucccaacacugugggaggcugaggcgggcagaucaccugaggucaggaguucgagaccaaccuggccaacauggugaaacgccaucucuaccaaaaauacaaaaaaaauuagccaggcaugguggcgugcaccuguaguccuaucuacucaggaggcuaaggcaggagaaucacuugaaccugggaggcagagguugcagugagccgagaucgcgccacugcacuccagccugggugacagagcaagacuccaucuggaaaaaaaaaaaaaaaaaagcaaacaaaaaaaaaaacuaauagguccccauaacccuagaaggccuuuaauucucuucauucucaggcaaaauccugacagaugacuuugcagacaaggagggucuggaaaugggugaugaguacuuugcaaaucuggaccauaucgagagcguggagaacuucaaagaaggauaugagagugaugcccccuguuccucugacagcagugguguagacuugaaggaccaggaagauggcaacagcgguacagaggacccugaagaguccaaugaugauagcucagaugauaacuucuguaaggaugaggacuucagcaccaguucaguguggcggagcuaugcuacccggaggcagacccggggccagaaagagaacggacucucugagacaacuuccaaggacucccaccccccagaucuuggacccccacauauuccuguuccucccucaaucccuguagguggcugcaauccaccuuccuccgaagagacacccaagaacaagguggccucaugguugagcugcaauagugucagugaaggugguuuugcugacucugauagccauucauccuucaagacuaaugaagguggggagggccgggcugggggaagccgaauggaggcugagaaggccuccaccucaggacuaggcaucaaggaugagggagacaucaaacaggccaagaaagagguaagcaguggcagaacacucugagagcuauggcuuuaacuuuggugcaguaacaaugcagucucaccaugagucuuugcauguagauuauucuacuugauggauauuucuguggccaccucguuaucucucccccuaacuagcacauuccuaguguuuguuuaaagaaccaaauuauugaccgggcacaguggcucacaccuguaaucccaacacuuugggaggccgaggcagguggauaacuugaaguucaggaguuggagaccauccuggccaacauggugaaaccccgucucuacuaaaaaauacaaaaauuagccgggcgugguggugcaugccuguauuuccagcuacuugggaggcugaggcaggagaaucgcuugaaccuggaggguggaggugcagugagccgagaucgcaccacugcacuccagccugggugacagaacgagacucugucucaaaaaaaaaaaaauuauuuuaaaauccacuugccuggugguagaggguggacaaguaucugauuaauuacaaaaugaaagauuuauaagugauuuuuuaauguuaaaugcuguuucaaguuauucacaucauuguuuccuucuacuaaaguagagaaacaagaauugauuuuaaguaucucuuugaugauuaugcugcuuuccacauuacagauggugaaacugucccugguugauguaauccugcucgugguguuuuccaugagcauuaagccccaucacugagaaggcuuaaaggcuccagccagggaguguagugaggauuucugucaaguugcagagugguuuacccaccccacuuuagaauguguaccugucacuggcugauguuaucuguggaggucauuugaagucugauuauuggacuuguuacccgaggcugugaaagcauuuaacccuucacuuguucuuuuccaggacacugacgaccgaaacaagaugucaguguaagugccuuuuguuuuguuuuguuuugagacagagucuugcuuugucacccaggcuggagugcaguggcguaaucucagcucauugcaaccucccccucccaggcucaagagauucucccaccucagccucccuaguagcugggacuacgggugugcaccaccaugccuggcuaguuuuuguauuuuuuguagacacgggguuucaccauguuucccagacuggucuugaacuccugggcucaagcgaugcucccaaaggggauccucagccucccaaagugcugggauuacagccaugagcuaccguguccagcccagugccugucuuuuugaccugucuccaaaucugccuucucucaaaccuaggcuagaagccuaagaaacagccaguaaccuguuggcuucauuccuuccccucccauuagaguuacugaaagcucucgaaauuacgguuacaauccuucuccugugaagccugaaggacuucgccgcccaccuaguaagacuaguaugcaucaaagccgaagacucauggcuucugcucaguccaacccugauguaagucaccucaagcuuauucagagucuaauaaaggaaaaugggccauugucaccucaucaaguccuucacuauaauuacuguuaggucuucuccuacuucuuuagccuugacuuccugccuuauuuucuuucauccagcaucuaaucuuccucuugccaccgcccuuuccugccaaaccguggguaacagcaaggacuuaaaggagcccuucccauuuacuucucuuacuucuuacccuccugcuuccccaggauguccugacacuguccagcagcacagaaagugagggggaaagugggaccagccgaaagcccacugcuggucagacuucggcuacagcgguugacagugaugauauccagaccauauccucuggcucugaaggggaugacuuugaggacaagaagaacaugacugguagccuggaaaaauuuugggaauggugggaagaaauaguaagaaacuugggauagagcauuuuuuaaggaagcuaaagaaguaguggguaaaaauucagauccuaagaauuggagcaucucugggagggcuuucugacuccaagcuaaacuauuguuugacacauccucucucauuuccauuuuuuuacucuuuccccucagcuccuuugucuagcagaucuaauuaugcuugaaaaaaaaaccugcuacuuaggaucuuugaguuccagcuuauugguguuucucagcugcaauguugggagagaaauagggguagaauguccauucaugauagaaugucuguucaugaguugggauggguccugaccccauucucccuccuguccagguccaaugaagcgucaaguggcaguaaaaucaacccgaggcuuugcucuuaaaucaacccaugggauugcaauuaaaucaaccaacauggccucuguggacaagggggagagcgcaccuguucguaagaacacacgccaauucuaugauggcgaggagucuugcuacaucauugaugccaagcuugaaggcaaccugggccgcuaccucaacgugagaccccucuccccaccucuagaugcuggauuaucccaugguccucagauuucuuuuaacauacucuauaagcccuuuucuuguuauaaacucuugaucucaaaggaucuuaaagagguagcuuucuuucaaagcaucuauuauaauggggagggucagauggcaucauuuuucuuccaacucucacucucccugcaaagccagguucaguuucccugguucuuauuugauccuguccuuaaaccuacagcacaguugcagccccaaccuguuuguccagaaugucuucguggauacccaugaucuucgcuuccccuggguggccuucuuugccagcaaguaaggagucaggaaaggggaugacuggggaggggcaaggaccacugaaguucuaagggccccuccuccauucaugauccaacuccaccuacauauucaguaaccccaagugccuggguuaucugcugucuuugccacacaccauccuuuucuuccucuucagaagaauccgggcugggacagaacuuacuugggacuacaacuacgaggugggcaguguggaaggcaaggagcuacucuguugcuguggggccauugaaugcagaggacgucuucuuuagaggacagccuucuucccaacccuucuugaacugucguuuccucaggaacugggucuuccugauuguugaacccugacccgaagucucugggcuagcuacuccccccagcuccuaguugauagaaauggggguucuggaccagaugaucccuuccaauguggugcuagcaggcaggaucccuucuccaccuccaaaggcccuaaaggguggggagagaucaccacucuaaccucggccugacaucccucccaucccauauuuguccaaguguuccugcuucuaacagacuuuguucuuagaauggagccuguguaucuacuaucuccaguuuguauuauuucuugaaagucuuuuaacaauaugauaaaacuaagauugug

SEQ ID NO: 191313 - RNA, 12234 nt, Homo sapiens
acacaugcugcauacacacagaaacacugcaaauccacugccuccuucccuccucccuacccuuccuucucucagcauuucuauccccgccuccuccucuuacccaaauuuuccagccgaucacuggagcugacuuccgcaaucccgauggaauaaaucuagcaccccugauggugugcccacacuuugcugccgaaacgaagccagacaacagauuuccaucagcagguaacguuugcaacuuccuagaucuuuuagcuuuucauuccugucaauucucugaguauuagggauguagugacuugaggaucacaauaaacuuuuagccucugcagaugaaaacagagaugcacuucuuaggucauucccuggcuaaauaaaaucugccuggaaaucuguagaauuccuuguaugauuuauauauauacauacaugauuguuaguaaaagcaaaguauauagggaaucauuuccccauccuucaagaguggccuuucugcaguguuuucuacuuuggccaacaaggaucaaaacgguuaacuccuuagugaggaggaggagagugguauggggagguaguagcucagugcuuccuguucacugagacaucucaaagcccuuaacacucuaguuuuuaaauguccuacuggacauuuugccaguuugcaaaauuacauguaaauggacuauaagcaauuguguaagccauaugucaugcugcaggcugcaaauuguucuuaaaauggaggauuuguaauuaagaaagccaaugcaagaaaugagugaagcuaacuagaguaaacuuaugaaaagcugugaauuucaucaucauagaacauugcuuuucagucugaacauucuucuaacaaaccuuggaucugaggcuucuuguccuuugcggcagccacaguggguuuuuguuguuaggggaaaaauaaaaaaccuugcccgcagcaucugguuaagauuagggcaguuuccugccuaaggagggaagggagagaaaaaggaagaagaaaugcauaaggagaaugaggagauauacaaugucucagaaaacaggaaacauuguccuauuuucccuuguccucuucugacaagaucugggaaaguaccagaauuuaggcacgaaagagaagaacgccucgaagaaaugaucaggaggcaaaacuuagacggaaaucucuccuuuguguauucugaaccccacuaccaccuugcuauuugucugucuccaagccugcuagggacccuggaggaaacgcacugagcccauucugauuguccaguuucuaucccccauuucugguuguguacgugugugugugugugugugugugugugugugugugugugugugugagagagagagagacagagagagaaacagagagaguguguguugccuaaaucucccgagagagagagagagagagaaagagagaaauggcuaaaucccccuagaucaaaguccuuggaaccagauguaccagcauccuaucuaaacacaggccccuccugacuaucauuguuuuaucacccuuuuuccgucuaccuuucucuuccucauaaagccuaguuuuccucuguuucccugccaaauggaagaguuuucccuaacuacauucuucugcaggaugugggggcucaagguucugcugcuaccuguggugagcuuugcucuguacccugaggagauacuggacacccacugggagcuauggaagaagacccacaggaagcaauauaacaacaaggugccugggguccuggagggggcauggcaggaaggcugagaccugagcucucucaucuuagcuuccagacucccuucuucaauccaaaugcuuuauuccaagcaaaucagucccucuucccuaacucauguuaacauacgguuuucauuccuaugcuucaaaucauccucugucaaacuguauccuuccuuugcuuuauaaguguguuacauuucucuuuugggaagaguucuaagauuaaugcuguuaaucuauaagcaauuuuucugucucuccagagcuuuguguuguauuuguuuacauauuaucucuucuugcaggcucuuaauuccaugguuaguuccccaacuaaacuguaaacuuuuaugauugugaguuuccuuuauucuccuaaaacccuucacaauauuacauauguaacuguagacagucuauacaaguacugacuaugcuuuguuuagguggaugaaaucucucggcguuuaauuugggaaaaaaaccugaaguauauuuccauccauaaccuugaggcuucucuugguguccauacauaugaacuggcuaugaaccaccugggggacauggcaaguauagcuucagcuccugucccaccugcaccauuugcuuuaguucccugcugaugccuggccucuuucuucuuugucuuagaccagugaagaggugguucagaagaugacuggacucaaaguaccccugucucauucccgcaguaaugacacccuuuauaucccagaaugggaagguagagccccagacucugucgacuaucgaaagaaaggauauguuacuccugucaaaaaucagguacucuccuuucuucugggugugcauauguaaucuggcaugaccuuuuccuuuuucugcugcuuuguucuugaggugaaagggcaccaggaaaagagggcaaggaauuaagguacaucuccccauucccauucuguuauuuaaccucauuuguuucuguacauuuggguuguuucugguuuuucuuuuucuuuuccuuuuuuuuuuuuuuuuuuuuuuuuugagauagagucucacucugucgcccaggauggagugcaguggugcaaucuuggcucacugcaaccuacaccucccggguucaagcgauucuccugccucagccuccugaguagcugagauuacaggcacgcgccacuacgccuggcuaauuuuucuauuuuuauagagaugcguuuucaccauguuggccaggcuggucuugaacugaccucaggugauccaccugccucagccucccaaagugcugggauuagagucaugagccaucgcggccugguuuuucuuuauuacaaauaguguugcaauaagcacccuugugcauauguuuuugugcacauguacaaauauuuaugcaaaauaaguccuaaaauuggaauuguuaggucacaaauaauccuuuccccccccccaaauuuuuuuuuuuuuuuugagacagcgucucugucacccaggcuggaguccaguggcgcaaucauggcucacugcagccucaacgucucaggcucaagugauucuccaaccucagccucccuaguagcugggauuagaagcacaugccaccacacccagcuaauuuuaaaaaauuuuuuguagagacagaguuuugccaugcuacccaggcuggucucaaauuccugggcucaagcaaucugcccgcuucggccucccaaagugcuaggauuacagacaugagccaccaugcccagcccaaaaaaguuuuugcaaucuuacauucuuacuagcaugagaaugucaguuuuuucacaacccaaacaacacaggauuguaucagcaagauaaacaauugauuuaacguucauuuaacaaacacuuuuugacccccagaaccuaccagaugcaguguuaggcagcagagacucaagaugacuaagacacaaccuguguccucaggaaaucucaaucuaaaaaaauagaacaggaaagaaagaaaaaucuacaaucuagcugcacaaacaauaauagcuaauacuuuuugagauuuuauuguuugucaggaacuucuuaacucuuuacaugaguuaaauauuuaauccuuauaacaauauuuuaugcauagagaaacugagacacaggcaaauuuaguaacuuacccggggucacauagcuacuggguggcaaagucaggguuagcacccaggacaaaugccuccacagcugguacugugcucugcuuuacuguagcuaauaguaaaaaugguagcaaaaaucaauagcaguagaacagugcaacagauauuaagcggaagaggaagacucacaacaaugacaacauuugugcugaaauuuuuagaacacauggaauuucuucaggcagguagagagaagauauagaaaauguaaacagcaaagauugauaguuucucuguaugccuuucagggucagugugguuccuguugggcuuuuagcucugugggugcccuggagggccaacucaagaagaaaacuggcaaacucuuaaaucugaguccccagaaccuaguggauugugugucugagaaugauggcuguggagggggcuacaugaccaaugccuuccaauaugugcagaagaaccgggguauugacucugaagaugccuacccauaugugggacaggugagauugcuccacacaauuauacagcucuguuggcuccuccuuccccagcaugauguuuuguacuggaaacaauuccagaaauacuguuuucuguuauccuauccugcuuucuugauggaauaauuucccacagaaggccaagaagauuuccacaaucugggggaauuuagggagcuuaagcuacuauagcuccuauuugcaucucugccauggagagaaaacagaggcuaggcuaccuaccccauagacuuccgagcuggguucuauaacccucugcucaauuccucacucccacaacaaacccacaaacccaccaugcuauuuucacaaauuguguggcuuuauuuuauaugaucucagugugaguuuucagaacauuucagcaaauuauguaaguuuacaugcuaacaucuauaaaaugagagaaaaaacaaguugcuucauauaagagauaagggauuaacucaguuccuccugcaugauccucuagucauaggaaggaaaucauaucugaaagggaggcaaccugagggguuuuuuauacacauagggcugggucugauagacaauauaauguagggccuucacaacagaaaccucugaaacagggacagcaaguuugagaauaaaaaugauggcuacuguguucuaagccguguccuuagugcauuuuuucuuuuucuuuuuuucauuuaaucucauaacaacucuguuagguagacuuaucuugaauguauaggugaggaaauggacacuuaaggagauaagacaguauaauucauaccacuaguauguaacaauguaagauguaucuaccagggauguuuaucuucugcaaacauuccuagguauaucucccaugcacaugugcaagaauuucuuacuaggauauaaugccuuggaacugaauugucugggucuuaggguaugucugucuucaacuuuacuacacaaugucaaauuguuugccaaaauauuuggaaaaauuuauaccugcaauguguaagaaauccccuucaaucaccuuuuuaucaguauguuuaucuggccauuugcauuucuucuucagugaauuaacuguuuuuaucucuugcucauuuguuuuucuuuuuauuuuuuugaaauagggucuuacucuguugcccaggcuggaguguggugauauagucauagcucacugcagccuccacuuccugggcucaagcaauccucucgccucagccucccaaauagcuaggauauaggugcaugccaucaugcccaccaauuucaaaaaaccuuugaaauuuuuuuuuguagaggcuaggcaugguggcucaugccuguaaucccagcacuuugggaggcugaggugggaggaucacuuaagcccaggaguuccagaucagccugguacaacauagcaagaccucaucucuacagaaaaaauuuuuaaaaguagccagguaugauggcgugcauaguucuagcuacucaggaggcugguugggaggacaacuugagccugggaguucaaggcugcugugagcugugaucaugucacugcucucuagccugggugacagagugagacccuguccccaaaaacaacaaccguuuuuuuugguagagacauugucucgcuauguugccaaggcuagucucaaacuccuaggcucaagcaauccucccaccucccaaagugcugggauuauagauguaagccaccaugccuggccuacccuuuuuuuuuuuuuuuugaaauggaguuuugcuuuugucaccuaggcuugagugcaguggcgcgaucuuggcucacugcaaccuccaccuccuggauucaagcaauucuccugccucagccuccugaguagcugggauuauaggcacccgcaaccacgcccggcuaguuuuuguauuuuuaguacagacaggguuucaccauguuggccaggcuggucuugaaccccugaccucaggugguccgcccgccucggccucccaaagugcugggauuacaggugugagccaccaugccccaccccuuacucauuuuuaauuggauuguuuuuucucuuucuuagcgauucuuaaaaguuuaaagagaauauuuggauacaauacuauguauuuaaaaguugagguuugucuuuucauucuuuuuaugaugucuuucaaucuagaaaaguuaauuuuaauaggccuggcgcgguggcucacgcuuguaaucccagcacuuugggaggcugagauggguggaucacaaggucaggagaucaagaccauccuggcuaacauggugaaacccugucucuacuaaaaauacaaaaaaauuagcugggcgugguggcaggugccuguaguuccagcuacucgggaggcugaggcaggagaauggcgugaacccgggagguggagcuugcagugagccgagauugcaccacugcacuccagccugggcaacugagcaagacugcguuucaaaaaaaaaaaaaaguuaauuuuaauauaguaaaauuaguaaaaugauuaauuuuccuuugcaauuuuuguaauguguuuuauucguuuaugaauggagaaagguaagaaaaaauaaaauuuaaaaaagaagagauguggccagguacgguggcucacaccuauaaucccaguaguuugggaggcugaggcaggcagaucacuugaggucaggaguuugagaccagcugggauaacauggugaaaccccaucucuacuaaaaauacaaaaauuagccaggugugauugcgcacgcuuguaaucccagcaggcugaggcaggagaauugcucgaacucaggaggcagagguugcagugagccaagaucaugccauugcacuccagccuggguaacagagacucugucucaaaaaauaaaaagauaaaaaagaagagaucugauagggcggccagauaacauuuuaaagggaugguauuauaaguuuguuccagcauaaugcagguuauucugacuuuaaaguaucaucacauaauaucuuuuugagucaauuuccaagauauucuguuucacuuguaauucuguguaauuuuuggcaccaggaggcaucagggauuuggagcacauggcagaaacaaaggcaucuugaaaaauaucaaggcaguagaccacuguaaucuuaaaauggcauaucaaaugcugcuauugcuguuaauauuuagauaauguuagauaauguauuuuuuuagaggguaucucacuaucuugcacaggcuggaguagaguggcuauucacagcaugaucacaguacacuaaaggcucaaacuccugggcacaaacaauccuccugccucagccugcugaguaguagauaauaaguucuuguggaugcaaccuuaggguucugaagggguagucuguaggaaaaugaauugcugaaaagaauacaccaccuuaacaugggcuauuauucgauuccauaauuguggcuugccaaugaaacauugcuaacuaccuguaaaauauaguguuggaagucauaggcuaaauugcuaaguucuuuaaucuauuuuagugucuuguuauguacuuuuauauuuugucuuugaugagagcacaaggaucacaccaguuccccugauauaggugcagagggcccaggucuucccucuagcuaagccuuggccuuggccuccuacccacacagcagcuggugccuuccugcccccugaggcuaauacauacuauguggccagaagaugguuuaugcuuuuuaaaaaaaucuuauuucagaaaucuuucccuacuguuuuccucccacauuuaugucuuaaaacaccuguaguugauuuuuuuuuuuuuugagauggagucucgcucucgcccaggcuggagugcaauggcgcgaucuuggcucacuacaaggucugccucccagguucacgccauucuccugccucagccuccccaguagcugggacuacaggcgcccgcuaccacgccuggcuaauuuuuuugcauuuuuaguagagacaggguuucacuguguuagccaggauggucucgaucuccugaccucgugauccacccuccucagccucccaaagugcugggauuacaggcaugagccaccgcaccuggccuguaguugguuuuuaugugugguggaaggcgggaauccucuuuucauauucguuuuucugaggaagaacagacccucucuagaaacccuagacugcugccucuguuaguucacuggcaucacucaaaauauugguugaguuucuuacucacugacucauugccuauugcuuuguccuaguccuauuacaaucuuguuucuuccaggaagagaguuguauguacaacccaacaggcaaggcagcuaaaugcagaggguacagagagauccccgaggggaaugagaaagcccugaagagggcaguggcccgagugggaccugucucuguggccauugaugcaagccugaccuccuuccaguuuuacagcaaagguaagaagcugcugauccuauacagcacugucuuuuaugauacaaacuugaugguuucucgaaggaccuuggguauuuucaguacuuaguuuuuguauucacauggagguggccagagagaaauuaacaacugcugcaguauggagcagcaucucugugguaaacccuccugacacggauggaauucuucaaacagucuccuagacugggagaucccacagggugacccuuggauugcauagagccucacgcugguaguuuguauucuagguguguauuaugaugaaagcugcaauagcgauaaucugaaccaugcaguuuuggcagugggauauggaauccagaagggaaacaagcacuggauaauuaaaaacagguaaugaugggaacacuacuuuuguuauucagucacccuuuuaacacucaaccucaccuccagcuucccgauauuccuuucucugucccaaaucaagaaaaaauuaucucagaguucucacuucuaucuucucagucagaggcucuuaauucucagucugacacuuaauggccaguguguuaguccauuuugcauugccacaaaagaauacccgagacuggguaauuuauaaagaaacgagguuuguuuggcuauacaaagcguggcacuaguaucugcucagccucugaugaggccucagagcuuuuacucauggcagaaggcaaaagagggagcaggcaugucacauagugagagagggagcaagagagagagggaggugccgacucuuuaaagaaccagcucuugcaugaacuaauagagugagaacucacucaucaccaaggcgauggcaccaagccauucaugaggaauccacucucauaacccaaacaccucccacuaugccccaccucccacauuggggaucacauuucagcaugagacugggaggggacacacauccaaaccauauccgccagacaauagugcucaauuaugugcugggcagaugcucccugugugcaaggugcuuagugacauacauaaaccaacgagcagaugacaccuucagugagcucagagcccaauaagacagaccuaacuaaccaugagauaaagcaguacaaagaaccagcaggagcuuuggaauuacguauuuuuacuuucuuuugucucuaaugugaucaguuucuuagaugguuuccauuagcaaucugucuuuaacaguaggggaacagcguaaagguuuaauauuccuuugaacaguuuuuuuccuucaaaauacacuuaagauacacguauauaagaacuugccaaagauugugaagagaaacauuuuuuagaaauaagauauaaacaaaaaaaguuaguguuuacuuuccuauguuggggaacaaagaaaacuccaggguaccuugcuucccauuucucuuuagcaccuugugacuuuuggggaggggcagauugauaacaauuauaguuuuccuuuccuggcugaucaccauuaaccuggcagcagcacuggcuaaaucuccuguccuuagugcccuccaaggagcaggagcccuagacucugggucgcugacagacucacgcagugguguuguucaaaccugaagcaacuuuuuauaucacaguuccaacucaaggugaaccugagcaucuucccaagucucccacagcuucuguccuguguugucccuucucuugacucccagguccaagcacuuacccuguucuuucaugaucagguaccauguguggagauagcuuccaagagagcugggaggaagaaaggacacacccgggcaggaucaggaacacugggggccccuggagaaggggagagugggggaggguacagguuuuaaauaaaauguguuggguaauuagagaaguugcugguuggggaaagaggacugaaaacaauucaggaagauaaacagacaaucucuccucucuccucuuucucacgucgucucucuugucuucuagucucgcuacucauuuccuuaguaaucucauccacucucauaguuucauccaucucuccuaugggguuuacucccaaaucaagaucaccagcuucagccucuuucuuaugcucuaaacucacauuuucaagauuaauauuccccaaauacagcucugaucauaucacucucccacucaaaaucccucacuggcuccucacgaugaugggucacagaguaaaggugaagcuuuuuaaccuugcaguaaagguaauucaaccugaucucaaucugccuuuccagacaucucucccacuacacccuguuaggcacacugcuuuucagcuacaugauccuaacagugccccacacuuuccugccucuguuguucauuucacacccuuccacuggcauccccuucccacaggucgaaauucuacuuagccuuuuggcucagcucaaaugccaccucuuacaucaagccucuaagauucucuugaucagaaggaaucuuucccuccuuugauaccuacaguauuaugccuucucccuauuucuugacuuuaaacucuuuaaaguuaaaaaacaucauauucauuuuuguguaccaucaguaccucgcacaauacucaguaaauauuuuaaugaauaaauaaacugagaguacuaaguauuuuucuugauuggucuuacagcuggggagaaaacuggggaaacaaaggauauauccucauggcucgaaauaagaacaacgccuguggcauugccaaccuggccagcuuccccaagaugugacuccagccagccaaauccauccugcucuuccauuucuuccacgauggugcaguguaacgaugcacuuuggaagggaguuggugugcuauuuuugaagcagauguggugauacugagauugucuguucaguuuccccauuuguuugugcuucaaaugauccuuccuacuuugcuucucuccacccaugaccuuuuucacuguggccaucaggacuuucccugacagcuguguacucuuaggcuaagagaugugacuacagccugccccugacuguguugucccagggcugaugcuguacagguacaggcuggagauuuucacauagguuagauucucauucacgggacuaguuagcuuuaagcacccuagaggacuaggguaaucugacuucucacuuccuaaguucccuucuauauccucaagguagaaaugucuauguuuucuacuccaauucauaaaucuauucauaagucuuugguacaaguuuacaugauaaaaagaaaugugauuugucuucccuucuuugcacuuuugaaauaaaguauuuaucuccugucuacaguuuaauaaauagcaucuaguacacauuca

SEQ ID NO: 191314 - RNA, 35762 nt, Homo sapiens
gacaagggcucuucuugauggcuuacuguauccacuuuguccccaagaccauagggaaaugacuagaggugacuguacuagcuagauuuuaaaugaaacugaaaugaaaguucacuuccucauuuugaguaccucaugugacaaguuccaauuucuuuucaagucaauugaacugaaaucuccuuguugcuuugaaaucuuagaagagagcccacuaauucaaggacucuuacugugggagcaacugcugguucuaucacguauguacucuuuguucuuuuucucccauuuggucuucaaacacucuguguuuguaacuuguucugccugcuagguuuuaaaucuuugguuucaggaaguaaacuaaaaaaucgugucguucaauuugccucuucucuauuuuuaaaaaguuaaugucugcuugagcaucuaagcaucuaaguugagacugaaacauggcuuucuuuggaauauaauuuaaaggcuuacauguuuaaaauuccagauguuuucaauuaaaaagaaauggaaaagaaaguagaauccaguuugagggagcuagucgcugaauuucuguugaugucucuugaauuaaauacagaaguggcauuuuaaagaguaguuaauugccucauuugaaacagaugucugaucauuaaaaaaaaaaaaacguaaaaaggaaaauuaccuaccuaaagaugugaaagcaauagaugagaauugucuuuuaacuaucuguaaagacuguggauauuuaaacaggucaguuaagaagagcccauguauucaaaaauucaggagauaaacugauuuuucagagguuugucucucuuaaggaugauuuuuuuuuuuuuuugagagagagagaaagagauuuccuuugauuagauuuguuggcaaauccuggaaagucccuguuuucuaacccucuagauguguuugguuuaccagauauugggaaauuccuggaaaucacuuuuuaaagugcuacuaagcauuggaaguaguauuucugacauaaaucugcagcuguucccugugacuauauaucccaggaauuuuccuguauaauucuguuuauaauagucugucccuuugauagacuuugcauuguuauuuucucuuaugaaaacauguggucacaacauaugcagcuaauagcaacacuuccuauguuaccuuuccuuacacagaaugaaacggcugguuugugugcucuuggugugcuccucugcaguggcacaguugcauaaagauccuacccuggaucaccacuggcaucucuggaagaaaaccuauggcaaacaauacaaggaaaagguagauuggauugccacucgagcgauaugcuuuuaaaggaguacuguuuucuaccucuuaaaauuguguucuuacaggcaguguuuucaguaaauauuuaagcugggugugguggcucgcgccuguaauccuagcccuuuggaaggccaaggugagcggaucaccugaggucaggaguucgagaccagccuagccaacauggcgaaaccccaucucuacuaaaaauacaaaaauuagcuggaugugguggugggcgccuguaaucccagcuacucgggaggcugaggcaagagaaucacuugagccgggaaggcggagguugcagugagccaagauugugccauugcauuccagccugggugacagagugagacuccaucucaaaaauaaauaaauaaauauuauguacuuguuucuugccagauacuguucuugguaccauacagcaggaaucaaaacaaaauuccuguuauggagcuuauauuauagugagagagacaggaaauaagaaaauaaacaagcagauauguaguaugcuagauggugauaaguguuguagauaaaaauaacagaaggcauggagaguaggaagggcccuggguggugguggugguaagaagucuaucuauaugacaggaggguuagggaaggccucacggauaagggugccauuugagcagagaauugauggaagccagggagcaagcaaaauacauaauagagugaaggucucaggccaagggcaaaucagcacaagcuccugaggaagggccacauuugggauggcugaggagcgaaaaggcguuaauacccacauaguguggccagauauuguuucuugacuaucacuucccauuuuguacuuuuguuuuuauuucaaagcacacuugcugauguuaagaccuuaacccuacugcuuuaaauaacuaaguccuguaacuauguaauauuucuguuuguaagcuagcaucauauauuuauuuauuugacauauuauuuuguauaaaaaugacacucuuaggucauacacucuaaguuuuauuuuuauuuauuuauaauuaaauaauaauugugucuauuuauggaguacaaugugauguuaugauacaaauauacauugcagaaugauuaaauuaggcuaauuaaccuauucagcaccucacauacuuauccuuucauugugauaagaacauuuaaaaucuacccuuucaguaauuuugacauauaaaauacauuauuauuauuaucuguagucaccaugcuaugcaauagauugcuagaauguagucuucuugucaaaugaaacucuguacucuuugccuaacaucuccccuuucccugucuacccuccgcccagccucugcuaaccaccauucuacucucuacuuuuaugaguucaacuguuuuagauuccacauguaaaugagauuaugcaguacuugucuuucugugccuggcuuauuucacuuagcauaacguucucuagacccauccauguuguugaaaaugacagaauuuccuuuuuuuuuuuuuaaggcuaaauaguauuccauuauguauggaauacaauauguaccacacuuuuuuauccauucgucuuuuaauggacacuuuauaagguugauuccguaucuuggcuauugugaauaaugcuacaaugaacauggaagugcagcuaucucauugacauacugauugcgcuuccuugggacauauacccagaagugagauugcuggaugauaugguaauuauauuuuuaguuuuuugaggaaccuccauacuguuuucccaaauggcuguacuaauuuacauuccuacuaaaaguguaugaggguucccuuuucuccacauccucaccaacacuuaucuuucaucguuuugauaauagccauucuaacagaugugaggugauaucucauugugguuuuacuuuacauuucccugaugacuggugauguuaagcauuuuuucauauaucuguuggccauuuguaugugucuuguuuugagaaaugucuauucaggucuucugcccauuuuuaaacaggguuguuuucuugauaguuacuuugaguuccuucuauauuugggauauuagccccuuaucaaauguaugauuugcaaauauuuucucccaaucuaugaguuaucuuuucacucuguuaauuguuuccuuuauuguacgaaagcuuuuuaguuugauggagucccguucgucuauuuuugcuauuguugccuguucuuuaggggucauauucaaaaaaccguugcccggaccaauguuguggaguuuuccccuauauuuucuuauagugguuguauauaguuucaggccuuauguuugugcuuuaauucauuuugaguugauuauuguauauggggugacauaaggguucaauuucauuuuucugcauuuggauagccaguuuucccaauacuauuuauuaaacagacuauccuuuccccauuguguguucuuggcaccuuugcugaaaauugauugaccauaaaguugcagguuauuucugggcucuauauccuauuccauugguaaaugugucuguuucuaugccaguacuaugcuguuuaaauuacuauaguuuuguaauauauuuugaaaccaggcauuuuguaaugccuccagcuuuguuccucuugcuaaagauuacuuugacuauuuaaggacuuuuguaguuccgcaugaauuugaggauuguuuuuucuauuucugugaagaauaacauuagaauuuugauagaaauugcacugaauuucuaguuugcuuuggauaguaugaacauuuuagcaauauuaauucuuccaauccauaagcauggaauaucuucccauuuauuuauuuuaucuuaaauuucuuucuuucuuuuuucuuuuuuucuuguuuuuuugagauggaauuuugcucuuguugcccaggcuggggugcaguggcgugaccucugcucaccacaaccucugcuucugggguucaagcaauucuccugccucagccuccugaguagcugggauuacaggcaugugccaccacgcccggguaauuuuguauuuuuaguagagucgggguuuuuccauguuggucaggcuggucucaaacucccgaccucaggugaucugccugcuucggccucccauagugcugggauuacaggugugagccaccacgcccggccuauuuugucuucaguuucuuuuaucaauguuuuacaguuuucagcauauaacuuuucaacuccuugguuaaauuaacuccuaaauauguuuuaaaugcuguuguaaauagaauuguuuuccuaauuucuuuuucaaauaguuguuaguguauaaaaauacuacugacuuuuguauguugacuuugugucuuacaacuuuacugaauucauguaucaguucuaauaguuuuuugauggagucuuucuucucucuuuuuuuuuuuuuuuuuuugaggcggauucaugcucugucgcccaggcuggagugcaguggcgcaaucucggcucacugcaaccuccgccucccagguucaagcaauucuccugccucagccuccugaguagcugggauuaccggcacacgccaccacaccuagcuaauuuuuguguuuuuaguagagaugggguuucaccauguuggucaggcuggucucgaacuucugaccucaugaucaacccaucuuggccucccagagugcugggauuacaagcauaagccgccuugcccaaccuucuuuuuuuuuuuuuuugagaugagaucuugcucugucacccagguuggagugaaguggugugaucauagcuuacugcagccucaaacuccagcucaagugauucucuugccucagccuuccaaguaacugggacuguaggcacaugccaccacaccuggcuaauuucuauuuuuguuuuuuguagagaaggggucuugccauguuguccaggcugguguugaacuccuagauucacacaauccucccaccucaaccucccaaaguacaggcaugagccaccacaccuggccaagacuuucuauaugaucauguuaucaacaaacaaacgcaauuucacuucuuccuucucuuauuuggagaucuuguauuuauuuuucuugccuaauugcucuggcuaggauuuucagcacuauauugacuagaaauggugagaguggguacccuugucuuuuucugaucuuagcagaauggccuuuaaauuuucacccaauugaguaugguguuagcuguagucuugccauauauggccuauuuguguugaggaacauuccuucuauauguaauuuguugagaauguuuguuaugaaaggauguugaauucugucaaaugcuuuuccugcaucuauuuaaaugaucauacgguuucguugguggugaugaauuucacccucacccacacccuuuaugaacagguuccucauuucaagauugacuggacuuagaugugcaauuagcaccacuaucugguuaaaugaaugcuaucccucuguuuaauaauuccagucccucaggaugaaugaaccugacuuuugauucguauccuaccuuuauaauugaucucaaagugcacuucuuuuuuuuuuuuuccuuucuugcacuuaguuagauuuguuugccuuuauaccauugcuucucaucuugugguuuggaaguaagcccaucaugcaugcccauuauguccauuacugggguaacaguaaaaccuugcuccaagggaaagaaaccugcauccagacuugcuacccagugccucugggacugggcucacccgcucaaugaaaugaggcagaacacaguuguugcugacugcucccugggguuccagcuuauuggaaacucuggcuucagcuacuguaggaggcaccauccaccuugccuucuacaucauuguauucuauguaaaugaaucuccugaaggacaagaaaaucgucggucagcauguaaauucacucugaauaaaauuaaaauaauagaaucaaaaaugaauuuucaaaagacuauauauaaaggaauaauaugcacacuaauggacaagaaauaaauuagaaaucuugaaaauaaaaaauauugucauugcgauaaaaaucaaaaggauuuccagacuggaaagagcuggauagaaucaguaaucugaaagauaguacugaggaauucacccagaaugcagcaccuagaaauaaaaagaaaaauauaugaaaacgcaaguaagagagaugaaagagaguuugaggcuccaaaauacuucggauaggaguuucugaagaagagaauuagguggaaugguggagaagcaauauauguggagacacugauugagaauuuuccagauaugagaaaagguccugaguccuccaaucaaaagcacacagccgaagguaaauaaagaaaccuacacccagauacauguaacgaaguuguaaaacaucaaaaagaaagagcaaaucauggcuggguguaugguucaugccuguaaucccagcacuuugggaggccaagggggaaggauccuuuaaggccaggaauuugagaccagccuaggcaacauagggagacccugucucuacaaaaaaaaaaaauaauaauaaaauaaaaauaaaaauaagcugguugugguggugcaggcuugcaguccuagcuacucgggcagcugagaugggaggauaguuugagcccaagaguuugaggcuguagugagcuaugaucauaccacugcacuccagccugggcaaaagagcaagacccugucuaaaaaaaaaaaaaaaaaaugcugggcgcgguggcuuacaccaauaaucgcaggacuuugggaggcugauaggggaggauugcuugagcccaggaauucaauaugagccugcaacauagggagacccagucucuaccaaaacaaacaaacaaacaaacagaaaaacuggcugcaguggcacacaccagucaucccagcuaugcaggaggcugaggugugaagauugcugggucccaggaggucaaggcuauggugagcaguaaucaggccacuucacugcacuccauccagccgagugacagagcaagacucugucaaaauaauaauaauaauaauaauaaauguuaaaaagagaaggaaauucauguuuaucauaaaauaauauuaaaccaucaaagcaguuaagagcaagaauuaagauuaauaugugaaguuagcaguuauauuggauauauuuauguauuugcaugcucucgggcagauccacauuugguagaaugcuucaaaaaugcuauuuuugggcgggugcaguggcucacaccuguaaucccaguacuuugggaggcugaggcaggcagauccccugaggucaacaguuugagaccagccuggccaacaugacgaaaccccgucucuacuaaaaauacaaaaauuagcuaggcgugguggcacaugccuguaaucccagauacucggaagguugaagcaggagaaucacuugaaccugagaaucggagguugaaguaagcugagaucgugccauuggacuccagcuugggugacagagugagacuccaucucaaaaaaaaaaaaaauugccauuuucaucaucaaacacuuauuuguccaggaugcaguaugacuauguucuucuucauuauguuuuagaaugaagaagcaguacgacgucucaucugggaaaagaaucuaaaguuugugaugcuucacaaccuggagcauucaaugggaaugcacucauacgaucugggcaugaaccaccugggagacaugguagguacauuacaagaaaucccacuuucacgucuggguaaauaucauuuccuuucugucuccccaaaagcaauuugaagguaaacaacaauaacaaaggaauguauaguacaaaguuggaaaacaguagaauugaaggacguaagaacguguacagaaauuucuuacuuaguucuauuuugacugcuuucuuucuuuaacaaaucacuucuuuagaggaaauuuuaaacucagagacuaccauuguuuuuuuuuuaauaaauucuagaaaguauuaccuaaagacuauugacagguuuuuauagcaaguugccauacuuauuuaagucuagauugacaauuuaguaugacccaucugcuuucuuaaugggagaauguggguauuuaauaucacaaauaauccccuauugguuuucagauucuguucuguccugcaaaacuuuaccacuguugccaaagugaagaagggaacgcccuagguagacugaauuccuucuuaaaugcaggaaucuccuuuguaauuauuucucacaugggaaaccaguuuaguccacuuuuuagacagcccuuuuauaaaauucugccuugcuuugaaacaaaaaucugccucccuguaacuucuaguuuuuaccauucucuuuuucuccuuccccaugagggugccuagcugggaugcuagugccaagugugaaacuaaacaaacccagauaauucgccccaccagauccuaauggaaccuguguuggucacaacuauuacuguuuuuucucaguuuuuuuauuccauggcaguuuuuaaauauauucacaguuacaguuauuaggauauuagaaaguaggauaggcugggcacaguggcucacaccuguaaucccagcacuuugggaggccaaggugggcagaucaccugaggucgggaguuugagacuagccugaccaacauagagaaauccugucucuacuaaaaauacaaaauuagcugggcgugguggcacaugccuguaaucucagcuauuugggaggcugaggcaagagaauugcuugaacccgggaggcagagauugcagugagccgaggucaugccauugcacuccagccugggcaaaaagagugaaacuccgucucaaaagagaaaaaaaaaaaaaaaaaagaaagaaagaaaagaaagaaggauguaagugaaagagauauauagucaugugucauaugcauuuuggccacugauggaccacauauaccauggugguccuuuaagauuaugauggagcugaaaaguuccucuugccuagcuagugauguuguagccaccauaacaauguagcacaacacacuacucacuugucuguggugaugcugcuguaaacaaaccuacugcucugccagugguaugaaaguauagcacauaaaauuuugcacaguacaaaaugcuuaauaauaauaaaugacuauguuacugguuuauguauuuacuauacuauacuuuuaauuguuauuuuagaguguacuccuacuuauacuuuuaaaaaguuaacuguaaaacagccucaggcagguccuucaggaggcauccaguagaaaacauuguuaucagaggagaugacagcuccauacguguuguugccccugaagaccuuccagugggacaagagguggagacgaaaugcagugauacugaugauccugaccuuguauaggccuaggcuaauguguguguguguuuguauuuuaguuuuuaacaaaaaaguguaaaaacuuuuaaaaaauuaaaaauagaaaaagcuuauagaagaaggugauaaagaagaaaauauuuucguacagcuguacaauguguuuguauuuuaagggguuaccauagaagacaaaacauuuaaaaaauuaaaaguuuauuaaguaaaaaaguugcauuaaacuaagguuaauuuauuauugaagaaagaaaaauguuuuaacaaauuuaguguagccaaagugcaccguguuuauaaagucuacaguaauguccugggccuucacauucacucuccacucacucacugacucacccagagcaacuccaggccuuucauaguaaaugaccuauauagaaguaccauuuuuacuuuuuuuuuuuuucuuugagauggagucucacucugucgcccaggcuggagugcacuggcgcgaucucagcucacugcaaccuccgccucccaggcucaagugauucuccugccucagccucccaaauagcugggauuacaggcaugcaccaccaugcccagcuaauuuuuguauuuuuaguagagaugggguuucaccauguuggccaggcuggucuugaacuccugaccucaggugauuugcccggcucggccucccaaagugcugggauugcaggcgugagccaccaugcccagcucccauuuuuacuuuuuauacuguauuuucacucuaccuuuucuauguuuagauauauuuagauacacaaguacuucauauuguucuacaauugccuacaaccuucaguacaguaccaugccgugcagguuuguaguuuaggagcaaugggcccuaccauacagccuagguauguaggagccaauacgcucuagguuuguguaaguacacacuaugguguuuucacaaugacaaaaucaccuaacgaugcauuucucagaacauauuccagucauuaaacaaugccugacuguauauuugcuuuguagaccagugaagaagugaugucuuugaugaguucccugagaguucccagccaguggcagagaaauaucacauauaagucaaacccuaaucggauauugccugauucuguggacuggagagagaaaggguguguuacugaagugaaauaucaagugaguauuaccaucccaagccucugaacccuagguagagcucuuuaaaugcuuagucuagcuacagaauuugacagugaaucuuacagucccacguguuacuuucuaguuauuuuuguuauucuugucuucccaacuaaauuauaaguuccuuaagggcaaggaucacauauuauauuuuauuuauacaguuggcccuccauauccacagcuuccacaucugcagauuccaccaaccguggaucaaaaauauccagaaaaaaaugaaaauaaaaaauaggccaggcacucacgccuauaauaccauuacuuugggaggcugaggcaggcgcaucaccugaggccaggaguuccagaucagccuggccaacaugaugaaaccccgucucuacuaaaaauacaaaaauuaacugggccugguggcacaugccuauaaucccaguuacucaggagagugaggcaggagaaucacuugaaccugggaggcagagguugcagugagcugagaucacaccauggcacuccagccugagcuaaagagcgagacuccaucucaaaaaaaaaaaaaaagguaaaguauaagggagggccgggcguaguggcucaugccuguaaucccagcacuuuuccaggucaagggaggcagaucacuugaggucaggaguucgagaccagcuuggccaacauggugaagucccgucucuacugaaaauacaaaaauuagccuggcgugguggugggcgccuguaaucccagcuacucgggagggugaggcaggagaaucacuugaaccugggaggcagagguugcagugagcugagaucuugccacugcacuccagccugggcgauagagugagacccugucuuaaaaaaaaaaaaaaaaaaaaguguauaggaggauguguagguuauaugcgaauacucaguaauuuauauaaggaacuugaaaauucuugacuuugguaugcucagagguccuggaaccaaucccuuguggauacugagggacaacuggauucuccacagugguuuuuguuuuguuuuguuuuguuuuguuugagacagggucucccucuguugcccaggcuggacugcaguggugcgaucugggcucacugcaaccucugccucuugggcucaagugauccucccaucucagccuacacggugacuacaggcacacaccaccacuuuuuuuuucuuuguauuuuuagcagagauggguuuugccauguugcccaagcugaucucaagcuccugagcucaagugauccuccuaccuccaccucccaaaguccugggauuauaggcaugagcccucguguucagcccccacagugcuuuucuaagugaucauagagccaccuacuuagacaaacacugaacuaagcaaauagguguuuaacacagacuuuuauugcucacgcuaugcauugacugcacuggacucuccaauaagccaauugcuugagaagcaguguugugugagagagcccuggugaucaggaaguuucuccauuucacuugugaguuucaaaguugaaggagaagaaagaacuagagauagaguguucuauaaauugagccacucaaguuaauucauggcuagucuugcaucguuagaauaugaaauaugugccuuguaaaauuauuguuccuaugcuguuguauuuuccuuuaguuugcuuguuuuaaaaaaauugcaaaaauccuaaauuaguuagagguaaaacacauguaucaccauagaggucaggguaagugagaggaaucaaagcauucugagcagcuaccccagguugugaucaaugaagaaaguaaaaauuuauuaggaaguaaaugguggccaggcacaguggcucacaucugugauuccagcacuuugggaggcagaggcagaaggaucgcuugagcccaggaguuagaaaccaaccuaggcaauauagugaggcccugacucuacaaaaaauaaaaauaaaaauuagccaggcauggugcgcuccuguagucccagcuacuugaggggcugagaugggaggaucgcuugagccugggagguugaggcuacagugagccaugaucacaccacugcacuucagucugagugacagaaggaaacccugucucaaaacaaacaaacaaaaagaaguaaaugguacugcuaaucucuuauucuuuuccaccuacauauuuuucuuucaauuaguuuuggauuucuuacccgagguucucuaaaauaacagcuuuuagaagacccaauaaaccacauauuuagauguuaacucugaguaaguuaaugagcuccuuucucugggugcuugcauuuuaaugaacaauuuugcuucaaucaaaagcaaugucaguuugcuuccuuuugguggagagcaaggugggaggagggaaggagagagaaagagaacaauuaugauggggcucuggacacucugccccuuuuaaaacuaaagcagcuuugccuuuuuuuguuuguuuaugccuccuuguaaaauauuuuuuaaucaaaaaaauucugaagauaacaaagguuugaaaaaugccaaccuaggauuaaacuucuuauguuucaggcaucauaugacaggagaaaggguauuuuaggucaaggaaaucauccuagcucucucaaaaucucauuacuguaggcaacuaucucccuuacuuaugggugaaaauaggugcaauuugguacaugcucagugaguauuguuucuaaguauauuugaauauggccauuauguucugagcuuggcugauugcaaaucucuaucaagguuggaccuugccuagauaacaauugaguuaaauuuagucuucauucccauuguuaaagacagaaggaaacuguagugggggagcucuuucugggaacuagggacagaacugauguagcugagcguuguccaguuuggguuauggaagucauuccgaaugauuuucugugauuugcguuugugaccuuguaucuguuuuaggguucuuguggugcuugcugggcuuucagugcugugggggcccuggaagcacagcugaagcugaaaacaggaaagcuggugucucucagugcccagaaccugguggauugcucaacugaaaaauauggaaacaaaggcugcaaugguggcuucaugacaacggcuuuccaguacaucauugauaacaagggcaucgacucagacgcuuccuaucccuacaaagccauggugcgucuuaagcaaacuuuuugugcugccccaugaucucauguuauccacugacugacugugcugggcuugccaccaugccaauugcuugagaagcaguauugugugugagagagaacccugaagaggaauucuuaaauucucaagaguucuguuucugaugaaguacucuucuuaauauaucaguaguacaaauaaggaaguagcauucaugcuuaaaaacagauuuuaaugacugggcguaguggcucauaccuauaaucucagcacuuuggaaggccgagguggguggaucaccugaggucaggaguuugagaccagccuggccaacguggugaaacccugucucuaccaaaaauacaaaaauuagccaggcaugguggugcaugccuguggucccagcuacucgggaggcugaagcaggagaaucgcuugaacucaggagguggaggugcagugagccgagaucacgccacuguacuccagccucggcaacggagcaagacuccaucccaaaauuaaacagauuuuaagcaaacuauccuuaaaauuauuucucuguauuuaaacuuuuucuucugcagccucccaugcucaaccuuauucucagaucauuaaccacaucauucuuccacccacugagaagcuaaauaacacucuccucuuccucagaaauucauuauacauuuugauauaacgauaaccuaaggauuguguccauguuacagaagauuuuaaaaauauaaaaauaucacucaaaaaccuucuaccuuaaccacuauuguuuugguuuauuucuuucaaguuauuuucuuguuaagcacuuaaaaaacauaguuggccaagugugguggcucacaccuguaaugucagcacuuugggaggucgaggugggaggauugcuugagcucaagaguuugagaccagccugugcaacauagugagaccucaccucuacuaaaaaucaaaaaaauuagccaggcaugguggugcacaccugaguagcaguuccagcuacucaggaagcugaggugggagaaucacuuggcccaggaguuggaggcugcagugagccaugauuaugcuacugcacuccagccuggacaauggagugagagccuaucucaaaaaaauaaauaauauaaauaaauacaaaauaguuguauauacaacaaacaugaauuuguaacuuuccuuuucccacuugaaauacuuguguuucccauauuauauggucuuuauauaccaucauuuuagcugcagaucaucuugcaggcaucaaaaagauuuuaaagcucucaucuagaguuuauuaucucuauguaauauuucccuacaguccaccugaaagucugaggggccauuguccuggcaaguuuugcauguaugaggauguucacaauuugaaagaauagaauaguucuguauuuccuccauuauugcugaaacccgggacuguuaggauuuggaagauuugcaaaggaaggagccuuagacacaugaaaaaguuaaagaaaggaagggagacauuuaaaauccaggcuuaggauacaggugauuuauacaggaguugaaguauacuucaucauauuuauacuucuuuuugcaggaucagaaaugucaauaugacucaaaauaucgugcugccacauguucaaaguacacugaacuuccuuauggcagagaagauguccugaaagaagcuguggccaauaaaggcccagugucuguugguguagaugcgcgucauccuucuuucuuccucuacagaagugguaaaaaauaaaauaaacaauaauuagaauuuaaagaaagaaagaaaggauauuggcugagcacggugguucaugccuguaauucuagcuuuggaggcugaggugggaggauugcuugagccugggaguuugacaccagccugagcaacaucgcgagacccuuaucucuacgaaaaauaaaaauaaaaauuagccggauauggugacacucacuuguagucucagcuacuugggagggugaggcaggaggacuccuugaacccaggaauuugagguuacagugagcuaugaucauaccacugcacuccaaccugggcaacagagugaaaaccugucucuaaaaaacaaggaagaaagaaagagaaagaaggaagaaagaggggcagggcagggcagggcagggcaagguggggcggggcggggcggggcggggugaggcggggcggggugaggcgaggcaauuuuaaaccucaugaaccaacaucugcuggcuucaaacuuuucuucuguagcuuccucgccucucucagccuucuuacaauagaagagaguuagggucuuguucuggauuagguuuuggcguaaaggcaugcugggcuggcuuacucuuguaucuagaccacucacauuuucucuguaucagcaauaaggcuguuucacuuucuugucauuuguguguucagcagagcagcauuuuuaauuuccuucaagcacuuuuccuuuacauucacagcaugccugacuguucgguacaaguggccuaggcuagguucuggccugucuuggcuuucaacaugccuuucccgcuaagcuuaaucacaucuagcuuuugacuuaaagugagagauaugcaacuuuucuuuuuacuugaacacuuagaagcuaucauaggguuaucauguggcauaauuucaauaucauugugucucagggaacagggaggccugaggagagagauggggguguggccaguccguggaucagucagaacacacacaacauuuguggguuaagucugcuaucuuauauaggugugguuuguagcucacccucaaaauuaugaaguaacaucaaagaucauugaucacagaugaccauaacagauauaauaaugaugagaaaguuugaaauauugugagaauuaccaaaaugugguacaaggacacaaugugagcacaugcuuuugggaaaaugguaccaauagacuugcugaauguagaguugccacaaaccuucaauuuguaaaaaaugcaauaucuagcugggugcaguggcucaugccuauaauuccagcgcuuugggaggccaaaucaggaggaugacuggagccuaggagauugagguuacaauuagcuaugaucauaccaccuguauuacagccuagacaacagagcaaaacacuguuccuuaaaaaaaaaaaaaagcuaauaucugcaaagcacaauaaagcaaagcacaauaaaaugagauaugccuguauacacagagaauuaaaauaacugauuguaugcaaguuuaaaaauacuuagaaaaaaacaaaaaagaaaaaaacuuagaaaaagguggugugcuuaucaaagaagguuucugggggaacuaugacuggagugaugcuaagcuuggcaagaacacugacaaauacagcauugguggcaaauaauuaugagcccuaguuuaugcaugacaguauauguccuugacuuuuuuuuuuuuuuuuaagauggagucuugcucuguugccaggcuggagugagguggcacgaucucagcucacugcaaccucugccuccuggguucaagcaauucuccugccucagccuccugaguagcugggacuacaggugcgugccaccaugcccagcuaauuuuuguauuuuuaguagagauggggugucaccauguuggccaggauggucucgaucucuugaccuugugacccgcccgccuuggccucccaaacuucugggauuacaggcaugagccaccaugccuggacauguccuuaacuuuuuaaauuaaccuugcuauguauccaaagcaggcuaauaaaaaguaauaccguuuuaaaaugcccuuuauuauccuauaguauucacucuuuuuucccacccauauuugauucucaggugucuacuaugaaccauccuguacucagaaugugaaucaugguguacuugugguuggcuauggugaucuuaaugggaaagaauacuggcuugugaaaaacagguaauauauuuacacuuuauauuuaauuggaaucaggaauuugagggaguuucagcaaauacucucaugauuuugaugaugaucauuaugaucacgauauugacaaugaugaacuuuauagcuucuuacaaagugacauucuaaauuacucagugcccccaucuuuucacuuaccauucugccuucaucacuuuguuuuccugguuuaucuucuguacuacuucugugauuauuccuucucagccucucucaugaaccuauuccucuccucuauuuagcccaaaaauguuaguuuuccccagggcucuaucaucugcccauuccucuucuuauuuuauuuuuucuugggugcuauaauuccacucuuaggacucuagcuauaaccuuuauaugccaauagcuuuugaaucucuagcucuaguucugacaucuucccagaacuucagacuuaucuggacacacucacuuacauauaucuuagucuuuccaaacucaauacauccaaauaauucaguacucucucccccauacuguuccuccuucagaauuucccauaucaguaaagggccacacaacacaaucacccaauaagauaugauggauucaucugagaccuccccaaguccaaccaagcaaccaauuagucaaaccaauuuuaccuuaucuauguccuugauucuguuccuucucuguuucuucuauuacggcucuaguucaggcaucucuaguguggacuauugcuguacccuucuaacuggucuccuuuacucucuauuuucuuccccuuuacccucaaauccaucuuucauacugcugccaaacuuauuugucuaaaauaugaacgagucugggcuuauaacucuucuacugaguuucauucgguguaaaauuaauguucccugacagaagacaaauccuauaggcugugcucccugccuugccagccucaccuccuggcauuuguugccuccuauuuucacucugguuauacugcacuauccacaguuguaguucccauacauuccacuuuaucuguaauaccuuccuucauaucuugguuuguguucccucugccuagaacauccugucuucucuuuugguuuacuucuccuuuucuucagaaguagcucaggcacaaucuauuccagaaaagucuuuccugaauccuugggcugaggaacaugucuuuuuucuaugcugccaaaauguccuaugcauacuggaucacaggauuuuaggcauuauauuuaaauuguauauuuaccugucugucacuccaguguucuguacgugccuuuggggagagauuaugucuggucuucauauccgcagcacagacuaaguggguggcaccuaaaggccccucaauauauguauugaacugacaucuauaucacucauaaacaaaaggaacauaacuucuagagggaaaaaauggaggaaauaugaagaguugagacuuuggggcauaccuggaguuucucuuuguguuaguuugcuauggcuaccaugacaaagugccacgaacugagcagcuuaaaugacagaaauuuaugucucccaguucuggaggcuggaagucuaagaucaagguguuacuuccuucucacgcugugaggaagaaaauauucguggacacaggaaaaaaaaacuguaugaucuuacuuauaugugggaucuaaaaaagucaaacuuacagaaacagacaguagaaugauagcugccagggacuggaggcuggguaaugaggagaugcugaucaaagaguguaaacuuucagguauaagaugaacagauucugggaaucaaagguacagcacggguggagauggauguguuauuucauuugauuaugucaaucauugcacaaugugcacauacaucaagucaucacacuguauaccuugaguuuauacaaucugucaauuaaauauguucuuuuaauuaaaaaaaaaaguuugaugccucuccccuagcuucugaaaguuugcuggugaucuuugacuuuccucagccuuuaggacaaucacccugaccucugccuucauuuucacaugacauucucccuguaugcauuucugucucuauucauaauuuuacuuucuuccccuuuuugagacagggucucacucugucacccaggcuggagugcaguggggugaucaauguucaccgcaaccucaaacuccugggcucaagcaauccucccacaucagccaccaaaguagcuggcacuacuggcaugcaccaccacaccagaccaauuuuaauuucuauuuguagagacaggaucucucuauguuucccaggcuggucucaaacuccugggaucaagugauccuccugcuuuggucucccagagcacugggauuacaggugugagccacugcgccuggccaauuuucccuuuucaugagcaucauucauguuggauuaggacccacccuaaugaccucaucuuaauuuaauuaauuaugucuacaucaacccuaucucuaaauaaguucacauucugagguacuggagguuaggauuccaacaugaauuuuguggggacacaaugcaacccauaacaccccuuaaaucuuuacuugaaguacauagucuacaaaucaaacaaaaggugcuuuccuacccuuuucccacuguggcacacauagaagaugaugauauucguauggcccauggggaaaguagcugaggggaucaauaucuugguucacugauaaccuauucacagcacugaucagcuuggguguagaccagugauagcuuuuuaaaaugaaacuauuucccucauaucuuauugacucucuaaggaacucccuacggcagguguucuaaauucccuucucuacugaaguugcucuugaagaucaucuauaucuuuuaguguugaaauucaaaucugcuucucuucacucauucauucaacaagcacuuacuaggcaucuacaaugugacuggcauuaucuaggcccuggagauacaaaaaauaguaagaaaccauccuguccuaaaggcacucacaaucuaacaugaaaaaauauauauaauauauauuauauauacauacauaauauacaauacauauuauguaugcauacauaauauacaauacauauuauguaugcauacauaaucuauaauauacauaauauauaauauaauacauaauauacauauauaauauauaauauauuauguauacauaauauacauauauaauauauaauauauuauguauacauaauauacauauaauauauaauauauuauguauacauaauauacauauaauauauaauauauuauguauacauaauauacauauaauauauaaauauuauguauacauaauauacauauaauauauaauauauuauguauacauaauauacauauaauauauaauauauuauguauacauaauauacauauaauauauaauauauuauguauacauaauauacauauaauauauaaauauuauguauacauaauauacauauaauauauaaauauuauguauacauaauauacauauaauauauaaauauuauguauacauaauauacauauaauauauaaauauuauguauacauaauauacauauaauauauaaauauuauguguacauauuauguauacauaauauacauauaauauauaauauauuauguauacauaauauacauauaauauauaaauauuauguauacauaauauacauauaauauauaauauauuauguauacauaauauacauauaauauauaauauauuauguauacauaauauacauauaauauauaauauauuauguauacauaauauacauauaauauauaauauauuauguauacauaauauacauauaauauauaauauauuauguauacauaauauacauauaauauauaauauauuauguauacauaauauacauauaauauauaauauauuauguauacauaauauacauauaauauauaauauauuauguauacauaauauacauauaauauauaauauauuauguauacauaauauacauauaauauauaauauauuauguauacauaauauacauauaauauauaauauauuauguauacauaauauacauauauaauauauuauguauacauaauauacauauauaauauauuauguauacauaauauacauauauaauauauuauguauacauacauauaaaucucucuauauauaaauauaaauauauuuauaaauauauauauauauauauauauaucucccagccucccaaaguguugggauuacaggcgugagccaccaccgcacccagccuagauguauuuuuaaacgauacaacaaacacaucgugguauaaugauacaugucuaaauggcuaugggacuguugaagaggaaaugccuaacagccuaaaccuccacagagaagacacuauuugaaucaaguuuccagauguauggaauuguucauguauuggaggaggaaaguguguuagagguuggaaaguugcucucaaugacccaaaaaacauaugcaauggcacauuucucacuaucuugauucauuuugcuacaucaacuuuagccucauaucuuacguuauuuuauccaccugccuguuacaugaguuugcuauaucaaagcaaacucaucuauaucaaagcaaacucaccugcuccuucaguuucaacuauugccauuauguagaugauccccaguucauaaucucugaaaaugaccuccuaagugacacacuuccuuguccaacuuccaauuuggcagcucuccuugaaaaauccaaacuccccaccuacaucacccuacuaccaacauauacacacucucauacucaauaaguuuacaauguucuucucuuccuuucuucccucaucccugaaaaggauuuucaaacaagcucaagggaaaacuauuccuuauuuuggguaauauauuaccaucuucagauuauuaaagccuaagcaucaucuuggccuuuuccuuuuccccccucaacccacccagcccuauccauuuggccugugaaucauauuuuauauguauuuucucuuugccauucccaauggcccugcuguaauucagauuccauucuacccagcuauagcgguaucuuuuuaaaauauagaucaugucaacuccugcucaaaaauucugaauaguucaccauugucuaaaaaugaaguccaaacuccuggccaggcauuccagguacuccauuaucuagcuuuuaacauaaccuuagacauuucuuccacuauauuuucauauacccacagucauacucuggccacagugaacuacuuauucaucauucccuaaguuuacagauacaucccuaccucuguuucuuuauauaugcuguaucuuucugaaaugccugugaaguccaaugcugucuauagaaaucccaccugucuuggugaaaugggcauucuuauacaguuugaugggaaaguaagcuguauuuauucuuuuuuuuuuugagauggagucucacucugucaccaggcuagagugcaguggcaugaucucagcucaccgcaaccucugccuuuaagguucaagcaauucuucugccucagccucccgaguagaugggacuacaggcaugugccaccaugcccagccaauuuuuguauuuuuaguagagauggaguuucaccauguuggauggaguuucaccauguuggccaggaugaucucgaucucuugaccucgugaucugcccaccucggucuccccaagugcugggauuacaggcaugagccacccuacccugccuauucucuuucuuggaagcaauuugacaauaugauaaagaacuuuuuaaauguucauauucuucccccccccuuuuuuuuuugagacagagucucgcucugucucccaagcuggagugcaguggcacaaucucggcucacugcaaccuccgucucccagguucaagugauucuccugccucagucucccaaguagcugagauuacaggugcccaccaaaacaccuggcuaauuuuuguauuuuuaguagagaugggguuucaccauguuggccaggcuggucuaccaacuccugaucuugggugaucugccugucuuggccucccaaagugccaggauuacaggcgcaagccacugcgcacagccagugucccauuacuuuuauuucuuggaaucuauaugaagaaaauaauccuaaauaugggaaaacuuucauacacaacuuaugugaauuguagcauuauuauuuaauaguaaaaacuaguaaguagccaaaaaugccuaacaauagguauaugauuaaauaaacuaugacauaaucaacuccaugcauuagauuuauucagacuauuauuaauaaccuaauaaaauacuugggauauauauuuaaaugaaaaaagauacacauaaauacaaaauuuauauguaguauaaauauuagcugaaugugguaagcucaugcuuauaacucuagagcuuugggaggccaaggcaggaggaucacuugaggccaggaguuuaagaccagaaacauagggagacccagucucuauaaacaaauuuaaaaaauuagcugggcaugguggcaugugccuguaauaucaacuacucaagaggcugagguaggaggauuuuuugagcugaggaguuugaggcuacagugagccaugaucacaccacugcccucuggccuaggugacagagcaggacccuaugucaaaaaaaaauuuaaguuaaacauaguauguccaaccaggcuuaguggcucaugcuuguaaucccagcacuuugggaggcugaacugggaggaucgcuugagcccagggguucaagaccagcauggggaacauagugagaccccaucucuauacaaaaauaagccaggcauggugacacacacuuguggucccagcuacuugggagacugaggugggaauaucacuugagcccaggaaguugaggccgcugugagugagccaugaucacaucacucaacucuagcuucagugacagaaugagacccuaucucgaaaaaaaaaggaaggaggccgggcacaguggcucaugccuguaaucccagcacuuugggaggccaaggcagguggaucacuaggucaggagaucaagaccauccuggcuaacacggugaaacccugucucuacuaaaaauacaaaaaaaauuagccaggcgugguggcgcaugccuguagucccagcuacucgggaggcugaggcaggaggauggcaugaaccugggaggcggagcuugcagugagccaagaucacaccacugcgcuccacacuccagccggggugacagagcgagacucugucucaaaaaaggaaggaaaaaaaagaaagguauuaauuuuaaaaugaaaaaaaagucauuacaaauccuauucauuuuuuaaauccugccucaaauacuaucuccuucauaccccauucacuuagaauuguuucucuaauuccuaagcuuuggcaaugcuuuaugaauucuauuauaguauuuuacacauaucccuuguguuauagcuauuugugcaaaccaugccccauucacuaaaauguaaacuucuucaagguaggauagucucuuguucauuuuugcaucuucauuuggacacugauucaacaaacauguauugaguaccuaccaugugccaagcuaggaacuagcgauuggaaaugaaaaaugcagcucuucuaccgucccucaagguacucauagucuaauggagugaaggaaacaggcaggugcauguguaguccauugcaacucaaugugauaaaugcuaaaaucgagguggcauagguugcacuggaggcauagaagaacuucggcagguuauuuaacuucuuuaauuuuaguuucaucagccuucuuacaauggaagagaguuagggccuugcucuggauuagguuuucgcuuaagggcauguuguggcuaguuugcucuuuuaucuaggccacucaaaucauaucagcaauaaggcuguuucacuuuuuuucuuuacuuuuuucuucuuucuuucuuuuuguuguuguuguuguuguuguuguuguuguugagacaggucucacuuugucacccaggcuggagugcaguggcacaaucucagcucacugcaaccuccgccucccuccaaguagcugagacuacaggcaugugccaccaggcacggguaauuucuguauuuuuagcuuguugcccaggcuggucuugaacuccugagcucaagucaucuacccgccugagcuucccaaagugcuggaauuacaggcaugagccacugcaccuggccuguuguuuugcuuucauucauguguucacuggaguagcauuuuaauuuccuccaagagcuuucccuuugcauucacaacauggcuaacugguucaagaagucuagcuuucagccuaccuuggcuuucacaaagcauaaucauuucuagcuuugauguaaaaugagagauguauaacucuuccuuucacuugaacacuuagaagccacuguaagguuguuuuuuguuuuuguuuuuugagacagucucccucuguugcccaggcuggaguacaguggugcaaucuuggcucacugaaaccucugccucccagguucuaagcaauucuccugccucagccuccggaguaacugggauuacaggcacgcaccaccacacccugcuaauuuuguauuuuuaguacagacgggguuucgccauguuggccaggcuggucucgaacucuuguccucaggugauccaccugccuuggccucccaaagugcuaggauuacaagcgugagccaccgcaccuggcccauuguaagguuauuaauuggccuaauuucaauaucauugugucucagggaaaagggaggccagaggagagagagagagaugggggaagugucaguuaguggagcagucagaacacacaccacuuaucaguuaaguucaccaucuuauaugcacguggcucauggcaccccaagacaauuacaauaguaauauuaaagaucacugaucccagcuugggcaacauagcaagacucugucucuacagauaguuuuuuuuuuuaauuacccuggcaugcuggugcauauuuguggucccagcuacuugggaggcugaggcaggagcgugagaccuggaggcugaggcugcagugagcugcgauugugccacugcacaacaaccuggaugacagagugagauccuaucucaaaaaaaaaaaaaaaaucacugaucacagaucaccauaacagauuugcuaauaaugaaaacaguugaaauauuaugagaaaugccaaaaugugacacagggacacaaagugagcacaggcuguuggaaacauugugccgauagacuugcuccaugcaggguugccacaaaccuucaauuuguaaaauaugcaaaauuugcaaugcacaauaaagcaaagcacaauaaaacaagauuugcuugcacuucucaauaccucugcuguuaccauuagaguucaagccaccauccaucuccuggucuauugcaauaaucucauaacugguagcugcuucccucuuguuugcuuggaaucaauccucuacacaguaaccagaauuaucuuuuuaaagcauaaaguagauuauguuacccuucuaccccaaacccucuaauggcuuuccuucccacucagaauaaaacccaugaccuguaaagcaugacauuaucuggccuuagccugccucuccaacuaccucuccaacuacucuccccucucucacucagcucccagcacauuagccuuuuggcuauuucuugacacaucaugcuuauuucuagcccuuuauccaggucuuugccucacuugcaucuuugcgcaaacauccacucagcgaagcuuuucccgaccauuccaccuaaaauugagcccugucucuuaacacucuguaucccuuauccugcuuuauuuuucuuuauuguacuaaucauauauaucaucaaguauuucuucguuuaucauauguuucuccucuagaaccuaggcuuuagaaagacuuugucucuguaauccuaaugccuagaagagugucuggcacagccuaagaagcccaggacuucagucuauuacaaaggaaacuggcauugauuuuagaaggaauaauaaguuaguagccuuauaauaugcaaggagaagguagggugaucaacuuucccacuuugcuaagggcuacgaggcuuucugggacauaggacuuucuuuuuaaaaacaggacagucccaggcaaacugggacuggugaucacccuagaagaacgcuauacauuuuuuuaaaaguagacggacucagcccggcucaguggcucacgccuguaaucccagcacuuugggaggccgaggugggaggaucaccugagguugggaguucgagaccagccuggccaacauggagacacuccaucucuacuaaaaauacaaaauuauccgggcaugauggcgcacgccuguaaucccagcuacucaggaggcugaggcaggagaaucacuugaaccugggagguggagguugcagugaggcgagguugugccauugcacuccagccugggcaacaagagugaaacuccgucucaaaaaaaaaaaaguagauggacucuacuugaguccaaucugauguacucauaccuggauaauaauaaaaauagcuaccuucacuuaguaagcauuggcuauauaccaaauauugugugaguacuuuaaauacauucucucauuuaauuuuuaaaguacucuuaugagauaggcauuuaguuaacaaacucaccuaaaguugaacaguuugagugaaagagcuauagaauuaauaaaaauauacaacuugguaaguaccgaaaugaacauuuggagcagaucuuguauaauucugaaggcaagacuuuguccucagauacuuuauuuagcuuaagauuuuuuuuuuuuaucaguuucauuguuuaagggaaguuagcaggacucagucaaaaagaggucugggaucuuuugcaaaacugggggcaauugaucuuggucgguaaaacugagaaaaguaaauuguuuagauguugaauggggucugggauuccuuggucucacugacugaauucauacugcuaguaacuagacccucaauucaauuuucauacuagaacucagguccaaauucaguucaccuaaaaugauuuauuuuaccuauuauuuaaugcagugaccauaguaggauauaaauuacaugagauccuagauguacuggucugaauuucauuccccauaugacuucacucacagagauaacuguagggauaggcauagauaaaaguuagagugggcuuuggaauaaaauaauccuagauuugaccucuggcuucacaauuuacuaucuaugugacuuuuggcaagcuacuuuaccacucugcccuucuguuuuuuucuuuaguaaaagaagauaauauucaccucacaggaugaugauuaaauuagauaauuuauguuaaucuguuuggcagaguaagugcuaaauaaguggugucuauuaauauuaauaauagccuggccggauucuuguuauugcuuuugcuuaucaaacuggauauuaaaagagcauugcuacagccugggcaacauagugagaccucuucuuuacuaaaauaaaaaauugggccaggcgcaguggcucacgccuguaaucccagcacuuugggaggcugaggcgggcagaucacaaggucaggagaucgagaccauccuggcuaacacgguaaaaccccaucucuacuaaaaaauacaaaaaaauuagccaggcgugguggugggcgccuguaauuccagcuacugaggaggcugaggcaggagaauggcgugaacccgggaggcggagcuugcagugagccgagauugugccacuacacuccagccugggccacagagcaagacuccaucacaaaaaaaaaaaaaaaaaaauuggccaagcauggugguaugcacaugugguccuagcuacuuguaaggcugaggcaggaggauugcuugagcacaggaggucgaagcugcagugagcugugauugcaccaccacacuccaaccagggcaacacggugagacucugucaaaaacaaacaaacaaacaaaaaaacccacuacagccagugguuuauuagaggugacgauggaguuugaauuuuauuguaaaggcauggagagccauugacaauuucuaagcaguggaguggcaauuaagugaaaggaaguaaagaaaggagcucaugaaaauguuugagaaggacugaccagagagagauaagaaaaucagaacauaguagugucuugaagccaagagaccaguaaggugggaguagacaaguguguuaaaugguacagagagaaaaaaauaggaccugcaaaauguccaaugagggcugauacauagaauauuuaaggccucuuaaagcacaguccuuuuaaauggugucauuugucuuccaacaauaaaccagcauuucuuagguucuccacugcaugcaaaaacacaaacuuugagucccugagccaaaauuucuaacagcuucccuuugccuuuguaauugaaguacauguuccuccaccugcuguucuaagcuguucacaacauggccccaaaccagcuuucuauccucuuuuuccacuauucuacuaaagauauccaguuuuccuuucaacuaaauuucuuacugcucuccagacacacuaggcauuuucucaauuucacacuuuuauuuguauccuagagcacuuaaugaauuuugccuuguaugauauuuauauaccuaccacuauaaaaucucagaaugauaaagagcuucagaaaucauuccucuuacaaggauuuucuaaguuuuuucaucagucuugguaaaguaagaaaaauaagaauauuuuggugacuuuuucauuaauauaaauuuauuuacucaaaagacuauccuuaaaauagagauuaugucuuuggauuuuuugcuuuugguguuaaaauguauuuucuuuuacaacauaauggugacaguaaguaguaugguuuuuauuuauuuucuuuuuuugagacagucucacucuguugcccaggcuggagugcacaggcgcaaucucggcuuacugcaaccucugccuugccucccagguucaagcgauucuccuaccucagccucucgaguagcugggacuacaggcucaugcuaccaugcccagcuaguuuuuguauuuuuaguagagacgggguuucaccauguugaucaggcuggucucgaacuccugaccucaaaugaucugcccgucucugccucccaaagugcugggauuacaggcuugagccaccgugcccgaccaauaguaugcuuuuuaaaaaagaugaccauacagccgggcgugguggcucacaccuguaaucccaacucuuugggagccugaggcggguagaucacuugaggucaggaguuggagaccagccugaccaacauggagaaaccccaucucuacuaaaaauacaaaauuagccgucgugguggcacaugccugcaguccuagcuacuugggaggcugaggcaggagaaucacuugaacccaggagauggaggcugcggugagcugagauugcaccauugcacuccagucugggcaacaagagcgaaacuucaccuccaaaaaaaaaaaaaagauguccauacaugcuaauuuuaaaauugauaacuguauaucuaucuguaaaaacuuuuugaacuccucuaaguccauuaaaucaaaaagugaaacacugaucuacucgaacccuaauccgacccaugauuuuucucugcaacaucucuaacaaguagccucugcugcagaguagguaaggaauacaggugcaugccaccaugccuggcuaauuaaaaaaaaauuuuuuuuguagaaucagggacuugcuauuuugcccaggcugcucucaaacucuggccucaaacaauccucccacuucagccucucaaagcacuuggauuacaagugugagccaccaugccuggcucauuuuucaauagcuuuaauuaugagaaagucagcuccacuucuagaucaaaaagcucuuucagagcugcauuuuuguuguuugcuuuagaauucccugcccuauaccuuuuucauaguagucacucaaaaauauuucuuaauugacauucucuagaggaauuuaaguuugauagaaaaucauuacacaugauacuguuaucaaaaaauuuagagauaaaggcuuauaaaggauacuaauacucuuucuuuagagaaggcauauuugcaaaguaggaggauuaaaggacugggauggaucuuacuauaguuuuccuuagguauuaagucuauucaucaauauagcacuaaagcuuuccaaaccauuauuuugaguuaccugaaaucccuggagaaauuauuaccuuauuucauucuaauuuuguuuuacggccuuucauauguaaucacuuauaggagaaaaacaaugagauaaaaaguugauaacaugguuugauuguacgcauuuguaauuuuguauuauuucuuuuucuaaagcuggggccacaacuuuggugaagaaggauauauucggauggcaagaaauaaaggaaaucauugugggauugcuagcuuucccucuuacccagaaaucuagaggaucucuccuuuuuauaacaaaucaagaaauaugaagcacuuucucuuaacuuaauuuuuccugcuguauccagaagaaauaauugugucaugauuaauguguauuuacuguacuaauuagaaaauauaguuugaggccgggcacgguggcucacgccuguaaucccaguacuugggaggccaaggcaggcauaucaacuugaggccaggaguuaaagagcagccuggcuaacauggugaaaccccaucucuacuaaaaauacaaaaaauuagccgagcacgguggugcaugccuguaaucccagcuacuugggaggcugaggcacgagauuccuugaacccaagagguugaggcuauguugagcugagaucacaccacuguacuccagccuggaugacagaguggagacucuguuucaaaaaaacagaaaagaaaauauaguuugauucuucauuuuuuuaaauuugcaaaucucaggauaaaguuugcuaaguaaauuaguaauguacuauagauauaacuguacaaaaauuguucaaccuaaaacaaucuguaauugcuuauuguuuuauuguauacucuuugucuuuuuaagaccccuaauagccuuuuguaacuugauggcuuaaaaauacuuaauaaaucugccauuucaaauuucuaucauugccacauaccauucuuauuccuaggcaacuauuaauaaucuauccugagaauauuaauugugguauucuggugaugggguuuagcaacuuugauggaagaaaauauuaggcuauaaauguccuaaggacucagauuguaucuuuguacagaagaggauucaaaacgccacguguaguggcucaugccuguaaucccaacacuuugggaggcugaaguaggaggaucgucuugagcccaggaguucaagaccagccuggacaacauagugagaccuugucuccacaaaaauaaaaaagaaacuauccaggagugguggugugugccuguggucccugcuaugcagaugucuaagacaggaggaucacaagagcccaggagguugagaaugcagugagcuuguaauugcaccacugcacuccagccugggugacagagcaagacccugucuuaaaaaaagaggauucaacacauauuuuuauauuauguuaaaguaaagaaaugcauaaaagacaagcacuuuggaagaauuauuuuaaugaucaacaauuuaauguauuaguccaaauuauuuuuacguagucaucaacaauuugaccagggccuuuauuuggcaaauaacugagccaaccagaauaaaauaaccaauacuccacugcucauauuuuuaucuaauucagauggaucuuccuuacaacugcucuagauuaguagaugcaucuaagcaggcagcaggaacuuuaaauuuuuuaaguucaugucuaugacaugaacaaugugugggauaaugucauuaauauauccuaaauuaaccuaaacguauuucacuaacucuggcuccuucuccauaaagcacauuuuaaggaacaagaauugcuaaauauaaaaacauaaauaauaccauaauacauggcuaucaucaaaaguguauagaauauuauaguuuaaaaguauuuaguugauuacuuuucaguuuuguuuuguuuuuugagacggagucucacucuguugcccaggcuggagugcaguggcaccaucucaguucacugcaacuucugccucccgaguucaagcgauucuccugccucagccucccgaguagcuggaauuauaggcgugcaccaccacgcccagcuaauuuuuguauuuuuaguaaagacaggguuuugccacauuagccaggcuggucucaaacuccugaccucaggugauccacccaccccagccucccaaagugcuaagauuacaggcgugagccacugagcccagccuacuuuucaguuuuuaacauaauuuuuguuuuauccacaacuuuucaaguauugaaaguagaauaaaaacauggguucuuagucuuuagcuaucuguuaaagccuaugaaugccuucuuaaaaucauguuuuuaaaugcauaaaauauauaggauuacaaaggaaucuaauuauaucgaaauacaguuauuaaaauguuaaaagauaaguuuguuauauauuaauaugcaugcuucuuuauaaaugcauuaaauaagaguuaauagcuauccuaaauuugaaauagugauaagcauaaugaaaauagaugcaaaaaacuaaugugauaugaaaauaucuggguuuuucuuuugaugaugaaguauugcuaauauuaccgugguuuaugaacuauguucagaauugaagaaaauccuaacuuucaguuagagguuagugacgggguucaggacacccuacacaaaauacagcacuuugacauauugaauauuuuaagcugaaggcauuugaggaaauugcagaagcaggaaggugacucugaccuucugccugcuguucuccccagaagcagccauaaaaccugggaaggauuuucugaccuuccccugaaguagaucauaagacugucauguaagaggugcucuccuggcacccagagaaaaggagcauccuuaccuccaaaagcacagggacacaaagaggaaucuaaacaaacaggccucucaguuucccccaguuuauuacauuuagcuuguucacacuuugcccuaugacauuucuacaucacuggcugcucuucaucaaaccuacuauaaaaaacauucaaguucaacuguuucuuugggccuuuauuuccuuauggagccccucgugucguguaaaacuuauauuaaauaaaugugcaugcuuu

SEQ ID NO: 191315 - RNA, 31777 nt, Homo sapiens
gacagcggcguggcggcggcgguggcgguagcgacggcacgccguagggcggucagaagguuuccgguuccgguguaacguucgggcuccgucucaggggcugaaguuugugaggugaguaguggccccgggcccacagaggguaauuccaguccgcgccacuguggccggggacucaguccaaggggaggaccgaagcgggaggguucagcgggaaggagugugaaaggaguaccugguuuggugggagaagagguuggaaugagauuguugagaggaaaagggcgggggcgggaaggagaccggguugggagaccagcucuggggugaggaguuuagguagaacaagguagaguaagagacugguuggagugacggagagaguaaaaaugaagauuagcgggggaguggggggcugcagagggaaacucagguuguagcaaacaagagcacggaguaaggaauuccuucugaagacuggauuuggauucugcugccugcucauugagaggagagaucauuguaccucgcuuuccuuccgcacccccacuacccccgcaccucgcaguuauuguugagcauuugauuagugacaaggcuaauuaccguuugaaacuuuuuuauccauuggcuguuuaguuugcacgucaucuuauggagguaacaguggcaccucauuuauugcuuugggcuuucaaauugcuuauacuuucuagccuaucauucaauucuaguggaauauaagacccguuaaggugaggacucuuguuaguuuugcucacuguuuuauguauccaccgcaccuaguacauugcuugacacuuaguaguuacucaauaaauauuuauugaaugaauuaggauguaaauauggcaguacucauuuuguaagaugguaaacuguggcuccaaagaauuacuuaacuugcccaagggcuuguaaaugguggggcucagugucccaacuguuucugugugaacucuuguuuucacuuucuauggcaucuggauaugccgcuuuugugcaauacauguguaauauguagaaauugguacgcuguaugucuacucauugugggguaauagaaccaccauagaauuacucacguaacuugucacugaggcagaaaaucuuucagucuuaguuucaucacuucaaucuacuagcuuccuuuggauauaccaaaagugagucuauuuggcagcaagucuuauagacucuaguauagaggcuaaacuuaccaagaauguagaaguuaaucagacuggauuuuuuggagaaaagaugucuuaaaacaucuugaaagaugauucccagaucuuugauaaguggcacugcugggaauagcugagcuuggaaauugaggucagucaauuuauugacucccauuuagacaccuuuuuuuuuuuuuccccgggacggagucuugcucugucgcccaggcuggagugcaguggugcgaucucggcucacugcaaccuccgccuuccauguucaagggauucuccugucucagccuccagaguagcugggauuacaggugcaggucaccacgcccagcuaauauuuguauuuuuaauagggaugcgguuucaccauguuggccaggcuggucucgaacuccugacgucagauaauccacccgccuuggccucccaaaguguugggauuacaggcgugagccaccgcaccuggcuuuuuuuuuuuuuuuuuuuuuuuuuuuggagacacaguuucacucugucgcucaggcuggagugcacaugauuuuggcucaccgcaaccuccgccuccuggguucaagugauuuuccugccucugccucauaaguagcugggauuacaggugcccaccaccucaccuggcuaauuuuuguauuuuuaguagagacaggugcagugggucacgccuguaaucccagaacuuucggaggucaaggugggcagaucacuugagguaaggcauuaccuggccgauauggugaaaccgugucuuuauuaaaacuacgaaauuggccaggcgugguggugcaugccuguagucccagcuacuugggaggcugaggcaggagaaucaagugaacccaggagauggagguugcagugaaccaagauuacgccacugcacuccagccugggcgacggagugagacugucucaaaauaaaaaugaggguauucuuuucugagcugaaggaucaucaagucagcugauggagacccuguagauugaacaugauaauuaccuguaugcagaauucccacugggaugaauaugaccacagagaaaugugacagaacauucuuuuuuuuuuuuuuuuugagacggagucuuacucuguugcccaggcuggagugcaguggcgcgaucucggcucacugcaaccucugcugccuggguucaagugauucucuugucucagccucccgaguagcugggauuacaggcgccugccaccaugcccagcuaaauuuuuuuguaguuuuuaguagagaugggguuucaccaucuuggccaggcuggucuugaacuccugaccucgugauccaccugccucagccucccaaagugcugggauuacaggcgugagccaccgcgcccggccagaacauucuuaaagaucaugagauuuaauuuaauaucuaagaugacugaccuggauaaacccucuuuuacuugcauaccuuaaaagaagggaauccuacauaagucaggguuggguuagggaaugccugccuggaaguaggaagaauggaaaagcuggccucuggaugggcuuuuuuaguucuguuuuaguguuacuagguuugcaaguccuuguugauaugacaggaucaagaaagaagcuagaacuaauuucucagacuuagcuuauucacagaguuuguuuauuccgcagauuucauugaucaacuuaagaguuagaauuaaaaaucaaaugggaucucuuucugcuuugagauaugguucuuggggaaaauauuugccuucaaaugaguuggaaaaacuugucuagggauugagaauagggcuggggaaugcauuccugauguacuaaccauuucccuggaucacuuuagucuuuuuuuuuuuuuugagagagagucuugcuuugucgcccaggcuggagugcaguggugcgauuuugacuuguugcaagcucuaccucccugguuauuccccugccucagccucccaaguagcugggauuacaggcacaugccaccacgcccagcuaauuuuuuuguauuuuuaguagaggcaggguuucaccauguuggccagacuggucucgaacucuugaccccaggcaguccauccaccuuggccucccaaagugcugggauuacaggcaugagccacugcacccagcccacuuuagucuuuucuuauucucuaacuugucucuuuuuuuuuuuuuuuuagguguaguauugaguccuguuugagcuauuguucucuuuuuccugaaaaauggcacugucaaagagggagcuggaugagcugaaaccauggauagagaagacagugaagaggguccuggguuucucagagccuacgguggucacagcagcauugaacuguguggggaagggcauggacaagaagaaggcagccgguauguaccuuucugcaucuuuuaucuuaacauauagggugaccccaaacacugcuuugaacuuccucaaaauucucucuguugggaacaucuaaaaaaauggcaggccauauuuuauuuucaccuguauuauagugaaaauaggcuaaauaauaauuugcuuuuucucuuaauugcuuauuuuuuauguuauuuaugauagauuuuaaaucuucguuuggcuaccauacugagucaccuaaguuagauuuacuuaggaaguaugcuuaagucagauaggcauauucagauucagacugaacaucucaacauacaaaaaucuuuaugaaauacaugaaaaagcuugaaggagguagauuuuguuaaugguaggcuucuacaacuugcuauuugggaaaggugagggugguuauucaucucaaacuugauguucaagguaaacagguugcucuaacugcaccacuucccacgccaaaaaauuauaacuauuuucaccucacagggcaaggucauuuaguguaagagagaugggaauccuacaaaaaacuuaaaauuuguuucacuccugggaauaaaauuccaguguugguaccuguuauaggccuaguauuagacuguguacucuuaccuuuccaacccuaccaccgccuuucuuccugucagaucaucugaaaccuuuucuugaugauucuacucuccgauuuguggacaaacuguuugaggcuguggaggaaggccgaagcucuaggcauuccaagucuagcagugacaggagcagaaaacgagagcuaaagguagguuacaauuuacugucuaaugagcucaggacuguuuugaaugguaacagaguugcugagcuuaccaguucacacguugauauccucuauuuagagcagcaaauguucaagagagguacuuagacauuagaguaggagagaugaauuagugucaucaccaucugaacuaccucuaaguucauggguugaaauauccaaagaaauaauuggcagcuuugucuuuuuuuagauaacaggaguuuugauucucauguuucuccauauuuccuuuuuuuccuucuuacuguuacuuauaaacugauugcucuaagauuuuaucuuugauuuauuugaggccuaauaaguuguuuuagaaugugacuccacugguaccugagcuguacaccucauuguugccucuuuguagaaguuucucugcaaugcacuuguagauagaauaccaaaaaauaacuauuauuuauuauauucuugagagcuuaccauuugcucuauggcauauugcugguccucugcugccaugagugaaacacuuggaggaguugucaguacccccuuaacuacuacacuuuuuauucuguaguugccgacugauccuggccucuuucaguauuagcaguaucaaguagccuauuuuucuacucauuucccaguaucucucuuuaggagaaaaaaaaaaguucugugacuccuaucaaaccuuccaaaguucuucugauaccuuggcuaucccauuacuuuuccugagggaaaagagugaauaaguaaugucugcuugguccccuggccaggcuauggaacuaaagaaaaaaagcagagagauuugugcccuuuguguuuggagcauuguaggguggucagagaaggagagauaguccuugccuuaaaacaauuuguaauuugucaggcaguguggcaugugccuguaauccuagcuacuugggaagcugaggcaagaggaucucuugagcccaggaguuacaauuuagaagaggcagggguaucacaaaauauauauucacguauuauaaaaucuaaguagcaguuucauguaaauuuuaggguugguuauagaauuucagaccuauguugaauuuuguuauauuuaagguggaaugauugauccacaguauacacagaucuguacagugaagauuaugucacgauagggcauacuucuuuuuuuuuuuccuuuuuuuuuuuucaagggugagucucacucugucgcccaggcuggaguacaguagcgcaaucuugacucacugcaacuuccaccucccagguucaagugauucuccugccucagccuccugaguagcugggauuacaggcacaugccaccaugccuggcuaauuuuuguauuuuuaguagagacgggguuucaucauguugaucagguuggucucgaacuccugaccucaagaucugcucgccucggccucccaaagugcuggaauuacaggcaugagccacugcgccuggccaguagggcauacuucuguaugagugcugagggcaugcugugaaugaagugacuacauugggugggauuaauaaaaauggcuucuugaaggaggugucuagauagccuugggauacgggucccauuuuugguccauucagguccccaccccacacaauauauuaugggagaguccuuuuucuugaacuguaggaguuccaggaagcgcucgccccuggccgaggauauguccuugcaaaacacgagcccuccuagugaagaggggaugucacccaaagccuaccaccgguguguacauuugcuuuuucccauugucccuuccaguuggccacucucgguccuguuaaauucaccuugcaaauuagucaucauauuugaguuuccauuguuugaugaaaacaaaguguuaauggggauuacugaagaagaaagagaaagccccuguccuggaagagcuuagacuuaguugggaaaacuauacuaacauugaaauacuuaacacuuggcaaacagaauaucaacaauguaauuuaaccuaauaugaaccaagcucuuacacgcuaagagaaugugaaacaaaaguuuaaucagagugggauagguuauaaugaggaaaacuucuuggaggaggugaguuuuaggcaggauuuggaacagggguuguggaaaaguugagagaaaucauuauaaaugugagcaguagcauuugcaaagaccuugagaugggaacauuuauaagaacaugggaaugaaauuuguuugacuggauuaggagaauguugaaguugggugagauggagagucuaguagacccugcuucuggcagguggcuauuugcaagguugugucauauuccccugggaauagccagaaaaugcugguaggggcuaggauaauucuuccuuucuccccacggggagggauacagcuuuucuuucaucuuggguucccuuaggagguguuuggugaugacucugagaucucuaaagaaucaucaggaguaaagaagcgacgaauaccccguuuugaggagguggaagaagagccagaggugaucccugggccuccaucagagagcccuggcaugcugacuaagcuccagguuagugauuagggacuggaagcaaagugguuuugugaguugaagaagcaaaaggugcaugggucuguauuuauuguggaauuuuuuuuuuuuuuuuuuuuuuuuuugagguggaguuuugcucuugucacccaggcuggaauacaguggcgcgaucucagcucacugcaaccuccgccucccggguucaagcaaaucuccugucucagccuacugaguagcugggauuagaggcacccaccaccaagccuggcuaauuuuuguauuuuuaguagagaugggguuucaccauguuggccaggcuggucuugaacuccugaugucaggugaugcacucaccuuggccucucagagugcuagaauuacaggagcgagccacugcgcccggcuaauuuuuuguauuucuuuuaguagagacaggguuucaccauguugggcaggcuggucuucaacuucugaccucaggucaucugcccaccuucgccucccagagugcugggauuauaggcgugagccagcgugccucgccuuauugugaucuugauuugaauuaguguuuagcauuuggggaaacuuuuuuuuuuuuuuuuugagauagaguuucacucuguugcccaugcuggaguguaguggcgugaucucagcucacggcaaccuccaccucccagguucaagcgauucuccugccuaagccuccggaguagcugggacuacaugcgaacaccacuacgccuggcuaauuuuuguauuuuuaguacagaugguauuuugucauguuggccaggcugcucuggaacuccuggccucaagugaucugccaccucagccgcccaaauggcugggauuacaggugugagccaccaugccaggccagcauuugggaaaauuuuauuuccugcuuuauguuuuagcguucuuugauuugaccaggaguauucuagguaaggguauugaaauugccauuuacuguggcaagcaaaguguguuauguacauuauuugccuaauuaccuaugucguugagucauugagaaaauuaaaugaaaugaucagaacucaucuuaaugacagaggagacucuccaaacauaaugcaaagaagauauaauccacugauaaauaauuuuaaguugacuuuauuuuuuuuuaacaggaaguauuuguguuuuuucaauuggcauuguuaaauaauaccacauaaguguuucuuuuaccauuuaauauuugagggggguaauagaacauauacagaaauauggguggguggauuugcauauaugugauauuuacagaaggaaagaaauggauuuuuuuugugugugugugugagauguucucucugucacucaggcuggagcgcaguggugcgaucucgguucacugcagccucugccucccagguucaagugauucuccugccucagccuccuaaguagcugggauuauaggcaugugccaccacgcacggcuaauuuuuguauuuuuaguagagacaggguuucaccauguugaccaggcuggucuggaacuccugaccucaagugaucugccuaccuuggccucccaaauugcugggauuauaggcgugagccaccguaccuagccuguuuuuguuuuucaggcaaggucucacuuuuuuguccaggcuggaguucaguggcgagaucuuggcuuacugcaaccucugccucccgggcuugagugauccucccaccuuggcuucccaaguagcugggacuacaggucaccaugccuggcugauuuuuguauuuuuuuuaaagauugaguuccaccauguugcccaggcuggucuugaacuccugggcugaaaugauccuccugccucagccucccaaagugcuggacuuacaggcgugagcuaccacgcccagccaauuauuuucuuuuuuggggggugggggauggagucuugcucugucacuuaggcuggaguacgguggcgcguucucggcucacugcaaccucugccucccggguucacgccauucuccugccucagccuccugaguagcugggacuacagguauguaccaccaugcccgacuaauuuuuuguauuuuuaguagagaugggguuucaccauguuagccaggauggucuugaucuccugaccucgugauccacccgccucggccucccaaagugcugggauuacaggcaugagccaccgugccaggcccaaugauguuuuuuauggagaauggggauggacguauucacaacauauccuuuuguuauguuucuuucuuuuuuuuuuuuugagacggagucucacucugucgcccagaguggaguguaauggcgcuaucucggcucacugcaacguccgccucccggguucaagcuauucuucugccucagucccuugaguagcugggauuacaggcacgcgccaccacgccuagcuaauuuuuuuguauguuuaguagagacgggguuucaccauguuggucaggcuggucucgaacuccugaccucgugauccgcccggcucggccucccaaagugcugggauuacagacgugagcugccaggcccagccuguaauuuuucauuuuauuuuauuuuauuuuuugagacggagucucgcucuugcacuguugccuaggcuggagugcaaugccgugaucucagcucacugcaacguccgccuccuggguuccagcaguucuccugccucagccuccugaguagcugagauuacagaacgugcaucaccauauccagcuaauuuuuguauuuuuaguagagaugggguuucacccuguuagccaggauggucucgaucuccugaccucgugauccaccugccucagccucccaaaguauugggauuacaggcgugagccaccacgcccagcccuguaauuuuuaauuuuuuuauuuucuuucuuucuuuacuuauuuagagauggagucucccccuguuguccaggcuggagugcaguggcaugaucuuggcucacuguaaccuccaccuucuggauucaagcgcuucuccugccucagccuccugaguagcuggcauuacaggcgcccaccaccacacccggcuaauuuuuguauuuuuacuagagacgguguuucaccauguuagccaggcuggucuucagcuccugaccucaagugauucgcccaccucagccucucaaagugcugggauuacaggcgugagccaccaugccugacccuuccguaauuuuuguauuuugaauauaucaccuauucaagaaaaaauguuaaagacaaauguuuaaaaauaucuugaagcaguuuaagaacaggucuguuuugcaaaauguaagaggaguuguuuggccauacccucaaagcuuaucauucugaacuucuuuaggacagaagggguuuauagagacuagggagcaggucuuugcaccaucgucucuuguuucccaaacuaguaguucaaguacuaauaucaugauuuuuuaaaaaaaauuaaguauaggcugggugcgguggcucacaccuguaaucccagcacuuugagaggccgaggugggcggaucacgaggucaggagaucgagaccauccuggcuaacagggugaaaccccaucucuacuaaaaauacaaaaaauuagccgggcgugguggugggcgccuauagucccagcuacucgggaugcugaggcaggagaauggcaugaacccgggaggcagagcuugcagugagccaagaucgcaccacugcacuccagccugagugacagagcgagacuccaucucaaaaaaaaaaaagaaaaauuaaguauaauauuuuguguagguucuguuagguuugcaugcauuauuuaagugguuaacacuagaccuauaagguagguacuguuuucuucccccuucuagacacuuaggagguuuagagacuaaguuccuuauccaagauaacaaaggcauuaaguggcagaguuaagauucaaacucagguuucucugacuccagagucucaaucaucacacuauauuacuaccuaauaugcuaaucuugcuuuaggaacauggguugaaaaauuccagugcucacuuaucuugacuaaauuuuuugcacuguggugcaggcagaaugugguauagucauucaaaacauuuuaagugucuagaccugagagccuuguggguuuaaaaaccugaaugggagaaguaagaaggagaaauuaacaguuuuucaauuuuuuuccuggagagcagaucaaacagaugauggaggcagcaacacgacaaaucgaggagaggaaaaaacagcugagcuucauuagccccccuacaccucagguauugugucuagauuacucugaacagaauaaucuuuggcacagaauuucuugccauccacucaaaaugagagacuagaagaggugacuacauguuucacuucauaaucaucugcuacagucuaccaugauguguguguauaucuguguguauguauguguguuugucugccugucuuaauuccucugauuucuuuuucucuaucucacagccaaagacuccuucuuccucccaaccagaacgacuuccuauuggcaacacuauucagcccucccaggcugccacuuucaugaaugaugccauugagaaggcaaggaaagcagcugaacugcaagcucgaauccaagcccagcuggcacugaagccaggacucaucggcaaugccaacauggugggccuggcuaaucuccaugccaugggcauugcucccccgugagugucuauuucauggaauaccuuuucauuucugaaguuugagaagcaauaaauaccuuugaauguuacugaucuggcugggcgcagugccucaggccuguaaucguagcacuuugggaggcugagguagguggaucaccugaggucaggagucaggaguucgagaccagccuggccaauauggugaaaccccaucucuacuaaaaauacaaaaauuagccaggcgugguggugcaugccuguaaucccagcuacucgggaggcugaggcaggagaaucgcuugaacacaggaggcagagguugcagugagcugagaucgugccacugcgugggugacagagggagacuccggcucaaagaaaacaacaaacaaaauauuacugauccucuuuuuccacagaaccuagaucauuucucacaguuucauauuucuuaggugugauugauuaaucaguugaauuuuuucucgucuucccuguuggaggguuuauuaucuucuuaugauuuauauaacugagauuaagguuauucaucuaauguuggagcuaggaguauagccagguuuccuuccugguuucaaacucagauuuauccauuaaaccacauugugugagacuagaucugagguuccucugcaacuggucaaagauguuacauuuuuuuuagcaucuacaguuggucuggcaucccaugagugacauaagaauucagggauaaggaaagauaggauuauaaauucauauaauuuauaaacucauuucauuugguuguccuguauacugaaauauccacuuugauauuuuuaaucaagauacuauuggcagggcgcgguggcucacaccuguaaucccagcacuuugggaggccgagacuggcagauugcuugagcucaggaguucaagaccagccuaggcaacauggcaaaaccccaucucucuaaaauauacaaaaauuagccaggcaugguagagcaugcguguaguuccagcuacuuaggaggcugaggugggagaauuucuuugggccugggagguugagguugcaaugagcugugauugugccacuguacuuuagccugggcagcagagugagaccaugucucaaaaaaaaagaugguauugcucacugaugagauuguucccuagaauuauuuuauuguccuuuuuguuguuguuguuguugagagggagucucacucugucacccaggcuggagugcagugaucucggcucccugcaaccucugccucccagguucaguagcugggacuacaagugcccgucuaaauuuuguauuuuuuguagagaugggguuucacuguguugccaaggcuggucuugaacuccugggcucaagccauccacccgccucagccucccaaagugcugggauuacagugugagccaccacacccguccauccaaauaacucuuauagagaaggcacugcagccucaacuuccugggcucaagugauccuccucaaccuccugaguaggugggaccacagguauaugccaccgcacccagcuaauuuuaaauuuuuuguugagaugcagucuccuuguguuggccagacuggucuuuaacuccuggucucaagugaucccucugccuuggccucccaaaaugcugugguuccaggcuugagccaccacgccuggcuuuauuuuguuuuuugcuugccuuaauguuccauacaggauuuauuucuuugcgggcuauuuuucaggaagguggaguuaaaagaccaaacgaaaccuacaccacugauccuggaugagcaagggcgcacuguagaugcaacaggcaaggagauugagcugacacaccgcaugccuacucugaaagccaauauucgugcugugaagagggaacaauucaagcaacaacuaaaggaaaagccaucagaagacauggaauccaauaccuuuuuugacccccgagucuccauugccccuucccagcgccagagacgcacuuuuaaauuccaugacaagggcaaauuugagaagauugcucagcgauuacggacaaagguaucuggcuuagaguauaacacagaauuuggaaaaaguuaagaagcugacaagaaaacauuguuaaaucucuguguucuaggaaauuagauaaauaggucauuuaaagcagcaguccucaaccuuuuuggcaccagggacuuguuucauggaagauaauuuuuccccuggaguaaggaugguuucgugaugguucaagcacauagcauuuauuguguacuuuauuauuauuauuuuuuucgagauggagugucgcucuuguugcccaggcuggagugcaauggggcgaucucggcuugcugcaaccuuugccucccagguucaagugauucuccugccucagccucccgaguagcugggaucacaggcaugugccaccacgccuggcuaauuuuguauuuuugguggagacgggguuucuccauguuggucaggcuggucucgaacuccugaccucaggugaucugcccacuuuguccucccaaagugcugggauuacaggcgugagccaccgcccccgccuuuuuuuuuuuuugggcggggagggggauggagucuugcacuguuaccugggcuggagugcagugguacagucucagcucacugcaaccucugccuccuggguucaagcaauucuccugccucagccuccugaguagcugggacugcaggcaugcgccgccaugccugacgaauuuuuuguauuuuuaguagagacaggguuucacuauguuggcccggcuggucuuaaacuccugaccuugugaucugccugccuugaccucccaaagugcugggauuauaggcgugagccacugugcuggccuauuucuauuauuauuuuauuguaauauaugaugaaauaauuauauaacucaccauaauauaaaaucacugggagccuugagcuuguuuuccugcugaaauggucccauuugggugugaugggagacagugacagaucaucaggcauuagauucucauaaggaaugugcaacauagcccccucacauguacaguucacaauaggguucgcgcuccuaugagaaucucaugccaccgaugaucugacaggagguggagcucaggccauaaugcagguaauagggagcaaucguaaguacagaugagacuguuggcuugccugcugcucaccuccuguugugcagcccaguuccuaaaagacuguuggguuggggaccccugauuuaaagcaaugaauacuuugaaaaaugugcuggacaagauggcucaagccuguaaucccagcgcuuugggaggccgagguggguggaucacgaggucaggaguucaagaccagccugcccaacauggugaaaccccgucucuacuaaaaguacaaaaauuaaccgagcgugguggugggugccuguaauccuagcuacuugggaggcugagucaggagaaucacuugaaacuggaaggcagagguugcagugagcugagaucgcaccacugcacuccagcaugggcaaaagagcgaaacuccgucucaaaaaauauauauauauauuuauuaauauaauacauaauuuuuuuagcagauuuuacuuccuaauucguuucuacauaaguggaaauauuaugaaauugaguuugaaaauucuccacauacaacuaaguggagggaaacaauuugaaacauucugagugacuaaggaaggcuugccuguaguuaaaauuuaaugagacaguacaccuggagaguugaauugauuguauauugaaugaccuuugccgccuuuuuauccucucaaagugagguuuucauaaaauuccuuuuuuuuuuuuuuuuuuugagacggagucucgcucugucacccaggcugcagugcaguggcacgaucucagcucacugaaagcuccgccuuccagguucaugccauucuccugccucagccugccgaguagcugggacuauaggcgcccgccaccacgcccggcuaauuuuuuuguauuuuuaguagagacgggguuucaccguguuagccaggauggucucgaucuccugaccucaugauccucccgccucggccucucaaagugcugggauuacaggcgugagccaccacacccggccauaaaauucuauuucugcguauuuacugcaggcauauacuguggagugcagggagggguugaaggugagaucuauguauaugaacuaaauaaaggauaaaauaaagcagaacaacuccuuucuaagcuuucagaaauuaugaacuuguugcguuagguguaaagaguucaacggggaaguguuuuaaaauuugggauucuuggccgaggugggcgaaucacuaggucaggagaucgagaccauccuggcuaacauggugaaaccacuucucuacuaaaaauacaaaaaaaugagccgggcguggugaugggcgccuguagucccagcuacucgggaggcugagucaggagaauggcgugaacccgggagguggagcuuacacugcacugcacugcagccugggugacagagugagacuccgucucaaaaaaaaaaaaaaaaaauuugggauucuggccgggcacaguggcucaugccuguaaucccaucacuuugggaggccgaggcgggcagaucaccugaggucgggaguuugagaccaggcugagcaacguggagaaaccccaucucuacuaaaaauacaaaauuagcugagggugguggcacaugccuguaaucccagcuacugaggaggcuuaggcaggagaaucgcuuaaaccuggaagguagagguugcuguuagccaagaccaugccauugcacuccagccugggcaagaagaacgaaacuccgucucaaaaaaaaaaaaaaaauugagauucuacacauucuguuuucuaugacuccaauuuaucuuucugucuuggauuaucuuguuuuuaggcucaacuggagaagcuacaggcagagauuucacaagcagcucgaaaaacaggcauccauacuucgacuaggcuugcccucauugcuccuaagaaggagcuaaaggaaggagauauuccugaaauugaguggugggacucuuacauaauccccaauggcuuugaucugugaguuuguuuuaguaccuuuuuaaaaaaacaguuuuuaaucagcugaguuuaagacucaaguuaauaccuuuuaguaaagcuaugguuuuagugggaaggaugguacucauucauuaauuaaaauuuuuaaauccaagagagauaaguaacuguacacaagguccuguauuuuuuuuuuuuuuuuuuuuugagagggagucucgcucugucacccaggcuggagugcaguggcacgagcucagcucacugcaaccuccaccucccggguucaagagauucuccuugaauucuccuugaaucucagccccucaaguagcugggacuacaggugugugccaccaugcccaucugcuuuuuguauuuuugauagagacaggguuuugccauguuggccaggcuggucucgaacuccugaccucaggugauccgcccaccuuagccucccaaagugcugggauuacaggcgugagccacugcaccuggccaagcuccugcauuuguaagugauguaucauauauauaggcuguuuuuagcuuuugggguuaauguaggauaaccagggacacaaucuacaaaagcaaagucuagaauucuuuuugcucuguuacacauuguugccuguuuuuagcauuauuuuccuuaauuacauucuuuugcuacguauuauagguguuuacauuuccuaaagaucucauugugauagagcaaggauuauuaguugguaggugagauaauaguaaauauagcauauaaggcugggcucgguggcugacaccuguuauuccagcacuuugggaggcugagggcugaaggauugcuugagcccaggaguuaaagaccagcuugggcaauauggugagaccucguuucuacaaagauuaaaaaaaaaaaaaaaguagcugggcaugguggcuugugccuguaguccuggcuacccaggaggcugaugugagagaaucacuugagcccaggagggucugugcugcagucagcuaugaucaugaccacugcacucuauccuggacaacagggugaaacucugucucaaaaaaaaaaaggauauaagacacauuugaagagcuuuaaauauaucugcuccauccauuuuuuuuuuuuuuuuccugagacggaguuucgcucuuguugcccaggcuggagugcaguggagcaaucuugguucaccacagccuccgccuccuggguucaagugauucuccugccucagccucccaaguagcugagauuauaggcaugcaccaccacgccuggcuaauuuuugguguuuuuaguagagacgagguuucuccauguuggucaggcuggucccaaauucccgaccucaggugauccacccgccucagccucccaaagggcugggauuacaggcaugagccaccacgccuggcguuuuuuuuuuuuuuuuuuuuuuuuaagacagagucucacucuguugcacaaucucggcucgcugcaaccucugucuccuggguugaagcaguucuucuagcucagccucauaaguauccgggacuacaggcaaauaccaccacaccuggccaguuuuuauauuuuuaguagacaagaguuucacuauuuggccaaacuggucucaaacuccugaccucaggugauccaccugccuucaucucccaaagugcugggauuauaggcauaagccacaucaccuggcccugcuccaucauucugauacauggcuuuaguagauuuugucuuagccuuucguugccccuucuuugucagccacuguuccagggacuuauugucacuaaugagagaacauagcgucugucagcuguggcaugguagaaaaaagguugagaaugauugcuguggagaguguguucaaccauagagggacucaguuuucucaucaugaaaauuauguguaauuuaacuauauauuuuagguaccuaaaugcuauuuuagguauaucaagcacaagaacccauuauagagaguggguuuuuucauuguauuucugagacuccucucuuagaaucaucucuacccgcauaucguguuuucuuuucuuccuacaauuuuaguacagaggaaaaucccaagagagaagauuauuuuggaaucacaaaucuuguugaacauccagcccagcucaauccuccagguaauguauagauuccugaaucaagucucuagagcagcauuacccauuggaaauuuauacagugaggaacauguucuguaucuaugcuguucaauacaauagccacuacccauguguaauucuuuuuuuuaauucaguuuuuuuccugacaauaguuuguuguuugaccagugaacauacauuuuaagugcauauuccugugcuuagaauuucaugagacagccaagcaugguggcucaugccucuaauccaaacacuuucggaggccaaggcaggaggauugcuugaggccaagaauucaagaccagucugggcaacacagugagacccaucucaaggaaaaaaaauuuggcuggguaugguggcuuaugccuguaaucacugcacuuugggaggcugaggugggcagauugcuugagcucaggaguucgagaucuaggcaacauggcaaaaccccaucucuacaaaaaauaaaaaaucagccgggcaugguggugugcaucuguagucccagccucuugggaggcugagguguggaggauggcuugagccugggagguggaaguugcagugagcugagauggugcugcugcacuccagccuggaugauacugccagaccuugucucaaaaaaaaaaaaaaaaaaaaaagaagaaagaaagaaagaaaaaaacccaaaauuucaugaagcuuuacauuuacaguucccugguuguuccuaggaaagagcccucagcuugcuccuuuuauagaaccacauguuguuguggcauccacagcuaaaugcaaaugcaagagccaaacucuuggguugguguguuauuagaugcgauaugcuccacuacccacugugagggaugcuaauuccaaagggcuuuuuguuaguuucccaaaguugaaacugggaaacaaaguugcuucuauuuuuuuuuuuuuuuuuuuuuugaggaggaguuucgcucuugugguccaggcugcagugcaacggcaugaucucagcucaccacaaccucugccuccuggguucaagcaauucuccugccucagccuccugaguagcugggauuacaggcaugugccaccacgcccagcuaauuuuguauuuuuaguagagacaggguuucaccauguuuggucaggcuggucuugaacuccugaccucaggugaucugccagccuuggccucccaaagugcugggauuauaggugugagccaccgcgcccggccuuuuuuuuuuuuuugaguuggaguuucgcuuuugucacccaggcuggagugcaauggcacuaucuccguucacugcaacuuucaccccccuggguugaagcuauucuccggccuuagccuccggaguagcuuggauuauaggugccugccaccacaccuggcuaguuuuugaacuuuuaguagagacaggguuuugccauguuggucaugcuugucuugaacuccugaccucaagugaucugcccaccuaggcuucccaaagugcuggguuuaccggcgugagccaccgcaccuggcccuaauuuuguuuucuacauuugccagguaucauugaaugaggggguuuaacagcuuaaaggaaaacaacuaagaacacuacuuaagaaagauaagaggccaggcgagguggcucaugccuguaaucccagcacuuugggaggccgaggcgggcagaucacgaggucaagaaaucaacaccauccuggcuaacaaggugaaaccccgucucuacuaaaaauacaaaaauuagccagacgugguggcgggugccuguagucccagcuacucaggaggcugaggcaggagaauggugugaacccaggaggcagagcuugcagugagcugagauugcgccacugcacuccagccugggcagcagagcgagacuccgucucaacaaaaggaaagauaagaauguuuuuuaaaaacauagccauauugccgggcaccaggccugaacugauuuuaaucuuacugaucccuuauuaacgaguuuucuucauuuucuauuuaaaguuuauacacacacacacacacacacauguuuuuugaaauggagucucgcuguguugccaggcuagagugcaguggcaaguggcacaaucucggcucacugcaaccuccaccucccggauucaagugauucuccugccucagccucccgaguagcugggacuacaggugcgugccaccacgcccagcuaauuuuuguauuuuuaguggagucaggguuucaccauguuggccaggcuggucucgaucucuugaccucgugaucugcccacccgugccucccaaagugcugggauuacaggugugauccaccgcaccuggccucaauauauuuuuuacauaaaauguuuauaauagaguugggucucacuugguuguccaggcuggucucgaacucuugggcucacgccauccucccaccuuggccuaucaaagugcuagaauuacaggcauaagccacuguguccagccuaaaguuucuuuuaaugauauugauauuuaccuagguuucuuuaauauuuuuauugcuguccgggccugguggcucaugccuggccaacauggugaaaccccaucucuacuaaaaauacaaacauuagccaggcaugguggcgugugccuguaauccuagcuacucgggaggcugaggcaggagaauuacuugaacccaggaggcagaggcuacagugagcugagaucgugccauugcacuccaaccugggugacagagugagagagagaaaaaaaaaaaauauauauauauauauauguauucuuacugcuuugguauacuaauaucucugccugacaguugacaaugacacaccaguuacucugggaguauaucuuaccaagaaggaacagaaaaaacuucggagacaaacaaggagggaagcacagaaggaacuacaagaaaaagucaggcugggccugaugccuccuccagaacccaaaggugcauuucucaguggccucuucuguuaaaaagaguggcaaguuuaugucuuuaauccuggaggaacuuuaacaucucuguguuugagugauuucuguuucuaagaauuauucuugggguccuuuuucuccaaguuuucuaccaucuuuucauauuaagauaggucaacacauucauuauagaggccauuuauggcuuauuuuuaagcauacugaucauacaacacucugguuuuccuggaagaauacaggucuugaaauucauggagauaguaguugcaguauuugcguagacuuuuuauguacauaauucuuaauguuuuaauuuuuacaaugaaaguacaggauaaaaaacuugacccuguaguuacauucucguucagcaguauuuugacugagcacuauuauuuauaagcucuuucacuagaugcugugaucagugugaaaaauaugaaaggaauuaaguuccacguccuucauaaauuuucagauaauguaaaugcauaccaaucuucaacuuaauugugugaacuucugcaaaugcugaagugauuggaugggauuuucaagauaggaguuauuggaggaagugaguuuagagcagagauuugaaauagguaaauaauaugaauugguauggaagaaauaacaaguuacuccagcuggagaagugacuucaaagacugauuguuguccucucuucacugcagugagaauuucuaauuugaugcgaguauuaggaacagaagcuguucaagaccccacgaagguagaagcccacgucagagcucagauggcaaaaagacagaaguaagugccaugggauuggguggaaaccucgggcaaguaccuuucccaaacucuucugggggguccauauuuggagggaggggagaguucuccguugcucucucuuucccucagcccugccucugaucuucaaugccuuucucacuuguggauguccuuccugucacgacagagcgcaugaagaggccaacgcugcccgaaaacucacagcagaacagagaaaggucaagaaaauuaaaaagcuuaaagaagacauuucacaggggguacacauaucuguauauagguagguguccauacugggccaaacuuccccuuagaauuacuaaaacauuuuccaagugcuugaggcagaaucauuguggccuaaaagcauaccuaacaccaguuccuacucucuuuuaaugacccuaguguggaucaagagcuaguaaaucuuguaaaauagcgagaguuaaugacuuauguuuaugguuacccaguucuucccucucaagucuucuuuuuuuuuuuaccagaauauuaguucugaacaagucaauauacuuguucaggccaagaugugaacuaaagauuguauguccuuugagaacuauaaaauaucauccuauuucuuuuuuuuuucaucuuuuuuuuuuuaaauggucugaguuugcuuccaacauccauggaagcauuacaaauuuucuuuccuccguagucauauccuuacccugauguauugcuguguuucauccucacuccaaaaugcauuuuauauguuguaaauauuuuucuaccuuuguguugauuuaauguuuuuauucuuuuauguugaguacauguguaucuucuauuuuuaaaaugugcuuauuucuauuaacuaguucuuuauuauaaaagugguacauuaucacaaaaauagugaaugcuuauuaagauuuaaaaaauugucugacaacacagaagaauacuuacucaaaaugucuccuuucuauucucugaucccuuagaaccacucucuuuagguaauugcuauuaacaguuuuucacauauccuccuagaaaauuuucaugccuauauagugauccuauauauauauuuuauuuauuuauuuauuuauuuugagacggaguuucagucuuguugcccaggcaggagugcaauggcgcgaucucagcgcacugcaaccucugccucccaaguucaagcaauucuccugccucagccuccugaguagcuaggauuacaggcacgcacccccacgcccggcuaauuuuuguauuuuuaguagagaugggguuucaccauguuggccaggcuggucuuaaacuccugaccucgugaucugcccacuuuggccucccaaagugcugggauuacaggcaugagccaccgcacccagccaaguaauccuauauuauaagagucuaagggucuagaggacaaaaagucuguaggucuuuacauugucaagaacaaugagauuguaaguauuuuuggaugauaguaaauaccucucccugacucuuagaguaaacuuugguuaguaauguaaugguuaauguaaagugcuagacuuugaagaaauguaagaguguggaaauauuucuagacucaucaacucuaccuuuuaagcauucaucuauuuguuuacuccagaggccuuuguuuauagagaggaaaccauuuuggauucaucuuuuuacuugccacuccauucaggcagcugcugaugcuaaaauggaagacauaacuaaacuuucccuucuccagaguucgaaauuugagcaacccagccaagaaguucaagauugaagccaaugcugggcaacuguaccugacagggguggugguacugcacaaggaugucaacgugguaguaguggaagggggugagucugaaaaacuugagggagacuguccccagacaacccuaggcuuagagugauuagcauuguggggagaaaggagaaaaagaucguauuuuagugccauaccugauauaauaugcuaggucucugcuucuguguuuuuuggaguagaaggcccuaagaugugguuccugagauugcuucaacuaccacauuaaugucugagcucagagguucuuucuaccccaucaucuuccacaguucuggcaaaauuauucuucucuguuuccaggccccaaggcccagaagaaauuuaagcgucuuaugcugcaucggauaaagugggaugaacagacaucuaacacaaagggagauggugaauggggguuagaggggauuaagggggagagcuaugggagguggggauggugcaucuguccguucaucuuauuuccucccugugacacucuugauaacacuagauaguguucaggaauuuuagaaagacccguuuagacuuugagccuccuagacauucauacaauauuuacuacaugauuauaugcaugaaugguaaagcuauuuuuuugccuaucauuuaaggcuuuucuaccagcugguuucugugucuguccuggaucugaguaccgguuacaugaauuuauucaguauuugaaaauucagcaagcagcuaggcaugguggcucaugccuguaauccuagcacuuugggaggcugaggcgggcagauugccugaggccaggaguucgagaccagccugggcaaacaacguggugaaaccccauaucuacaaaaaguacaaaaauuagcuggaugugguggcacacaccuguauucccagcuacucaggaagcugaggugggaggaucacuugagcuuggggaggucgaggcugcaguaagcugugaucgugccacugcaauccagccugggugacagaaugagacccugucucaaaaaaaagaaaaagcaaaucuaguaagcuauacauucauguguacagugucuauauuauauuauuauuugauuuuuuuuuuuuuaaggauugaagccaaaaagaucuucaggucaaaaaagcucugcuuugaucaaacuauuucuuuugucugauauauauauauacacacauacacauacauacacacacacacacauacauacacacauguacacacacauacacauacacacaauacacacacauacauguacauguacauacucacacauaugcucuucaacuuaaugaugggguuaguuccaauaaaccugagauaaauugaaaauauuguuaagucaaaaaugcauuuaaggccaggcacgguggcucacacuuauaaucugagcacuuugggaggccgaggcgagcagaucauuugaggucaggaguucguaacagccuggccaacauggugaaaccccgucucuacugaaaacacaaaaauucggggcguggugguggaccucuguaaucccagcuacucgggaggcugaggcaggagaaucgcuugaaccuggcaggcggagguugcaguaagcugugaucgcaccacugcacugcagccuaagcgacagagcaagacuccaucucaaaaaaaaaaaaaugcauuuaauacaucugaccuacaggacaucauaacagccuagccuuccuuauacuuucucagaauacuuagauuagccuacaguugggcaaaaucaucuaacacaaagccuauuuuuaucucauguaagaguauuuuacugcauauugcuagcccaggaaaaucucaaaauuuaaaauuugaaguacauuuucuacuaaauauuuaucacuuucacacuauacucaaggcaaaaaauuguaagucaaggacugucugucuauauuugaaggccagacauucuucuggccaucauacucccauuaguguucauucuucucaucuuugaacaccuggauuagcauuuaaaaucugcagagaggccuggugugauggcuuaugccuguaaucccagcacuuugggaggccgaggcggguggaucaccugaggucaggaguuugagaccagccugacauggugaaaccccgucucuacuaaaaaauacaaaaaugagcugggcguggcagcgugcgccuguaaucccagcuacucgggaggccuaggcaggagaaucacuugaacccaggaagcgguugcagugagcugagaucauaccacuucacuccagccugagugacagagcaagacuccgucucaaaaaaauaaaaauauaaauaaaaucugcagagaguucaucuuaagauaccugagaauaaaaaauauuuuguucuacacgugcauuuuuuuuuuuuuuuuuuugagauggagucuuugcucuuuugcccaggcuggagugcaguggcaccaucuuggcucacugcagccuccgccucccagguucaagugauucuccugccucggccuccugauaagcucggauuacaggcaccugccaccacaccuggcuaauuuuuguauuuuuaguagagaugagguuucgccauguuggcuaggcuggucucaaacucuugaccucaggugauccacucaccucagccucccaaagcgcuaggauuacaggcgugagccaccacgcuggccgauaauuuugauuugguauaucugcccuccuccuccauugggugaaaguuuuuugagaguaauauaugauguugacauaugaagccugccucccaaagugccuaggacaaguuuuuauucuugacugcuugucuuuuauuuccuuauucccaguaccugguggagcucuugauucauaacaagugcuauguaaaugcuaauuguaucaauuaauauuacugccuacuuggagcuucaagucuaauuuggggaaaauaaagagcaacagaaaagagaacacuugguccaacacauaaaaagggugauaauauuuuagagaguuuggguagacuugaauauuauuuguuuagaaccugaaucucaagucuaagucuguaacaagauuucucuuccagaugaugaggagucugaugaggaagcugugaagaaaaccaacaaauguguacuagucugggagguaggugauccuuuguaaaacauuguaaaacuuuagccaacuccugaauauuuauacuauuugaguggagcaauggaauguaagauguaaucagugaauaauguuuuaaauaauuuauguuucuuuuuggaauccauuuuuaaaugguuggcaguaaauucuuccugaucaucuguuuaauuaaauucgugaguauuuaguauaugcuaucuggggaagugcguggacagugcugcugguagcaggaauacaaauucucuaccgaaaauuauuuauuucacagucaugaauaugagacuuggaaacgggaaugaauuguuguuggauuuaccuuuggauauagugaaggaaguacuagacuuaagaauauaaaguuaggaggcugggcagugcugcuuauuagcugugcaaucugggcaagacacuuaaugucaaauucuguugccuuagcuauuguucucuauauugucaaguuuuugagaaugaaauuagauaauuaugugauagugcuucauaaaaugugacugaaucacucuucaaguggaauauuuuuuaugguuaucuaguucuuuaaccccugaagccuucuuagagaaccaguauuaaaaccaguauuaauguuuucauguuugcuuuuagguauaguacauguauaucuuuuuuugggggcgggggggcggggggcgguauggaguuucgcucuuguugcucuuguugcccaggcuggagugcgauggcgugaucucggcucaccgcaaccucuaccucccagguucaaacgauucuccugccucagccucccaaguagcugggauuacaggugcacgccaccaugcccgacuaauuuuuguauuuauaguagagacaggguuucuccauguuggucaggcuggucuugaacucccaaccucaggugauccgccugccucggccucccaaagugcugggauuacaggcaugagccacugugcccagccccuccauuucuuuuuuuuuuuuuuugagagaguuuugcccuuguuacccaggcuggagugcaauggugcaaucucagcucaccgcaaccaccgccuccuggguucaagugauucuccugccucggccucccgaguagcuggaauuacaggcaugagccaccacgccuggcuaauuuuguauuuuuaguagagacgggguuucgccauauuggucaagcuggucucgaacuccugaccugagguccgacugccuuggccucccaaagugcugggauuacaggcaugagucacugcgcccggccauauaucuucuauuuuuaaaaugugcuuauuucuaguauaugugcugcugaagcgagcaguaaaaugugcuuauuucuauuaaugaauucuuuauuauaaaagugguacauuauuacaaaaguaguaaauguuuauuaagauuagaaacaaauucuaauuauacagaagaguacuuacugagacccagcacaguggcucacgccuauaaucccagcacuuugggaggaugaggugguuggaucacuugagcucaggaguucaagaccagccugggcaauauggcgaaaccccgucucuacaaaaaauacaaaaauuagccuggccugguggcgucugccuguagucccagcuacuugagaggcugaggugggaagauugcuucagcuuuggaguuugaagcugcagugagcugugacuaugccacugcacuccagccugggcaccagagugaaacccugucuuaaaaaaaaaaaagaaaaagucucaggccaggugcaguggcucaugccuauacucccaacacuuugggaggcugaggugggcggauuacgaggucaggaauucgagacuaaccuggccaacauggugaaacccagucucuacuaaaaauacaaaaauuaguggggcgugguggccagugccuauaaucccagcuacuugggaggcugaggcaggagaaucgcuugaaucugggaagcggagguugcagugagccgagaucgcaccauugcacuccagccugggugacagugcgagacugugucucaaaacaaaagucucuuccuauucgcugaucucuucagaccagucuuuauagguaauugcuauuaauaguuuuucuucugaaggagcaaucaaaaaauaaaaauuaaaaaaaaagguuuucauguauccugccuuaucccagauucuucaauuuaugcauacaaauuagaugauaauaaccauaguauuuguucucuguuuuauaaguucccaccugcauauuuguuaucuuuuuuuaaucaacuuuuuuuuuuagagauagggucuugcucuauugcucaggcuggugugcaguggcgcagucauagcucgcuacagccuugaacuccuagggacaagcaauccuccagucucagcuucucaaguaucugagaccucagguccacaccacugugccuggcuaauuuuuuuuuuuuuuuuuuuuuuuuuuagaaauggaucucacuauguugccuaggcuugucuugaacucuuagccuugagugauccucccaccucagccucccaaagugcugggauuauaggcaugagcuacugugcccagcccuaccuucacauaucucagcacccucaucuuucaauuuucuucuauuuaucucugaagaguacuuacugaaaaagucccggcuucuuagagaaccaguauuaauguuguaggaauuuaguuuucaggaauugucucucauguucagaaauaagccaaguucugcuccagccuccuuauuggagucuacucccugaacgccucuugagguauugcuuuaugacugccauugcugcugguaacuuuggcaagaaugccauucugcccaguacugucuuuuucuguuguaauucucugcugguaccugcucuucuucuguuccccgcccccaguuguucuuuguugcugggccccaaagccuccugcuuauauaaauaguuucuggggccuuuuugaaggcucagauuuaguccuuaaggccugguaggagauaaguuuaucucauuccaccuuccauaguucuuccugacuugcuguuccacccaggcaccagagcaaauaauuccucacuucauuucaaaaaacuaaaagccuuaugcauaugaauucguaaaaucucauacaaauauccaaggaggccgggcgcgguggcucacgccuauaaucccagcacuuugggaggcugaggcgggaggaucacgaggucaggagaucgagaccauccuggcuaacacggugaaaccccgucucuacuagaaauacaaaaaaucagcugggcgugguagcgggcgccuguagucccagcuacuccagaggcugaggcaggagaauggugugaacccgggaggcggagcuugcagugagccgagaucgugccacugcacuccagccugggcgacagagcgagacucugucucagaaaaacacaaauauccaaggaaauggaggucacaauuuuuuuuuaaccauaaaaucacguucagcugggcacaugucucacaaauguuacuaggucuucuuauaaaagaauauuaucugauuuaaauaagaaauugaaguguuuuuauuauauaucucuuuucuaggguacagccaaagaccggagcuuuggagagaugaaguuuaaacaguguccuacagagaacauggcucgugagcauuucaaaaagcauggggcugaacacuacugggaccuugcgcugagugaaucuguguuagaguccacugauugagacuacugcaagcccuugccucuccucccuugccuuugucucuucaguccucucacuuauucuauuucccaacccccucccacuuguuugugugaucucagaacugugccaagcagacacugggacaaagggagaauaucuugcuccccuccugagucagccugguguugcccuuuauuccccuuaugugcauaugauuaaagaguuauuuuuaaacuuggugugauauuuuucacacauucguaagua

SEQ ID NO: 191316 - RNA, 17788 nt, Homo sapiens
ggaguguaggccaggggguuggcggugccgugucauggaggcucagucucugagcagccauugaaggggaaggaacugcggguguguguguguauguguguguguaugugugugcgcgcgugcgugcgugugugugcgcgcgcuaguguguggacaaggaggugggggcagcugaguuagagucccaacucuuggacuccauuugcuauucucuucuuucucccccacaccuaucugguggugguagugggcguuuauauuugcguuccuuuucauucauuucuaaaucucuuaaaaauuuuggguuggggguauuggggaaggcaggaaagggaaaaggagaguaguagcugaagagcaagaggaggacauggagaugaagaagaagauuaaccuggaguuaaggaacagauccccggaggaggugagaugacucagcccccaccgcuuccccaucaguccaguauucugaggaucggauuucuggugguccugggugggugugcggggauggaguaauaaguuagcccccauccccccggguuaggguuggggaaauguuuaauuuuaaguuuuaaaucauuaaaaucuucuacuuaaaauggcgaaggguugaaguuucuaggggcguuuuugugugugcaugggggcuuagcuccuuucggcuuucaucgagucgggcguccugaccucgugggggcgggaagcgggcuggugggggcgcuccgccgcuucgcucccggcacuccuccuccugggggccggcggcgugggcgcgaccccccagucccacucagccccugccgcagccauaggcgccugagaaguuaguccaacuuuucugcagugcggccaacucaucuuuuuagggggugggcuuccccggccucgaggcccugggcguccgacgucgcgacgggcgcgggcuggggucgcuugcaggguccgcgcacugucugcuccggcggcgcccacuccuccgggaagccgcgcgcgccgcccucugcccuucgcccggcggaaucugggucagcggcggguucuccgaccgcgggcgaguuuggggacucgucgcagugaccggagguggagaggggacgggaggcguaauccgcuucuucccccgccguguaacgauauguggcacgucguguggccgcaacucugaauuugaucccuggagacgguuucacaaaacucaacauaagggacguaguaguuucgugcuuuaaagauggguucgccgaaacuaaaugaugcgcucucacugcugucgccuuaaagagacgggguugggaggggccaugugaggcggggucgcggucaacuuuucgggggucggguaggaggcguuuccgccuccuuuucgcgguugccuucucggccucaccuacccagggcgaaggcgcgaggacaacgcggguugggaggcgacccguuuuuuccuuggggaguccccgccccgugugggguuucccgucagucggagcggcaggucgcgagagcagggcugguggccagcggggagccucgcagaggaaagcaucagucuugcugaaauaagccuagaauuggaacguaagggaguugucuguagcugaaucgaccgaucgauagaaggauauaacugggguggugucugugcagaucggcauagaggaugagcagggucugucugggcuuucgcguccggcguguggaguggcaacuaagauuuuuuuuuuuuuuuuuuaagugccuguuuucugaaauuggcaggggccagggagaggaaacaguugcuugcuaucagggucaucccggagauaacuugaaguuucuagagcuuauucuuagaggcuucaggaaaaaaauaaaaaaaaccaaaaucaaacuuuaaaagcugucucucacaagcacacguuuagaauacuuuuugguggcuuggguuggaaaauugaaucccgcccccgccucccccgccaggauucuuucacuuagugauuguaguaauuucuuugccaguuuuggggugugcaagacguugccuuuuuucaacuucuuccgcuguguuguaauaacggucucuuauauuuguauagacaguuuacaaagcacuuuacccguuuguuauuuacuuuccuccuuacguacuuguaagguggauuguguuguucuagaauccaaauuagcagacagucucagggcagugaaaugauuuacagaaguggaggaacugguuuucugacaccaaaucuaguagcccccacuccucagcuaaacggggagucugaagacagaaccaauucacaguccuucggcaaaccaacugugacucuaggcaagccauucuucaucucugggccauaguuuccucuucuccaaaacggagcucaagaugcucuuucuggccacagaaauaauuaugucaaaaucauauucaaauagagaagguggcauuccuuguugccaaauuuuagcccucggauaccucaaacagguuuucacauuggguauagagaaccaggaucuucaaccuuucccuuaaagauuaaguccauucaggcccacaccaggaaguuuguuacuacaacucuuaccuaauagggaauucagccccacuccuugaggaauggggaaaagugcacagaaaugcuauuauaccagagugguagggagaaguaacauuuuguuaagaauguauuguucugggugauaccguuuggccuggaugugagaaccaauaacacccucugggcuguucccagaagagcuuucuaacguuucuucauaaaggguaaggaggauuuuuugaguuaugaugguuuuaucaaccaaagagaaggagguuuaaacugaaaaagugauuaaacaguuucuucucuuuguagguuuuuuuuuuuuuuuuuuuuuuuugagauagagucucuaucuguugcccaagcuggagugcaauggugcggccucggcucacugcaaccucugcugcccggguucaagugauucuccugccucaacuucccgaguagcuggcauuacaggugcccaccaucacgcccggcugauuuuuguauuuuuaguagggacgggguuucacuauguuggccaggcuugucuugaucuccuaaccucaagugauccaccugccucagcuucccaaagugcugggauuacaggcgugagcccccgagccuggcacucuuuguagguuuuagggcagcucacuugaaucuuuuccugguagcucagguacucgcuccuugcauaaauauauuaucugauguugaggguccuccuuaucagggucagaaacagguuucacaugggaacuucuucaaaguuuguuucuuaugcaucagugauuugaagcaggcauugaacuuuaguccaaguuuaaauuuaaaaaauggccaggcaagguggcucaucccuguaaucccagcacuuugggaggcugaggggggcgaaucaccugaggucaggaguucaagacuagccuggccaacauggcaaaacccugucucuacuaaaaauacaaaaaaauuagccgggagugguggcauacgccuguaaucccagcuacuccagaggcugagacaggagaauugcuuggacccaggaggcagagguuacagugagccgagaucgugccauugcacuccagccuggguaacagagcaagacuccaucucaaaaaaaaaaaaaaagaaaaaaaagaaauuuaaaagauuacuuauagugaugacuuuagauuguauaucaguuuuggggggaaaugaaaaggauccguguaaggggauuggugggguuucuguuguguuguauuuuuuuuuuuuuuuuuuuugagacggagucucccucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccuccgaaagugcugggauuacaggcgugagccaccgcgcccggccguauuuuguuuuaacugacgggcaaucaaacuggagauuggugguuuuaauacauuuccagagugucaagacccaggucucuaccuaaacagauuacaaacuaaagaaucauuaauuaauguuuucccucuuacaggugacagaguuaguccuugauaauugccugugugucaauggggaaauugaaggccugaaugauacuuucaaagaacuagaauuucugaguauggcuaauguggaacuaaguucgcuggcccggcuucccagcuuaaauaaacuucgaaaaguaaguuggcauuuacgugaagcaucaugauuucaaugccacggcuauaugucuaguguuuggccaaauggaaugaccauucugcuuguuaauuagaaguuuuuaaguuucuagagauaagaaaaaguuauauaggauuuugagaauaagcucuaauacugcuuuuauaaauuuauuuauuuauuuauuuuugagacagggucuugccaggcuggagugccguggcaagaucuuggcucauugcaaccucugccucccgagcucaagcauccucccaccucagccucccgaguagcugagacuacaggcaugcgccaccacaccuggcuaauuuuuguauuuuuugcagagauaggguuucaccauguuguccagacugguuucaaauuccugggcuccggucauccuccugccucggccucccacagugcugggauuaaaggagugagccucugugcccggucuagaaauguaaaucuaauaguggaauugccuuauaauaugaauuuggauuuaauauauaccaaauauuuuucucuacaucaugaaauccaaauguaguacaacuagaauccaagcuggguuaagagcccauuauguagguguucuaauacauuauuuggcagauguagaaaggaauuuggaaauuaaugaucugucgugauaguuucuugaagccagagagaaugacaguuuuuuuucuucaaauugauauacuuuaaaaaucuuugauaugccaggcucagugguucaugccuguaaucccagcacuuugggaggccgaggcggguggaucaccugaggucaggaguucgagaccagccuggcuaacauggugaaaccccaucuguaccaaaaauacaaaaguuagcugggugugguggugggcaccuguaaucccagcuacuugggaggcugaggcaggagaauuugcuugaacccaggaggcggagguugcagugaguggagaucgcaccacugcacuccagccugggcgacagagugagacuacauuucaaaaaaaaaaaaaaaguuugauaugauaccuuuaccauucuuuguuuuuuuccuuuguugaauguauaguuggagcuuagugauaauauaauuucuggaggcuuggaaguccuggcagagaaauguccaaaucuuaccuaccucaaucugaguggaaacaaaauaaaagaucucaguacaguagaagcucugguaaguggaacaguuuugucucuggacuugcuuuuuuugguuaaauuuucugagauuuguuugugucuauuaauuucuauuuaacucuuaaaacuuaagaauuuuuuguauguugugaucuaggcaguuacugcuuuuguuucuuuuagacuaaaauauucagaugaauuuuuaaaucaaugagaaauuuauuuuaucaucaacuucaggaguugacuaucugguuuuaacauuuccaguauuuuuuuuuaaccuucuuucauucuuuuucuuugcuucuugauuauuuuuugaguuuuuuauuauuuguccccuucuuuccugguuugagggaaggaaaagaaaaacugacaugcugaaaauuauugcucugauuuugaaaaaagauuggaggcugggcacagugguuuaugucuguaaucccagcacuuggagaggcagaggugggaggaucgcuugaguccaggaguuugagaccaaccugggcaacauagugagacccugucucuacaaaaauaaaaaauaaaaaauaaaaauuagccaggugagcugguugugcuugauauaauaacccuucauuauaaaacucgaaaaauacaaaaaucauucucaauuucaaauauauauuuucuggaucauaaauuaaaaagaaaugauguggucgggcacgguggcuugcgccuguaaucccagcacuuugggaggccgaggugagccgaucaugaggucaggagauugaggccauccuggccaacaugguaaaagcccgucucuacuaaaaauacaaaaauuaggccgggcgcgguggcucacgccuguaauccuagcaccuugggaggccgaggcaggcagaucaccugaggucaggaguucgagaccagccugaccaauguggagaaacccugucucuaauaaaaauacaaaauuagcugcguguggaggcgcaugccuguaaucccagcgacucgggaggcugaggcaggagaaucgcuugaacccgggaggcggagguguggugagcugagaucaugccauugcacuccagccugggcaacaagagcaaaaaguccgucucaacaaaacagaacaaaacaaaaacacaaaaauuagcggggcaugguggugcgcaccuguagucccagcuacucgggaggcugaggcaagagaaucgcuugaacccgggaggcggagguugcagugagcagagaucguggcgcugaauuccagcuggcaacagagcuagacuccgucucaaaaaaaaaaaaaaaaaaaaagaaaaaagaaauaacaugguauuuuaaaucuugaauguaaguuuuaacuuuacuuuuccagcaaaaucuuaaaaauuugaaaagucuugaccuguuuaacugugagaucacaaaccuggaagauuauagagaaaguauuuuugaacuacugcagcaaaucacauacuuagauggauuugaucaggaggauaaugaagcgccggacucugaagaggaggaugaugaggguaaucguucuuaauacucauaagugugucauaauuauagccucugcuguagcugugcaaauuagauugggccuggaaauuuaggugugaaaaaaaaaauccacaacaagauauuaguaagacaagaaaaaauuaaaaacccauagcucuagccaguauuucuucuuucagauuucccauaguuucagggaauuuaaugacuauuauaacaugaagcucugugaaauuuuauaucuguagaaaguuguacacccaguaaaaguggcaaccucuuaaauaguauuuuuuuaaaaaagcaaccacuuauaauagccagaaaguagaaacaacccaagugucuaucaacugaugaacggaauuuuuuuuuuuuuuuuuauguugagagggaguuuugcucuuauugcccaggcuagagugcaguggcacaaucucggcucacugcaaccucugccuucugguuucaagcaguucuccugccucagccucccaaguugcugggauuacaggugcccgccaccacucccagcuaauuuuuuuguauuuuuaguagagacgagguuucaccauguuggucaggcuggucucgaacugcugaccucgugauccaccugccucagccuccuaaagugcugggauuaccagcgugagccaccacgccccggcccgaugaacagauuuuagaaaugugguuuaucuauacagugcaauauuauaucaccauuaauaugaaugaaguagugauacaugccacaugaaugaaccuugaaaauguucuucuacgugaaagaagagagacacaaaagaccauguguuguuugacuucauuuauauggaaaguucaugggaagccgaggcagaauugcuugaaccugggaggcgaagguugcagugagcugagaucgugucacugcacuguagccugggcgacagaguuagacucugucucaaaaacaaaacaaaaaagcaaacaaaaaaccauauauauauauauaauauauauaugguucagaauaggcagaaacuucaggauaggcaaauccauugagacagaaaguagauuauugguugcuugaugcugggggagacgaaaaugggagagugacugccuauggguaugggauuucuuuuugagggaugaaaaauaaucuagaaguauauugugagcauacaguuuuagguaaguggaugacuaacagaucagaugacagaauagcuguuaguaauaggauacugcucauuauuauugagugaaaacuucuucaucguaaaaagaaauuugauggauaaauacuguuauaaaaugaugaaaugauagauaagcagguuuauuuuuuauuuuagauuaaggggguacgugugcaaguuuauuccauggguguauugcaugaugcugagguuuggucuucuacugauccucucacccaaauagugaacauagugccuaauagguaguucuucagccacccuccuuccccucuuuugaaguuuccagugucuguucccaucuuuaugucccuguguccccaguguuuaacuccugcuuguaagagugagcaugcaguauuugguuuuuuguuucugcauuaauccacuuaggaugaugguccccagcugcaucuauguugcugcaaaggacaugauuucauucuuucuuuauggcuguguaguauuccaucauguguauguucuacauuuucuuuauccaguccaccauugaugggcaccuagguugguuccaugucuuugauauugugaauagugcuguggugaacauacaagugcaugugucuuuuugguagaaugauuuacuuuccuuuggguauauacccaguaaugggauugcugggucgaaugguaguuguauuuuaguucuuugagaaauuuccaaacugcuuuucauaguggcugaacuaauuuacauucccaccaacaguguacaagcauucccuuuucucugcagccucuccaacaucucacaagcaaaguuuugaaguguucacaaaguaaaacaaacuuuagugcaugcaauauuuucaugagaaucuagauauauauuggauaccaguauuuagaagccauacuucucgcauuugguuuguaggaauaacuaggaauguugugaaacagaaaucuuaaaaaaaaaaaaguaucgcugugaguuacuuuccaccuauuggcuuacaaguuugaagugauugggcaaggguaaaaagcaucaacauccuaggaagaaacauuuacccagucauuuacucaucuuuaaaugauuuuuuaaagauggcgaugaagaugaugaagaggaagaggaaaaugaagcugguccaccggaaggauaugaggaagaggaggaggaagaggaagaggaggaugaggaugaggaugaagaugaagaugaagcagguucagaguugggagagggagaagaggaagugggccucucauacuuaaugaaagaagaaauucaggugaauacacacuucuuaccugcacugaaaauuaauuucuaggcauaggaguaaguacuauauaaaguguguuuuguagcaaucugagaguuguuucuaaguugugggugugcauaugucuauccaccugucuuuuuuuucauuguccuccaccccaaacuauauccagauaaucauaaacaccuauugauuuuaccucccagauaacuuucaaaucuguuacagccucaauggcaugguaugguggaaacauuuuacaaaugucugugaaccucaauuucugcauuuauaaaacagauuaggccgggcaugguggcucacaccuguaaucccaguacuuuuggaggcugaggcaaguggaucaugaggucaggaguucgagaccagccugaccaacaugaguggggaaaccccguaucuacuaaaaauacaaaaauuagcugggcaugauggcacacaccuguagucccagcuaaucgugagacugaggcugagaaucacuugaacucaggaggcggagauugcagugagcugagaucgugccucugcacuccagccugggcaacggagcaagacucugucucaaaaaaaaaaaaaaaaacagguuauaucaaccucauaggauuaaggauuuaacaagguaaucuauguaaagaauauagucccuggcacauuauaggcacucaagaaaacuuaaguuucuuucuccuaauuaucucuugcuuauacuuuuguaguagcuuucuaaauagucugucugaauacagcaucaccacuuaggaguauucuccacagugcugccuguuuagucuaaugcaaaugugauuauacaucagccuucuugaaacccuuuaauguuucccucuugcccccaagacauacaaggccuuucauuucuggccuuugcuuccuucugcuuuuuuuuuuuuuuuuuuuuuuuuuuuugacagucucacucuguugcccaggcuggagugcaguggugcgaucuugacucacugcaaccucugccucccaggcucaagcaauccucucaccucagccucccaaguagcugggacuacaggcacacuccaccacgccugguuaauuuuuguauuuuuuuguagagacaggguuucaccauguuggccaggcuggucuugaacuccugaccucaaauuauccgcccaccuuggcaucccacagugcugggauuacaggugugagccacugugcccggccccugcuuucuccuccagcuucaucucccuugauuccaaauuaaaugaucacaccaaacuauuuuaccuuuauggcuguguaugaauauguuguucacucuaucugaaaugagccucugaugaacuuuuuguuuuuugcugagugaagcuugugaagugcacugauuuuauuuacaacuccauggaauuuuacauaugcauguacuugugcaaccaccacccaaaucaugcuuugugaauucuuaucuuuacaaacccaacucuucaguugccucaucauugaagcucucuauauuuuuucuuaggcagucacuccuccaucuguuaccucugaaucgugaucagaauucuauugccuacagacacuuguaaaauaauuuggccacuuccugcuaaguggugagcuccuuaaggggagugccacucaccuuuguaucucagcaucuaguacacugacugguacaugguaggcucaugggaaaugucaguugacuagaacaaguuaucuacagccccugggaguuuagguuaguuauuuucuccuaauguuaaauugaaguuuauuuuaaaaacucauaauuuaaaguauuuuuuauuauuaaaaauaacaucucuuauuuagacuggaaguugcuaauauuuguuucaaugaguuuugcauugguuagauacauaauauaaacgaucaaugacacauauuugcugaugaaacuaguauggaaaaaauaggauuuauauucauuuggggucuuggcgaguuaggagcuauauauaaugaagaacagaacuuuaaguguucuuuuuuuuuucuuuuuugagacggaguuucguucuugucgcccaggcuggaguggguggugugaucucgguucacugcuaccucugccucuugagugcaagcgauucuccugccucacucuccugaguagcugggauuacaggugcccaccaccacaccuggcuaauuuuuuguauuuuuaguagagacaggguuucacuguguuggccaggcuggucuugaacuccugaccucaggugauccaugcaccucagccucccaaagugcugggauuacaggugagccgcugcaccuggccccaccuuuuccuuuuuuaaugaacaaauucugcaacaaaagccacauucagucuuccccuuuuuuucuugucucuccuucuucaguuuagucugcaguauuuccugauuuucauuguguuccuuuuuaugcuuuuugcuaucucaucuauuccuuucgcuccuuauagcuuacugguauucugguauggagaugcuuuauuucaacugauuguauaagaaugauuucugauacaggaauuaggcaguuggccgggugcaguggcucacgccuguaaucucaccauuuugggaggcugaggcaggcggaucacuugaggucgggaguuugagaccagccugaccaacauggagaaacccugucucuacuauaaauacaaaauuagcugggcgugguggcgcaugccuguaaucccagcuaaucgggaggccgaggcaggagaaucgcuugaacccgggaggcggaguuugcggugagccgagaucacgccauugcacuucagccugggcaacaagagcgaaacucugucucaaaaaaaaaaauaaauaaauaaaaaggaaagagaaaaaaaaagacuacagauuuaguuagguuuuuuuuuuuuuuuuuuuuugagaugaagccuugcucuuuucugccaggcuggagugcaauggcgcuaucucagcucacugcaaccucugccuccgagguucuugcgauucuccugcgucagccucccgaguagcugggauuacaggcgccugccaccaugcccggcuaguuuuuguauuuuuaguagagauaggguuucaccauguuggccaugcuggucuggaacuccugaccucaggucaucugcccgccuuggccucccaaaguacugggauuacaggcgugagccaccgcgcccggcccuuuaguuagguuuuaaaaaggaccuuuauaagaauggcagagguugucaaaacacagaauaaccauaguuucuuugcucuuguuggaauauauuacaagaaagagugaaaaaucauauggauuuuucaaucuucaaacugaauauuugaauuucaaggaugaagaagaugaugaugacuauguugaagaaggggaagaagaggaagaagagggugaguuacauuagccauaaacaaauuauaaaauuaaagacauagucauuuuuuauacuuuauuuauuuguauuucauacacuuuaaagaaugagccuauaaugccaauuuuuacugaucccuuugauuuugcuuuaucauagagugccuucaaaguuauaaaaguuuuuuuuuuaagaguaauugucuuagggcacucauuaauucauaacucauaaacagcuuauaacauuuauuuuaaaaacaaaugaagagaugaauggaaccuugagcucaauuuauuauuuuuauagagucucauuuuggacagagugaagccuuaucuuauaagagaggagcaguugaacuccagauaauuaaugcucuuuuuagauuuguuuuccaggccuuuaaaaauuuauauauauauauauuuuuguuuguuuguuugaaacagggucuuacuuuguuacccaggcgaguacagugaugcaaucacagcucacugcagucucaaucuccuugggcucaggugauccccccaucucagccucccaaguagcugggaccacaggcacacaccaucaugcccagcuaauuucuguauguuuuuuuuuuagagaugggguuucgccauauugcccaggcuuuguugaacucuggguucaaacgaucugcccaccccacccucccaaagugcugggauuguagaugugagccaccauggccaaccaauauuuuuauuuuauuuuauuuuauuuuauuuuauuuauuuauuuauuuuuuugagauggagucucgcucuguugcccaggcuggaguacaguggcccgaucucaguucacugcaagcucugccucccggguucacgccauucuccugccucagccucccgaguagcugggacuauaggcgccgccaccacgccuggcuaauuuuuuguauuuuuaguagagacgggguuucaccguguuagcaagguugcucucgaucuccugaccucgugauccgccugccucagccucccaaagugcugggauuauaggcgugagccaccgcacccggccuauuuuauuuuauuuuauuuuauuuuauuuuauuuuauuucauuuuauuguuuugagacagggucucugucagcagugagugcaguguggcaaucauaggucacugcagccucgaccucccaggcuuaagcaauccucccaccucagccucuuccaaaguagcugagacuacaggugcccaccaccacaccuugcuaauuuuuguauuuuuuguauagacggggucucacuguugcccgggcuggucuugaacuccugggcccaacugauccucuugccuuggcaaagugcuaggauuauaaaugugagccacugcacccagccucaaaauaauuuuuaaaauuuacuaacaauugcauugaugucaagcccuugguuucuuaaucuguacuucaugauauggccacaagggugcauagcaaacuguaauuauggauuucuaagccuguuaagucuguuuucaaccuucucaaauuuaaagaaauucagagaggaaacuugaaguauaauuuccuuccuuccuuccuuccuuccuuccuuccuuccuuccuuccuucccucccucccucccucccucccuuccucccacucuccuuccuuuccuucccucccucccucccucccucccuuccucccacucuccuuccuuuccucccucccucccucccucccuuccuuccucucuuccucucuuccucucuuagccugcccucccucccucuuuugagacagucuugcucugucgcccagacuggagugcaguggugcaaucucggcucacugcagccucugccuccuggguucaaacaauucuccugccccagccucccagguggcugggacuacaggcaccugccaccauacccagcugauuuuuauauuuuuaguagagaugggggguuuacccuauuggccaggcuggucuccaacuccugaccuuaagugauccgccuggcucggccucccaagguauuggaauuacuggcgugagccaccuuaccuggccaauuuucuucugccauuaacguuuuuuuuuuuuuuuuuuuuuggagacaaaguuuugcucgguugcccaggcuggagugcaguggcgcaaucuuggcucacuggaaccucugccuuccagguucauggaauucuuccuuagccucuggaguagcugggauuacaggcacccgccaccaugccuggcuaauuuuuuguauuuuuaguagagaugggguuucaccuuguuggccaggccucaagugauccauccaccucagccucccaaagugcugggauuacaggugugagccaccgugcuaggccuugccauuaacuuuucacuaagauucaaaaauguaaccaauccucauuuguuaaaauuaagcacuuugcauuuuucuuuccacucuuuaagaagaaggaggucuucgaggggagaagaggaaacgagaugcugaagacgauggagaggaagaagaugacuagaucauucuaagaccagauucucuaauguuucugggugugcaauagagugaucacaucuuuguuucuucauguacgauagcuaucccuacagaagauaauguguaacuuuuuauaggaaaagugugguuuuacuauuuuugccuuaucauuccaaauaagaacuagucuguuaaugaucauauuguauguagagaaaaauuuucauugacucccauuguggaauucccuagcaauuuauuuagacuuaauuuuuuaaauucaagcuuacuguauuagucauuuuuagcccauaauuaaaacaugaucacuuuuacacagguguaguauggugcauuucauuccuuauuuauaaauuaacugaaauuacaguuugcuauaauauaaaaugacaauagucucuugagugguaaguugguuauuuuuuuagaggugauccaggaaucuuuaguuugaaggcaguuaccuuuuuuuuuuuuuuuuuuuuuugacuaagaguguuugguugcuuuuuugucacaaguaacuuggaaaauagaagcagaauaguaaagguucuauucagcaacauaguucauggauuuuguggagguucuauucaguaauaugguucauggauuuaguggugacugauaagauuuuauuuuugaaggaaaaauugcuuauacuaaguccagagacaugcaggugagcccuuuugucaggcugcaaaucaugacaugccgaugguuguuuauuuuguuuuuaggugugcauucuuuuucuucuuagcaauuccuuuaugaucaccuucccuucuuguuucacucccucccgcucucucaaaaggaacuugggaaacuugugaaacccaggaaaaccuuuagucuuauaccucaacuaccuuucaguccugucuggguuuuaaauaagugaaguagaagaaauugaguauuuucugacauaagaauauauuaucaauacaguuuuaugcaguaagcucuccuuaccauaaauguuucuugguugacaacaucuaagacaauauuagugggaugaagaaagaaaagcaggggugcuuuuggaagcaguguuaguguuccucaaaagucggaacaauugccuguugauauauuaauaagacauuaaagucaaauuuuaauguuggccucucaaaugauuuggauaccacucugcaaaguauuucuaaccuuuaauucccaguuuuaaaacagauauaauaauagcauuuaauuggaauauacuaggcagcuggaaaaguauuugaaacuaaauugacauuaaaauuaagauuuguuuucaaguggauguccauuaaaaguagaaaaauauuugggauaagugaguguguguuuccuuacauggcuacuaaauaaaauauaaugaguauacaaguauaucuccucuuuugcuauggaggcuccauguucaaggcaauggcuuuuuaaaucuuggcuaucuaaaauuuuuucccuuuguuuugaauauuuguaaguuuuuaagaaguuagugucagcaaauuaauugaaguuaugcuucuauacugggacauauuuaaauacugaguauaguacugcugcuacugcuucuacaauguaaaauguaugacuugguguuuuaaaguaaaaauuaugauguuacuuguggagaaacuaaaaauguuguacaacugaccgaaagaaaacccuuggggauaaguuuagugaggggauuggaauccccaaaaagauaacauuuuucuucugcuuuuaaaaacugaaauucccuguucuaguuccuaacaauucucauuacauacuaugccagauuacaaaauacuuauuuuuaaaaugaaaucuauauauugacuuucuuaucaaucaucuuacugugcaaucaaaauuagaguacuuugguuugaaaacaacacuuagagccuccagauaacuuuuaagacuuauuuagcuuugugggugguauuuucaugcaaauaaguaaggguggguuuuauauuuuguagaaguuuucgguccuauuuuaaugcucuuuguauggcaguauguauauauuguguuaaguuccucaagaaucuccuuaaaaacuuugaaguuaauacuuuugugcaacuguguuuugaauaaagccaugacaguguuaaaaacaaacaaaaaaauuugcaguacuccugauuauucuuuuauuguuuuugacuguucccuguuuuuuucugugacugcuguaacuuaaaguuuuugaaacugaauugcuucaaauaaauugaagauuuguuauaaugauua

SEQ ID NO: 191317 - RNA, 534 nt, Homo sapiens
cgacuuucccgaucgccaggcaggaguuucucucggugacuacuaucgcugucaugucuggucguggcaagcaaggaggcaaggcccgcgccaaggccaagucgcgcucgucccgcgcuggccuucaguucccgguagggcgagugcaucgcuugcugcgcaaaggcaacuacgcggagcgagugggggccggcgcgcccgucuacauggcugcgguccucgaguaucugaccgccgagauccuggagcuggcgggcaacgcggcucgggacaacaagaagacgcgcaucaucccucgucaccuccagcuggccauccgcaacgacgaggaacugaacaagcugcugggcaaagucaccaucgcccagggcggcgucuugccuaacauccaggccguacugcucccuaagaagacggagagucaccacaaggcaaagggcaagugaggcugacguccggcccaagugggcccagcccggcccgcgucucgaaggggcaccugugaacucaaaaggcucuuuucagagccaccca

SEQ ID NO: 191318 - RNA, 534 nt, Homo sapiens
uggguggcucugaaaagagccuuuugaguucacaggugccccuucgagacgcgggccgggcugggcccacuugggccggacgucagccucacuugcccuuugccuuguggugacucuccgucuucuuagggagcaguacggccuggauguuaggcaagacgccgcccugggcgauggugacuuugcccagcagcuuguucaguuccucgucguugcggauggccagcuggaggugacgagggaugaugcgcgucuucuuguugucccgagccgcguugcccgccagcuccaggaucucggcggucagauacucgaggaccgcagccauguagacgggcgcgccggcccccacucgcuccgcguaguugccuuugcgcagcaagcgaugcacucgcccuaccgggaacugaaggccagcgcgggacgagcgcgacuuggccuuggcgcgggccuugccuccuugcuugccacgaccagacaugacagcgauaguagucaccgagagaaacuccugccuggcgaucgggaaagucg

SEQ ID NO: 191319 - RNA, 14152 nt, Homo sapiens
gacagauaaaaacacuuuauuuaaaaguauaaaaccaggcuuacuccuucaaacugcucccaccccuaauuaucuccacaaagagcuauauaaauugggcagggguauguguacagucaucucagcucuaacaaccccaguucuucuuucaauucuccuuucucccuucauacaauugagauguuuguccuuugcacuuuccccaagauagcaaaggugauacaaauguggaaggaggggaaguguagaaaauaaacugucaucauccucuauucccaucuccagggaacagacagauuauaugaacucugaccaaaugauuugcuugucugaagaaacaaauaauagguacaguuacucucuguauccuaaagaaagacacgaggguccagaguccuucuucaguauauagccucguccauauugucaucacugucaccaccaaaguccucuccauugucaaaauaugacaugauguaaucaguuuccugaaauggaaaaaaaaaaaaaaguaaaagucaauuuggcauucaccuuccuuccuguguaccagaccccuuuccucucagucacaccauuccaggccugagacaucucuuccagcuguaguuuguagaaggggggcagaugaaguagagagaagccccuacccuggggggcacuaucucuguuggcaugccaacccucugaggagagcaacccuaguauaaagaggguaaagggagggggacuaagguggaaggaguccccuucaccucuucauguucuucuucaucauacucuucuucuuccuccucuuccuucucuucuucuucuucuuucuccucauccuccucugaaguuacuucuucuuccuucuucuccagggucucauguggggaugaauaggaauagaaacucagguucaguucacagaagggaaaaauugaggcacacaugggccaagagagagggaauggauccagggcucaggaggucucuaugcacacuuccuccucaccucuaguuucuguauuguuuccuccuuaucuucuguggucuuagggggccucuuggggagcagaauuguaaucccugguggagggaucaaaagguaaaccuucagagagcaaauuuugccagcuuuauagcccauccucaugcaaagaacaugucacucugcugcccucauguggccacuaugacaucuagcaacaacacuugguagauuggguauaggaacugggauggaaggugagaccagcagcagccucggcccucaggcugaugaaggaaaccucucuucucccuccuuuuuuccagauacacucacguuccuucuguagcuuccgcacucggaucuuuagcucccgggguagacgccgccaaucugggaauagugggaacguaaaugucaauaggacccugccuggggucuccagugaauacugacugguuuuaaaggggggugaggguuuuaaaggagaggaaggaaggggcugggccaaaguuguucaguggcuuggauaucuccugaguagugggaacuauuuaauagcuuuuucagguagaaucugagaauguguuggaccauaacuaaggcucuagcuugcagaugcuggaucggggaaugggguggggucaugggcguggugggaauagcuugaagcaucccaugcauuugaaagaagggcagucaaugaaagggcccaucaccuaccaggguuccaaucgauggcauugucaaucggaccugacaucugauauuugucugaauaacgcuccacaucugagggguggaagggucaaaguuuuaucccuucagagacccagaacaggacuguuccugagaguccagcccucucaauacugaggaauuaucuguuuccuuaccccaaacccagagcccagggggucagcuucagugaggaccuuaucacuuuuuuuuuuuuuuuuuuuugagacagagucucgcucugucccucaggcuggagugcagugguacaaucucagcuuacugcaaccuccaccucccagguucaagcgauucuccugccucagucuccugaguagcugggacuacaggcacacaccaccacgccuagcuaauuuuuguauuuuuaguagagacgggguuucaccauguuggccaggauggucucaaucuccugaccucgugauccacccaccucggccucccaaagugcugggauuacaggcgugaauuacugcgcccggccccuuaucacucuucuaaccuguuccuuuuccacccaaaauuacgauuuuuuuuuuuucagacagaaucucgcacugucgccugggcuggagugcaguggcgugaucucagcccacugcaaccuccgccucccaaguucaagcaauucuugccucagccucccaagcagcugggauuagaggcaucugccaccaggccuggcuaauuuuuuuguauuuuuuguagagacgggguuucacuauguuggccaagcuggucuugaacuccugaccucgugaucugcccaccucagccucccaaagugcugggauucuaggugugagccaccacaccuggccuuuuuuuuuugagacagagguuugcugugucacccaggcuagagugcaguggcaagaucucagcucacugcaaccuccaccucccagguucaagcgauucucaugccucagccucagccucagccucccgaguagcugagaccacaggcacacaccacugugccuggcuaauuuuuauauuuuuaguagagacaggguuucaccguauuggcuaggcuggccucaaacuccuggccucaagugauccacccaugucagccucccaaagugcuggccauuacaggcguaagccaccgcacccggccaugaugauuuuuuuuuuuucugucccuuaguucaaaggcauggcuguauuaagaaauagcguggugcaguggaaaguaugcuagggaauaagaaaccaggauuucaguauucucuuguugguuggugcuuauaauauccagauuguuaaaaauuuugcugggcgcaguggcucaugccuguaaucccagcacuuugggaggccaaggcaggagaaucucuugagcccagaaguucaagaccagccuggacaacauaaggacacccuaucucuauuuuacaaaaaaauaaaaaauauauaauuuuuuagaaaauacaucccccuacuuauacacgugaaaugggauuuuaauauuuaaccuccugcugucccaagacuaucaugagacucaaaacaaaccaugaauacuauaaugcauuucagauacagggguaacuauuaugaucuccccaguuagauaguaugcuuccugugccccucuggcccccaguggugcugagcacagggcacuccccauggaaggcacucagaauaugaugcuagcauuccaacugaccucucuuggggacagcuggccggaugaaguaggggagcugccucauggcuccucguagcucuugcuucagugccaggacauauuccccuuccucgccugagggcaaagguacugggcggaacuccaagggcuaaagaggcaggggcaguggucaguucagggagaaaaugcuaguacaaauuuaggaagaccccuccucccaauuuagucuaacacucccacugagcagagggccaaaugacaaucgagggaguaacauauuauuuugaaagcuggggagaaguaaagguggacacuucuuugccugcaaaacaucccugugcauugggaguauagagagagggccaaagcgaggaugguuuuaugaugguccaggaggaauucagaaucauguacagucagccaggggcacaugagagucugggaagggaguggagagacucacagggaagaguggagaaggcugcagggugggugggggcaaagcauccccuuucccaaugcccacggccuccacguugaaggucaacuggccccggccacgaccccggcccccaccccggcuggccaugguggagggggccuggguauucagagauccagugaauaaaccuaauaaagacaaaaacaaagagaaaaagaaauguaguagaauggacaggaagccaaggagguacaagacauucaaucuuuuaucucugggacaugaaaaguuaaugucauucaacaaauuuugacugagaaggcacagugucagagagagaauuucuggaaauauaaacaugaaugagacauggucccccaaacaggucagauaauuacaauauaguuuagcacaaaggagaaagugcugacaccuuuggacaaaacucuacaucccuaagacaauuugauguuuaucucuaucugcauuucuuuauuuuuauuuuuagagaugcucugucacccaggcuugagugcaauggugcaaucacaguucacucuagccucgaaccccugggcucaagauccuccugccucagccucccaaagugcugggauuacaggcaugaaccacuaugcccagccacaaacugcauuucuacauauaaccuuugaauucuuucuaucucuggccuuccaaaccugaccaggccccaauucaauccaaugcaaugcauucggcgaaacauuuauuaaucgucuaccaugaaaaagauagugugucaggcacugugggagcacagggaugagucaucaauuucauuguaaaccaggggaaaagacacauuacaaucaaauugaucuuuuuauuuuauuuuauuugagauagggucucuuucugucauccaggcuggagugccguggugugaucauggcucacugcagccucaaccuccugggcucaggugauccuccugccuuagccucccaaguagcuggagcuacaggugugugccaccaugccuggcucuuuuuuuuuuuuuuuuuuuuuuaagagacuggauuucauuaugucaagugauccaacugucucagccucccaaagugcugggauuacaggcaugagccaccgcgagaggccaaauugaucuuuuuaaacaccacuuggaagcauagaaucuuagaauugggaggacccuuauagaggucaucuagucuaaaccccucccagugcaggacuucacucuguaaauuguuuuguuguuguuugguguaugugugugucuucuuuuuuuuuuucuugagacagagucucacuuuguugcccaggcuggagugcagcagugcaaucuuggcucacugcaaccucugccucccaggcucaagugauccuccugccucagcuuccugaguagcugggacuacaggcaugugccaccaagccuggcuaauuuuuguauuuuuuguagagacaggauuucgccaugucacccaggcuggucucgaacuccuggacucaaaugauccaccugcuugggcuucccaaagugcugggauuacaggugugagucaccaccccugacccuacuuugugaauuguuauucagcuuuugguggcauuucccuaaagagaugguauccauucuccccccaagacaguauauuccacugugaucaacacugaugaaucuaaaguuucuccuucuaccgaauuuucacucugucucuuaucaucaauccugaggaaccagucagaggcagcuaggaugggggaauaaaaucaccagaugaaaagaaaacuugagagaaaugauaucccaguagcaaugagcacaccuagcacccagaucuugguuucucauacaauuuuccaauaaaaggaaccagggcucucuggacuacuagcugauucuaggacaggguaggaaauauacaacaugagucuagagcaucuugaggugccaaaaaguaaggaggugcucaaaacaacaaccacacucacauauugauggguuagcugggugcagcggcucauugcuauaaucccagcacuuugagaggcuggagcgggcagaucacucgagcccuaggaguuugagaccagucuggacaacagggcaaaaccucgucuuuacaaaaaauacaaaaauuagccaggcaugguggcaugcacccguggucacugggugauccuucccuacugggaaggauugcuugagccggggagguugaugcugcaauguuaugauugcaccacuugcacuccaaccuggguggcagaguaaagacucugucucaaacaaacgaaaaacaaacaaaaaggagaaaaaacgaaaaaaauaaacauauugaugaggcuaugucaaagggacauaagagccaacugaaaaaguucccaauggccaaagcugaaacaauuugaggaacaaaauaaauaaagcaguauuagauuauaaccccaaaguauaagauaaauaucugugaguccauagugauauaaauaaaugacugaauuuauuuauaugggggaaaaaagacaaaucucucauguagaauuccaaauaaaauauguagacacuccauccuaaaagggagcaggggagcauaacuccccacuuuuuuuuuuuuuuuuugagauggaguuucgcucuuauugcccaggcuggaguacaacggcacgaucucggcucgcugcaaccuccaccucccggguucaagagauucuccugccucagccucccaaguagcugggauuacaggcaugugccaccacgcccggcuaauuuuguauuuuuaguagagacgggguuucuccauguuggucaggcuggucucaaacucccaaccucaggugacccacccaccucggccucccaaagugcugggauucaggcgugagccaccgcacuggcuauaacuucccacuucuuauguguggacuguguauagggaauuucucucucucucucucucuauauauauacacacacacacacacacguauauauauauauauauauuuuuuuuuuuuuuuuuuuuuuuuuuuuuugagacagagucucacucugucacccaggcuggagugcaguggcgcaaucucagcucacugcaaccucugccucccgggugcaagcgacucuccugccucagccuccugaauagcugggauuacgggcgcacgccacuacgcccggcuaauuuuuguauuuuuaguagagacgggguuucaccauguuggucagucuggucuugaacuccugaucucaugauccgccugccucggccucccaaagugcugggauuacaggcgugagccacugcacccggcccucauucaauaauuuaggaaaucaggaggaauaucuuuacaguggagagaccagaaaaacacuacuucaaccagaugaccaaggucagcaucaguacucauaaaucauguuuucgguaugugcccuuaaaauuacaugauaaaaugguacuucaccucugugaucauccuccuaaaaacccauaaccccacacuaauaaagagaaaaauaucaaauuccagcagaaaggcauccuacaauauacccaacuccucaaaacugucagucaucaaaaacaguaaagucugagaaacccgucacacuuaagaggagccuaaggagacgugacaacuaaauauaauguggaauccuaaaugggauucauguacagaaaaagagcaauagguaaaaaccaaagaaaugucaaucaaguaucaaccuuaguuaauaauaauguaucaguauucauucauuaauuguaacaaauauacgaaucaauuuuuuuuuuuuuuuuuuuuuuuugagauggaguuucgcucuuguugcccggcuggagugcaauggcgcgaucucggcucacugcaacuuccgccucccagguucaagcgauucuccugccucagccugcugaguaccugggauuacaggcaugcgccaccacgccuggcuaauuuuauacuuuuuuuaguacagaggggguuucuccauguuggucaggcuggucuccaccucccgaccaggugauccauccgccucggccucccaaagugcuagauuacaggcaugagccacugcgcccggcauuuuuuuuuuuuuuuuuuuuuuuuuuuuugagauggaguuucgcucuuguugcccggcuggagugcaauggcgcgaucucggcucacugcaaccuccgccucccggguucaagcgauucuccugccucagccucccgaguaguugggauuacaggagcccgccaccgugcccggcuaauuuguuuuuguauuuuuaguagagacgggguuucaccaucuuggccagguuggucucgaacuccugaccucgugauccacccgccucagccucccaaagugcugggauuacaggcgugagucaccgcggccggccaaucuacaauguuaauaggggaaacugugcacugggacaaaugggaacucuuggcacuaucugcuaaauuuuuccguaagucuuaaauuguucuaaaauauauaaucuauuaauuaaaacaaaaacaaaaaacaaaaaaaacucgaggcugggcguggugguucacaccuguaaucccagcacucugggaggcuggggugggaugacuacuuaaguccaggaguuugagaccagccggggcaacauagugagauuccaucucuacaaaaaauaaaaaaauuagccaggcaugguggcacaugccaguagucccagcuacgugggagacugagguggaaggaucgcuucagcccgggagauaagaggauucagugagccaugaucaugucacugcacucacccugggugacagagaccuugucucaaaacaaaaagcuaaaacaaaaaucaaguagcaauucaaaauucccaagagauuaguuggugaaaaaaauauuuaaaaauaauauguagaagguaaucuucugucagaaauacauacacacauaugaauuaaaaaucuguuauagaaggauauguaccaaaaauuaacaacgguuaauuugaaggaugaggguuuuuugaauuuuuucugguggggagaguuguguaucuuuuuuuuuuuuuuuuugagacagagucuugcucugucacccaggcuggaguggugcaguggugcaaucucggcucaccgcagccuccaccuuacggguucaagcaauucuccugccucagccuccugaguggcugggauuacaggcacccaccaccaugcuuagcuaauuuuuguauuuuuaguagagaggggguuuucccauguuggccaggcuggucucaaacuccugaccucgugaucugccugccucagccucccaaagugcugggauuacaggcaugagccaccaugcccagccagguuauguaugcuuuguuuuuuucuauacugaauagaauacuauaacaacauuaaaauauuaauuuaaaaauuuuuggcugggcaugguggcucaugccuguaaucccaacacuuugggaggccgaggcagguggaucacaaggucaagggaucgagaacauccuggucaacauggcaaaaccccgucucuacuaaaauacaaaaauuagcugggcaugguggugugcgccuguagucccagcuacucaggaagcugaggcaggagaaucgcuugaacccgggagguggagguugcagugagccgagauggcgccacugcacuccagacuggcaaaagagcgagacugugucucaaaaaaauuuuuuuuuaaugggccaguuguggugguucauggagguaauuucagcacuuugggaggccagggcagaaggaucacuugggcccaggcagucgaggcugcagugagcuaugaucacaccacugugcaccagucugggcaacagagugagaccgugucucaauaaauagauaaauaaaauuuaaaugucguaacagaauacuaaaugagauuaauaaucuguagcuaggagaggguagaaaaauguauaucugaggaaucugggaaguuucaagcccaacugccauaaaaaaaauugaggaaacaauggcuguugguuaagauaucaaauugcaaucuguuugaaaagagcauauuaagggagagaagaugucucauggagacuagagaaauaauaagaauuuguuggcugggcgugguggcucaugcuuguaaucccagcacuuuaggaggcugaggugggcggaucacgaggucaggaguucaagaccagccugaccaacaaagugaaaccccgucucuacuaaaaauacaaaaaauuagccaggcgugguggugcacgccuguaaucccagcuacucaggaggccgaggcaggagaauaacuugaaaucaggaggcagagguugcagugagccaagauugugccacugcacuccagccugggcaacagagcgagacucugucucaaaaaaaaaaaaaaaagaauuugucaccgugucuucagccccuuuuaagcgagagaacauucuaaccagcugguuaaguaucuuuccacuugacagauauaguucuggcaguggagauaggagcugcugugacugcaaagcaaugaagagucaauaaauggccaugaguuugagguuagacaaauuccacaccauuucuacacauuaaaugagugauccucuaagaaugcaggggaaaaagaagacaaaauuuuauuuaauacagguugggaaauaaaccauccaucugccccauucaucuuaggaaucuauagggagucucugcuauuaaagauugugauggaguuaaaauucuugaggauacuuaaggucucccauaaucuagucacaaucugcuccuccuuaacaucaaccuuuccagagaguuuaccccuguacucuguuuuacuccaaacaacacucauauacacuaugcucauucccaauuauucauacauauauauugugguggaaguuacugagaggcagguuucaacuaaacauacagaaaaacacuaacaauuacaucaaauuuaaggaaggcaguacauguagagguuaagaauaugguuuugaaucccaguucaauuuccuagcuacaaaacucugguaauuuauuuauugucucuaaaccuguuuccucaucuguaaaaugggaauaaaaauaacaauaauagaaucauuucacucaacaaauauuuacugagugcuuacuaggugugccaggcacuguucuagauucuauggauauagcagugugcaaaacagacaaaaacaugcugcacccacgggguuuaaauggagcuuucauuccaguggaggcaucagcaaacaaacaauacuucaagccaugagacuaggugagaccccuaaaggaguggauguggacagagaaaauaagaaauccaggcacugaggccuggggcacgcugauguguagaauuugcuauacauguaauaaauaaagcaagaaauuaacacccuuaaaaucuuggaaauccaaauuuuaaaaaaucaucucaauagaaaaaaugggcaaaggacaugaacaggcaacuggcaaagagaauggccaugucuggacaugguggcucacuccuguaauccaggguuuugggaggccgagguggacagaucacuugaggccaggaguucaugaccagccugggcaacauagagaaacccugucucuacuaaaaauacaaaaaauuagccaggcacagugguacacaccuuuaauuccagcuacucaggaggcugaggcaugagacucacuugaacacaggagguggagguugcagugagcugagaucucaccacugcacuccagcuugggcaacagagcaagacugucucaaaaaaaaaaaaaaggagagagaauggccaauaaaaccacucuucaccuaugaaagugacaaagauuuaaauaauaagcaggcugucaugaguuuuuuuucaaauggacacucucauaccucacuggaaagacuauaaacauaauauuucaaggggagcaauuuguccaguuaaaucaacagccuuugaaauguuuauaucccuaauccagcaaucccacuuuaaaaauauauuccaaagacaucaacagauauacagucacagauauaaguaaaaggauauucaucaaagagcuauuuaugguagcaaaaauucugaaauaacugaaacaaucuaacaauaaaugaaugguuaaaaaauacccauuuuauuuauuuauguucuuuuuauuuuauuauuuuuuuuuugagacaguuucacucuugucguccaggcuggagugcaauggcgcaaucucagcucaccgcaaccuccaccuccuggguucaagugauucuccugccucagccccccgaguagcugggauuacaggcaugcgccaccaugccuggcuaauuuuuuuuguaguuuuaguagagaugggguuucuccauguuggucaggcuggucuuguacuccugacuucgugauccacccgccuuggccucacaaagugcugggauuacaggcaugagccaucacgcccggccucuuuuuuuuuuuuuuuuuuuugagacagguucuugcucugucgcuuaggcugaagugcagugcaguggcaauuuuggcucacugcagccucgacuucuccagcucaagcaacccuccaccucagccuccugagcagcuggaacuacaggccugagacaccaugcuuggcuauuuuuuuuguaguuuuuguagagacaggguuuugucauguugccuagacuggucuugaacuccugggcuaaagugaucugccuaccucagccucccaaagugcuggaauuacaggcaugagccaccacgcccagccagaaauggcuugcuuuuaagaaugcuaccaauuccacuguaaaaggacagauuuccuuuuuuuuuuuuuuuuuuuuuuuuugagagggaguuuugcucuuguugcccaggcuggagugcaauggugcgaucugagcucacugcaaccuccgccuccuggguucuaaugauucuccugccucagccuccccaguagcugggauuacaggcaugcgccaacacgcccagcuaauuuuuguauuuuuaguagagacagaguuucuccacguuggucaggcuggucuccaacucccgaccucaggcgaucugcccgccucggccucccaaagugcugggauuacaggcaugagccaccgugcccagccauauuucccucuuuuacaguggaaguguggaaugcauuuccuuuagcuauauauuucuuauuuagaauauuuguaggauauugacuaaagaacagguaucaaaaaauugaaugaucuacaagagagauaagagaguucccuuacuaaagauguuuacauagaagcuggguaaaaauuuacuacauaggguuuguaagaaggaugcauggcucuaguagaggauucccuaugaucagcaugauuuagcauugugucuggcauauaguaggugcucaauaaauauuuauugaaugaauaaauacaucauuucuaugggccuuuccaaacuugagaaauugugauccauaaagccuccccucaccauuccaguucuccuugcuuucuuccuucucuagauuguagaaacaauuaugaaacacuaauauuaugaaccacuaauuuaauggcucuuaauuacauacuguauugucuuuuauuguucccuaguuauguuaggaguuuaaauucugccuccccaaaaagagugcuaguuaccagaaaucaauucuauuuaacuaacguuuauugggcacuauauauuaacuacuagcaccuguccuacaaaaccuucuauucuaaaaggcauagaaacguuaaagagagacagugcacuaaguguccuaauaaagguauauacaaaacgcuaucguagacgggggaacaauucauuuugcaagaaaggcggcccaggaaaacuacagguagcauuucagcuagucuucauagauaacaggaguuugucaggcucuugggauaauauuaauagauuagggggaaguugaugcuauagcaaagacagauacaagaggcugucucguuuucugcuuuaaugucucuccccaugcgcgauagaaaacugccauucucuaguauacaaucaauacagaaauggaagcccaggggagaaacgguagggagccagaagggggcugauccaacaaccugacggaaagcguugucuauuucgcagccuggccggggugaacaaguuuggcaagugucggaccgaaccaggucaagccuuaccugcugccccuccccaaagcggagcccaagccgcgaccaacuugaaauguacugggcuuccucaag

SEQ ID NO: 191320 - RNA, 14152 nt, Homo sapiens
cuugaggaagcccaguacauuucaaguuggucgcggcuugggcuccgcuuuggggaggggcagcagguaaggcuugaccugguucgguccgacacuugccaaacuuguucaccccggccaggcugcgaaauagacaacgcuuuccgucagguuguuggaucagcccccuucuggcucccuaccguuucuccccugggcuuccauuucuguauugauuguauacuagagaauggcaguuuucuaucgcgcauggggagagacauuaaagcagaaaacgagacagccucuuguaucugucuuugcuauagcaucaacuucccccuaaucuauuaauauuaucccaagagccugacaaacuccuguuaucuaugaagacuagcugaaaugcuaccuguaguuuuccugggccgccuuucuugcaaaaugaauuguucccccgucuacgauagcguuuuguauauaccuuuauuaggacacuuagugcacugucucucuuuaacguuucuaugccuuuuagaauagaagguuuuguaggacaggugcuaguaguuaauauauagugcccaauaaacguuaguuaaauagaauugauuucugguaacuagcacucuuuuuggggaggcagaauuuaaacuccuaacauaacuagggaacaauaaaagacaauacaguauguaauuaagagccauuaaauuagugguucauaauauuaguguuucauaauuguuucuacaaucuagagaaggaagaaagcaaggagaacuggaauggugaggggaggcuuuauggaucacaauuucucaaguuuggaaaggcccauagaaaugauguauuuauucauucaauaaauauuuauugagcaccuacuauaugccagacacaaugcuaaaucaugcugaucauagggaauccucuacuagagccaugcauccuucuuacaaacccuauguaguaaauuuuuacccagcuucuauguaaacaucuuuaguaagggaacucucuuaucucucuuguagaucauucaauuuuuugauaccuguucuuuagucaauauccuacaaauauucuaaauaagaaauauauagcuaaaggaaaugcauuccacacuuccacuguaaaagagggaaauauggcugggcacgguggcucaugccuguaaucccagcacuuugggaggccgaggcgggcagaucgccugaggucgggaguuggagaccagccugaccaacguggagaaacucugucucuacuaaaaauacaaaaauuagcugggcguguuggcgcaugccuguaaucccagcuacuggggaggcugaggcaggagaaucauuagaacccaggaggcggagguugcagugagcucagaucgcaccauugcacuccagccugggcaacaagagcaaaacucccucucaaaaaaaaaaaaaaaaaaaaaaaaaggaaaucuguccuuuuacaguggaauugguagcauucuuaaaagcaagccauuucuggcugggcgugguggcucaugccuguaauuccagcacuuugggaggcugagguaggcagaucacuuuagcccaggaguucaagaccagucuaggcaacaugacaaaacccugucucuacaaaaacuacaaaaaaaauagccaagcauggugucucaggccuguaguuccagcugcucaggaggcugagguggaggguugcuugagcuggagaagucgaggcugcagugagccaaaauugccacugcacugcacuucagccuaagcgacagagcaagaaccugucucaaaaaaaaaaaaaaaaaaaagaggccgggcgugauggcucaugccuguaaucccagcacuuugugaggccaaggcggguggaucacgaagucaggaguacaagaccagccugaccaacauggagaaaccccaucucuacuaaaacuacaaaaaaaauuagccaggcaugguggcgcaugccuguaaucccagcuacucggggggcugaggcaggagaaucacuugaacccaggagguggagguugcggugagcugagauugcgccauugcacuccagccuggacgacaagagugaaacugucucaaaaaaaaaauaauaaaauaaaaagaacauaaauaaauaaaauggguauuuuuuaaccauucauuuauuguuagauuguuucaguuauuucagaauuuuugcuaccauaaauagcucuuugaugaauauccuuuuacuuauaucugugacuguauaucuguugaugucuuuggaauauauuuuuaaagugggauugcuggauuagggauauaaacauuucaaaggcuguugauuuaacuggacaaauugcuccccuugaaauauuauguuuauagucuuuccagugagguaugagaguguccauuugaaaaaaaacucaugacagccugcuuauuauuuaaaucuuugucacuuucauaggugaagagugguuuuauuggccauucucucuccuuuuuuuuuuuuuugagacagucuugcucuguugcccaagcuggagugcaguggugagaucucagcucacugcaaccuccaccuccuguguucaagugagucucaugccucagccuccugaguagcuggaauuaaagguguguaccacugugccuggcuaauuuuuuguauuuuuaguagagacaggguuucucuauguugcccaggcuggucaugaacuccuggccucaagugaucuguccaccucggccucccaaaacccuggauuacaggagugagccaccauguccagacauggccauucucuuugccaguugccuguucauguccuuugcccauuuuuucuauugagaugauuuuuuaaaauuuggauuuccaagauuuuaaggguguuaauuucuugcuuuauuuauuacauguauagcaaauucuacacaucagcgugccccaggccucagugccuggauuucuuauuuucucuguccacauccacuccuuuaggggucucaccuagucucauggcuugaaguauuguuuguuugcugaugccuccacuggaaugaaagcuccauuuaaaccccgugggugcagcauguuuuugucuguuuugcacacugcuauauccauagaaucuagaacagugccuggcacaccuaguaagcacucaguaaauauuuguugagugaaaugauucuauuauuguuauuuuuauucccauuuuacagaugaggaaacagguuuagagacaauaaauaaauuaccagaguuuuguagcuaggaaauugaacugggauucaaaaccauauucuuaaccucuacauguacugccuuccuuaaauuugauguaauuguuaguguuuuucuguauguuuaguugaaaccugccucucaguaacuuccaccacaauauauauguaugaauaauugggaaugagcauaguguauaugaguguuguuuggaguaaaacagaguacagggguaaacucucuggaaagguugauguuaaggaggagcagauugugacuagauuaugggagaccuuaaguauccucaagaauuuuaacuccaucacaaucuuuaauagcagagacucccuauagauuccuaagaugaauggggcagauggaugguuuauuucccaaccuguauuaaauaaaauuuugucuucuuuuuccccugcauucuuagaggaucacucauuuaauguguagaaaugguguggaauuugucuaaccucaaacucauggccauuuauugacucuucauugcuuugcagucacagcagcuccuaucuccacugccagaacuauaucugucaaguggaaagauacuuaaccagcugguuagaauguucucucgcuuaaaaggggcugaagacacggugacaaauucuuuuuuuuuuuuuuuugagacagagucucgcucuguugcccaggcuggagugcaguggcacaaucuuggcucacugcaaccucugccuccugauuucaaguuauucuccugccucggccuccugaguagcugggauuacaggcgugcaccaccacgccuggcuaauuuuuuguauuuuuaguagagacgggguuucacuuuguuggucaggcuggucuugaacuccugaccucgugauccgcccaccucagccuccuaaagugcugggauuacaagcaugagccaccacgcccagccaacaaauucuuauuauuucucuagucuccaugagacaucuucucucccuuaauaugcucuuuucaaacagauugcaauuugauaucuuaaccaacagccauuguuuccucaauuuuuuuuauggcaguugggcuugaaacuucccagauuccucagauauacauuuuucuacccucuccuagcuacagauuauuaaucucauuuaguauucuguuacgacauuuaaauuuuauuuaucuauuuauugagacacggucucacucuguugcccagacuggugcacaguggugugaucauagcucacugcagccucgacugccugggcccaagugauccuucugcccuggccucccaaagugcugaaauuaccuccaugaaccaccacaacuggcccauuaaaaaaaaauuuuuuugagacacagucucgcucuuuugccagucuggagugcaguggcgccaucucggcucacugcaaccuccaccucccggguucaagcgauucuccugccucagcuuccugaguagcugggacuacaggcgcacaccaccaugcccagcuaauuuuuguauuuuaguagagacgggguuuugccauguugaccaggauguucucgaucccuugaccuugugauccaccugccucggccucccaaaguguugggauuacaggcaugagccaccaugcccagccaaaaauuuuuaaauuaauauuuuaauguuguuauaguauucuauucaguauagaaaaaaacaaagcauacauaaccuggcugggcaugguggcucaugccuguaaucccagcacuuugggaggcugaggcaggcagaucacgaggucaggaguuugagaccagccuggccaacaugggaaaacccccucucuacuaaaaauacaaaaauuagcuaagcaugguggugggugccuguaaucccagccacucaggaggcugaggcaggagaauugcuugaacccguaagguggaggcugcggugagccgagauugcaccacugcaccacuccagccugggugacagagcaagacucugucucaaaaaaaaaaaaaaaaagauacacaacucuccccaccagaaaaaauucaaaaaacccucauccuucaaauuaaccguuguuaauuuuugguacauauccuucuauaacagauuuuuaauucauauguguguauguauuucugacagaagauuaccuucuacauauuauuuuuaaauauuuuuuucaccaacuaaucucuugggaauuuugaauugcuacuugauuuuuguuuuagcuuuuuguuuugagacaaggucucugucacccagggugagugcagugacaugaucauggcucacugaauccucuuaucucccgggcugaagcgauccuuccaccucagucucccacguagcugggacuacuggcaugugccaccaugccuggcuaauuuuuuuauuuuuuguagagauggaaucucacuauguugccccggcuggucucaaacuccuggacuuaaguagucaucccaccccagccucccagagugcugggauuacaggugugaaccaccacgcccagccucgaguuuuuuuuguuuuuuguuuuuguuuuaauuaauagauuauauauuuuagaacaauuuaagacuuacggaaaaauuuagcagauagugccaagaguucccauuugucccagugcacaguuuccccuauuaacauuguagauuggccggccgcggugacucacgccuguaaucccagcacuuugggaggcugaggcggguggaucacgaggucaggaguucgagaccaaccuggccaagauggugaaaccccgucucuacuaaaaauacaaaaacaaauuagccgggcacgguggcgggcuccuguaaucccaacuacucgggaggcugaggcaggagaaucgcuugaacccgggaggcggagguugcagugagccgagaucgcgccauugcacuccagccgggcaacaagagcgaaacuccaucucaaaaaaaaaaaaaaaaaaaaaaaaaaaaaugccgggcgcaguggcucaugccuguaaucuagcacuuugggaggccgaggcggauggaucaccuggucgggagguggagaccagccugaccaacauggagaaacccccucuguacuaaaaaaaguauaaaauuagccaggcgugguggcgcaugccuguaaucccagguacucagcaggcugaggcaggagaaucgcuugaaccugggaggcggaaguugcagugagccgagaucgcgccauugcacuccagccgggcaacaagagcgaaacuccaucucaaaaaaaaaaaaaaaaaaaaaaaauugauucguauauuuguuacaauuaaugaaugaauacugauacauuauuauuaacuaagguugauacuugauugacauuucuuugguuuuuaccuauugcucuuuuucuguacaugaaucccauuuaggauuccacauuauauuuaguugucacgucuccuuaggcuccucuuaagugugacggguuucucagacuuuacuguuuuugaugacugacaguuuugaggaguuggguauauuguaggaugccuuucugcuggaauuugauauuuuucucuuuauuagugugggguuauggguuuuuaggaggaugaucacagaggugaaguaccauuuuaucauguaauuuuaagggcacauaccgaaaacaugauuuaugaguacugaugcugaccuuggucaucugguugaaguaguguuuuucuggucucuccacuguaaagauauuccuccugauuuccuaaauuauugaaugagggccgggugcaguggcucacgccuguaaucccagcacuuugggaggccgaggcaggcggaucaugagaucaggaguucaagaccagacugaccaacauggugaaaccccgucucuacuaaaaauacaaaaauuagccgggcguaguggcgugcgcccguaaucccagcuauucaggaggcugaggcaggagagucgcuugcacccgggaggcagagguugcagugagcugagauugcgccacugcacuccagccugggugacagagugagacucugucucaaaaaaaaaaaaaaaaaaaaaaaaaaaaaauauauauauauauauauacguguguguguguguguguauauauauagagagagagagagagagaaauucccuauacacaguccacacauaagaagugggaaguuauagccagugcgguggcucacgccugaaucccagcacuuugggaggccgaggugggugggucaccugagguugggaguuugagaccagccugaccaacauggagaaaccccgucucuacuaaaaauacaaaauuagccgggcgugguggcacaugccuguaaucccagcuacuugggaggcugaggcaggagaaucucuugaacccgggagguggagguugcagcgagccgagaucgugccguuguacuccagccugggcaauaagagcgaaacuccaucucaaaaaaaaaaaaaaaaaguggggaguuaugcuccccugcucccuuuuaggauggagugucuacauauuuuauuuggaauucuacaugagagauuugucuuuuuucccccauauaaauaaauucagucauuuauuuauaucacuauggacucacagauauuuaucuuauacuuugggguuauaaucuaauacugcuuuauuuauuuuguuccucaaauuguuucagcuuuggccauugggaacuuuuucaguuggcucuuaugucccuuugacauagccucaucaauauguuuauuuuuuucguuuuuucuccuuuuuguuuguuuuucguuuguuugagacagagucuuuacucugccacccagguuggagugcaaguggugcaaucauaacauugcagcaucaaccuccccggcucaagcaauccuucccaguagggaaggaucacccagugaccacgggugcaugccaccaugccuggcuaauuuuuguauuuuuuguaaagacgagguuuugcccuguuguccagacuggucucaaacuccuagggcucgagugaucugcccgcuccagccucucaaagugcugggauuauagcaaugagccgcugcacccagcuaacccaucaauaugugagugugguuguuguuuugagcaccuccuuacuuuuuggcaccucaagaugcucuagacucauguuguauauuuccuacccuguccuagaaucagcuaguaguccagagagcccugguuccuuuuauuggaaaauuguaugagaaaccaagaucugggugcuaggugugcucauugcuacugggauaucauuucucucaaguuuucuuuucaucuggugauuuuauucccccauccuagcugccucugacugguuccucaggauugaugauaagagacagagugaaaauucgguagaaggagaaacuuuagauucaucaguguugaucacaguggaauauacugucuuggggggagaauggauaccaucucuuuagggaaaugccaccaaaagcugaauaacaauucacaaaguagggucagggguggugacucacaccuguaaucccagcacuuugggaagcccaagcagguggaucauuugaguccaggaguucgagaccagccugggugacauggcgaaauccugucucuacaaaaaauacaaaaauuagccaggcuugguggcacaugccuguagucccagcuacucaggaagcugaggcaggaggaucacuugagccugggaggcagagguugcagugagccaagauugcacugcugcacuccagccugggcaacaaagugagacucugucucaagaaaaaaaaaaagaagacacacacauacaccaaacaacaacaaaacaauuuacagagugaaguccugcacugggagggguuuagacuagaugaccucuauaaggguccucccaauucuaagauucuaugcuuccaagugguguuuaaaaagaucaauuuggccucucgcgguggcucaugccuguaaucccagcacuuugggaggcugagacaguuggaucacuugacauaaugaaauccagucucuuaaaaaaaaaaaaaaaaaaaaaagagccaggcaugguggcacacaccuguagcuccagcuacuugggaggcuaaggcaggaggaucaccugagcccaggagguugaggcugcagugagccaugaucacaccacggcacuccagccuggaugacagaaagagacccuaucucaaauaaaauaaaauaaaaagaucaauuugauuguaaugugucuuuuccccugguuuacaaugaaauugaugacucaucccugugcucccacagugccugacacacuaucuuuuucaugguagacgauuaauaaauguuucgccgaaugcauugcauuggauugaauuggggccuggucagguuuggaaggccagagauagaaagaauucaaagguuauauguagaaaugcaguuuguggcugggcauagugguucaugccuguaaucccagcacuuugggaggcugaggcaggaggaucuugagcccagggguucgaggcuagagugaacugugauugcaccauugcacucaagccugggugacagagcaucucuaaaaauaaaaauaaagaaaugcagauagagauaaacaucaaauugucuuagggauguagaguuuuguccaaaggugucagcacuuucuccuuugugcuaaacuauauuguaauuaucugaccuguuugggggaccaugucucauucauguuuauauuuccagaaauucucucucugacacugugccuucucagucaaaauuuguugaaugacauuaacuuuucaugucccagagauaaaagauugaaugucuuguaccuccuuggcuuccuguccauucuacuacauuucuuuuucucuuuguuuuugucuuuauuagguuuauucacuggaucucugaauacccaggcccccuccaccauggccagccggggugggggccggggucguggccggggccaguugaccuucaacguggaggccgugggcauugggaaaggggaugcuuugcccccacccacccugcagccuucuccacucuucccugugagucucuccacucccuucccagacucucaugugccccuggcugacuguacaugauucugaauuccuccuggaccaucauaaaaccauccucgcuuuggcccucucucuauacucccaaugcacagggauguuuugcaggcaaagaaguguccaccuuuacuucuccccagcuuucaaaauaauauguuacucccucgauugucauuuggcccucugcucagugggaguguuagacuaaauugggaggaggggucuuccuaaauuuguacuagcauuuucucccugaacugaccacugccccugccucuuuagcccuuggaguuccgcccaguaccuuugcccucaggcgaggaaggggaauauguccuggcacugaagcaagagcuacgaggagccaugaggcagcuccccuacuucauccggccagcuguccccaagagaggucaguuggaaugcuagcaucauauucugagugccuuccauggggagugcccugugcucagcaccacugggggccagaggggcacaggaagcauacuaucuaacuggggagaucauaauaguuaccccuguaucugaaaugcauuauaguauucaugguuuguuuugagucucaugauagucuugggacagcaggagguuaaauauuaaaaucccauuucacguguauaaguagggggauguauuuucuaaaaaauuauauauuuuuuauuuuuuuguaaaauagagauaggguguccuuauguuguccaggcuggucuugaacuucugggcucaagagauucuccugccuuggccucccaaagugcugggauuacaggcaugagccacugcgcccagcaaaauuuuuaacaaucuggauauuauaagcaccaaccaacaagagaauacugaaauccugguuucuuauucccuagcauacuuuccacugcaccacgcuauuucuuaauacagccaugccuuugaacuaagggacagaaaaaaaaaaaaucaucauggccgggugcgguggcuuacgccuguaauggccagcacuuugggaggcugacauggguggaucacuugaggccaggaguuugaggccagccuagccaauacggugaaacccugucucuacuaaaaauauaaaaauuagccaggcacaguggugugugccuguggucucagcuacucgggaggcugaggcugaggcugaggcaugagaaucgcuugaaccugggagguggagguugcagugagcugagaucuugccacugcacucuagccugggugacacagcaaaccucugucucaaaaaaaaaaggccaggugugguggcucacaccuagaaucccagcacuuugggaggcugaggugggcagaucacgaggucaggaguucaagaccagcuuggccaacauagugaaaccccgucucuacaaaaaauacaaaaaaauuagccaggccugguggcagaugccucuaaucccagcugcuugggaggcugaggcaagaauugcuugaacuugggaggcggagguugcagugggcugagaucacgccacugcacuccagcccaggcgacagugcgagauucugucugaaaaaaaaaaaaucguaauuuuggguggaaaaggaacagguuagaagagugauaaggggccgggcgcaguaauucacgccuguaaucccagcacuuugggaggccgagguggguggaucacgaggucaggagauugagaccauccuggccaacauggugaaaccccgucucuacuaaaaauacaaaaauuagcuaggcgugguggugugugccuguagucccagcuacucaggagacugaggcaggagaaucgcuugaaccugggagguggagguugcaguaagcugagauuguaccacugcacuccagccugagggacagagcgagacucugucucaaaaaaaaaaaaaaaaaaaagugauaagguccucacugaagcugacccccugggcucuggguuugggguaaggaaacagauaauuccucaguauugagagggcuggacucucaggaacaguccuguucugggucucugaagggauaaaacuuugacccuuccaccccucagauguggagcguuauucagacaaauaucagaugucagguccgauugacaaugccaucgauuggaacccugguaggugaugggcccuuucauugacugcccuucuuucaaaugcaugggaugcuucaagcuauucccaccacgcccaugaccccaccccauuccccgauccagcaucugcaagcuagagccuuaguuaugguccaacacauucucagauucuaccugaaaaagcuauuaaauaguucccacuacucaggagauauccaagccacugaacaacuuuggcccagccccuuccuuccucuccuuuaaaacccucaccccccuuuaaaaccagucaguauucacuggagaccccaggcaggguccuauugacauuuacguucccacuauucccagauuggcggcgucuaccccgggagcuaaagauccgagugcggaagcuacagaaggaacgugaguguaucuggaaaaaaggagggagaagagagguuuccuucaucagccugagggccgaggcugcugcuggucucaccuuccaucccaguuccuauacccaaucuaccaaguguuguugcuagaugucauaguggccacaugagggcagcagagugacauguucuuugcaugaggaugggcuauaaagcuggcaaaauuugcucucugaagguuuaccuuuugaucccuccaccagggauuacaauucugcuccccaagaggcccccuaagaccacagaagauaaggaggaaacaauacagaaacuagaggugaggaggaagugugcauagagaccuccugagcccuggauccauucccucucucuuggcccaugugugccucaauuuuucccuucugugaacugaaccugaguuucuauuccuauucauccccacaugagacccuggagaagaaggaagaagaaguaacuucagaggaggaugaggagaaagaagaagaagaagagaaggaagaggaggaagaagaagaguaugaugaagaagaacaugaagaggugaaggggacuccuuccaccuuagucccccucccuuuacccucuuuauacuaggguugcucuccucagaggguuggcaugccaacagagauagugccccccaggguaggggcuucucucuacuucaucugccccccuucuacaaacuacagcuggaagagaugucucaggccuggaauggugugacugagaggaaaggggucugguacacaggaaggaaggugaaugccaaauugacuuuuacuuuuuuuuuuuuuuccauuucaggaaacugauuacaucaugucauauuuugacaauggagaggacuuugguggugacagugaugacaauauggacgaggcuauauacugaagaaggacucuggacccucgugucuuucuuuaggauacagagaguaacuguaccuauuauuuguuucuucagacaagcaaaucauuuggucagaguucauauaaucugucuguucccuggagaugggaauagaggaugaugacaguuuauuuucuacacuuccccuccuuccacauuuguaucaccuuugcuaucuuggggaaagugcaaaggacaaacaucucaauuguaugaagggagaaaggagaauugaaagaagaacugggguuguuagagcugagaugacuguacacauaccccugcccaauuuauauagcucuuuguggagauaauuaggggugggagcaguuugaaggaguaagccugguuuuauacuuuuaaauaaaguguuuuuaucuguc

SEQ ID NO: 191321 - RNA, 158236 nt, Homo sapiens
gcaacagcggcggcggccgcggcggcuggccggacucagguguuucggacgcuauugcccuucgcgccagccgucgagugggcagcagcgggacucagccgggcgccagguuccugccaggcagcgccgggaagcgcgggcggccgagaacuccuuccugcuacuucgcccagcgccgcugcuucggcuucccagcgaagugggagaccuuccucccuguuugcagacguccgugggagacccuuauuuuuuccaccgcuaagguuaagagauucuggaauagaagcgucgaaggagaucaagugaaccuucuacaacuccucggaugucgccagucucccuuucggggcggaagacuacguuugagcaucucacugaggugcaggaauggaagaacccaccuugcagcuuuucugcaguguggcuugccugaucuaccccuaggaaugaagaggaggcuuguaauaauccgaugaaguacagauguugaagaggauaucgcaggaccuaaacuugugaucguuugggggaggucacacacguuucugagugggaauggaugggcgugaaugacgugcccucuuaaaaagcacaacaguccuuuaagaggagcaaaauugaguuuucccauuuuggccaagauuuugaagacaguucaauguauucuacauuugacauaagaugagaacuuucuaaaguauucucuccaagagcguaaacgaugacuaccccagcccugcugccccucucuggacguaggauaccaccucugaaccuggggccgccuuccuucccacaucacagggcuaccuugagacuuucugagaaguuuauucuucuccuuauucuuagugccuucaucacucuguguuuuggggcauucuuuuuccuuccagacucuucaaaacacaaacgcuuugauuuggguuuagaagauguguuaauuccacauguagaugccgguaaaggggcuaaaaaccccggagucuuccugauccauggacccgaugaacauagacacagguuuguuuauuucagaaguucugguacuaacauuuggcagagcaagguacggugauuggaucgaaucugucuuuuuuuuuucuugcaguaaaauguaauuuuucgagucauaaauauuguauuguuacuucaagacuggcugaauaaaaccauagacuggagggacucuaccuccagucuaugguagaguccauagacugguaggacuggaguccuaccuaagucguucuucucuucgguuuuauauaagaaaaacauuugcguucagaguugugucuaauguggacaucugggaagggagguaugaaaacuuaaccuaaagaaauggugacauaagcugugccugcauuuauuaauaacguguuggagucagucauugugccaccaugugaaaucaaagcaucgaaccuugacagcucuuuugggugugcucucccagagggcucucguuuucuggcuuguaguugaagcuuaguagugagucagcuuuuuaggaugacaaacgugggcagaauauaccugucauuucuuaacgugaaaauauccugauuuuuguucuuuuuuuggggauguguguuggugcuguauaugaaaucaguuaaguuaaaagguauugaauccuaaguuauugcacuuugugaggcuuguagacaagauuuauuuuugugaaacuuaauuuugcucucucuuuuaauguaauagauggacugugucaagcaacuauuggaauuugguugauuaagggguucacauucuuucagaucacuaaaucuaaagugagcucuggggagagcauagccaaacuaggauaaaaugggagcucuaguuacaauuuuuauaauuuuuauauuuguacucaagaguuugggaaaguaguugacuuuucuuaaaccugccaucuuuuccuuguuucuuaaaauaauucuugaguaugugggaaaaaaaaucaugugcuugaauucauuucccaucugaugauaguuuuaacuuuuugucaagcaccgaaaaagcuuagguucacguguaagccuacauuaaauauuugggaaaaugcacuguuuuaugagaacugguuuuucuuuuuuucucaaccuaguuaauucauuacuugugugaugguucuuugacuuuuggaugaauuuuauggaguaguuacuucuaauauuguuucaugccauucuuuuguaacuaaguuaauuuggaauuuuugccauuuucgacuacuguacuccuguauuuguuucuuuaauuuugcacuuugcuuguugugacuuuaagaaaacacuaauaugaucugugaaauauguuacugaaaaauuaacggugaaaguaguuuuccuugaaaaucuuauuucgcaugguauuuguauaacauaugaaauauauugaaaaaauguguuaaggcuguuuuuagagcuguuucacaacagccacacauuaacauuacuuagcucuauuauuaauaguaucugucauguacuaagcaguuuaaaaaauacauuuugaauggucuaaaaguuuaaaauaauaugaccacauuuuaguuuaaaaacauuuacacaaaaauucucaguaaauggaguuaaaauaugaaauuugaaugaaaauacagauaugugccuuuuauucacauuuuuaacagucuguauaaauaguuuaaacaagaauucuuaaauuuaugaagcccuuggauauauaugcauauguauuuagcuaucuaaaacuauuggguuccugaguuuggaaugagagauugguuauuguucugauagcaggggugguuugugagccaugcccugaguuuuggcuaguaagagucuggauagcaagugauacaugugagucuggauagauuccaaugcaguuuuuggaaucuauucgguuccugaguuuuggaaaacgagaauucaaauagaguucagguggcaaaggauccuuguguuaucucuuuguauuucugugguuauaucaguugacauuugcuuuagcguauuauuugcuguuguuuacuauaucagaaaagagucuguaguaauaaacuuucuuuuacuuugagcaaggaaauacuuuuuaaauuaaguguauguuuaaaauguggaaacagaaaacaucaaauguauaaacauuaacuuauuuaaaaauaauucagaaaaauagcacuuuuacaguugguacuaagaucauauguauuuuggguaugggucagaacuuaccuaauuuagaagaaacaaauugacaguuuaucuucauuuaguguguguguguguguguguguguguguguaaggguacaggauagagggcugaggaauguuacuuuaacuaauaaguaauggaaaauaagucauggucaccauuucuuauuugcaguacuuaagagauacuuguuuaguuaguauuucuuuauuaauagauuaguauaauaauuugguguuuaaguucuggagucagacuguauagauucauacccuagcuugccacugauuagauuuaugauacugagaaauuuuaaaacucuauauuguuuccuuuguaucacaguggcauguaucuacuuuacagauuguuuuauugaaagagauaguacaugcaaagcacucaacauaguuccuggcauuuaguaaaugaucaauaaauguuaacuauuauuaucaucagugauuauaauuguaauggaauauuuuuauucggaaucuacuuuccuuuaaauacuguauauuuucugaaaaguaggguacaguuugauuaauauuuagaaguauacuaggaucuuauugucuaaaggaacauuuuauaaccaaacugguuggcaacaaauguaugccuacuguggcaggccccgcuuucaugaaacuuucaaucuagggagagaugaugggcauuaaauaaauaauuuuguuuuugaggugugaugaauguuacgaaguuguacucagugcuuucagagcaaggaaugugugaccuagucuauagaguuggggguggaggggcagugggaauaaggaagacuucauugagaaagugugccucagaaacguagaaugaguaggagauugcuuaaugaaguggaauuggagguugaggggagguugagggucaaagcagaagacacaacaugugugagagcccuaaggaaaaaaagcuuggcaucacuaagaaucugagaaauguuaaguauggcuguugcagagggugugggucugggugaugagacuagaugagaggucagguuuggccugcuuacaaguuuuuuggccuccuuauuguuguuacaaaaguuugaauuaguugucagcauucacagaucaggagauuucauguuaaagucuggauuucugaucuuucuugaaaaauuagagguuauggcaacauccaguguauuuucagaugguaauauucaagccacaacccaguagcagcugcucccuugggagggggacgggggcgggcaugugccacucagagugcgaaauaaguaaauacaaaucaaucaauauuuaaccugguuguuguugaguuugcaaauucuagucaggauucuagagaguuuguaguuaaauauuuugguuuuuaucauaaauacuaagagaaguuauugaaggauuguaauaaaagcaagggaaugacaugaucauuuuaaauuaaaaaaauuaaauaaucacuuugguugcaaugauuacuuacuggaugguaagaagcaggaggauaacaaguuaagaggggcugggucacagaggauauauuggcuuagaucgcaguggugauaguggagaaugagauaaauuaguggagaaaagugguugagucaagagguguuaaacuauuaaguuucacagaaaauggugguugguuaaauauggggccaaaauagaaagaaaagugaguccaagauaaugucuagguuucugggugacauggccauggauuaguaagaaauacauacuauauuuaauuaaugcccuaauuuauagauaauagugguauuacaugaauuuaguauauuuucaugaggaaaccaauauguucccuucuauuaaguaguucauaaauaauccagaauuuucaaacacuguagauacacuuuauagaugauaaggauauaucaaauguguaguuugguguugauuaugguuauuuauaguaucuaugauuuugcaguacccaaaaccagaaguuguuauaauauacauguuguuauacgcuaauauacauaaaguaauauacguaaguauacuuuguguacauaauagaucucaauaauuaaaaacuuuuuuuuuuaaaacugacauuuguuuuauauaauggcauuuauagaugggcuuugugaguuaaaaaaaaaaaaacccagcuuaugagcuguuuaucugaauagcuaauaaguuucacccuccagucagaacuuuguuagucugaauugaauacuugagggucagguauauguuuaccuuugauacuuuccucaaaggcauuggaguuauaaauaaggcugcaucuuaguucuacuaacuagcuguguggcauugugcuagacguaaucacucaaaccugugcgcuguccaguaccauagccacuaguuauauaugacuauugcacuuaaaauguggcuaguccaggcugcagugugcuuuagugaguuucucaaguucuucauguuaugauucguguuuuuuuuuugcuugauucaguuuuguuacaagaguagagauuucaaaucucacuauugcaauuuuaauuuucuugucaucuuucuuugucucaucccucuucuggaccuuuuuuuucuauccuguuuuuuauuuggggcuuucugcuccuguuugggcgacgucacauuguuuuaugcacuaauauuaaagucugcuggauguuccauuucccuuauaaauugcucaugguuauuuuucccacuucccuuuacucagacaugaauuauugugagguuuguuuguauuugacguuugucaacaacagacugguguagaugccuuugcugcauuuguuuuuuuuuuuuuuuuuuggguacauucugugguccaggcuggagugcaguggcacaauuacaguucacuauagucucaaacuccuaugcugaagugauccuccugucuuagccuucugaguagcugaaacuaugggcaugaguugggacuacaggugugaacaaccaugcuagguuaaguuuuaauuuuuguagagauagggucuuacuuguugcccaggcuggucucaaacuccuguguucaaguaauccuuuuaccuuggccucccaaaguguucggauuacagguguuagccacugcacccaaccgaaucuuauuuuuaucgauauggauacuuucaaauuggagcucaugccuaagauuggaaaguugguaaugcagaagcuaaguaucuucuagaaaucaguaguacaugguaaacauuaauugauuuuuuuuuuuaagugaaagcaaguuuauuagaggaggaaagaaacaaaggauuauaggcagagcagccaauuuauuuuuaacugggcaaauguuuuguuuacuauuguuugaaaauuauagaauauuuaacuuaugugggagguggaggugggaggauugauugauugaggccaggaguuugagacuagccugggcaacauagugagacccugucacugcacauacucgcacaugcacacagcugggcauggugguuggugccugccuguagucggaggcugaggugggaggaucacuugagcccaggaguucgaggguguaguuagcuaugauuguguccgugcauuccagccugagagacagaggcucugccucuuuaaaaaaaauuaacuucugguuugggcugacuccacauauuucuuggauaggaaaaucauauugcuacuuuuauuuucccuaguugugcaaauucugucagaaaaguuuauuuucacugcuauugaauuuuugcuagaacuuuauuccuguuaaaacaugguuguaaugaagucugcacuggaguuuuauuuucagauuggguauuaggauuugucauuaaaaaaaaaaucuccuucaaagggcauucuuuccaaugaucuguuuuugaauuuaauguaguccagaaggaaggcaucauuauauauuagaaagaacauuggacucaguguuaagagacaggggcuuuaguuucaccauuguccuugguuguugaaguauauuuagauaugcuauucaacuucucugugccucgauguucuuauuuaugaaaugagggaauugauugaaucuuuaaagauuuuuuucuagcucaugcauaugaaauacaaguaauuuuaugaaguagggaacugaagagugugcaguaauuuaguucauacaucucaaauauuacaaagauaaaauguauucuaaaggaauuagugucuuuuuuguauauaaaaauuaguuuaaaaucacuuuggaaaugacuaaaauuuauuuacauaauauuauuauuuacauaaugaaaucuauaccgauuuaaaaugugaaaaugaacgaaaugacuuuuauacauucuuguuucuuguuaguuuuaaaguauaguuuauugagcauuugauaugccagccugaauguaguggguauauuuacaaaauuguuuucaggugucauuucuugagcccaguuaucaauuacacgucuucaccuguuaccugagacuuuaggauagauucuguggaauacaguccuugacugaggccucagacccuuugaaggcucuuacuacuccuguggcacaauuuucuuugauuuaaggcuauaauuuccuuuuuuaaaaaaauuuauuuuaauuuuuuaacaaaacacaccucucaugggaaggacuauaauuuccuaaccuuaauauugagagauuccacugaaaguguucucuccuguucuccauaucuuaagaacaacuuuugggacaaguuauacaaauaguuuuuuuaaaaaaagaggaaauuaaguaaucuggagauuacaaagaacacagguguuguuuuuccuuuugacuuuuuaaaaaaauauuuauauaaucaaccuguuauguagcucucuuggccuccccuuagugauguugauauuaccauuaaaaaauauuagucacaaucauuuguucagcaaguguuuugaguguuuauuauguaccaggcauuuugcuaaauauuggagauuauuaaugaauguuacagaagauuaauuuugacuauugaaaaauucagaucuuagacucacgucuugauauuuuucuuaaagcauauuauuauguuuggagccagauuccaggggucuuagagauaacuuuccaccuaugggagguucugguacaggcauuuaggucauuggcauuuuuuaagaguucagauaaguuauucuaucucuccccauuuuuguuuucuuuuucuaagauguauuuaagauaauuaauuuauguuuuuuuuuuuuuugagacggagucuugcucugucgcccaggcuggagugcaguggcgcgaucucggcucacugcaagcuccgccuccuggguucacgccauucuccugccucagccgcccgaguagcugguacuacaggcgcccgccaccacgcccggcuauuuuuuguauuuuuuguagagacgggguuucaccgcguuagccaggauggucucgaucuccugaccucgugauccgcccgccucggccucccaaagugcugggauuacaggcgugagcccacugcgcccggcccuaauuuauguauuucuaauauacggucuggguuaucugguauaaggaagauggaugcugcggucaagaauaggucgaggcagacauccgguccagcaugacucaagugaguuuggagugcaggcauacagcuccgcuuauuauguaaccaugucaugugaggcgcauuaggugaucacccaugugagugugugcuuggcuuggagccacuauggucugugaaaggucuaauuacccugcuaacgugguacaaaaggcucgcgccaaggcucgcucacgcccagagaguaaagccauguugaaacuaugauuccucuaguguuuuuccaacuaccugccacucacccaccaacucuccucagaccucaguuacagccugacaucuggaaaaaagagacaaauauuuugaagcguuuugguaaggaaucaggcucuggcaucugaaaagaauuccuaacauugugugaaguugagaucugguaccuuuguauguacaguuggcccucuguauccauagguuccacauguguggauucaaccaacugcagguugaaaauauucagaaaaaguuaaagaugauugugucuguacugaacauguacagacuauuuuuucuugucauuauuuccugaacaauacaguauaaucacuauuuacauugcauuuacauuauauuagguauuauaaguaagcuagaguuaauuuuaaguacaggagagguuguacauggguuauaugcaaauacuacaguauuuuauauaagagacuuaagcauuuguggauuuugguuuccaagggagguccuggaaccaauuccucauggauaucaaggaacaacuguguuuauauuuagccauauauacaugaacauauuuacauauggcuauauaugguuauaucuguauguuuauaauguuauacaugcauacaugacuuuuuuccaauuaguuggcagucagguggcaucugauacaaaguuuguauguguuugguguguaucuguuaaauauaauaaaugaggauuauuuucuauuaauuuguguugucauuaauaaauauguuuucaugaccuagauuuuuuucucucuacauaaaaagauugguaacacgcugaguaaggugaacauugagccucuggcucuucuucagugccguugguguaaauguaaauuaauagaauuuucauaaagagcaauuuauuuauaucaacuaacuuauagugcauauucuuugauucagcaauccuucuagggauuuauccuugggaaauuuucacaaagaaguguucaaaucacuucuuucacaaauccgugugaaacugaaguuucacaaaucagugcacaaagaaguguucaagaauguccccugaagcuauaacaugacauauuguaagugaccuagaugucugucagcaggguauuaguuaaauaaaugauauaucccaucccaauauauacaaaggguuucuuuguuuuuuuguguucguuuuguuucuggugcugugaaucuuucugguuacucccaaaagcaccacacuauuuuaauuucauaguuuuauaauaguaugcuuucauaucugguagguuaaguuuaauguaucauucuuauuuuaaaaguuauuggcucaugccuguaaucccagcacuuugggaggccgaggcggguggaucacgaggucaggugauugagaccauccuggcuaacacgcugaaaccccaucucuacuaaaaauacaaaaaaaauuagccaggcgugguggugggcaccuguagucccagcuacucgggaggcugagguaggagaauagugugaaccugggaggcagagcuugcagugagccgagaucgcgccaccguacuccagccugggcgacggagugagacuccaucucaaauaacaaaauaaauaaauaaauaaauaaaaaaguuauaaguguacaugaaaagucuuaguggauaauauuacugaaugucaguguaacuacuaguuagcuuugucaaauccuaacauuuucuuauuuuggcuggauuacccuucuugagguaaauuccuauacugaguuggacauugucauugucagugcaugguuuuauauuuccauaacguguauuuguugauauaaauuauauacaguuuuucauguuuuuaaacauuauuuaucauucugcaaguuguuuuccccuucauguuaucuuuacaauuucacuuuugggcucugguucaauuauauaauuauauuaucugccuauucagugauuaaaccucaaguuauuuguguauuucccuguugauagauuuuuaguuuuuaguuuuuuuuguuguuguugcaaaaacauucuguacauauguucuugggcacauguguuuuucuccaagguaaaaacuuagaacuauaguuacuggguuguaggguauguguaucauugacucuaaauuuuuuuguuuacagccccugaagugguuauuauaccaguuuauacuuccaccugcaucuuaacaaaccaugauauuguuagaguuuaaaacucuuuuccaaccugcugucaauuuguuuguacuucccugauuacuagaggugaaacacguauuuucaacauauuuauugacuauuugaguuucuuaaucuuugaguuacuuguucaguuuuuugccaguuuucuuuuggguuguugccuuuuucuuauuuauuuguagaaguuauuuguacauucuggaugaauucuguguuaauaugcauuacacauuuccuccugugaauaccuuauuuuuuaauuuugauuaugauguuuuuaguuuuacacaaguuugaaauuuuaauauauuuaaaauuguuaauguuuucauuuauggucucuacucugaaguaacaguuuccuguauuuucaguucugauaguuguaaaguuuuguuuuucacaccuagggauuuaaucuacuuguugauuuuuguguaugaugagguggggacugaauuuauauuuuuccguauggguaucuaguugucccugugugacuuauugaagagucuguuuuuuucucauggauuuguaaugucauuucugcaauauaaauuuucauauauucauagauuuguuuaugauuucacuugguucuuuuguauauuucuguuggaauaacgugccguuuuguuaaguauagccuuuagauauaucuugacaucagauagugugggcucuucuaccuugcucuucaaaauuuuuugcucuuaauucuaagcucuuucauaagcauuuauuuuuuuauucagguuaaguucauuuaacauagaauuaaucauuuuaaagugagcacuuaguaguauuuacaacauucacaugguuguguaacuaccaccucuaguucaaaagcauuuucauuacuccaaaaggaaacucuauacccauuaaaugguuacuuuccauucccuccucccugcuucccccuagccucugacaaccaucagucugcuguuucuauagauuuacaugcucuccauauuucacauaaauaguaucaugcaaucuaagaccuuuuuugucuggguucuuucacuuagcauaauguuuuugagguugauccacacuguaacagguaacagguauuagcacuucauuucuuuuuuauggcugaauaauaugccauuguuuguauauaugugauuuguuuauacauuaaucugcuguugggcauuuggguuguuucuaccuuuuggcuauugugaauaguguugcugugaacauuugugcgccuauauucguuuugaguaccuguuuucaguucucuugguuauauaccuagaaauggaauuacagggucguaugauaauucuaugcuuagcuuuuugaggaaccaccagacauuucuguagcagcugaaauguuuuguguuuccaccagcaauauagagguucuaauuucuuuauauucucucuaauauuuauucauuaaaaaaauuacauccauccuagugucuaugaagugguaucuaaugaugaauugaaugaaugaguaaugaugaauaggaaugaauaaucauguugaacacauuuucaggugcuugcagaccauuugcauuuuugaaggaacgucuauccaggcuuuguccaucuuuuaaauuggugguuauguccuuugcacaaaaguuuuuaauuuuggugaaguccgauuuaucuguuuucuuuuguugcuugugcuuugggugucauauccaagaaucaauugccaaauccagagucaugaagauuuaccccaguuuuuuccauaagauuuuuuaaaaaagaguuuaugguuuuaacucuuauuuagguuguugauucauguugaguuaauuuuuguguauggagugagauagagguccaaauuaauuauuuuguuaguggauaucuguuugucccagcaccauuuguugaagagacaaauuuuccccuauugaauaauauuggcacucuuacugaaaaucaguuggcuauagauguauggguggguuucuggacauucaguucuauuccauucaucuauaugugugcccuuaugccaguauacacuguguugcuuaauguagcuuuguaguaaguuuugaaauugagaaguguuccagguuuguuauucuuuuucaaaauugcuuuggcuauuuggagaccacugaccauuccuuaugaaucugaauauuggcuuuucaauuucugcaaaaaugacuguuggaauuuugauagagauuacauugaaucuguagauuguuuugguauuauuaucaucuuaauaauaguaaguccuccaaccaugaccacaggauaucuucccauuuuugaggucuucuuuaauuuuucagcaauguuuaugguuuucagcauacaaauguuuuaccuucuucauuaaauuuauuccuagguauuuugcucuuuuguaugguaucgcaaaugcaauuguucucuuaauuuucuuuuuugguuuuuaaauuucugguguguagaagcgcaacuaauuuuuuuuuauuauacuuuaaguuuuaggguacaugugcacaaugugcagguuaguuacauauguauacaugugccaugcuggugugcugcacccauuaacucgucauuuagcauuagguauaucuccuaaugcuauccuucccccucccccaaccccacaacaguccccagagugugguguuccccuuccuguguccauguguucucauuguucaauugccaucuaugagugagaacaugcgguguuugguuuuuugucuuugcgauaguuuacugagaaugaugauuuccaauuucauccaugucccuacaaaggacaugaacucaucauuuuuuauggcugcauaguauuccaugguguauaugugccacauuuucuuaauccagucuaucguuguuggacauuuggguugguuccaagucuuugcuauugugaauagugccgcaguaaacauaugugugcaugugucuuuauagcagcaugauuuauaguccuuuggguauauacccaguaaugggauggcugggucaaaugguauuucuaguucuagaucccugaggaaucgccacacugauuuccacaaugguugaacuaguuuacagucccaccaacaguguaaaaguauuccuauuucuccacauccuuuccagcaccuguuguuuccugacuuuuuaaugauugccauucuaacuggugugagaugguaucucauugugguuuugauuugcauuucucugauggccagugaugaugagcauuuuuucaugugucuuuuggcugcauaaaugucuucuuuugagaagugucuguucauauccuuugcccacuuuuugaugggguuguuuuuuucuuguaaauuuguuugaguucauuguagauucuggauauuagcccuuugucagaugaguagguugcgaaaauuuucucccauuuuguagguugcucguucacucugacgguaguuucuuuugcugugcagaagcucuuuaguuuaaugagaucccauuugucaauuuuggcuuuuguugccauugcuuuuuguguuuuagacaugaaguccuugcccaugccuauguccugaauguaaugccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuacccagcaccauuuauuaaauagggaauccuuuccccaugucuuguuuuucucagguuugucgaagaucagauaguuguagauaugcggcauuauuucugagggcucuguucuguuccauugaucuauaucucuguuuugguaccaguaccaugcugcuuugguuacuguagccuuguaguauaguuugaagucagguagcaugaugccgccagcuuuguucuuuuggcuuaggauugacuuggcgaugcgggcucuuuuuugguuccauaugaacuuuaaaguaguuuuuuccaauucugugaagaaagucauugguagcuugauggggauggcauugaaucuauaaauuaccuugggcaguauggccauuuucacaauauugauucuuccuacccaugagcauggaauguucuuccauuuguuuguauccucuuuuauuagcacaacuaauuuuuaguguugauguuaugcacuacaauuugcuaaauugacuuauuagcucuauuaaucauuuuaugaguucauugggauuuacuaucuguaggaucauggucaucugugaauugaauugauuuuacuucuuccuuuccaauuuggaugucuuuuauuucuuuuuccugccuaacugcucuugcuagaacuuccaguacaguuucaaauaguaguggugaaagugggcaucuuugucuuacuccuuaucuuaggggcaaagcuuucagucuuucaccauugagugugauguuagcugugacuuuuucauaaaugcccuuuaucauguugaggaaauucucuucuauuuuuaguaugagcauaaguccuuucacucuauuaaugugauauguuacauuaauugauugauuuucuuaugcugaaccauccuugcauuucugggauaaagucuaccugccuaugccuguaguucuuuuaauaugcuguuggauucaguuugcuaguauuuugaggauuuuugcaucacuauuuauaagggacauuagucuguaguuuucuuggaaugucuuuggcuagcuuugguaucaagauaauuacuggucucauaaaaugaauuaggaaaucauuccuccucuguuguuuuuagaagagcuugagaaugauugcuguuaauccuucuuuaaagauuuggcagaauucaccaguaaagcuaucugguucugggcuuuucuauuuugggugguuuuugcuucuugauucagucucuuuaccugauucagauucucuucuugagucaguuuuuauaguuuguuuucaagaauuuguccacuucauguagauuaucuaauuuuuuggugaauaauuguuuaucauauucuuuaaaaauuuuuuuuuuuuuuaagcguugggggucuguguugcccaggcuggagugcagugguuauucacaggugugaucauggugcacugcaaccuuguacuccuggccuuaaguuaucuuccugccucagucucuucaguagcugggacuacagaugcacacaucaaacaaaccaggccauaagauucucuuuuaaucuuauuuauuucuguaaggucagcugcagugucuccacuuuuauuugugauuuuaguuauuugcaucuucucuguuuuucuucuuugucaucuaaccagagguuugucaauuuuguugaucuugucaaagaaccaacuuuugguuucauuagauucucucuauuguuuuucuauucucuguuuuaucaccacuguaauuuuucauguuuuugucuguugugcagguuaugggcuugguuugcaccucuuuuucuaguucuuuaaguuguaaagauuauugauuuuagaucuuuuaaauguagguauuuacuacuauuaauuuuccucugaggauugcuuuugcugcaucccauaaguuuugguauguguuuuugucuucauuuaucuguauuuucuaauuucccaugugauuucuuugacauguugguuaagaguguguuguuuaauauccacauauuuaugauuuuucauuuuccuucuauuauuaauaucuaacuucauuucauuggggucagagaagauacuuuguaugauuuaauaucuuuaaauuuauugagacuuauuuuguggcucaaaauguggucuguccuggagaauauuucauaugcacuugagaagaaugucuguucugcuguuacuggguaggugcucugcauauguugguuagucuucucuuuccuuauugaucuuucuagauguucuagccauuauugaaaauggggguauugaaguuucuauuauuguuacuuugucuguuucucccuucauuucuggccaugauuucuuccuauauuuuggggguucuguuguuuaauguauauauuuauaguuuuuauaucuucuaaauugacuuccauaaguauuuuagaaucagguuaugaagauaccauccuuaugcuuucaaguuuugcuuuagugcuuccuguuggugguaccuaguagggaaccagcugacaaaagaaagauguaauuugcagagucuaagccccagcaucaugaagcauagacgacggaauuuggaauuauauagaagaguggauuuggaauugaaaauuuugguuuacuuacugaugcugucuggcugucugaauuuuagcguaugaacuuugauuaggucuugauaagcagucaguggaacagccuaugagggaccucuuccuuguagaauuagaauugaauagccagcagcucaccucagacaaaauggaugccuguugaaaugggccuuuucucaguagaucccugcagaauuuuaugacuugugcagucugagguuuugccccagguagaugagcaggagggcaucuuuccaguaguaacagagacaagcucucuucaccugugcuggaggauauaccaguucucaaaucagacaugugauagacuugccaagagaagaaccuauauaggugaguuccuugcuaaguuccaggucucuuccuagauuccugacagugccuucuaucugaauguguaguaguaauuauggucugguugacugccuuccugcauuccacccuauucucaucuacaccauauucagaguaacuuggaguguuaaucauauagguaggauccuucucuauuuuucacggauguugugauggaucaaaguuuuauguucuguauuguuugacuugccuuagcaagaauugaggggguggggugaugaguuaaaggcaugugcuuaaauuuuauucccagaauacuuuuccauuuguauuacaaauaauuacaggagaggaauccuggauacagacaguagacagcaacuguaacacaugcagaaaagguauuuauuggaaggauguuagacuguaacacaugcagaaaagguauuuauuggaagguuauuagguugcuucagaauugacauaaaagucugaagaacuagguuuaguaaauaggcauuaagugaagccagauacacagaaccacugucagugcugcugauuaaugagcauugguuauggcguugcuaccucuggauacuggaugugucugcuuccagagugauuucuuaaauugaguccuuguuucuuuacagguauauaguaccagccauagcaucucauugcuuacacauaggugauaggcaauacccuugcugcuagauguuaggaagauuaaguaucuugaauuuuucugacuucuguaggaagaggagggauucuguuaccauuauacuaauuaauuccugaauguuuuggcagcuuaagcaacauaaaggaaaccgaaaggaauccuacauuuuauuacagugacuuaaaauaaaauaaggggaugaaguuuuuauuugugcugugcuauuuagaaauguagauauaaauagacuuucuagacucuauccuuucagcacuuucuguucagggguuuaaaguagggguugguacuguucaccugagaggcagcuuggaaacauggggacauuuuuugguuguuagaaugauggggaugagggcacuauugcauuuaauuauaugugggcuggguaugcuaaacaucccauggugccuuggugguugugcacaauaaauaauugaauuauccuccucauaaugccaguagugcauuuaagaaaaaccagguuauauggcuaucuuggugaaggacuaaaaguuauuacuagcuuccuuugcuucacugucugcacccucuggcugaggauuauuucucauuucguugcuuugcuguuuucuuuccuuaguucaagggacuugauuccuuucaagcuccaaaaauguuauuuuuaaacucuggcuuuggcucggcucaguggcucaucccugucucuagagucccuguuucuagagacccugucucuagaaaaaaauaaaaaaauuagccagaugugguggcacacaccuauauuuccacguaaucgggaggaucauugaagcaggaggcuguagggagcuaugauugugccacuguacucccaccugagugauagagugagacccuaucucuaaaaagaaaacaaacaaacaaaaacugugaaaaggugcccgguagcaugggagaaaauauuugcaaaucauguaucugauaaggcauuaauauccagaauauauaaagaacuccuacaacucaacaacaacaacaaaaaaccugguuuaaaaaugggcaaaggacuugaaaagauauuuuuccaaagaagauguauaaauagccaauaaacacaugaaaagaugcucaacaccacuaaucauuagggaaauauaaagcaaaaccacaauaagauaacccuucacaucuauuaggauggcuguuguaaaaaaaaaaaaaaaaaaacaaaguaacagguguuggaguggauauggaaaaauuggaaaccuugugcauugcugaggggaauguaaaaugguguagcugcuguagaaaacaguaugguguguuccuuucagcagucuuuguguagccaguaguugugauucuaauaaaaguagcaguugguuugggacugauagugauuguuaugauuucaauuggguggugcugacaguaugugguucuugguaucugugaggauaaaccgcauaagcuaucucauuucuaucuuacaugagugguguggaucauuccguaucaguagguucacuaaugcaaauaaaguacauuuaaaacaauguaaaagguaguaguaaaugcaaaaguauggagguaaagguguaccauuaguuuuugggcuucaaggcuuggaacucaggguuggcagcugucuuacuuaguuugcuugagcugccuuaacaaaguaccauggacuggcugguuuaagcaacaaacauuauuucccacaguucuggaggcugagaagugaugaagaugcuggcugauucaguuccuggagaaagcccucuuccaggccuguagacugccacuuucucuguguguccucucauggucuuuucuccaugugugcuugugaagaaagagacagcagcucucuuucucuuccuuuccuuauagggccccacccucacuacuuaaucuaauccugaguaccucccaaggccccccaccccccgccgucaucuccaaauacccccucccccuaucaucuccaaauacuaucacuuugggaauuagggguucaacauaugaauuuuggggggacacaaacauuuacucuauaauugaaucagucugagagauaauaucuuaguaacaaaccagguaaaucuaggcugaccacagaaacaaguugucaguuuggagaggccggacagaaaggaaagaugugagccaauaagacaaauuagagacacuugaagagagggaagguucaaagccugaaaaugggauggcagagauuugagaaauuaucuauaauaacaaggagugauggcuauaacaauuuuguuuugggguucuuacuaccuuagauauauguaggcaggggagacaugguaaagaugcuguauuaggcuguucuugcauugcuauaaagaaauacccgagacuggguaauuuauaggaaaagagguuuaauuggcucacaguucugcaggcuauacaggaaguaugaugccaacaucugcuucugaagaggccccaggaagcucauaauuguggcagaaagugaagggcggggggaguguaggcaucucacacaguaggagcaagagcgagagagugagugggagaugucacaaaccaggucucaugagagcucacuauugugaggacagcaccaagccaugagggauccaucucaugacccaaacaccugccaacaagccccaccuccccaacacuggggauuacaauucaacaugagauuuaguggggucauauauuaaacuguaucagaugccuguaguacuaauaacagcuuggggccaaggucugcacaaagacugaaugggugauguuuuacuccacaagaaaagaaugaauaguguaccaaaaccuuuuuaaaaauaauauuuacaauaaauuauuuucaugucuucacagauaacccauaaugacuuuuugcuuuguacugauggugauuucugauaucaacauccugguguaucagugcuguuucugaccucuuucugaugguagcuuuugaugaaaauauacaaauuuuugguaaaggaucuuuauggugaucagaaauccacuucaacuuuuauccuuuauacuucaaaaugucaaugagaaugacuacuuaaaauaccaaaucccaucuaaaacaaccccccaaaaucucauaaaauauugaagcuaaaagaaagaacgaguuacuaugugcaugauaguuucuucuuuuuccuuuggguuuuauaccuucuucaguuucugauuuguuacagcagcaguccccaaucuuuuugggaccagggacugguuucauagaagauaauuuuuccauggacaguggguggggugggggaugauggcuucagggugaaacuguuccacuucagaucaccauaaggagugugcaaccuagaucccucacaugagcaguucaagguaggguuugcgcugcuaugggauucuaaugccaucgcugaucugacaguuauguggaaugcaagugguaaugcuugcuugcacagcucaccuccugcuugccagccgaguuccuaacaggcccuggacugguacugaucuguggccuggggguuggggaucacugcauuacaggaaggccaggccuuauuuuauuuagaaccuguauacugggguagugauuuuuaguauuuuuuucauuauguguuuuaaaacuacaacaaagcaauuuaaaggucuuauaagguuuauaccuuuuuuuucuuuuuuuuuugugugugucugauugcacugcuagaaccuguaauagauuuuugaguagcuuuuuguucuugaucuuaauggggaagcuuucagucuuucacccuugaguaugauggcugcuuuagguuuuuaauaggugcccuguaucagauuaggaaauacccuugcauuccuaguucgcugagaauuuucaucaggaauggauauuggauuuggucaaauacuuuuucugcaucucuugaugaucaugaggucauucuuuuuaagucuuuuaauguagcaaguuguuacauuaguugaguuuugaauguuagacacccuuugguaauuauucuguaaucuuaaaaguaguuuucuguguuuaugagggauauuaguuuguuuguuuauuuauuuauuauauuugucugauucugguaucagaguaauguuggccccaugaaaugaguugguuuuccauuuucaguguccugaaagaguuuccauagaacugguauugauuuuuaccuaaaugcuugauagaauucgucagugaaauaaucugaacuggaguuuucuuuguggagagguuuuaacuauacauucaguuucuuuaauagauacaggcuguuaagguaaucuaguuccugaguucacuugaguaguuuuuuuuuuuuaaacaaggaauguaaauuauugaauuguugacauaaaguugcuaauaauaguuucuuacugucauuugaguauuuguaggauuguaauuauaucaguucucucauugcugauauugguaguuugugguuucucuuuuuucccuucucgucauuauuagaaauuuaucaauuuuauugaucucaaauaacuagcuuuuggauguauugguuuuucucuguucuuuuguuuuauauuuuauuucuuguuuugcuuuuaucuuuauuauuuucuuucuucuucuaacuuuggguuuaauuuucucuuuuuuccauuuucuuaaguuagaagcugagguucuugauauaagaucuuuuuucccccuaauauagauugguuaaugcuauaauucucucuuuaacuuuucuuuuuuuuucuucauauuggcauuuagugcuaugaauuucagucuaagaaguacuuuagcuuuaucuacaguuugauguuuccauuuucuuucgguucagggcacuuucaaauuucacuuuuuaaaaaacgccuuuauugagguauuauucacauaccauaccauccacccauuuaaaguauacaauucagugguuuauucagaguuugguauguuuaguauauucacaauuaucugcaaugaucaccagucaucuaguuuuacuuuugauuucuucuuggaccugugauuauugagaaguguuuuauugaguuuauaaauauuuggagacuauccagauaccuuuauguuaccugguuucuacucuaaucccauuguagcaaaaaacauacuuuauauggucugaauacuuuuaauuucauugaaacuuguuuuaugaccuagaaaauggucuguauugguacauguuccguuugcauuuaaacagaauguauauuuuguuauaguguucuguaaaugucaauuaggucaaguugguugaugguguuguucaagucuuuuauguccuuauugauuuuccuucuauuuugaucaguuauugagugaaggauguugaaauuaccuauaacauugugaauuuguuuacuucuuucauuucuaucaguuuuugcuucagguauuuugaaauuuuguuauuaggugugugacguuuaucauuguuacauucucuugacauauugaccucauuaauacaaagugacccuuuuuauaccugcucuaaaaguuacuguuagauuuaauauagcuguucucacuuaaacuuuauugaguuacuuuacacacuguaaaauuuacccauguuaacuguacaguuaggugggagcuaugccuccuguacauaggaugaugauuuccaaaucuguguuuucagacuuugacaucugaaccuacgagcuuuguugacuucuuaaacuuaacaggucuaaaaucauacacauucaucucuuucucacuccuucccuuuaucccaaaucacccuuucuuucuuuguucuugguucaguuaauggcacccguuucuauccagucaguauugugaaaaaucuauuauuguuaauuaauuccuuuuccuucucauguuuaaucacuugccuaaauuucuagcuuucuaaggucucuuauauugguccuucuucucuguaucuacuuuaaauacauuuuauuaggcccuugucauuuuuugccugggaggacugcugugacuuccugacuccuuuuccuacuuccagccuuauauccccucccuuucuacucccaccuugccucaagucaauccugaggaggcauucuuuccaagauuuaaguacaaucaugccauuuucaaguugaaguucuuuagugccuugcauuuuuccccaggcugcauuguuagcucaauuaaugauugagcuuuugucuucucuagcuuccuugcuauaguauauuguguuacuucuucugugucuuuguacacucugcuaucuucgucuagaaugcccuuauuacuugaucugcauggcaaacucuuauucuuuuaauuuuuauuugaagaucauguaugucuuucucuguuucccuauguaaaucugcuuucaagucauauacuuguaugguuaacaaguaacuauucuuuucuauguauaucuuaccuuuucuauagcuguccgugguauuuauuuucucuuucacacauuuugugcuuacuuuguuuauguauucauuagauugugaacuccugugggcaaaucaugugccuuauuuuucucuguauaccuugccuuucacauuucguaaauuuuacugaguuaagcugaaauuacuugaaugacagauaaccauugauuuaaucugaaauuaccauaaacgcaaacugaaauccuuugaaaacccuaguuagaauaaucuauaacugcuuucuacagaaacaaaaucuuuuaauagccagauaggugaccuauaccuaacuagagacaguaaguuuguguugaugguccauggcugcauuauuaaagugggagugcuaaagcacuuaguauuuuguaggugccacaugaccaaaguaauuggauuugguauaaaagcuugagguucuguggauuucucagugcuuagccuuaaaucuuuuuuagccucuuucauguggccaaccaauucauauugagaaacaguugggcuucuucauuaacguguuauuuuaggaaagggauuacuguuaaggaguggugaucccaaaugugauacaauuugucuuguuuggccuuuaacuacagucaguacacuggaaacuaugugauucuuaagaugauaauguucagaaacuuuuggucauuuguaagacaguauuauucugugcugguagaguauguucauuugcuguugaaaaucaucuuagaccagauuuguaaacaucucccuuauaauaacaccauuuuaauuaaccucuugguuauuuccagguuuaaggagaucuuuuuauuaccuugaagguguggcauuucuuuuaggaaggucuuaaauuccuucaggcacuugccacuaaaggaguguagaaugcuguuguuucauuauuuucuguaucaguugcugacuauccuauagucauuucccaaaaucauucuuggccuauauugugcacaaguaacuauuuauauaacugcuucaacuauuuuuuuuuuuguguguguguguguuuuccuggauucucugaaauuucuuuugaauauuauuaaaauauaggauguuugagaaggcuauuuaauaucuaacuuugucauaaaaaaacuuuuaguauuggccauuguuacuuaucuuuuaaaagguagcauuacauuguugauucauuuagcauuuuuuuuuagucauuaaauggagcaauggggaguuauucuuggaauuuggcgaugagagucaauguaaaauucauuuaugauuguuaacaauaguuaucugccaaagucuuuaaagggcucucauauucuuagaccuuauucggaagaagauggucuagaaaucuuagcaagguaguaauggaugugaaugaaagcugauauaaauagugguauuaucauagaagaaauaauguaucaauggaaguuugaauguguggagucuagugaugggacccaauagauagggagggaaggaaauuauguuuacugaguaccugcugucugcucguaguuuccuucccuugcugagcucuuauuuauuuguugauucuuuugaguuuucuauguagaacuccuauugccugugacaaaagacaguggguuuccuuuuuuuuuuuuugagauggagucuugcccugucgcccaggcuggagugcaguggcgcagucuuggcucacugcaagcucugccucccggguucacgccauucuccugccucagccuccugaguagcugggacuacaggcacccgccaccaugccuggcuaauuuuuuuguauuuucaguagagacgggguuucaccguauuagccaggauggucucaaucuccugaccucgugauccgcccgccucggccucccaaagugcugggauuacaggggugagccacugcgccuggccuucauuuucucuuuuuauguugcuggcuaggacuucuaguacaaucaaauugaagccgugauagugagcauccuuacuuguuucccucacuuugagagagaauuacuuuuguaguuuaucaagaaugugauuugcuguaguuuuuggagauaucuuuuauuagguugaagaaguucucuuuuucuccauucacuuucuucuucuguuucuacugaaugaguguaagagcagaagugaccaaaaggcuggaacacuguacuuuugaggguacauugaagaugauaaagccaaugaucagaggccuguugguaaagcagguuugaggaagagggagcuucaaaggaaggaucaauuuuuaacagugguggauagaagagugauguaaaguguaggaaguggaaacagcaaguguaguacuguuugaaaaaguaaagugaaggaaggagaacaccaaugaagguugaaguggaggcaguuuugaggggaguuuuuauuuauuuuuuaaggacgggugaaacuucauauuuguaaguaaagguuaaagcuccaguagagaaggaaagagugaauauaaaggaaaauuucugccaaccaaaauuccagcguaauuuuauguaucccuauguaaauuagaaucauccagaaugcuuccaaacaugauucaagagccacagcggcuuaagcaagauagaaguuaauuucuguucacacguaugaauucugcaggacaguuucaauaagagaggcugagaaauagaguuuuuauuuagcaggaucaugggucuagccaaaacuugagggcucuaggacuaaggaggaagaaagaaaagauuuugggagacaguuuucaguaucugcacaguaagugugagaaaacucuuaaauaaaauuuaucucucucaguauuugcauaguguuuaagaagucaaaaugcauuuguuuauaucuagacucuacuuacuagcuccuugacccugaacaaacuauuuuucucuuugugccuuaauuuuuucauaacaagguagagaauaaugguguuugauagagaguaccucauaaguugguaugauaauuaaauaagauaauauauguaauugaugaagccauugccuuguacaucuaagccacaauuacuaguuuuguugucauuugcccuugcucuucaaggaucagggauguguugaaggacaaaacacaaaaaaacaaaauaauauaacaaaaacaacaaacaaaaccuuauauuacuuaugggauauccaaaaguuaauuaaauauuacacauuaagauacaauugaaaagaguaacuucaaaucucaugagaacuuguagauauaaaacuagauuuuuuuggaaaccuuggaagguacucagccaaacugcaaaguuugaggacacaguucuucacaugaccacucucacaucuggcaccacuugcaaauucagagggcuccccagaccacccucuggcuugauaauuugcaaggacucacaaagggauuacagauuacagggauccagauuaaaaucagccaagggaagaaacacauagggugaagucaggaaaguuccaaauguugaucugccaguguccuuuucccauggagucaggacauguucuuccagcaccaaugugugacaguaugcaugauugccaaccugguaaccucauccaagcuucaguguauagaguuuuauggggcuucauuauguaggcaucauugauugauuacucaauuaccuguaugguugaacucagucucccaauggacugauacuguguaacccagagccuuguccuaagccauauuguugguguuuaugacauggccagcuuuugcuuuaaaacuauuaguuguggccaacccuaccugaagaucugguauggccagcacccauaauaaacaagcacacuucuaucaacuaugacacauuaccucccagaagcugaagucaauggugagacuucucuuuggacaaggccaaauucuuuacuacacaggaagauacaagacacugaugaaaaggaaugaucuuuacaaaugaaagucuaacauaauuaucuguugaaaauaccaaaguuaaaaacaaucuuaaaaauauguauauaagagaaagaucauccaagugaaaauaaaacccccagcuggaguaauuuaaaaaucuagaaauuuggcugccaaagcaaaauuugaggaaccauuugcauggagaucaaaaugaaaauaaaauuuugagucauauagagaagaaaacuagcaagaaaguucauagugcuacuaaauaauuauugugaaaacucaaggaaaagaaauaaagcacauuauuugcuuuggcaguuguaaagauugcugcauuaacuuguaauuuggaacagagagguuagaaggauugaaauuauugacuuacauguguauagaacauuacuuuuuacuugauuccaagguaaguacaaggaaguacuuagcaaaaaaggguuauagugcuuuuaaagugguauagucaggguaguguauguuuuccuaucucuguuaaugaagguacuaaucauagagguuuuuuuuuuuuuuagugauuguuccagguuguagugugaggcaugggcagagauggaacuaaaaucuuugucuccugacuuuuggguuaaguauacuuuuuuucuaacugcaaaaugauuccucuuggaacccaguuaauaggaggucugacugaauuuccuggaacucuggaguuucucuuaggaccagucugguuagucuuuucuugcccucuaguugauauugguucuucugaaauaguuuacucacuaaacucuuaagcaaauagugcuuguugaggaacaaauaaaaauaaaucuauagauuauuuagauuuucaaaauguguuugaauaaggcucuucacaauauugcaacaacauagguucugaugagcaaaguuugacugcuguaacaauaacaagugggauaagaugauuggagcuuuccuuuagagcaaacauuuagagggcucaauuuuuuauuuuuaaaaauaauuauaaaaauuauuauacauguugcuaucaaauguacuuugcaccuguggaggaacaacugaugcuaacacgaaguuaauagcaauaguaagugaaaauggaaaacuguuacauggcaguguuauuaaggggucucaccauaacaccuugucauuaauuuuaauauggauuuuaauauuuaauaugcauuuguauugccuacccuguagucagagccgcuguuuauaacccccuuuuuuuuuuuuuuuuuuuuuggagacguaguuucgcuuuuguuggcccaggcuggagugcaaugucacgaucucagcuuagugaaaccuccgccucccagguucaagcaauucuccugccucagccuccugaguagcugggauuacaggcaccuaccaccaugcccagcuaauuuuuguauguuuaguagagacgggguuucaccauguuggccaggcuggucucgaacuccugaccucacgugauccacccgccuuagccucccaaagugcugggauuacaggugugagccaccacacccggccuuacaacucuuuugacuguuuguagccucaugaugguauauagacuuuguauaucauauuuacuucagauggggucuuagaaucuguauuugcauuuuaguauuuuuaaacaccuauuauaugccagguaguguccuaggcauugagggauauguuggaacaaaaaucagauagggucucugaacuuaauggaguuaauagucaucaggagagacaggcauuacucaaagaaucacaugugguuaaguacuaugaaggaaagauacauggugccaucagacuguauauuagggagauuugucuaaucuaggagaaguuaugauugaucagugacuugaagguaaagaagaaauuguaagaguguuuuaagcgaggaaaccucaugcauauggggcuauugaugggaaagaaaaugguguguaaaagaacugaaagaagguggcugggcacgguggcucaugccuguaaucccagcacuuugggagccugagguggguggauugccugagcucaggaguucaugaccagccugggcaacauggugaaaccccguuucuacuaaaauacaaaaaauuagccaggcgugguggcgugugccuguagucccagcuuguugggaggcugaagcaggagacucuguugaaucugggaggcagagguugcagugagccgagaucgugccacugcacuacagccugggugacagagggagacucuauuucaaaaaaaaaaaaaagaacugaaagaagguguguggcuguagaacagagagcuagaggaguauguaugagaugaagcuugagagauagauagaagcuacauuauacagaauuucuuaauaggccauaauauaauagaauuccuuaggauaagggaagccaugaaguguuuuaagugagagugaggcauagucugaauaauuucagaaagcacauugggucuauaguauggauggagaauagcuuguggguggguuggagagugguuggagagugaaugugugaagacuauuggaagcguauuacaguaguuuaggugaggcaugaugguagccuccuuauugugguuccaucgcaugcuaaaaagaguaugcagaaaaggaggacuaugacuaaguaaguucaagaaguguuguguuaggcaacucuauugcagaacuucucagggcuuuuaaaaugcccaugugcguggugaagcucugugaggggauaugggauguuuuguggcauauaugucuugccccccacaggguggacucuagaaaaugguguguaauaccuguucguggaagcucacugguaggugaagaugcuuucugagugauaacauaugagcuauugcaaacauggucggggauuccacaugccauuuagcaauaacuuggggauaaugugguacguggagauagaaauggaaagcuuguuuuccuggggcaaucuccccauuugucaucaggacagaaaauuacccuugaaagagccagucuuccccauuugauguugcucuucuuuggggcccauuuccagguccucuguuuuucugaaucugugugccugcuugcacagugagugggugaguuggggaaauucucagcuggaaaugucagaauacccauugauaguuacuccauagaaucugaaaucuggggacaauugagggccguggugguaacucaugauagcaagcacuuucccucuuucucuucuguccugaaccauguuggccacuugaccucaggcuuauagucucuugauugcaagauggcucucuuagcuuuaggcuucacaaauacauuugaagacaggaauaggugguuggguggguuuagacuuagcagguaaauguccuuuucucaacuggcucuguccauuuguuaauccguaaaggaaaauuccugguaguucccuuuuuucucucugguugaaauaggguuuuauggcuacccuuagcugcaaggacagcugggaaagacuugauuaacauagauggauuaugaucuguucucugggguuaguaguaccguguuuuucuguugguaaaauguggggcugggauuggaagacucuuggguguuucugccuuggauaucuuauauaagacuucagucagcaccuaugugcugaugaugcccuugucugccugagucgccugaacagaucagcccucaugucaguuucucaugguuucauucagggaccaaccuuaguucccugcccuguuccucccacaucaauccagucugucuguagggcccguggauucuuccucccugcugaaugaccuuuuguguuacugaccgucuagccuacuucaccucccucucccuuucucucucuuguuucucuuaucagcaccuuuucagugcuaauaacucuuuuuuuuucuccaguguuuaacauuuuauuguuaauacuagauaauauuagauugugaauuuuucuuuuggcauacagguuuaugauuuaacacgugcuauucauguaacuaccaucauaauuauauauguaacaauucuaucauuaaaaaaaaaacucccuuguguuauuccuuuauaguuagcccaucccucauccauaacuccuggcuaccacuaaucuauucaccaucccucuuuuuugucuuuuuugagaaugucauauaaauggaaucauauaguauauaaccuuuugaaauuggcuucuuucacucggauaagaaugccuuugagauccauucaagaaguguguauaaacaauucacuccuuuuuauugcuaaguaguagucuguaguguggauauaccacaguuuuguuuaacuguuuauuuuuggaggauaucuugauuguuuucaguuuuugccuauuaugggcuauaaacauuuguguauaguccuuuguccuccauuuuuuuucauuauggcaaaauacaauuaacauaaaauuuaccaucuuaaccauuuuaauguguacaauucaguagcauuaaauacauucauauuguuguacaaccaucaccaucauccauuuccagaacucuuuucaucuugcaaaccugaaacucugucuguacccauuaaacaauaacuucucauuaucccaucucuaguuccuggcuaccaccauucuacuuuuugucucuaggguuuugccuucuuuaaguaccuucuacaaguggaaucauacaguauuugucuuuuugugaccagcuuguauaaagguuuuuuuuuuuuuuucagugaucauaagucuuuauuucucugagauaaaugccgagaagugcauuugcaggauucuaugauaguuacaucuuuaguguuuuaaaaaaacacaaacuuuuccaaaguggaaaaauuuacaccauuuuacauucucacuagcaauguuauaaguucagccaucugcagagcuugaauuaaauuucuggagagaugaccuauugacucuuggguuagguguuuacccuuagaguagucaucguugguugacugauuuggaaaagaguguuuuacaguaaguaccacucuuguauucauuccuguggauugggguggauauagagggaauauugaacucucuuucacaaaaguagggcuggguggaaaacgguguagguguccauugcaguagugguuuccaaaucuguguguacaccagaaucaucugaggagcucuucaugauacagauucauggguuucauauagaccuacuaaauuggaaucuguuuuuaacaagaguucaagagaguuuuaaguagucaugcccacaucuguugggaauguuacauuauaguaucuaugcacuuuugaaaacuuaaagguuuuagaagcauaugcuguacuauauaaaugaaaaacuuccuguucucuuaucuuuuccucuuauuuuuuucuuuggccuuauguuuauauuuuugucucuucucuguuacuuauucuauuuuuguuuucucuccuccauuuaguuuucacuggugucuguuuuuugcaagugucuauggauaaguuacuguuaucuuugcucuuagucuggaaauuguauaaagagauuauaaacagaguuugaucuuaggcauccaggguuccuuuucuuucucauuccagaucugaaugugucucacugauaauucuuuccuuuuaauggcaaaaguagaaaacaaguuccuggguuuaauggagaaaccuuuauguuuuauauuuaaagguugacauucuuaaguaggcucacuguuacguuuuauuuccuucuuuucucacagggaagaggaagaacgucugagaaauaaaauucgagcugaucaugagaaggccuuggaagaagcaaaagaaaaauuaagaaagucaagagaggaaauucgagcagaaauucagacagagaaaaauaagguaguccaagaaaugaagauaaaagagaacaagccacugccaccagucccuauucccaaccuuguaggaauacgugguggagacccagaagauaaugacauaagagagaaaagggaaaaaauuaaagagguaauaagcugaguuuugugauauggaguguuuauggauuuguauuuggauacaaacaaauauauauaaucuaugguauccuguuuugaucuguuuauucuugggucauaguuguaguauaguuuccagguugguaauaaggacuagaacucuuucuuguuuuuuuuuuuaauguuaauuauaauguaauuauuggacacuuaaaauauuuuugauacaacuuuuggaugguuagugccacucauucuuuguucagagaucuuuugaaauucagcguuuuauuaauaauauaucuguauauaacuuauugucuaagcaguuucuuaaauguucaguuacaaagggacucugcuagauacuaugcagaucaccucauaaacaugcuucuaaagagcuagcauuauaucuccaauuuuuuaaggaacaugucaugguaucccucaacuauacuguagauuaagaacacauuccuuccaaaaagucuccauggauugaaaaaugggaaagaauugauuucaaaauucuuuaaauuuauuuagccucagaagucuuucaauuuguuauucuguaguuacuuaaaaguaaagagaauaccagaugggaaaaaucuagugaauauuuggguuaaacuuuguuaauuagaacuccuaaaaauucuggguggaguuugugauuauacugccugugaagaaaaauauuuuaucagaguguaauuguaccaacaauauuucagaagguuuaauuauuauaaaguaagauaaauuuaguucaaguaaucaaauaucuauuuggauauauucuaguaauggauauggaagguauagcagauacuuuaagcuuagccuuaugaauuauuauaaaaccuugaccuugauggaguagaaauagagcugugcucugauuuuaccucaccucuagagucuguuuuauauguagacuacuuaaggcacuuccuucggacaguguugggagagacagugauagauuuuuuuucagaugccugacuugcuuuuuuucagaugucauuacaauguacugaaauacuuuuuucaaauacguaauaauucagauagauaaccauguguguucaggggacccccagaugauccucagguucagugacucaccagaaguacccacggaacucagcauauagaaacauguuuuaguuugcugaacuuuuauccuguuauuuuacugaaguuauuuauucuuauagcuuuuuuguagauugcuugugauuuuucuuauacguagucaugucuucugugaagagauacuuuuacuuuuuccuucuugauuuuuauaccuuuuauauuuuuuuucuugucguacugcaguggcuaggaguucuaauacauuguucaaaguaaguggcgagaauggacauacuagguuuguucccaacuuuagggguuaagcauccagucuuuugccauuaacuauguugugucaacuguagguuuuuuaaagaugcuguuuauuagguugaggaugucuccuuguaauuguaguuuacugagaguuuuaucaugaaugaguguugaauuuugucagaugcauugucuucauuuuucucuagaugacuguaugauuuuuuuuccuuuauucuguuaacaugguaaauuacauuguuuuuuggauguuaaauuagucuuauauuccuggguuaaacuccacuuugucgugguaugguaucugucuuagauguugcuaauuuuucuuaaggaauuuugcaucuguguucuugagauacauuggucuugaguuuucuuguaauaucuuugcuugauuuuggugucugauuaaugcuggcugcauaaagcaaguugggaaauguuuaaugaauaguaugcuguuaaaugaauagauuuuuggucuacuauuauauaauucgucugauauauaauuaaauacucugcuauuguauaacucagaacuccuuggguuguaagacacucagcucaaacuaagugauacaaauaguauuuauugguuuaauggcucuaaacaagggcuucaaguuuggcugaauccaagccuguagauauuauugugaguguuaagcaucugucucucuuuccuuuugcuaguuucuccaugcuggcagagagccauuaucagcuccaggauuauauauuacauagaccaucagauugcagaauaaaaaagcccucuaucucauggugucaauaacaauauguguaaaaagaacuugauuguuccuaccugaaucacauguauccacucacuuuguuuagggcagggguugacagcugcaaccugugggccaaauucugcuugcugucuguuuuuuaaaaauaaauuuuaggcugggcaugguggcucacaccuguaaucccagcacuuugggaggccaaagugggcggaucaugaggucaggagaucaagaccauucuggcugacacggugaaacccugucucuacuaaaaauaacaaaaaauuagccaggugugguggugggcaccucuagucccaggaggcugaggcaggagaauggugugaacccgggagguggagcuugcagugagcugagcuggugucacugcauuccagccugggugacagagcgagacuccaucucaaacaaaaaaaauaaauaaaauaaauuuuaauuugaacacaaccauguccauuuacuuagauauuaucugggacugcuuuuaugcuguaacagcagaguuaguuuguugaucucuggucuaaggauaggggauuuucuagcuagggugaguuaauuggugguagaagcagagccucuugauugacagcucuguuauaugugaggaaaggagagcuguccccaaaaagacuuaacauuucucaaaaggaaagaaugccaaacaaauauguaccuccugaagaaagaagacuuuucuauuaugcccauuuuuuuccugucauauagaugagauuaaacauaguuauguauguuuucauacugauacaaaugcuaauugaauaauguacuaauauagaucuggaagaaugggcaaggauauaguaauagaacccaaaauuguaugaaauaaaaaaacaguuugugaaaaauuuaaauugauggauuauaauuuuucucuuuucagaugaugaaacaugcuugggauaacuauaggacauauggguggggacauaaugaacucagaccuauugcaaggaaaggacacuccccuaacauauuugguaaguuuacuuuuucuaauuacuauuuccauuuucuaccuccaucuuuuaaaacaagauguaacuuuucaaaguacuuucuaaaaucugaguauuucuguggaacuauaauuugaagaaacagguaugauuuuuugcaagugucagucacgauuaaguuccaguugcuuuggaguacacauauaugugguagauuuucuauuuacauauggaugcuuuagucauuuaucugaguauuuaaaagcuuuuuuuuggcauuuuuuucuuuagugucaggaaaaguaggcaccuacuugucauuuuuuucuucaacacaauaccuauucugauauucacauuacagaggaagaggggagggauaggaaauucuuguaguucuguguacauuuuuuaaaaaagugacauaccugggaugauuggguuacugaauucaguggguuauguuguacauucacaguuccuaaggaaaaauuaacaauguguucugugaauggagguuuggggaagagcuguguucaucuugaguuuguucauccuacuuucccugagcucaguucacuuguaaaacuucccaguuuaacuuaaccaauuuaacaacuuuuacuaaacccaaagguaagucuucagaauuguuaagcuacucuuuguagucuucacuccuuucccccauuuuaaaugcuucuugaugugacuugaucauuaucuuuuaaguaaugauagaugaaggcaagaaaauuuuaaugggcuaaaaagucacaaacuaguuauaugcaaucugauuuuauuaccuguaguaaaccaucacaguaauucaaauaacagcaauuuucuuuuugacacuagggaaggauuuuucuaaugcugugaguuuucuuauaauuuguucauuguugcuugcuuuugaucaaaaaagaaaaugucuuaaaaaauaauuucuguuggguuugggagauguugugguagaggaguaaaggaaaaaaguuuccucuagguaaucagugacuacuagagacuucauaauaugauauuuaauuuaucagccauuauguaaugaaauaaaguauauuuucuuaacagaguuuuggacuggaaaguucuuacugcuuuguggaugucacaauaugaggcguuagugcaauaaagacauuaaauuuaauagucaauuaaauuuagaaccucccuucaaguaacuauuuuuauguuaaacucaacgguaaauugugagccuuuuaaaaagauuggaguauaaaaauguauugaaaauaaaaauuggaugucaauuuuuuacuuuuuucaaacgauauuucucagaacaucuaauguauuaauauuuaucaaauagauacugguccuaucuguuuaucagauaaauauugaugcuuuaguaaacuuuaaagguagaagaaaauuaauuuugacacuuaggaaacaucuauucugcgaagaaaauuauagugaaaugguagaaaaagaaaaucuacagaauuuucaguagucaaaauuaggugcugcuuauuuuuuauugaauuuuugagugguuacaguuucuuuuccagccagauaagcuaaguaggaauagauccauuauuauguuuugucuuauguuuguagcuaugcagucaguuuguuaaaggauuauuuuuuauaguuuaauacuuuguuuccuacuuacucuguuucuuuuguguaucucaaauucuugccaguaaguacaauuugaguuuuuuuaaucuauuuuuugaucuuuuucuuuuuuaaaaaaacaguaaaagucuaagagaagcgugguaaguaguucucagugucucauuugacaucucaaauuuaguaugccuuuacagaauaggaauauguagguggauacugaaccuuugcuugcaauauucuagauuuuagggaaaacauuaacuuaaaacacucuuuuuguuagccuugauuauuaaacaauucuuuuauaugguaacugagauaggggcuccucugacuucugucuaguuaguucuuggcaucagaguccucuuuacaugcagauaacagaaaauccauugcaaaauggcuuaaacuaaaaagaaaacuuaaucagcugaaugaauuccugguguauaucugauuuuaccugagcuuuuuuacuuuaucuuuucuguuuuccuguguuuugauauaaucaagcugguuucuuagcaggauggcugcagcaacuugaagcuucauaucuucauacuaccacagcugugggaaagagaacauuguagagaagagagcacucggaugucuuagaaauauaauugaaauacucacuguuucuuauugucucugauuaggucuugugcccauuguugaaccaaaugcugugcuuaggaggaugggacauguucuuuuuguuuugcuuaguuagggccuggcucuggagccaggagaggggaggaggaaauguugcuggauguaaguuagcacugauacuaauuauucuaacaaugauuaauaguuagaauggcugggugcaguggcacauagucccagcuccgcaggagguugagaugggaggaucgccuggggccaggaguccaaggcuauggggcaccaugaucaugaugccugugaauagccacugugcccuaaccugggcaacauagcaacauagcaaaacccuuucucuuaaaaaaaaaaaaaaaaaaaagcagaaugaguucuuucuauuuagauauucuggaaaguagaaaguuuuguuagggauaggucuuuuugcauguagaagaaauuauuuuaauuuguaaaaaguauucuuugauuuugcaaugcucuuugaagggugcauuuuauuuuccagguguguguguguguguauuuauauguaaauauguuccuuuuguuauuucugacuuaacugugauuugauuuguacauguuuuguugaagauuguugcuucuauauuaauaagagauacugcucuguacuuuucuuguauuaucuuugucuuguuuugauaucagaguaaugcuggacucagaaaaugauuugggaaguguuuucugcuuuucaguuuucuggaugagauuguuuaggauugguuuuauuuuuuucuuuaauguuugguauauguugcugaagaaaccacuugcaucuggaauuuuuuuuuucuugaagguuuuuaaacuacaaacuuaauuucucuaauaguaaggaccauucaguuuaucuguuucauuuugguugaguuuugguaauuugugguuuuugaguaauuggucugguuuuaucuaaguuauugauuuuauaugcauagaauuguuuggaguauugccuugucauuugaaugucuguggcagcuguaguaauaauccccuuucauuucuaauauuauugauuuauguuuugucuccucucuuguccugcuagaaguuuauuaauuuuauugaucuuuucaaagaaacaacuuuuggguucauugaucuuuguaauauuuucuuuguguuuucauuucuuugauuucuacucuuuauuguuuucuucuuuugcaugauuuggguugauuuugcucuuguuuuuccagugucuugaaguagaagccuagauuauugaccagagauccucuuuucuaauguguuuauuacuguaaacuuucuaacuacugcuuuugcugcaucccugagguuuugauauauuuucauuuucauucaauucaguguuuuaaaauuuuccuugcguaaguuuaaguauuuagaguuuaaaaaaauccuucuguuacagauuucucguuuuaauuuuguuaggaucagagaauguacuucacauaauuuucauucuuuuaaauuauuuuugguuugcuuuuagacacagguuugucuuggugaauuuuccauuuguucuuagaaagaaugguauguguauauucugcuguuauuguguggaauguucuauugaugucaguuagaucccauugguuaaugggguuguucaggcugucucuaucuuaguuggguuucugucucauucugucaguuacugagagagggauguugaaguccucaacucuuauuuuggacuucuuucaguucugccaacuuuugcuuaauguaauuugagguacucuugucagguguuuguccauuaaggaugauguauucuuaggagcaccacuaaaguccuaguaucaaaaccagacaaagauauuuauaaaaaaaggaaacuauagagcaauaucccuuaugaacauagacauaagaauauuuaauuaaauuuuaguaaaucuuauugaguaauacaguuguccuuugguauccauggaggauugguuucaggacuccagagaauaccaaaauccauggaugcccaagucucuuuuauaaaauaguauauaauauuugcauauaaccuaagcauauucucauauauuuaaaauuaucucuagauuacuuagaauaccuaauacaauagaaauaguuguuauacugugucuuaaaauuuuuguuuuuuaaauugcuguguuauuuuuaaaauuauuuuccccaaauauuuuccgucuaccguugguugaaccuguggauauguaacuggugaauacugaaggcugaguguauauuacauuaugacuaaguggaauuuaucauagagauacgugguagguuuuacauuuggaaauuagcuaguguaguuuaagauaucaguauaauaaaagagaaaaaucauaggauuaucccaguaguuggagaaaaagcauuuaauaacauuuaacauccaucgaugauaaaaacugucagcacacuaaacuaaaaaggggauuucuuuaaccugauaaagagaauuucaaaacaacaacaauaagcaaaaaaugcaaaauaccccccacauacuuaauauugaaagacuauaugcuuuccccuaagauugcaagcuaggcaaaggugucuacccucucacuuuuauguaacauuguacuggagauccuagccagugcacuaaggcagaaaaaagaaaaagaaaaaaaaaaaagaauaaagauuggaaaugaagaaguaaaacuaucuuuacauuuuuagucaacauaauugcccacagagagaauccuagggaauguacccaaaaaaggugcuagaauaaacaaauuuaguaauguuauaggauacaaguuuaauaugcaaaaccaauuaugugucuugguauacuugcaacaaacaguuauaaacacaguuuaaaaaauaaagucauuugcaguaguaucaaaaaauaagaacuauauguguauaaauuugacaaaauauguacagaaccugcacauggaaaacuuuauguuguuuuugagagaaauuuaaaaggacuuaauggagagaaaugccauguugaugaauuugaauauucaauauuguugggauguuaauucuuucuaaauuuauguuuaaauuuagaggaguccaaugaaaaugacuaggcuuuucuguagaaauuggcaaguugauucuaaaaucuaugaaaauacaaagcacuuagaauagucaaguaauuuuuuuaaaaaaaaccaaguugaaggauuugcacuaccugauuuuauaaauuacaguaaagcuacaauucaggacaguaugguuuuagcauaaggaugggcauagagaucuguggaaaagaauagaaauagaaguguacauacaugguuaauugauuuucaacaaagaugcugagguucagugauuaaaaggauagccuuuccaacaaguggugcugggucaacuguauauuuguaugggaaaagaaugagcuuugccucuuccuucaacauuguauagaaaaauggaucacagagcuaaauauaaaagcuaaaaguaaaaaaauuucaguagaaaacacuugagaacaucuuugugacuuugagguuagcaaggauuuuuuagaacacaaaaagcauuaaguauaaaauaaaaauguugguaaauuggacuuaaugaaaauugaagauuucugcuccccaaagacaucaggaaauuggaaagacaaaccaaagacuuggagaagauauuugaaauauuuacauaaggauguauccagaauauauaaauacuuccccacccaaggagguauaugaauagccaguaagcacaucaauaagcagggaaaguaaaauucacaccacaauggaauauuucuacacacccauuaacaugucuaaaauuugaggaucaacaauaccaaauauugacaaggaugcuagagcaacucuguuauacauuguauugggaauguaaaaugguacacuguggaaagcaguuuguugguuucuuauaaacuuacuguauagccuagcaauuccacuccuaaauauuuccuuguugcucacaaaugagaucagguguaguuguauguuucuuaguaaauucgauuuuuuuccgccaaugauauaaagaauuuacaaauugaauuuuaagaucuuuuucccuauguuauauaaaaguuuguauagaauaggaguuaucauccuuaaaauuaaaguaguagucauucuaugaaacuucuagaauaugguauuuugauagcggguagcucuuugaaaacuuuuuuauuuccuguguuuuucggucuguuuagauuuucuguuucuucuuucauaagucaaaaauaguauuucucgagaaagaucaaauuuauugugaauauaugaauaaaaugggccuuuuauaauuuuaaaaaauuuucucugugcuugucuguuguuacauuuuuauuuauuuuguguuuuugucuugucuaccuuuuaaaaacgagguuaaugguagauucauuguaugguucuucauggaaccauuucuugaauuuauuauuucaauaauuuucuucauuucuaauucauccauuucugccuuuaguuuuucucauucuucuauuauuuugcucaaauuuguuuuuucuuucuuagaauauucaguuauuuucauuuguucuuauuaacuaguauaaauauuuuaaguguuuuugugagaacugcuuuaguugauucacuugcucucauacuaaauuuuuaugauguuuuauauauuuugcaaugucauguuuugcugcuucuuugacccaagaauaguguuaggcuuuuucauuuuuuccuguucaaaucuugacuuccucuagguaaacaaucaugaugauagccaguaauuucaauuuuacacuuuucuuccuugaagccuuuagcucauggcaccuagugcaacuaaccaagacugguacagaauaggugggucaggccuuuuuccacuccagaauagucaauaccuuagagaaauauguacuuagaggacuaaauaaauaacuagguaacuggaggagcagaacuaucuacaaaaauuaaaauaaggacacaaacaguagucucaaggauuuaaaauaaguuugguaaauguuuuggaugaaaugcuaaaauuaaaagagaauacauauucaagaauuuaugcaagagauagagauauaugagugauuaaauggcuugauaccauuuuuaucguaauaaaaagcugaggaacguaacaacacauaacuuucuagauaauaucaacaugaagggaacugaguagguagaagaccaaggaauuuaucagaguguguuggaguauuugucuuguuagcuaagagaagauagauguauugauaaguugaagaaauuauuaggaacacaugaacaagaaaauggcauguaaauuaagaacaaccaucauaagaacaaauuuguguagcuuuaaaucauuggaagaaaacaauuucuacucaguagaaagaggaauggaaaaagaaagaaaagaggagaauaguaaauggaaaaugugaacuaaguaauguugaaugcuggcucugaaaaugucaccaagaaaacccguugauaagacaaagcuguuaauuauuacuuugguaaggagaucacuaccucgcuggagucguaaccuuucagaguuuugggguauaaaucaucauuugauacuuucuguuguagaguugaugggucuuuaaagaaguuccuggaaugaacaauaaauuuuuuuugcaacuuuuaucuuucugagcaagagcuccuggaacaguaaauucauguuguugaagacaauguaauauaguaaagccauguuaaugcaggcaguaagcuguguggaucauuugcauuuucauaggacacaaauaauaauugcauuaaugggauuggggugaacccaucugcucccugauauuuauuuuuuugcuguacuacuagauuuuuuacucuacuaguagcaaaacaaaccuaguuuauuuaggauuuguagaguuauauucauuaguaagauuggccuguuuucuucucuuaaguuuucauuaucuaguuuugguaucaguuaggcugguuuugaauuaauucuucccucucuuccucccuuucucucuugcuuucuuccccucagaacauuuuuuuaaugauaaggauuaucucuuucuuaaaaguggauacauuuuauuauuuugauuuucucuacucauauuuuguuugaugguuuccuuuuuucaauuugaucuaccugcuuguugauuguuaaggauuguuuuuuuuccacugugguuauccagcccuguuguacauuuauuauuauuuuuaaauauauuuuuuguccuuuauaugaauuuggaccagaccagaaggacaugguugucuuauuacuuagcuuugucauugugaaguacucuccucuuuucuugaauuaauccucuuuuuuuuuccuuucucaguuaaguagauagauaucucauauucugacgaggcagaaaauuaaggaaaaguaugcuuuuaguuuucuuuuaucuuccuauuuuuaguaaaguacuauuuuuaguaaaauauauuaaacuauguauauuaucuaauauauacauauaauuucuaauguaaaagggaacaauauuggguauucuaaauuuuuaguccuuauacucuuacuuuaguuuaccuuuauacauaaauaauuaaaauacacugaaugugaagggaaucuuuuuuuuccccccaaagagaacaggaaccuaaagggaucuuuuuaaugauaauuuuuuucuucccaaauauaggaaguucacaaaugggugcuaccauaguagaugcuuuggauacccuuuauaucaugggacuucaugaugaauuccuagaugggcaaagauggauugaagacaaccuugauuucaguguggugaguguaugauugauaacuaaucucuuagauuaaccaugaaaagacacaaugucuaacugcuauggucugaacauuugugccuuccuaaaauucauauguugaaaccuaaucacuaaugugacgguacuagaagauggggacuuugggaggugauuaggucaugaggguugaccucucaugaauggaaaaaauauauauauauauuuuaaaguugaguaauuagcacagcuucgaugaauuuucauaguuaggccuacacucauucuucuggcacuuuagcauggucaaguggcacugcuuagguuuggcauaguuguuaagucacacgcccagcacaguugcauucuuggugugcgacuugagaaaguuccuuaucuuccuaaaccugucauaaaauugauauuccauuauaguauugugaggauuauuugagauaaugugguacauauuaaaugcucaguaaaugguagcaauuauuuucauuaucaccagucuucaccuaaaagauguguggacuguuuugucauauucacaucuuuugugauauuugugcuugcuuuuccuuuugacuguauuauccuucacuacuucucuauguacuucucucuggcagacucuucguuauuuaaauugugauauaaguccauaauuauuucuucucugaugccauucuuggagcuaacuagacaaaaaugguuuacuuuccuuuauauuacuguagaauuuggacguaucucaaagagaacaauuuuuauuaucaauuaaguuuagguuugauggugagugauagaaaaccuaauauaaaagagcuuaaacaagauagauauuuauuuuuuuuucauguaaaucaaguacagaguuaagcaguucagggcugguuuggguggcuccuugaucaucaaggaucuaggaucauuugucuuguuguucuguuggcuucaguguauaucuuagaccucaugauaugaaaugguuccuaaagauccagacauuuuauccaguugacagaaagaaugugacuguucucuaagaagacuucucaggagguagucuccccauuuuugcuuuuagaguuuacuaacacagccucaacuaacuccaaaggaaagcugagaaauguagucuuuuuuucuguguagcuauguagccuuuauacaacagauugugcuuuuuguaucuuguuuaagaaagcccuacuccuagaucaugaauauauuuucuuauauuuuauucugaagguuuuaaaguuuugcuuuuguauuuagucuuuaauccaaauggaauugaauuuuuuuuaauguaggaugaaguaggccacuauuaguugauccuaguaccauuucuuuuccugcuacuuuuauaugccacauuagucauauauuagucauauuacaguuuauucuuuaacauuggcuuuuuucuuuauccauaugucaauacuaaacuaucuuaacuacaauuuuuuuuauaagaagcuugaugucuguaucugaaucuguucucuguugguaucugaucuuguucucugcggaaauugucuuaguucucagcuuuuuguucuuucaaguucuggaaaacuguguggaaauuuugaggaggauugcauuuaauuugcagauuaauuuggggagaauuagcaucugugcaauacucccauucauugacaggacagcuuuauaauggcuaauaauucccuuguauaucauuauuaucagucaggguucaaucaggaaccagacuaugccauuuauuuuaacuagaggauuuaauguuuagaauuguuauccaacuaauggggaaccaaaaaggcaaaaagagagcauugugauaucaccagaaguauuaacucuaggaaacaggaaacagcugccaccuguggggacuauaagaacaaugggaagagguugggaucauuaaaaugcaguagcuugggcucuauggaacugguaccugugcugcccagguguuacugguaccucaggaagacugugucagagcugagacucagaacucugaggaggagacaccuagccaagugcuugauaucuguaaaggaaaccaugaggcugauuuggggauugugugucuguaugugugauaagggaacaguacucuggaagcaguugccacugccagggugaacccuggcuggugagacacuaucagaaacuagaaguaagcaggagggaauaagacucuucuuccuccagucuuguauugucuuuuuagaaccuccuaauguuagugccuaaaagggagccaguugguaaauuaaaugcauuuguguaguuccaacucccauauaccaaaguagaguauagaagaauggauuugaaccugagagaaguaguguaaucaucagcacagucauuuuuuguuccuuucuuucaaccuuuaaaugucauuauguuuuagcugcuuauuuugcauauauaguauguauuuggguuuuguuauuuuuauccaaccuuagagucuuuuuaacuauuaaguuugauauauuuacauuuacuaugauaacauauuuggaguuaggucuuucaucuuuguuuugcuaccuauauuaugaucauacuuuucauuuguuuuuaguuuguuuuccuuauuuuggauuaaauuacaucaucucucuuuuucccucuacuaguuuaacauuauaccuuccauuucuauugacuuuggagauauccuugaguuuaaauauauauauauauauauauauaugugauauauauguuuuauaaaaauacauuaaaacugaguuuuaucucuuuuuuguguuugugcucuggugucaggagcaaaacaauaaacaauguauguuuaaacuuuaaggguaacuccaaaguaggcgugcacacacacacacacacucucucucucucucucucucucucucaucaaaguauaguauauauaaauauauauaaacuuuaaggauaacccuaaguaggcaguuugaaauuaaucaauuucagacaaggagucauggcucgugucuguaaucccagcacuuugggagguugaggcaggaggaucgcuugagcccagcuugggcaacauagugagaccugaacucuacagaaaauaaaucccagcuacuugggaggcugaggagggaggauugcuugagcccaggagguugaggcuacagggagccaugaucaugcuacuguacucuagccugggcaacagaguaagauccuccuucugaagaauauaaggauuuuagaaugcuuuaacuuaacucaucccccuuuuguuuuaugugucauuguugucuaguugaucccaaguuauauuuuaaacuuccaaauuaaguaauagauaaauaaaugcacacauuuaucaaaugcaacaggcacuguucuagauucuguggauauaguaaucaacaaaacagaguuuuaucucuuuuuuguguuuguguucuagugucaggagcaaaacaguaaacaaguuauauauaguacaucagagggugaugauaagugcuauggagaguaauggugggguacugcuauuaguauuuuacaugggguggucauggaagaacucuuuguuaaagugacacuucugagaagagacccaaggggagccauguggauauacaacucugucuuaauagauauuaaaacugagaauagagguacaguucccuugucuuuccugcuucuguuauacuauugcaaaguguguuuucaguuuaauuuuaaaaaggcaaucuguuuuuucccuuguuuuaauauuuuauuuuuugcuuuguuguucuguaauucuauuacuauaugucuauguguggguuauucuuuaaaggacucauaauguuucaucaaucugaagacuuacauuuucaucaaguuuaguagguucucaguuauuacuucuuucaaaaaugucucuauccuauuuuuccguucugucccucuagaauuucugauaccuuuuguuucuguagugaaggaagauuguuuuacaaaugaaacuauuugauuaccgugugauuauauauaguuagaugaugauguguuaauuagggaaauaaugcaagguaauugguauuaauauuuuauauuagauggucagaaaaaauuucugauaaggugacauuuauucagagaccuauaggaagugagagugauuuguucaguuaugugaaaggaaagcauccagauaauaggguaacaauuguaaagcugacauaggagucucaaguuugacaauucuggguacagcaaguaggcccauauaauuaaaugaaucaaagggauauuaauacaagggaugucaaagagguuguaggggaucugagcauguuggaucuuauuggucauuuuacucuugaguguuaugugaaggcaucguagggguuugcacagaguagugaucuaaacugauguaagauuuaaaaggcucauuuuaacuauagugugcugaauagaggguaaggaggaggguaaguauuaaagcagggacugguuggaagguuauuguugcaauucugguaagagauggaggcccucccacccuuuuuuccuuccuccucauauuuagucaaugucugcuaugugcccuguaguauguuagauguugggaauauaugaaguaauauuaagcacuuugcuuucauggugggauggaaugaugaucguguuaucaaaaaauuacauuauauuguaaaaauucuauacugaagaaauauguuagcagaugaugugccugccuaugaauguuggaaagacuuuagaguaauacaguuuccuuuuaauuuuuauuaaaauuaacuaugaauguuuuuauguuaguuguauaucuucuguagauucuuugauuauguucucugccacuucugcuuuucuuuccauguguuagaauauuucuagcaauaucuauaucaauauguaaauacaaacauagagacucuauuuaguaagguuauuaauauuacuauauuugugcuguuuccaucuguuugccauuuaguuuuguuuaugauucuuuuucuuauagguaauuugcauuuuagaaaaauuucaugucugucaucaauuuaucaaaacuauugguuuuaugcuuaaguaccugcuuucucagggaaauuuauauauugccacacuucuacuuuaaaaauuuuuuuaaacauuuauuuccaaauaauuuagauuucauuuugauauuugugaaauuaguauuuauguuaauuucuuacccaggaggcaauuuucucaacauuauuauugaauaauccaucauucugccauuuuuuuggugccuccuuuaacacuuauuauauauucuaggaaaaauacuuaaaauccaggaggagagaggaaguaaaaauuaugcuguagugauuagaacagaagaaaaaggaccaccaguaaagagugcuauucuagaaucaugacccagaauucuagaaaugaaggcuuucaugaggaaggguaauaguuaacaguguuaaauauccugauaaguucacaguacuguguaagguacauaaaaaauggcuuguugguuucaggaauuagggagcuguggugacagcaguagagaaguuucaguaacauuaacaaacgagaggagagauugcaguugcaugagaaaugaagaugcagaaaguagaaaaauauuuuccacaggguguuugugaaaaacaaaugaaguauugauaauauuuugaaaacuauaaagcauuacguauuugugaauguuuucaauauguuuuucacagaauucagaggugucuguguuugaagucaacauucgauuuauuggaggccuacuugcagcauauuaccuaucaggagaggaggugagcaaaaucaagcaaugcauuguuuguuuuggaggggaggguuggaauuuaauaaaaugaacaauuucccuagaagcauauuaguuuucuaaauugguaauauugaaccagucuagaacugguugcuucaggcagaacuauuccuugggaauaauaauuuuuccauuuugaggcucucaauaaaacaugaauucaucacagauccuagcuuuauauacaccaugucuccuuugcaagagugauccuucuccaggauuuugccauugcaauuaauuccauggcccaaguaaagggggaaaauaaacuaauaaggacaaaauuaaauaacaaaucagaaagaauuaauauggauccuccuaagaccaaaaauuaguaauucaaacuuacuguuuagaaauugaauccaguuuuuggcuauaaauaauaacaacucugaauucuccucucuggaaaucuugguacagaacacauggagacacuugagaccuaaggugauggagaaguggguguaggaaauucccuuuuacuauugaaauagguuaaagaaugagguugaagagugggagaaagagaaacuaaaggaagagguuauaagucauuuauuuguuuuuugagcaacuguuucacccauauuuugguuuguugaucuagacaauuuguaagagcucuuuguagauuuaagaaaauuuaccuuuuguuauauguauuauaaagauacauaucuauguuagcuguauuuuguuuaauuuuuuuuuguuguuaauguugaaguaaucauuuaaaggauuuuuuuuuccccccaguguuuuggcuucuagauuuugguccuuagaaagccuuuccuaugucuguguuauuacaaaacaaaaauucccauuuucguauggauuuuuaugacuuuauauacuuuuaucuauauauuucauuuauuguuguuccuuuguguguaaagagugagcuauuuauguacuaccuuuuuuuuuuagaagaaauauguuuaaagaugcugguauuuaauauauuagauuacauuuaucuuaauguguaauuuuauugucaaauuauauugugugauuuguuuauaccucuaacauauauuucuauagucagaacauuuaaauucacauuuaauaaaauagaaaaaaaugauauauacucuggccaagagguuaucaaacuuuaguauguauuagaaucacauaagguguuuuauaaaaaugaggauuccaagcccugcccaaaggaccgauucaguggguuuagcguggagaccauuauccuacguuguucaugccaaauacuccuuguuaaaggugauuuuggaaacauugguucuauauuuugagaaacucugaccuggcuuauaggaauaaaaucauugugaauuaauuguuauuuuuaguaagguuuauugagguauuauuuacguacaguaaaauucaguauauaguuuuaugaguuuuuacagugcauaguauuguaaucaccagcaugaucaagauacagaauuuuauuauccuagaaaauuuccauuuaccauuuuauaauuacccuaucccauugccagccccugauaauuacugaucucuuuucugucucuacaguuaagaaugcuggcuucuuuuacuuagcauaaugcauuugagauuuauccauguauuaguaguuuauuccuuuuuacuguauuacaguacuccauuaugcauuuuauauauuuaucaguggaauuauuuacaguuuuggagauugugaauaaaccugcuauaagcauuugccuauagauuucugugggaaaauaaauuuuuauuuaucuuggauaaauacauaggaaugggauuuacugagucaaagguuaaguguauauuuaacuuuggaagaaacugucagauucuuuuccaaaaauugccucucauuguugugaguacuuuguauugugagucucuuuauuauuguuagccauucuaauagauacauaguaguaucucauuguggugguucuauuuugcauucccugaugacaagugauguugagcaucuuuuccuauguuuauuugucauauguauuuuuugaauuagcugcucaaaucccuugcccauuuaaaaauuuuuguuuuuuuugaauuauuaaauugugauaguucuuuacauauuuuggacauaggucuuuuauaaucuauacauuugcaauuauuuucucuaucuguggcuugucuuuccagugauuuaacaguaucuuuugaagaauugauguuguuaaucuggaaguacaauuuacuaauuuugucuuuuaugguucaugcauuugguauuuuguuuaagaaauguuugccuaauccaacaucacaaagauuuucucuuaaguuuucuuccaaaacuauuauagcuuuacuuuauuuguacuuuuaagucuguaauugauuuugaguuaaauccuauauaugcugugagguauaaguugaagucuacuuuuuuccauauggauguugaaaagacuacuuuuucauuaauugacuuuguaccuuuguugaaaaucaguugauuagguaugugugggucuacucuagacauucuguuuuguucucuugauuuaugugucugucuuugguacuaccacauuguauucauuauuauggcuuuauagaaagucuugaaaucagguugugugaguccuccaacuuuauuccuuuucaaaauuguuguggcuguuuuaguuacuuuuccuuuuuguauaaauuuuagaaucaacuuguugguuucuauaaaaucuacugagauuuuaacugggauuauaaauuuugagugauuugacaucuucacaguauuguuucaguccaugaauaaugguauaucucuccauuuauuuauuuuuuuauugguguuucuacuuuuuagcauacagaucuuguauguauuuugauaaauuuauacauauuucauguuuuugguaguucuguauuuuaaauuuugguuucccauuguucauugucaguauauauaaauacauuugauuuuuaaaaaaccuuuaauaaagacuuaaauucucaguugucucaggacauuuuguuucuucuagaaaacuuugugauacuaucauuuuaaaaaagugcuaaagguacacaacauaaaauuuaccauuuuaaccauuuuaagugugcaguucaguggcauuaaaaacaacauuugcauuguugugcaaugugcaauugauuuuucuuuuuuucuuucuuucuuucuuuuuuuuuuuuuugagacggaguuuugcucuuauugcccaggcuggagugcaauggcgcgaucacagcucacugcaaccucugccucccggguucaagcgauucuccugccucagccuuccauaauugauuuuuauauugacuuuuuacccugugauuuuucuaacuucauuaauuaauucuaguagcuuuaaaauauacuuuaauagauucuucaggauuuaccuuauaaacaaucaugucauuaguaaauagagaugaguuuuauuuuucuguauagagaaugguuauuuauuuauuuuuguucuuuuccugcuccuucuccugaggcagagaaugguuuuauuugugugguccuuuucuuuuucuugccuuacugcauugccuaggacaucuacuacaaaguugaauaguaaugggcagaguaggcauccuugccugguuccugauccuaggaauugcagugauagcuuuauucucuuccacgaucauggcauauggcuucaaaaguacuguaauccaagaauguuuauuauuucuguuggucugcuccuuuaacucuccaccuuucguacccauaagauuuuugccugguuuguccuuucugugcccuggaacgaagauaguuccuggaaaaacuagucccagagggagagcuuuugcucaugacuugggaaggagugcuuuugcucaugacuugggaaggagugggauuuaugauuuggaccucuagucucuuucaguccccucagcucuccuauaugcguuucacuccucugccuugagucugcagucugcugcauaccccauccuccaucugccucagccuuacauacaaacaguaggucugggcucuuccucucaaaggucacucagagaggugccuuucuucauaaaaucuuugggauuuagauuuccccgggaaggauggaauguucauucuugggucucaucuuuuccccuugacccaaaacuucuuccccacagaaaugucuuuaagaaucuucugagcugcuucaucugcuaacugccaguucucuaacacugaaaugugguagguaacuggacauauuugaaggacaucuuuauguaagugauauauggagucaggagauagccaccuucauauauugcucugugccaagagaaauaaaaccgauuucuuuuuccaaaagaaggagacaaaacaggagagggggaagggaagaaaaggagggggaagggaggagaagggaaagggggaaggaaggggaaaggaaggaagaaaaggagggcaaaggggggagggaagggggaaggaucagaacucuaucuauaaaaagaugcaaaguuuuaaaacuuggaaaggaaaaaacaaaacucccaacccaaguugcuucacuggcaaauucuaccaaauauuuaauaucgauuauauguaaauuucuccagaaaaaaaagaagaguaauuuuucagcucauucuaugaggccagcauuaauccuaugugacacacacacagagguauuaaaguaaaacuauagaucaguaucucaugugaauauuguagaugcaaaaaauucucaacaauguaucacaaaaucaaaucuagcaauauauaaaaaggguaauacaucaugaccaagugggguuucuucccaagaaugcaaggcugguuugauguucaaaaaucaaccaauauaauucacuaugucaacagacuaaagaaaaacaucauauaaucuuauuacauaaccacagaaacaucugacaacauguaacgucuauucaugauaacaacuugcagcaaacuagaaguagaagggaccuuucucaaggugauaaagggcaucuacaaaaaaccuauagcuaacaauauucuuuuuaucuuuuuguguauguuguuauuauuauagauuucaguuuuaugcugcaaauccauaguacauugcuaccacuuuuaccuuaggugaucaguuaucguuuagaacuauuaaaaauaaaagaaaugccuuuuugucuucauuucagucauuuuuguuggucuuuucuuuuugcagguucagguuucugauuuuucagguuuuucagguauuuuauuccuucuguggaaacagcuuccuuuaacauuuuuuauaguauaggucuauugguagugaguucuuuuaguuuuuguuagucugaaaaucuauuuccacuauauuuuugaaaaauuuucuuuggguauaaaauauagguuuacaguuuuuccugucaacacuuuagaaaugucacugcauuaucuuauagcuugcauaguuugugaugagaaaucuccuuuaauucuuuauuccucuguauguaauaggucuuuuuuuuuucauuugguugccuuuaaaauuuucuguuuauauuuuguuuuguaugaagagucugagugguuuuuacuuuguguguguauguguugggcugcagggguaugaguaggacuguuuauuuugccugagguucuuuaagcugcuggggucuguggguugauaucuuuaauuauuuucuaaaaaauucucaguuauuguuuuuuaaaauauagacauccaucgacuuaugauaggauuauguccugauaaacccauugcaaauugaaaacauccuaaguugaaaaugcauuuaguacaccuaaccuaccaaauaucauagcuuagccuaccuuaaacauccucagaacacuuacauuagcuuacaguugggccaauugauauaacaaagcccaguuuauaguaaaguguugaauagcucguguaauuuauugaauacugaaaacgaauaacagaauggccauacgagcacuugaaguauaguuacuacugaauacuuauugcuuucauaccauuguaaaguugaaaaaaucaugaguugaaccauccuaagucaaacugucauaaguuagugaccaucuguauuuuuucuuaucaauacuuuaaaaaugucacuacauuaucuuauagcuugcauaguuugugaugagaaaucuucuuuaauucuuuguuccuuuauauguaaugucuuuuuauauauugcaagagcccccugccccacuucugggauuccaauuauauacauauacuaggcugucauagcucuuggacucauuguuagauuuugaguuuagccaaauuuaagugcuuuuuaaaacaaaaaaugugcacuucucagaagauauaacagaaucagcuuccuguaaagccuaucaaucacagugaucaggauacaguuuaaaauuacucaauguaugaaaaaaauagggaaaaugauccauuuuuuuuuuuccaaaagucaaucaauggugaccuguucuaagguaacccagauacuggcauuaguugacaaggauguuaaagcagcuguuauaacuaugcccagugacauaaaggaaaauauuucugaaaugaccaaauagaugaaaaucucaucagaaaugaaauaacauggaaauucuagaaugaaaacuucaguguuuaaaacaaagucaucauguugacuguugucauuggaagggugagagucagugaacuuguagauagaucaauguaaauuauccagugugaagaaagagaauuaaauauuuauuaaaaaugaauggagcuucagaaacuuauaggacaguauuccaacauacauauaauuggaauccuguaugaagagagcagauagcuguaaaaaauaguugaagaaauaaugacuauauuuuuucuauauuuggugauggaccugaauuucaagaagcuaaguagauccuaaacaugauaaauaccaaccaaauguaggcauaucauggucaaacagcugaaagccaaauacaaagagaaaaguuugaaaguauucauagagaaaugacacauguuauauguggagguacuuuaauuugacugaugacugaacacucaucagaaaccacagagauuacuuuuucaaaauuucuuuaaaauuaugugaaugcuuaggcaaaaaccauagcauuuuauauuggguuauaacauacauagauguaauacaugcagcuguggaauaaaagagggagggaggaaauggaacuacaagauuguaagguuucuccauuuuauaugaaguuacaccauauuacucuuaauagucugugaaaaguuaaggacauaauuaaucccugggacaaacauuaaagaaaaauauugcagacacguauagcuuaaccaccaauaaauaaacuguaaaucucucucucucucucucucuauuuuuuuuuuuuuggggggggaccgagucucacucuugucacccagacuggagugcaguggugugaucacggcucacuggaaccucaaccuccugggcuuaagugauccuugcaccucagcuuccugaguagcugggaccacaggugcacgccaccaugcuuggcuaauuauuuuauuuuuuguagagguggggucucuccauguugcccaggcuggucuugaacuccugggcucaagagaucuuccugccuuggccucccaaagugcugggauuacaaaugaaagccacugugcccugccuagaaaauauuuaaauaaaaaaaacagaaaggaaggaauagaggacaacaacaaaaagcaauggaaauggcgaacagaaaaccaaaaauaauaucauacaccuauauccaguaauaucaauaaugccauuaaguuuuagugaaugaaauauucuaagucaaaggcaaaaauaguuaaaacgacauaaaagcaagaccaaacuauucacagucuaaaaaagacacacuuaauagagagguugaaaguaaaugaaugggaaaaaagauacauaguauaugaacagcaaguguagaaagguuuaaaugacuacaucaauaucagaguauacuucaagaugaaaaguauugucagagacaagaggagaccuuucuuuuuuuuuuuuuuuuuuuuuuuaaauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugauuacuugagauuagggauuggugaugacucuuaacgagcaugcugccuucaagcaucuguuuaacaaagcauaucuugcaccgcccuuaauccauuuaacccugaguggacacagcacauguuucagggagcacaggguuggggguaaggucacagaucaacaggaucccaaggcagaggaauuuuucuuagugcagaacaaaaugaaaagucucucaugucuacuucuuucuacacagacacggcaaccauccgauuucucaaucuuuuccccaccuuucccgccuuucuauuccacaaagccgccauugucauccuggcccguucucagugagcuguugggcacaccucccagacggggugguggccgggcagaggggcuccucacuucccaguaggggcggccgggcagaggcgccccucaccucccggacggggcggcuggccgggcaggggggcugaccccccccaccucccucccggagggggcggcuggccgggcggggggccgacacccccaccucccucccggacggggcggcuggccgggcggggggccgacccccccaccucccucccggacggggcggcuggccgggcggggggcugacccccccaccucccucccggauggggcggcuggccgggcagaggggcuccucacuucccaguaggggcggccgggcagaggcgccccucaccuccuggacgggguggcuggccgggcaggggggcugaccccccccaccucccucccggacggggcggcuggccgggcggggggcugacccccccaccucccucccggacggggcggcuggccgggcggggggccgacacccccaccucccucccggagggggcggcuggccgggcggggggccgacccccccaccucccucccagauggggcggcuggccgggcagaggggcuccucacuucccaguaggggcggccgggcagaggcgccccucaccuccagacggggcggcuggccgggcggagggcugacccccccaccucccucccggacagggcggcuggccggguggggggcugacccccccaccucccucccggacggggcggcuggcugggugggggugcugacccccccaucucccucccggacgggguagcuggccgggcugaggggcuccucacuucccaguagggguggccgggcagaggcgccccucaccucccggacggggcggcuggccgggcggggggcugacccccccaccucccucccggacggcacggcuggccaggcggggggcugaaccccccaccucccucccggauggggcggcuggucgggcggggggcugaccccccccaccucccucccggacgggguggcugccgggcggagacgcuccucacuucccagaugggguggcugccgggcggagaggcuccucacuucucagacggggcagcugccgggcggaggggcuccucacuucucagacggggugguugccaggcagagggucuccucacuucucagacggggcggccgggcagagacgcuccucaccucccagacggggucucggccgggcagaggcgcuccucacaucccagauggggcggcggggcagaggcgcuccccacaucucagacgaugggcggccgggcagagacgcuccucacuuccuagaugugauggcggcugggaagaggcgcuccucacuuccuagaugggauggcggccgggcggagaugcuccucacuuuccagacugggcagccaggcagaggggcuccucacaucccagacgaugggcggccaggcagagacacuccucacuucccagacgggguggcggccgggcagaggcugcaaucucggcacuuugggaggccaaggcaggcggcugggagguguagguuguagcgagccgagaucacgccacugcacuccagccugggcaccauugagcacugagugaacgagacuccgucugcaaucccggcaccucgggaggcugagguuggcggaucacucgcgguuaggggcuggagaccggcccggccaacacagugaaaccccgucuccaccaaaaccagucaggcguggcagcgcgugccugcaaucgcaggcauucggcagacugaggcaggagaaucaggcagggagguugcagugagccgagauggcagcaguacaguccagcuucggcuccgcaugagagggagaccguggggagagggagggggagggggagggggagggggagggggaggggggaggccuuucauaaugaaaaaaaggauccauucauuagaaagacauaaucacaacauuaaaacauaagcaaauguguaggcaucaaauaacagagcuuugaaauguaugaaucacaaauggaagaauuaaaaggagauuccuuuuuaauuuuuuauuaaaaagguaauuccacaaagauuguuggauccuucaacauucuucucuucaacugauagaauaagcagacagaaaaucaaagaugauguagaagucccgaaugacaguaugagcuauuuuaaaugaauugauauuuauuuauacagcacuuuacucaacagcugcugaguacacuuucuuuucaagugcacaugguauguuuaccaaaaauaaauuguaugcuggaucauaaaacacauucagucaauuuaaaaaguuagaaauaguacagaguauggcuaggugcaauggcuuaugccuguaaucccagcacuuugggaggcugagguggguggauugcuugagcucaggaguuuaagaccagccucggcaaacauggcaaauccucaucucuacaacaaauacaaaaauuagccgagugugguagcauguaccuguagucccagcuacucaggaugcugaggugagaggauugcuugagccuaggagguugagucugcagugagcugugaucacacugcugcacuucagcuggggcaacagagcaaaacccugucucucaaaaacaaaaaacaagcacgaucuuugaccaugauggaauuaaauuagaaaucaauaauagacaucaggaaaaacuucaaauauuugaaaauuaagcaauauguuucuaaauaaauagacaucaaguaagcaauuacaaaggaaauugaaaauauuacaaaguugauucuuugaaagaaucaacagaauugauaaaccuuuuuagcuaaauugaucaagaaauaacagaagacagauuaccaauagcaggaguaaaugguauugccaauaugaggcuaucauugcagauuccacauacauuaaaugcauaauaauggaauauuauaagcaguuuuuuugcaaaauuuaauaauguagacaaaacaaggaaaauauuacaaagucgauucuuuuaaaguauccacagaauugauaaaucuuuuuagcuaaauugaucaagaaauaacagaagacagauuaccaauagcaggagcaaaugguauugccaauauuaggcuaucauugcagauuccacauacauuaaaggcauaauaauggaauauuauaagcaguuuuuuugcaaaauuuaauaacauagacaaaacaaauuuucuaaaacaaucuuauugaaacugagucaagguaaagcaagaaguaugccauuuguaguauuaauugaauugguaauaaaaagcuauuucacaaaauuaacuccaaguuaaauggcuuuauuggugaauuauaucaaauaagaaagaaauaucauucuuccccagaggaacagggaacauuuugcagcucuacuucagaggccagcauagcacuaacaucauagccugaaaggcaauauagcaagagaaaacuacagaccaguauacuuuuuaaauacauuagcaagaauccugaacaaacuauuaauacuuguaaagcauagcuagcaauaauauaaaagauauauauauuauauauaagaauauaaaagauaaaagauauauaaaagaucuuuuauauucuuuuuauauaauauaaaagauaauauaucaagaaaaauuucuuuuauuguaggaaagcaaaguuaaagauuugaaaaagcaguuaauguaauuaaucauauuaauuaacaauaaaggagaaaaaucauauaauuauugcaauaaauuuaguaaaagcauuugauaagaugcaacacccauucaugauuaaaaucacucaguaaacuaguacagcgugauaauucccaauccaaaaaccugaaaugcuccaaaauccuaaacuuuuugaacaccaacauggagugcaagggaaaugcucauuguaguguuuaggauuucagauuagagauacuaaacugguguaaugcaaauaauucaaaauuuaaaaaaaucgaaaauuggaaacauuucugguucuaagcauuucacauaagagcuacucaaccuguacuaaaagguaauuauuauuuuucauucugauaagggacaccuacgaaaacucuacagcaaacuauauguuaauuauaaaauauuaaaauguuuuuacccaaggaucuggaauaaaggaagguguuccauuuucacuauuuacauuuagcauuguaaugaaaaucuuagcauugcaagaaagcaagaaaaauaccuuguucauauucacuuauauaguuuuuuugcuagauuccuuuugauuucugagauacacagucauauugucugcaaauaaugacaguuguacuucuccuuuuuuucuaaauucuguguagccaggaaugccaucgcaauacugauucauuguagucauuacugcacacacuuugcaguuugcacugauggucccacugauacugaauacuguccuuaaaaauuuuuggaaaugagaugaacuugccacuaccuauuagcugaauugcuaaauggauuccccaccaucuccugucucuaacuuccccuuaccuaaccuaauuugcauacuaccugaguaacaagaaaggccguguugcuuacuaccuuaguugcagaggaggcuuggaaaugugauuauauggcauuugcagcagcuuuaagguaauagauggaauggaguuucuuguuugucagacagauagaaugacaguuuccauagaaaguagagggaguacuuucuaaagaggucaaaagcuguaaaagagauuaucugagggaucuauuuacuauuuccuaagauucuccagacuugacacuuauauuaaaccacaguauugugaaacuauuuauuuagaccacauuguuuuaucucccuguguuuauagagcuauaucacgauuuucugucuguaauagucucucacccuuccacauucuuugccugguagagacuuucaagaccuuacugagguuaauuuauaugcaauaaaauguaccuauguuguauguauaauauguaauuaaauguauacuuugcauuuuaacaaaugugugauaaauuguuagaauauaaauugauacugucuuuucagaaaauaauucggcugugugaaguaaauauuuaaaauuuaaaauacucugacccagcgacccacuucuaggaaucuauuaucuaaaaguaacagaguagauacacaaggguauacucaaaaggauguuuaauugcaguaccguuuguaguagaaaauauuugaaaaagaccugaauauucauccauaggagagugacugaauaaauugauauaucuguuaccauaggauaaaauuaaacuauaaaccuaaauuuguauauuuuaacgaggaaaaaugugcuugauguauucagugacuaaagcaaguuauagaccaguaguugguuacagcuguguguguguguguguguguguguguguguguguguguguguguguguauccauucagucagcuagucaucacaguauuuugccaagaaauaauggcaccuuggacuaagaugguguuguagagaugagagauauaaaugauuucaggguauuuuggagauaaauuuaaaaggauugggugauacguggagggggguauaaaacagaaggaauugauuuugucucucagguuucuguuuuuggugcuagauugaugguacgauaguuauuaaauaucaaaugcuuaaagaauacuagauuagagggggaagaucaugaguuaauuuuagguauuuugaguuugaggauuuuuuuauauuuaagcgaaaauaaguaguagagagauguaaugggucugguguucaauggagaaguauugacuggagauauaaguuugggagucaguugcuggguagcugauaauugaaaucaagcacauugugaaauuguccagagagacaauuuaggauaggaagagaaaggggccuagaauuaagccccaagaaauacaacaucaaaggccagauagaugaggauaaaccaaaggaagcagggagauuauaggauuauugaacacagaggaagcauguauuuuaaggaagaacucgugaauaauaacaaaaugcuuuugcucacauguguggucaauccuuaauaagaucuguuucagugaaaugauggcagcagaagccauguuggaauagguugaggagugaauagaaaggagaggauauggauauaguaaauuagacaauuuuguaaaacuggaaaaguuacuuguguuauuaugucaguagcagccaaacauggaauaaaaauccagcuacuuaauuguauguuauguauagaaaaaaaggauggaaauacauaaaaacauuaauguauuugguucaagauagaggaacuguuuaugauuuaaacuuuuuuauuuuuucuauuuuugaaacuaagcaaauauuuuguaauagauaauaaaauauggauuauuggccuugcgcgguggcucaugccuguaaucccagcacuuugggaggccgaggcgggcggaucaccugaggcugggaguuugagaccagccuggccagcauggugaaacccucucucuacuaaaaauauaaaaauuagcuaggcgugguggcagaugccuguaauccuggcuacucgggaagcugaggcaggagaaucacuugaaccugggagguggagguugcagugagccuagaucacgcuguugcacuccagccugggcaacagagugagacuccguuucaaaaaaaaauguauauggauuauuuauuuuucagaagucuagucaagagacagaauccaucuaguuacuugaacagagaaaauuuaauauaaagauuaauuagguauaaaguuguuaacuagguaaaugcuagauuaaaaagaauacucuguaggaaucauagagguggcuccuacaggaagcaaacaggguugacauaauauggggaagagguuuuaauuaguaaaacuuagaaaccuuaagaggaagggguauccgaagcugaaacucagaccccugaagagagugggcuagcagguuauugcuggugcugaugucuuuggggugggugauaaugacugaugucuuugagggugauaaaacugguucuacaaguauuggaaaaacuuccaaauggauccagcugcugcuauaggaagggacuccccuugcugaugugaaggcuuagaaaagcaauccagcacuggggccugagcauaucccugcacauuugugcuagaaguaccaggaaugcaagucccugacugcucuuuauccauauaaucacaauugugcuuguagggaugagguaauguccacccuggauaaacaggcuuacuuucgcuuacuauagaagagauaccacaagcugaguguucuccuauaauguaacccacuguguguacaggcauucaucaugggcccugugcaucaucccagugugauugggguggagguggggcauguauaguccaaugcaaaugaacuugaagcuuuggcugcuacuuuucuauaaauaauaaagccuuuuaucucugacccaguagucuugugucuucugccaacauuuauaaaacugugaaaggcugacuuauuagcuugcaaauauaauaaaaucuuagauuucauuaugaguuuuaaaauuauuauuugcagguucauuuuaagagggaagugugugugaauguguuucugucucuuuguguuaacccucaguuuugcagugaccuucacuugguucugaggaacagccaucuagccuuuaaggguacucgugcucucucagugauacugaaaaauuuauccagaaugaaguauagagagucaaagagggaaaauaagcaaaagaguugagagaugaaaauagauugagagguuucagagaauauuuggaagaagucucagaugaguuuaauggaacaaauaauaugugaaaagauaagaacaaagaggaaauauuaaaagcuaccaaagagaaagggcugauuacuuaaaaaagaaugacagcugacaguggaguucucaguaguaauugaagucagaagauuuuagaguaguaucuuuaaacugcugagauaaaauagcuaccaacccagaauuugaaucugucauucaagagggaagguacaagauaaaagacaaagagguauacacaucaauuaauaaaauauuuuugaggaauuuaaauauuaacuauaaaaauuaagauuagauaaugcaagguguaggagugugugugcguguguguguguggucaagaacauggacucuagagcuggauugucuagguuuaaauucagacuaacugcuuaacuaccuguaugaccuugugaaauacauuacuuauucauuuuauaucaguuuuucuacucuguaaaaugggggcaaaauuaauacuuaucucacuggcuuguugugaggauuaaaugaguuaauauguuugucaucaucaucaccaucauuaucccaacauuuuuguagaacauauuaaaaaguccuuaaagcccuuguauauuaauaucacauauuagggggcuagaguugguauggaaaugggaggagaaaauuuguuuauuuuaaaucuccaccuuuugucuuaauuuauucaacacuuguugagcaucugcuauaugcuaggcacucuucuaagcauugaaaacaaauuuaaaacaaauuguuguaccccuauggcuuaugguuuacugugggguaauaggcaauaaauaaauaagauagauaugugagagagcauguauguauacacauauacagucauguaccacauaacuguguuucagucaacaauggauauguuggugguugcaugaaauuauaauggagcugcaaaauucuuauuuccuagugauguuuuaaugauccugacccuguguaggccuaggccaauguuuguguuugugucuuaguuuuuaacaaaaaaguuuaaaaaguaaaaaaaaaauuuuaauagaaaguagcuuauaggaucaggauauaaggaaagaaaaucuuuuuguacagcuguaaaauauauuuguguuuuuaagcuaaauguuauuauaaaagagucaaagaguuaaaaagaaaaacccuaaaacguuuauaugguaagguuacaguaagccaaaguuaauuaauuauuuugaaggauaauuguaaaaaauaaauuaguguagccuaaguguacaguguuuaaaucuacaguaauguucaguaauguccuaggccuucacauucacucaccacucauccucugacucgccagagaauuuucaguacugcagguuucguucauggucagugcccuguacagauauaccauuuuuaaucuuguauucuguauuuuuacuguacuuuuucuauguuuagguaaacaaauacuuaccauuguguuaaaauuaccuacaacguucgauacaguaacaugcuauauagguuuguaguauaggagucauaggcuguaccauauaaccuagaugugugguaggccuuaccaucuagguuuguguaaguauacccuaugauguuugcacaaugacaaaauugccuaaugaugcauuucuuagcacuaucucugucauuauacaugauggaacauacacuguuagcaguaagcaccaaggagaaaaauaaagugggauggggcauaaaggaguuuaaauuucaaauaggaugguuagggaguccaugaaaagguaacauuugugugaagaccugaaggagauuagugggugaggauauuuuuuguaagaacauuuaauaggcauagcaaauaaaaagacagugaaacgaaaacauaccuggcauccuuagagaacaacaaaagaggcgaguggagcuaauguagagugacugagggacagagugaaugaaggagagugcaugaaggagggggugaagccauagaagguaauggggauacaucuuugauauagguauauacccuuauuaaggacuguggcuuuugcucugagauagggagccauuugaggguucuaaacuguugacuucuauuuaacacucccacauugacugcuagauugagaauaggcugcaaaaauauuaucuuaguaacuuaaguacucuaauagagaaaacaggcauaagaagcauauauagauccuaaugucacuucccuccucaagaaacuacagugguucuauguuaccuauuguguugucuuacuuuuuuuuuuuuggagacagagucuugcucuguugcccaggcuggagugcaguggcgugaucucgguucacugcaaccuccgccucccggguucaaaugauucuccggccucagccuccugaguagcugggacuauaggcgcgcaccaccacaccuggcuaauuuuuuguguuuuuaguagagaugggguuucaccauguuggccaggccagccucaaaccucuggccucaagugauccacccaccuuugccucccaaagugcugggaugauaggggugagccaccacgcccagccuaacuuucguuacuuauacuuuaaagcucuuuguguuaacaagauaucaugaaaaagccacucauaaauugcugguagaaguauaaauuaguaaagcauauauggagggcaaauugguaguaacuuaccaaaauuucaaaugcuuauacugauugagacaacaaauucacuucuggaauuuaucuuagauagccauauacuguagaaacaaauuaaauguccauuaauagaggacugaguaaauaaauuacaguguauccauaaaagaggaaauucugcagccaccaaagagaaugagcugguaguccuuuguaggcugcuuuggaaagcuccccaagguacaaaacaauauguuaaaguaacaaguucagaaugugugauauucuguguuagagagagacaaagacucugaguguguguaaauugcaacagaauuucuguuuuugugagguuugggaaugaggauuuuaugugacaugaccaggaaccauguauaccaugggacugauuuggcacaaaauacaaagaagcuaacaggugguugcauuguaaaaggaauuguguggcugagggacagaacugaaaaagagacuuaauuuuuuacuuuugauacuuuuuggauuuuguauuauuugccugcauugcauacugaaaacuaauuugcaguugccuaccaaaauauuuuucugaaaauagggaagauaagucuaaaauauauuguuaaagaguuuauauauuuauaaauuaagauuuauauacuauguaagggauuuuuucucaaugacauuaggguguuguuuucuuuuagaccugucuacuauaacuguuuauauguuaauugcuauuaaugauacaauauuuuuaguugaaaauuagacaauauauuauugguuuauucuggaagugaauugagcaugcuuucuauuuagaaaaaguucauaggucauuuuaucaguuuuaauuuuauauguagaaaagauaugauacaaaaugugugauuaacaaagauauaguauuaauauuaguuucuagauaagaaaguugauuucuuugucuuuaugguaaacagaagcaauacuguuugcucuauaagguaacuuguguuuacuaacauguaaauguuaauaaagagagaacugauuuuacauuugcuuuuccuaauuaaugagaugaauaugagaacauuauuacaacuuugacuuuaaauuauaauguuuuucuuugggguuuugauguuaaaguagauauugaaggaaaugguaaauuguagaugugugaauauaucuaauuaaaaguucugcuaagaagcuugugccuuguugagggaacuuuggaacaucuuaaugagggacagagugaaugaaggagagugcaugaaggagagaguaauggggaugcauuaccucuaugauauuuccuuaucuacuuguacauauuucucucuaauauuuucuauccccaguaauguugguaugcuuuguuauaauauaaucucaacucaaaauuuugauucauuccagaucuucaacuacuuauuauauuauuagaagaaucuaauaauauuuuuaucaaaaguauuuggcugcaguaaaaagauggaauuuuaaauaacuacucaauuuggagaccauuugagaggggauagacuugaugcauauaagagaaugugcuacuuuuccuaauagaacauuaugacccagucacaguuuggaaucuguaagucaguggucucuaaaguuacguacacacacuuaccuauugggauauacuaagaaaauaguagaaauuuuucuauauacaucuugauaauacuacaugcuaagaaaauaguagaaauuuuacuaucuauaugauuuuaaaaguuuggaaaccacugauauuuaggcaauuauuuuuggauaccaaaaaagcagcaauuggaacugacaaaugaagcauuuauaacucucaaaguaaacuuaguaugugaacucaaauguuuucuuuccuuuucuaucauaugauuaaaccuugauggaaaauuuugagacauaacauauucagaguaauuuaagggcauuuaugcaaauugaguuaccucuuucuuuuguuuauauuuugaacuaaaccuguuuaccuuggaugaaaaguccauagccuaauguuucuucuuaaauuuuuugccagaugaaaauagacuaucaacaccaaaacuauguccuuccuuuucaauuaauuguuguuuuaggccuuuugcaugguuagcuuuccuuaguauccaguuugcaaacaugcucucugauugccaaaugcugccugguaccaaugagaugcuuuuuccuacccugugcucccguguacccaguaccuugugcuauguauacuaugagagagagagcaauaaguaaaugcuuacuaauggcuauaauuuaugaauauucauguuuuaaaucucagauauucaagauuaaagcagugcaauuggcugagaaacuccuuccugccuuuaacacaccuacugggauuccuugggcaauggugaauuugaaaagguaacucuauguggguauucuuauucuggaagaauuauuuugaccuuuuuagucuuagaaauuucuaaugagucacccccacauuuuuuuuaaagacauauuguuuuucucucuauauauaaucuuuguuuucuuuuguguauaugcauaaauguguuucuuuaaaacauuuucugauuuuuaaaauaaguccuuugaaacagguuaauugucuuaacuugauugcaguuuuuacuacucguuucuguaagucuagauuucucuuccucaccuguaugguauacaauauuuguuucuuuuauuugcuuauucauuuccauuuagugcuagaauagagucaaaguacauccucccucuuuuucuuuuuauauaccaccuccugaucuucuaagugaaaauagaaaauaauauaccuagaaaugagggcuuccuauugcugaaugucauauuaaagauaaagaaagacguaauuuaugauguugacugcgggguuuuuauuauagcaucuacacuagugaaguucaaagugaacucuuaagcaucaaucuuuauaaucuguuuucuaaucgaaaacauugguuuuuuacuuagaaauagaugaaauguuuucuuuggacaacuuuauaaauuauguagagauauacaauuaacauuugaauaaugucaacauauuugaacuugcauuuaaguaauuuaugcugacugaaauuuguugugcucauuuuuucuccuaguaaaauuuauucaucauaauguuggaauuuggaaauuaccuaaaaauuugauuguuguucucuuugcacucagacccuuuagaauaaaaguuaggaacauuuauuuuucuggagaugugaaucuaugacauuauuuuuagaaacgacucgacuuuaguaaaauuuuucuaauugaagaacuuuauugaguuuagauuuacauugagaugucagcagcauuuaauacugaacauuaaaucuaacuuuacuaucucugauuucaugcacuauguauagugcagauuaccucuuuggugaggaaaaagcuggcugaaguuccagagcaagcuccauggaaggauauggccaagugauguuguguauacgcuuguucucguuccuuaguuuugugacagauuuugugauauuuccuucaggaucaucgucagaaucagacauuauuaucuacuuagauaauaauuaaaacuuaauuccgauaggaagacagacuggaggcucuuuuuuugucuacauagaggaaaagaacuugaaaaucaagauuaaauugcagaacuucuaauuuaagauugagauuaaaguaaaaagguuuccaaggaccauguugugagcuuuuuauaagauuaauuuuaauuuaauuucuuugguauguaaacaaauacauaauuuuacuugaguuuuuauaucaugaauguaauuauuuaccuauuuaaaacuuuuuaaguaaauuuuuugcagagaagggaucuuauuuuguugccuaggcggaucucgaauuccuaggcucaagugauccuccuaccucagugcugcgauuauaggugugagccacugcaccuagcauuauuuaccuguuuuugaaaauuuuuuuuuuuuuggcuggggucuacgcauuucccacacauaggccuucccuuagucuugaugacugaaagccaacccaucuuaauaaucuaucauauuuaucuucuacaauaugauacagcagacagaaacaaaagcagagcuuuuuuuguaauguuuauuugguuuaucacuuuaauggcuugcuuuucugcuucuuaucuuucucacucaauaauacuccauggaaauacgauuccagguuacucaauaaagaucuaaauaaaucuuugugaugaauaccaagugagaaaugggauaguuauacuauaauuuauucauuaauuuucauaucagugguauuuguuuccauuauuuuccuaccacaaacauugcuacaauagcauccuguuauacauguucuuguguaguaggaauuuuauuucuuggaaaaugguucucaagaauacaauugcuggauuaaaaagcaucugcuuuuuuuuuuuuuuuaaucugugggacagauuucuagauguagcguuccuggaucaaagggauauguauuuuuaaauuuaauagauauugccaaaauguguuccagaaaggcuguaguacauuuccaccaacaauaugugagagucucuaaaugucugcagguauaaauucuuuuuaauuuuugacacgaugguugcuauaaaaucuucauuguauuuucugacuagugaauuuugaacauccuuuucauaaauuuauugggcauguagauuugcuuuuuggugaauugucuauuccuaagucuugcuugaguucuuugucuuuuucuaauuaauuuauaaaguguuuuguagauuauauaauuaauucuccucucucuacucuucuguuggucuguugucuuuauaauaauauaugacucauaaguuuuaagcuuauauauacaaauauauguuuuauaacuuuuaguuuacagucuugguuaaaaaauugucuccaucuauauuuuuuacauucuucgagauuuccauaaaagcuuugaaauacugcuuuucuaaaagaauugaaguauggcauuaguuguggaguuuucaucaguuauaucaauuuccuuuaucacauugaggaaauuuccuucuauuccuauuucacugagauguucuuguuguuguuuuaucaugaauggauguuaaauguugccagauacuuuuuuuccaucuauggagauaaucauaagguuuuucaccuuuauucuuuuaauaugguaaauuacuuguaagauuuucaaauguuaaaucaaccuugaauuccuuagauauuccuuggccauaauguauccuuuuuauauuuugcuguauuuuauuuccuaauacccuuugaaauuauaugauggauauugguaggaauuuuauuuuuggaaugccuuugucagauuuuggugugaguuaccuggucuuauuaaaugagauauuauuaaauuauuaaaauuuuuguuugcagaaauaauucguggagugcuguaguuacuucuuucuuaacuguuugauagauagaccuaaaugcaacuaccugagccagaaauuuucuuuguuggaaaguuuuuaauaacaaauuaaaauuuguguguguguguuuggagggggcugguuuagagacaaggucuugcgcuuuuguaucgacuggaguacaauggcacaaucacagcucacugcagccuugaccugccgggcuuaagugauccccccaucucagccucucuaguagcugagacuacaggugugugacaccacaccuagguaauuuuguuuauuuuuguagaggugggcucucacugucuugccuagucuggucccaaacucccgagcucaagugauccucccuccuuggccucccaaggugcuaggauuacaggugugagccacugcacccugcccaaauuuucauauuuguguguguguguguguguaugugugugugugucuguguguguguauauauauauauauguauauauguaaauuuauauguauacauauaaaagaaaauuuauauauaaauuuauauauauuuauauaugauauauaaacauauaucuuauauucagauuuuguuuuauuuugugucaguuuuaguuaauuuuaaagaaauuucuucauuucacuuaaauuagaaaauuugguguaaagucguucuuguguuacuuuguuuuaccuuucaucuuuguagauucuauagcaacaaccacuuucauuccugauucuaguaauuuguauucuuucuuuucucuuuacuaguuuaaugaggcauuugucaauuuuguuaaucuuuucaaaaaaguacuucuguuuuuguuaauuuuuacuuuuuuuugguuuuauugauuucugguuuauuuuuauuauuuccuucucuuuucuuauuggagcuacuuugcucuuuuucuggcuccuuacauuggaacuguagguuguaucuuucuacacugaucuuauaucuuucucucuuuuccccccauaaacuacuguuuuucuauagagcuauaaauuucccuccaaggacugcuguagcugcauuccagaaauuuugauuuuuuuuguuauuauucaguucaaaauaauuucucauuuccuguagaauuuuuucuucaaugcauuaguuuuuuauaauugugugguucaauugccaaauuuuaggacguuucuuagauaucuuauuguuuugauuucuaauuuaauuucauugugaucauaaaaauuacaauuugaauccuuucaaauuuauuacaacuuguuuauagcuccgcauauggucuuucuugguaaauacacuugauaaggaaguguauucugcaguuguuggguauaacauucuguauauaucaguuagguuaaggugguuaaugguguuuagaucauguauaucuuuccagauuuuuuuuugguauaauuguuuuaugcauuccugaaacgaagugucaaaauaucccaaguaugauuguggaauugucucuucucuauuucugucaauuuuuugcuucaugcauuuugacgaagcuuuacucuuaaguacuuacacguuuauuauaugcuuucugauuacuugagccuuuuguuauuccacugugucuucaucucugguaauguuuuugucuugaaguuuaucagauauuaauguagcugcucuacuuuaugcuuacuguuuucaugguuuaucucuuuuuuuccauuuauuuucagcuucacuguauuguuuuaacuauaguucugcuuuuggagacagcauauaguuuggaucauaauacaaauuuuguuauucagucugacaauauugacauuuuacaucauuuagcaauagaucuaaaaaauuauucuguaucaacacuuuauauauaaucucauuauuuuuaagagcuucauaauauaaugcuuaugaaaauguugugacuuaaaauuaauucuguauuagugaacuauuagauuauuucuagauuuuaauauuaucaaaaaauauuggaagaaguauccugcauauguugggaaugguguguguguguauguguacauagacauguguugguaugacuuuaguagaaauaguggaucaaagaauuaaauacauuuuuucuguugauagguacugucuucuagagaggauaugccaguugacauuuccuuaauaagugugugagaauggcucuuaucgaaccuuuugaaaauaugguuuacuuuuauuuaucagauagauaaauauaaaaucuuguuccaauguuuauuaauuuuugagugagauugaauuuauuuuauucaguagauagccuuuuuauguccuuuguuuguuuuuuauuggcuauuuuuuaaaaaaucaguccuuaagguauuuuuguguauuagcuagauuaguacuuugucauauaaauugcacauuuuuuugcuauuaguaguauaguuugaaguuggguaaugugaugccuccagcuuuguucuuuuugcuuaggaauguccuggcuauccgagcucuuuuuugauuccauaugaauuuuaaaauaguuuuuucuaauucugugaagaaugucagugauuuaauggaaauagcauugaaucuauaaauuguuuugggcaguauggucauuuucgugauauugauucuuucuauccaugagcauggaauguucucccaucugcuuguauccucucugaguuccuggagcagugguuuguaguucuccuugaagaggcccuucacuucccuuguuagcucuauuccugaauauuuuauucuccuugcggcaauucugaacgggagcuuauuaaugauuuggcucucugcuugucugaauauguuuaaaagaaaacugaacauguuuuaaagaaagaaaauaaaauucagauauccaacaauauacuuuuauaauauccguaauccaauccaaaauuacuuuacuuuauggcaugcaaagaagcagcagaaaaauguagcucauuauucuguagcccagagaaaaaucuguucauagaaacagacauggaaauaacagaggugauggagauagcaguaaaggacuuuacauagcuauuguaagugugcuugaggauuuaaaggcaaaugugaagaaugagaaaagagauuuuaaaaaggaccaaaguggaacuucuaaaggugagaaauauaugaaauaaaaaauuuacuugacaagcuugaaggcagauuugacacugcaucagaaaagaucagugagcuugaagacaaaacaauagaaaccaccuaaacugaagcacagaaagagaaauaaaaaagcuggaguauggagagaagcauauccagugaccuauggggcagugucagaugguuuaacauaccuguaauggagugaugggaguggcgaauuugggagugggaggaguggcagaaaaacuacaagcaugaauuguuuuauugugcuucacuuaauuguucuuugcagauauucuuuuuuuccuuuuucuuuuuuuuaaacaaauugaugauuugugucaacucuguguugagcaagucuaucggggcuauuuuuccaacagcauauaucacauuuugauaauugucacaauauuuuaaaacuuuucauuauuauuacaucuguuauaguaauaugugaucggugaucuuucuuauuacucuagggcaccaugagcaagcagucauagaugauggcaaacuuaaucacuaaauguugucucuguucugacggcuccacagauuggccauucucccuucucucuccuucuccuugggcuucccuacucccugagacagaacaaugccaauaaauaaccuuucaguggccuugauguauucaagagacaagaagaauagcaugucucucacuuuaaauuaaaaguuagaaauaggcugggcgugguggcucacaccuguaaucccagcauuuugggaggcugaggcaugcagauugcuugagccuaggaguucgagaccagccugggcaacauagugagacccugccucuacaaaaaauacaaaaauuagcugagcaugguggugugugccuguaguaccaguuacuugggaagccaaggugggaggauugcuugagcccaggaagcagagcuugcagugagcugagauccugccacugcacuccagccugggugacagagccagacccugucucaaaaaaaaaaaaaaaagcuagaaauaauuaagcuuagugagaaagucaugucaaaagcugagauaggccaaaagcuaggccucuugugccaaacaguccgccaaguugugaaugcaaaggaagaguucuugaaggaaauuaacaaugcuaugccagugaaacacaagaaugaugagaaagugaaauagccguauugccaacauggagaaaguuugaguggucuguguagaaggugaacccagcuacaacauucucuuaagccaaagccuaaugcagaggaaggcccuaacucucuucacgucugugaaugcuaagagaggugaggaagcugcaggagaaaaguuugaggcuugcagagguugguucacaagguuuaaggaaggaaucugccuccaaaacuuaaaggugaugggugaagcagcaaguaccaguagagugggacaucgcugaaaagaugccugaaaauguggaacaacuuuggaacugggugacaggcagagguuggagaagaagaagacaggaaaaugugggaaaguuuggaacuuccuugagacuuguugaauggcuuuaccuaaaaugcugauagcgauauagacaauaaagaccaggcugaaguggucucagauggaaacgaggaacuucuugggaaaugaagcaaaggugacucuuguuauguuuuagcaaagagacugguggcauuuugcuccugcccuagagauguguggagccuugaacuugagagagaugaucuaggguaucugguggaagaaauuucuaagcagcaaagcauucaagaggugacuugggugcuguuaaaggcauucaguuuuauaagggaagcagagcauagaaguucagaaaauuugcagccugacaaugugacagaaaagaaaagcccguuuucugaggagaaauucaagccugcugcagaaauuugcauaaguaacagggagcugaauguuaacccccaagacaauggggcaaaugucuccagggcaugucagaggucuucauggcagccccucccaucacaggcccaaggccuaggaggaaaaagugguuucgugggccaggcccaggguccccuugugugcagccuagggacuuggugcccuguaucccagccucucuagcuguggcugaaaggggccaaccuaaagcucagacuauggcuucagagggugcaagccucaagcuuccaugugguguugagccugccagugcacagaagucaagaauugggguuugggaaccucugccuagauuucacaggauguauggaaauaccugccuguccagguagaaguuugcugcagggacacgacucucucucauggagaaccucugcuaggggagggccgaagggaaaugugggguuggagccccaacacagaguaccugcuggggcaccaccuaguggagcugugagaagagggcaacuguccuccagaccccaaaaugguagauccaccaacagcuugcaucaugcaccuggaaaagcuguacucaaugccagccaguucaggcacccaggagguugggcuauacccugcaaagccauaggggcagagcugcccaaggcugugggaguccuccucuugcaucagugugaccuggaugugagacauggagucaaaggagaucauuuuggagauuuaagacuugacugacccaauggauuucagacuugcauggggccuguagcccuuuguuuuggccaauuuaucccauuuggaauggcuguauuuaccuaaugccuguacacccauuguaucuauaaaguaacuaacuugauuuugacuuuacaggcauguaggcggaggggacuugccuuguuucagaugagacuuuggaccauggacuuuugaguuaaugcugaaauaagacuuugggggacuguugggaaggcaugauugguuuugaaaugugaggacaugagauuugggaggggccaggggccgaaugaugugguuuggcuguguccccacccaaaucucaucuucaauucccauguguugugggagggacucagcgggagguaauugaaucaugcuauucuugugauagugaauaagucucacgagaucugaugguuuuaaaaaggggaguuuuguuacacaagcucuuuucucuugucugccaccaugugagaugugccuuucaccuuccaccaugauugugaggccuccccagccacguggaacuguaaggccauuaaacuucuuucuuuugugaauugcccagucucagguaugucuuuaucagcagugugaaaauggacuaaugcagcaugauggugcaugccuguagccccagcuacuugggaagcuaagguaggaggacugugugaguccaggaggcggagcuugcagcgagcugaaauugugccacugcacuccagccugggggacagagccagacccugucucaaaaaacaaaacaaaacaaaaaaacagaaaaaaacccagccaggcacaguggcucacaccuguaaucccagcacuuugggaggccgaggaagguggaucagcugaggucaggaguucgagaccagccuagccaaugugaugaaaccccaucuuuacuaaaaauacagaaacucgcugggcaugguggugcaugccuguaaucccagcuacuugggagguugaggcaagagaaucacuugaaccugggaggcggagguugcagugagcuaagauugcgccacugcacgccagccugggugacaagagcaagacucugucucaaaaaaaaaaaaaaguuggaaauaauuaagcuuagugaggaaggcaugugaaguaauuaagcuuagugaggaaggcaugccaaaaacuaggccucuugugccaaacaguuagaguaguugugaaugcaaaggaagaguucuugaaggaaauuaacagugcuaugccagugaacacaugaaugaugagaaagugaaauaguuauauugccaacauggagaaaguuugaguggucuguauagaagaugaaaccagcuacaacauucucuuaagccaaagccuaaugcagagcaaggcccuaacucucuucacgucugugaaugcuaagagaggugaggaagcugcagaagaguuugaggcuuacagagguugguuauaaaguuuaaagaaggaagcugucuccaaaacauaaaggugacaggugaagcaguaagugcugauguagaaauugcagcaagugauccagaagaucuagcuaagguaauuguugaagguggcuacacuaaacaacagauuuucaguguagaugaaacagguuucuacuggaagaagaugccaucucauagcuaaagagaagucaaugcuuggcuuucaaggacaggcugacucuuguugggggcugauagagcugaugauuuuaaguugaagcuaguucucauuuacuguucugaaaauccuaggaccuuuaagaauuuugcuaugucuacucccuguguggucuguaaguggaacaacaaaguucagaugagagcacaucuguugauggcagaguuuaagcccacuguugaaaccuacugcuaagcaaaaaucucuuucaaaauauuacugcucauugacagcguaccuggucacccauuuucuacagugaagaugcccaagauuaauguuguuuucaugccugccaacauccauucugcagcccaugggucaaggagugauuaagacucucaagucuuauuauuuaaagaaugaauuuuguaaggcuauagcugccauauauagugauuccucugacagaucucagcaaaguaaauggaaaaucuucuggaaaggagucacuauucuagaugccauuaagaacauuugugauucaugagaggaggucaaaguaucaaacaggaguuuggaagaauuugauuccaguccucaugggugauuuugaaggguucaaacucaaguggaggaaguaacuguagcugugguggaaauagcaagagaaccagaauuagaaguggggccugaagaugggaccaaauuacugcagucuuaugauaagacuugaauggaugaggaguugcuucuuacagaugagcagagaaagugguuucuugagauggaaucuauuccuggugaagaugcuaugaacauugucaaaaugacaauaaggauuuagaauacuacguaaacuuaguugaugcagccagugucaggauaugagaguggccuccaaguuggaaagaauuuuuacuguggacaaaaugcugucaaacagcaucacaugcuacagagagaucuuucgucuugcagagaaaucaaacaggaagaaucaaucaauacagcagacuuuauuguugucucauuuuaagaaauugccccagccaccccagccuucagcagccaccacccugaucagucagcaaccaucgucaucaaggcaagacccuccaccaucaaaaaagaguaugacuugcugaaagucucagaugaucauuugcauuuuuagcaauaaaguauuuuucaaauuaagauaugaacauuauuuccacauaaugcuguugcacauuuaaaaggcuacaguauaauguaaauauaacuuuuauauauacugagauacgaaaaaguuugugugacucauuuuguugcaauauuugcuuuauggagguagucuguaaccaggcccauaauaucucugagauaugccuguuuuuaaagaaguaaugucuagaaauuuuucagauuuguuaaacagcuguaaauucacagauuccaacauuugauggaacccagcaggauaaauauaaagaaacaugacgucugaaaaucugugacuagaaaaagaaaaguuaaacagccagagaagaaaggcauuuacauuggggaaccaaaauagaaauacuuccuucuuaucauaagcaauacaauccagaaaacaaucgaauccaucuugaaaguguugaaagaaaaaagucgaucucaaauucuauagccacugaaaauauucuuuaaaaacaaaggugaaauuaagacauuuucaggcaaacaaaagcuuagagaauuuauugccagcauaccuguauuguuagaaauuuuaaggaacuuucuaaugacaacagauggaaaaacagauuuacacaaagaagggaagggcacuggaagcaguaaauauuugaauaaauauaaaaggcuuauuuuuucuguuuuggucuuuguuuaaagcaaaaauaauaacucgcauaguggggccuauaguauacauaggagaaaaauuuguuaccacaguagcacagaggauaguauggagacgugaagcccuuacauuauaugugaagugguauaauauauaaaggucuacugugggaagguuaaugguuuauguuguaaugccuagagcagucauaaaaaaauaagccgguaaagaaaauggaauacuaaaaacuacugaauccaaaugaaggcaggaauagagaaggaaacaacuaaugggaaaaauagacaaugaaaaggcaagauaguaaacuuagguugguaggauguaaaaugguagagacacuuuggaaaacaguuugacuguuuuucaaauguuuaucacaucaauaggauauagguaaauaguugucauauucauccaauggaauaccauuuagccauaaaaagaaucuaacugcugagacacacagcaauaugggugaaucucaaagacauguugagugaaagagccaaacacaggagcauauacuguaugauguuuguaugaaauucuagaacaugcaagacuaaucaguagugagaggaagcaaauugagaauuguuugagacuugguggaggaaguguguguguugauugcaaaagggauaaggacauguuuuggaaggauugacuugguuuguauaccagucuuuguuuucauuugucauaacccauugaaugguguaccugaaaggaugcauuuuuguauguaaauuauacgucaguauauacuuaaaaagaaaaauaaaccagauccuacacuuggcugaggggcuguguaauaacaaaaaauaacauuaccuuauaauugaaggacaaucuuaacuuugaaaacauauuuagaaaaaaguuuguaaaaauacagaauuaaaauuagaagagaccagugaguauuuaaaauguaauagacaacucaaauuaugcuuaugcaguuuuccagaaggauagaugagaauguguuaacagauugcuuugguacugagagugauuggaagagguagagggcuuagagagauacuuuuuuuuuuuuacuuuaugcuuuuucagugccauuuaaauuuuaaaucaugaguauauuacauauccucucaaauuaaaugaaaauguaacaaaaaucagacuucauuuuaaaauaaaaauuaaagcuguuauauucaucugcugucaaacaaggaaguuuuuacuuaaaaaauuuuuaaagcaucugcuauaauaaaaaggugagaagaaagccauucuuacauuucagcuuuacuuguagacuaguguauuaucugucaaaagcccuuaaagcuuguuucuuuugacccagcaauucaaccuuuguuaaugugcccgaagaaauuggauguauggacuaaggaagacaucuacaaaauuauguuuaucacggcguauuucacaaaaucauaaguacagguugaacguucaagaguaaggucauuuguuaagcaaauuugguaguccauaagguaaaacaauauguugccacauaaaugauaucauagauaaaauauuuacaguauauuaaaaauguuuuauaagccagauuauggcaucauauaaugagaaugaccauauaguguguuguucauaagaguacaauuuaagaaugaaugggggagcugaaauaauuaaaacuauuuaauuuucugaguauuuaaucacugacaaauugguuuuauuuuauuggguauccuguaaaauaauucugcuauaaaccuauuuucuaaaaugaaauuauuaaaaacauacauucuuguguauuuaucuaaauuugaaauuauuggcacuuucaauugacucuuguaugcuuuuauuagagaagguauucucccuacaguugcucagagcaaauucugcuuaauuuuaggauauucucaauucuaaauuuuugcauauuaaaauguuuaaauauuucagaccagauauuuuuacaaaucccauucuuuugcuuucauucagaauaccuuccacaaaucugagauauuuuuacauugacuuuuauuuguaauuauuuuaaauaaucauccaguuuagaugauacagaaucauagggcuucucaauuucauuccauugaaguauacaauauaaauaaaucuaauugaaaauaggagcuccaucaaaccauuauuccuacaaaugaagauacuucaacuuaagcuuacacauugaguguuuuaauuucuucaguucauucuuugcuuuugucggaaugcauuucaauaucaguguguuugcaagcuuuguuucuaauaauugcaguuuacugaaagcuuuacuccauucuuucaauacauugauuaaauauauucgacugacuuugaacaaaaugcaaaccaaaauauagaagacucauuaucaaaacaauuuaauaugauuguagaccacuuagggugauuuacugucaagaguuuaccaaacauuuuuagaaucuuuccuuuugcugguggucagguaagagaaacauacguuuugcuugcuuguuuuuguuuuuugguauucauugcaaauuuuuuguuacucagguucucugaguauauacguaaauuuuaguauccagaccuuuuauuuugaucaguugagaaaaaaacauaacauuugcaugaaaugaugauccgguuauuuuuuggcagcucaucaucauuuuauaguuggaaauuuuguccucggcagcauuauaucuuguucuuagggauuuucuuauuuuucugaguugcuaggauauauguaaguaucaaauuuaauauuuuagauucuuccugugacacuauguaaaaaauuuaaaaaccuuauuuagaauuuaguauuuugaaaaguguuacuuuuugacuuuuggcgagauguucuuuuuauagagaauggcaaacuguuggacuuccuaaguuuuguuuuuauacuugaccacacuauaauucauccgcuaugcugaaaccuaguuaaucuuucuaaaugguaugcuuuauuccuuaaguauuauguuauaauccuuaaaguuauucaugacuuuccaucacacuuaaagacuaaaauuuuaccauggccuacaaaauuauuucauaguccagauuauaccuugcuuucuaaccucauccugugucauucacuuccccuuacuuucugaacucuagccaaacuagccuccuuccuuucccucaaggccauuacaucugcuguuucccuuacugggaauucuguucuuccagauauuuucauuaguggcuccucaucauucaggucucaguucaaaucauaucauuuuagaaacauuuucucugaacauaauauguaaaaagccuuuuuuguaacucacuuucuaucucuaguacucaacauucuauuuuuccuuuuuaauuuucuucacagcaacuaucacuauuuaaaaugaucuuauuuauuguaggagcaggaauaguauaugucagguucaccacucucucacagcauaguaaacacuuacauuugugaaaugaauuacugucuuauguaguuacuauauccauauuuauucuuugauucucacuucuagcuauaaaauauccuagugguauuugccuuccauauuuucagacaguuuaaaaauagcaccaaacaaugaaggaacuuuaagcaagguugugauauguucuuacaucuauuuuaauguucucuaaacacaaauaaaauauaacauauugaauugacagaauacaagugaauauaagaugagaaauauauauauaucuauauauauauauagauauauauauauuuuuuuuuuuuuuuuugagacagaguuucgcucuuguugcccaaacuagaaugcaauggcgcaaucuuggcucacugccaccucugcauucuggguuuaagcgauucuccugccucagccuccugaguagcugggauuacggcgccugccaccauguccggcuaaguuuuuguauuuuuaguagaaaugggguuucaccauguuagccaggcuggucuugaacuccugaccucagguaaucugcccaccucggccuccugaagugcugggauuacuggcgugagccaccgcgccuggcaaaaauauuuauauuuauacuucucccaaaaaauaagacaagauccuagagaauggucuagaguucuuguaggaauaauccaggaacucugcugcuugaaucaucuagacuuccaguuccaaccaggaaauacuguuuaucagacuacccuucuaccaaaagcagucaugaaagcuagacaaaauauauaaaaccaaaugguuugaagacacugaaaugcaauuagguagagcuugaggggcugugauccuaaggucaucgccauauaaacauuggcuuuuucccugaggauauguucuaaaacauguucagagcaauagaggccauaucuaaaguggcagucauuucgggcagaggagacaauggucaggccccagagcugcuaaaaugacugaaacauagggacaaaaucucauauagaaagaaauugcagaggaaaagcccaaaauuuauggacaaauuucccugaagucauuggugauuccauaaccacauauauggggcaagcaagacucaaagaaacccagcagaaaauagcagaagaaauuuaagggcuaaggaggaaauuuaacagccacaugcuaguggggaaacagagguuaggcugcuuaggugcccuugguaaauaccccuggcuuccaacugaaauucccagggccauuucuggaaguugggguaaaaacggaaauggacuauuuuuaacaaaaccuaaaacacaauguaaucugcauuuacucagucuguguucagaagaaauuuaaccuuuuuagaagauaaugucauucaaagccucuacaauuuuucauuuuauguaguuugccuucagauaaaaaauuacuagacagauuaaaaaaauaaaacgcaagagcauauucuagagauuauaucugcacaaaugaaauguuuaugagauuauucacugaaaaauguucaugguaacaaaauauuggaaauagcccaagggaccaucaauagggaauuuauuaaauuguguauauuuauguaauauauuaauuuucacacaggcacuaucaucguuuggugcaagccaguucuuuauuguaugauacugucccgaucauucacuacagggcaguuuauaacuuuggaccuggcacaauaaguggagguugcacauucaaauuuugagacaacucaaaaugcucccacacauuuucaugugccucuaggguggggcauuccacuugagaaucauuaauauuauggaauuccguacaacuguaaaaaaaaaaaaaaaacugagaaaguuguuuaugaacugauauggaaagaccaccaacuugcuauguuuuguuuaagaaaggaggacaaugagcauauauauuuggauugccuacauuugcauaaaacauucuguaguaauauguaagaaacgaaugaaagugauuuucuguggagccugaugaggugaauggagaugagaaugggugaaauguauuuacuggauuuaaaaacuacuguuuuaauuuuuagaacauggauuuauuaccuauuuaaauuuuuaauacaauuuuagauauaaauaagcuaucgugucagauauaauaauuuauaagagaucuauuuaaaauuuacauauucauuaaacgaauguuuuggucuuuucccaauccugugucuccuuuuacuuuuccuuuucauucaguggaguagggcgaaacuggggcugggcaucugcagguagcagcauucuggcugaauuugguacacuacauauggaguucauccaccucagcuacuugacaggggaccugacuuacuacaaaaagguuuguuuucuugccuucuauucuuuguuuguuauaaagaguccuuuaagauuggcccaaagauuugauuaaugcuuaaaagguuugccuuucuagauauauguuuauuagggcuguagccuuuauuuuuucuuuugaaguuacucaaagaaauguccuuucuauuuagaacauauuuaaaauauguauuguuauuugagaaguuauaaccacuguuacauuuuucaaaaauuucacugcuauuuuuaugcagcauugugcugcgguaccuacccagccugguaagacaagaaaaacaaaauaaccagauguuuaggaauugaaaaggaggaaagaaaacaguaguuauucacagauuacgugauuauugaccuaagauauuaagacagucuauauuuaaauuacuagaaauaagaguuuaauauguuuuuuuaaauagaugaucaauauggauguuaaaaaucaguagcauuucucuacaccagcuacaaaaggcaagaaaaugucauuuugcaaaaagauaucuuauguaauagaacaaaaguauauauguuuccuacaaauaaaucuaacaaaagauaaaguucaaauuuuuacucagccauggaaaagaaugaaauccuuucauuugcagcaauauggauggaacugcuggaggacauuauguuaagugaaauaagccaagcuuagaaagacacguauuauguguucucauucauaugugggagcuaaaauaaauugaucucacggagguagagaauagaauggugguuaucagaggcuuggaaggguagugaggagagaaggauaaaaagggguugguuaguggguacaaaaguacaguuacauagaaugaauaagaucuaauguuugauagcacaauagagugacuauaacaaugauuuguuguauauuucaaaauagcuagaagagaagacguagaauguuuccaacagaagaaaugauaaauguuugaagugauggauguuucaguuacucaaauuuuaucauuauacauuauaugcuaguaucaaaauauguauaacucuuuauauccauaaaaauuaaaaauaaaaauuuaaaaauacaaaacuuuauuaaaugauauugaagaggauauaaauaaauggagagauaucguauuuauauauagguaaacaauaucauaaaaauuucagucauccccaaauugauuuauagcauaaauucagugccaauaaaaucucuaauggccuuuuuccucccaguggaacucgaaaagacacuucuagaauuuauacaguaaagaaacauucuagacacuugugaggaaaaacacacuggcuggauuuacauugcccaguuaucaacauugacaguauaguauuuguuaauagggacaaacagacugacaaacagaauagauagcucuuaaacagaccuacauauauguagaaacuuguuuuaacaagugucgcacuguggauuauaauaguuaauuccaggaauauuaaaggcuuaacuuuaaaauauaaaacccugacacuuugagaauaaaaaaauauaugcccuugggguaaagaaggauuuuuacaaugggaaacaaaaaauauuaccuaguaaaaauacccuguaacccagcaauuccauuauucgguauguacauuuacauuguauacguagaagcauuguuuauauuggcaauuuauauaauaaaauacaaaauaguaaugaaaaaugaauuauguuuauaucuguuaguuaaaagaauaugauacaauuuuuauaaaguucaaaacaaagcugaacaguauauugguuagggauucaaaaugguuuugauaaauuguugaaguaaaaauaauauauagagaugaaucucuaaauuaaauguuuuauuuggaagcacagaacuccaauucagggcauacacacagaguagggugguugguccucaguacauccagagaacaaagagaagguuggaaguuuuauuagaaauguuauguauaguuuugaaaggaaauguguugacacgaguaaagcuucuagaagcugucuggcucugauuggugauggcaguagauaaaacuauaaucuuaggguuauagcagcugagcuuguggaaaacguaauuuuuggagcugguguuaugugccgcaggugauuuucugcugggccccuugacucugauuuaguuggguaugacaagaaugacccaauucguauaauuugcuuucacaaagucaagauaaugacaaauaugaaacucaagacuacagauacaucugggauauggggaauaguaugugaaugggcagugaacagaccaucaaagguguucguaguguuguauuucuuaaauugagaugugaguagagucgagauauauauguauauuccuuucuguguaugaaguacuucaucaacagagaagaauuuucaggaaaauggaacuagaugacauaauuuucccuguucugacuaaauaaauaauaaaaauuaaauauuuuuauauuaauuauguuaaaaauuauuuuuauaucaauuauauuaauaaaaauauuaaagacaguacaaauucaucaaaggcaauaaaagaaggaaaaaauguaacuucaugucauauuugauaaccaaaauaaacaaaaacgaaaagauuucugauuucuggaaugagacauaagucugcuuccuaccguauccugaaaccuuucugggaaaagagagucagccaacuccuaguauucccuaucugucuugccagggagaccagugcccagggcgucaaauauguaauugccuacagcuccagcagaguucucaccucucauccuuccugaacacauaggcuucaagugaucaaguagaaguacacuaguacuccagaucucaaauuguauccaagaagggagaaacacacacauacacacacacacacacacacgaggaacucaaggagaaaucaacaaaguucaggucagaacugacccugguaaaugugaacaagauaaaacagaaagcauggcaauugugcaaacauacugcuagaaacaaaagcagagugguauauagcauguagaagacugauaaagaauccaguuucaaauuuuaaaaacaguaaaaaaaaaaagucaccaugaguaauucauaccauaauagaaauuaaauuuaacagaguuagaacucagaaccaaaauaaaacaauaaagugauacaaaaauauuguggagcuaaagaaacaagcugagaccuaaaaugauguauccccauagcuaauggaaaacaacaaagaacucguugcacauaguuaaaaacugaauuacuuacauggaauaaaagcaagagauagucauagucaaaacaaaggaaaagcagagauuaaaaagauaauagauuuguaaaauaaacauaauuuaacguaugggccuuccugaaguagaagaccuaaaucauaggaauuaaccuaaaagcugcaagaagaagaaacacugcugggcacagugguucacaccuguaguaccagcacuuugggaggcugagguggguggaucgcuugagcucaggaauucgagacaagccugggcaacauggugaaaccacuucucuaccaaaaauuagccaugugugguggggcgugccuguacuccccagcuacuugggaggcugaggugggaggaucacugaagccugggaagcagagguugcaaugaacugagaucgagccauugcacuccagccugggcgacagagcaagacucugucaaaaaaaaaagaaacagaacacugcaaauuccauuucuaacaaaauuaagggauacuugaugcuucauaacaccaaauaggaagaaaaguaggcauauaagcaguaaagaucagagagagguuugguauaaauggaagagaggauguuugggucugcagacugaaaaauacaaagccaguagagcacaauucucuaaauuagaugguguaacuugacauacaaaacucaaauucucaugagcagcaaugagaacaggaucacaggcuaauggugaguacuucuuuggaccuuacuagauauaauguguugagaagcuggaaaaacagaaucgaguaagguuucucacagacaagcuguuugcgccugcgaacuuuggugagggaagggaaugaaugacagauucacuauugugcugcauuuccaaucucaaguggcuggggagaagcaaagucuaaaaaaaacauuuaugucuggacucuuaccugguguuuuaugucaaaacuuucauucaggaaaauaguaaugaguaauuuguuaaaaaagaacagguacagaauuuauacaaagauauuaccagaaaaaaggaaaaggagggaaaauugugggcacaaaauacguaaaagagcaauugaaaauuccaagcaaauaucaccaugagagaaaacauaguaaagccuucaucucuguagaacaaguauauaaacagagauacaagagcucagagacaauaagaugugauaucaguaacaaaguauaagaaaaaauaguuaucaacaaaaugaaggccaaaauggaagcaauacaaagaaaaacaguguucaaaauauaaggagcuuagaagacaaaauugagaaaagcuaguaaauguguggaaauaaaaggagacagaaagaaaaugauagauaaggaagaaaaagaauaguauacaguuuuuggaugacagaagaguuaacuuucucaccuuuuauaacaucauucagaacuaucuaaaaaguggucuauggaauuuuucagauugagauuguuauacauaguguuggucucaaaugugaaagaacacagguaauauagacagcaucccugaguccauuccuaaaacuacuuaaagacaaaauccagccaaaugaaugacgaugggaaaccuuguggcagaagaauugauauuguacucagguccagaaaagugaaguauauaucagguccucugaaaaagaaaguuuucccaaguuuauaccagccagguuauucaucaaauguaaugacaauauucucaaacaaauaagaguacaaggaacauaacaccuccucccaccuccaggggcccccuuaaaagcacuuacaaaguucaccuaaucuauaguugaaucaaaauaaaucccuaggaaagucuccagcuucuuaauauauuucaugauuuuucuuucccccuuacucucagggagauauuuuaaaauuuggaauuucaggaacuuaaagauaucuauugugggaacaauauuuaaaguucaacaguuuguuuuacuucauuuacuuuuuuaucuguucaauucaaauuaauaacuuuucaaaauacaauggcauuuuaugauucaauuccugugaaguuauuucuguucuuauauuugaauauauauguguugacugugucuagaaugauguuuaaaauaacugauguuucagaugguauuucuagguaguagcauguugagauuuaaaaugguuucuaucugugcaguuuucucuguauuauuuuuauuauugcuugauuuuaaaauaaugaacacauaucaucuuauaaaaaugagucauuuaagaaauagaaggcuucccugacuucccccugccccuccaacacacacacaaaggcagggaauagguguagauucugaguaagaaaaaacacaaagccuacauuaaaaccaagccuugaugacacuuauuuuuauuaauugcauucuuaauuuuauuuuacucagguuaugcacauucggaaacuacuucagaaaauggaucguccaaauggucuuuauccaaauuauuugaaccccagaacagggcgcuggggucaguguaaguauucuaguauaccugaggcuuucuuaaaaaauuauuugucugaaaacucuuugcuugauguuguaaaaaguacacuacguggaguuagaaacccucagugucuaaccuuguggucugcuggugcuguucuuaggcauguuucugaucucucuuagcuucaguuuucccacuuauaaaauggaaauguuaauaacaugucuccuaagaguauuuuauuuccuguauugcuaaaauauaguguggcaguuugaagguuguacuuaaaaacucuuauuaauaaauuauaucuucauguaaauaaaagcacugcuuaggagagggagguagaggaggaguaugaaaaacaaaugaguauuuacuagaaggggggcaguuguucuuggauaagccaugucuguucauucauuuuagaagagggcauccuggccuucauuauuuaccagucucugugcuaaguucuuagaagagauugagauggagaaagaacauagggcuuggccugaauucacaggcuggcaggauaggcugacacauaaauguuacuguacaggaaggaaccaauuguuauaugaaacugugguaaaaaugauucccucugccugaggggaaaguauuuuguuuagggagaggguaauuuuucuuauuagaacucauuuauuuuugaaggaauugauuuuuaaaaguaacaacuaauauuucuguggaaauguggaacuuacagaauuuuaguaauuguagguuuaucaaugcuauucucuuuuaaaaguuaggaaaacaaaaacaaauaauagagauugcaacuuugccgcuaauaaaacaugauucaguuauuuuugagacuaaugaaaucuuaaguaguaaauaagagacaaaaguaaugaucauuuaauuuuaguauugaaaacacugcugauucugccaguaagaaaauaagcuggugugaguaccaagaauaggaaaacauuugcccuggaauugucuuuuuguuccuuucuaggaaauugucuuuuauuuuaugaaaggaaagcagauaggucaauauaauuaugucuuucauggaucugggaauagaucucaaucuucuuugacucuuuuuauacuuacuuuuccuguuuccugaaauuauuuacauaugacucauuuuucucuuuauuuugaagaagauaaaagcucuaaugccuagacugagugggaaugauauuuucuggaaaaacaaaacccugagagcugcauuucuaaaauguaaaaacguaguuuucuuauuucagauaagagugacuggauuggaugucuacuuaguaauuuggaugaauucuaucaaucauaaaucuuuaccccugugaguuguauugagauuugagaauauuaugauaauauaaugauauaauaauguauaugaaaaauuauguucaguuccugucuuagacuauaugccaguguauauucuauaugguauuacuauuuaaauguaaaagaugaaaucauaaaaguacuaaaaaaaggguugaauauauaaucaggaaagccuuuucuaagcaugucauguaaaacagaaacuacaaaaaaaagaugucaguuuuccuguauauuauuguuaaccucuguauuagucuguucucaugcugcuauaaagaacugccugagacuggguaauuuauaaaggauagagguuuaauugacucacaguuccacagggcuggggaagccucagaaaacuuacaaucauggcagaaggggaagcaaacacauccuucuucacaugguggcaggaaggagaagugccaagcaaggcggggaaaagccccuuauaaaaccaucagaucuugugagaacucacucauuaucaagagaacagcauggggguaacaucuuccuguacccacucuccagaguguauauauuuguaugcuuuuugagccagcaacucauuuccagcaauuuauuccaaauaaauuuucagagcuauauauuaaaguuuauuuacaauaaucuugggguuguuuauaauagggauaauuuggaagcaaucuaaagcaguucuaucuaacagaacuuucuguaaugaggaaaagauccuauuaucuguauuauccaauacaguagucacuagccacaugugaccauggagcacuugaaauguugcuaguaugguuguggaauuacauauuaaauuuuaauuuaauuaacuuacauuuaauuagcuacuuguagcuagugcuucuacauuggacagggcaguuuuuaaacgucuuguaauagggauuugguuaaauacauuuuggccuguccagauauaguauacuaugcagccauuaaaaguuauauuuuagaauaccugacauagauaaaugacauaucuagaaagauauuuagaaaaggagaggaaacacuauagaaauagaaaccaaaguguuaugugugguuuucuuugaauuuguguuuuuauuuucuccuuuucauuuacuguuacuauccagauuugauuaugaacaucuauuacuuuugauguuagcuuaaaaacauuuuuaaauaaaaagagaaucccauuuuccaugccaguauaaggauacucagaaaaguaaaucacaguuugagaauugccagccuuaaaaugaucaaaaguacaacauugaugacauggaggcaggagagucacuugaacccaggagguggagguugcagugaaccgagauugugccacugcacuccagccugggugacagagcgagacccucucucaaaaaacaaaauaaaacaaaaccaaauccaaaaaacagaacucuuucucuucaacguuguguugagaaaacuggauagccaugugaaaaauaaugaaguugaacccuuacucuauauuaucuacaaaaauuaacucaaaacagaucaaagacucuaaauuugagaaccaaaacuguaaaacucuuagaagaaaacauaggggaaaaucuucgugaccuuugauuugacacuggauucuucaauaugacaccaaaggcacagguaacaauacaaaaauaaaagauaaauuggauuugauuaaaauugaaaauuuuugugcaucaaagcauacuaucuaugagaaagaaagacgacccacagaaugagagaaaauauuugcaaaucacaugucuuuuaagggucuauacacagaauauauaaagaacuccuacaacucacuaacagaaggcaaacuaccuacaacucaacaacagaaggcgaaucaccaaauuaaauaaugggugaggacuugaauagucauuucugcaaagaagauaugcaaauggaaaauaaguacaugaaaaagaugguuaacauuaaaauacaaauaaacucacugagauaccacuucacagcuacuaggaagacuguaaucaaaaggaugaaaaauaagcauuggcaaggauguggagaaguuggaacccuuguacacugcuaguaggaauguaaaauggugcagcugcugugaaaaccuagcaguuccuuaaaaaguuaaacauagaauuaccauaugacccagcacuucaucuccucuguauauacccagaagauuugaaaacagagacucaaacagauacuuguagccuaguguucauuacauuauuuaugauauccaaaaggagaaaguaacucaaauguccaacagaugaauggguaaacaauaugugaguauaaacauacaauggacuauuacucagccauaaaaaggaauggaguucugauacaugcuauaauauaaacaaaccuugaaaacauuaugcuaaucaacaaaagccagucacaaaaggacaaauauuguaugauuccacuuauaucaaauaucuagaguugucaaauccauagagacagaaaguagauuagaguugaccagaggcuuuggaugagaagaaaguggagaagaaaauggagaguuauugcuagaguuuguauuugcagugaugaaaauuuuuggaaauagguaguggugaugguuuuacagcacugugaauauaauuaaugcugcugaaugguacacuuucaaaauaguuaaaauggcaacuuuuguguuauauacauuucaucacaauaaaauuuacaacaaaaaagauaacuuuuauuccucuguuuuuuccucacaaaauaaauucaaauuacuuuauaauauauucacucucagcaguuuuuaauuucaguguuauagaaagagcuauucacugguuauuuuggcagaagaucuuuaaaauccuagcgagcugcccugauauccuuuuagcagcuguaguccuuacagaauuguccaauuuguuccuuuuaauguuuuuguauauuuuauaucagccucugaaaaguauaucaaauuuuauuauuaucuuugagcuauaugcaucugucauauuuauaaauagucugcaaaacaaacauuuaauugaacugaaauuuaacaauucagcuuuggcuaacuguauuauaauuagaguaaugauaaugucugugacaugcacauagcaaucacagaagauaauuacugguaauuaccuucaggaaaagugcuuggcaacagauguaaaagaauauagcaagaaaccuagauuuaaaggcaaauuacuaguuuuuuuuucuuuucuaaaacuuuuuuuuuugcuaguuuucuaagcacaauacuuagccuaugucauuuaaugauuaaagugaagaaaauauaggaaaucagucauuacugauucauuguuuuauauuacuaaauuuauaauuguggaaaaaacaagaauggacauguuaugccccuuugaguuagaaaaugaauugauugucuugcuuaauaauuuagauaauuuauuuaacuucucuaugcaucuuuaucuguucucauuguacuuauuuaauagaaaauucauguggaucauauuuauaauauguuugaaaaugcuucaaauuaguuuuuauucuagaauuucccauaagaagacuucaagaaauagcuucuguuagaaaccugccauuaacuguauaacauguugaaauaaaucauaugaaucauugcuauuuaggaguauuuuauaauauguuaaucaauuucugaauaucaaaaggaccuuagagugacaugguuuaucaaauuugacauguaggcauauaaucuacaggaaagagaaguagcuucaaguuccuuagugguauccuuuugcuuuaauguaauuucagauguucuguaaagcaagauggacagaauucucacuugagaagguuuuuuuuuuguuuguauauuuuguuuuuauugaagauaauugacaagaaaauguaaauucucuguucaauaauaagguuaauuuuguuuuaauaugauuuguuauuauaacauuucuaauucacauucuuccuuuugcacucagugaauauauauacucuguuaaaaguuaaacaaggcauauaccauaaggugucauauucagauacugagaagaaaccggaucagguuuugagaaaacuaaugaaggaacaagauuaguuuuauucuguuaaaacugucuauaaaauacauuguaauaaauaggcuaaauuaggaaaaggaaaggcuuacagcagaaggacauacuagaaagcuaauauaauacggaucuggaucuaggauagcugucugugggagugguagucaucauagauuuuaucuuucccuuuguauccuacauucauucuucacuaagucuugucaguucugacuauuucugaaauauucguuuccccauuuuaacugcaccuuuuuccguuuggaauaccuuccgccuucucuauguccucuuaucaauaaauuccuaccuauucaaugaaaacagaaaaggaaaauccuaaguuaaauaaacuauucaaauauaguaaucucucuugcaaccaccuguuagggaaaaggaaaaauauuaggguauauauauaaauacccauuaaaagauuaauaucaauuuuaugugugauaguauuauaggaauauauuuucucuacaggauguuugcauucacuaauuucacugauacuaaauaucaaccacuguuccagaugcuagguauauagaugugaacaaguagacagugucccuaauacccuuggagaacuuacauucugcuggagagauaugaaauaaacaaauacaugaugugauguaauauaaugguaagaauuucuuuuuucuuaaagcacuuuuaguuucuaggacaauacauucuuuugcuuuucucauagccuuacuuagcuucaugcuucacucagucuuuuuauuauuauuauuaguuuucuccuuuucuccuagccucuuaguguuggaaugccuuagagcaagcuugcccaacccagggcacuggauggcuuugaaugcagcccaacacgaauugauaaacuuucuuaaaacaugagauuuuuuuuuuuacaauuuuuaaaaagcucaucagcuaucauuagcguuaguguauuuuauguguggcucaagacagugcuuccaguguggcccaggaaagccaaaagauugguggacaacccugcuguagaggucaguccuccauucucucuucucuccagugucauaguuuuaaauaccauuuacaugcuggcaucucucaaaucuagaacucuaguccucaccuuguccuuggccucuguacucauauauccaauuaucuacuugacauuuuuacuuaaauaucuuauagauaccugaaacuuaauauaucuguaaaugagcucuuccuaauaauucuauccaccucaaaaccuguuauuccuccagucuuucucauuucaguuaauggcaggucuauucuugcucaugccauaaaucuuguugucauccuuuacuucuuuaucucacaccccacuccaguuucucagcaaauucuguucugucugccuuugaaauaugucuagaauucaauugccacuacccugagccaagucaccaucucuugccuggauuguuauaauaaauagcauccuaauuggccuuucuguuucugccucugccccuuucagucuauuccuaauacaggagccaguaauuuuuuacaaaguaagucacauuaugccauuuuauuuaacucuucauuacuuuucaugucagaguaaaagcuaaaguccuuuuggggcccugugaucugguucuuauuaucucuuuuccuucauuuauucuucuccaacuacauuggccuucugucacuuguugaauccauuaggcacuucaccaccacagagcuauugcagccacuacucccuuugcuuggaaugauuuuucgagagauauucacauagcucaaucccucacuuucuucagguuuuuuuacucaaaaguuaccuuuucaaugaagucuucccuggucaccuuacgugauaggcggaaguacagaaaauugaaagacauguuuuauagauuucuuccaccgagugguccauauuuucucugugaauuagaaggcauuuaacugcugauagcagagaagaagguagagcaguaggggacuuaagacaaauaacaaauaucuucuucaggaaauaggaaagaacauuaaugaaggaguuauaaaaaaguugacaggcaguguugaggcucauguugauggugaaaacgguaaauuuggagguaauaguaaaacagacugacagcugggcugacccacaguugauguuuaacugucuggguacaacaggagaacaguggaguaagggucuugaaugguuggacaagugggauuaccuguugcuuccuuucguauucaaccugacugcaaaggauccaaacuuauuugagaauauauauauguauacuuuucucuuucuauuuuaucuaacaaaucccaaaacucguaucaacccagccaccuacuuuucccauuuacauacagagucaacuaagcauugcuggugaaaauaacaguacagauuaaaguuacuauaaacguacaauuuccaguuuuauguggaucaccaguauuccaugaguuuuuuuuuuuuacuuugaucaauuuacuuuccuauucuuuacucuccuuaaguuuucuauguaaccccucuauccaucuccagcucuuauuuugaccauuucuuuauuuucaaguuccuaggcaauuuuaguuuagauauaucuuuaguaaaaauaguauuuauauagauuuaaaaaauuucaguuugagagucucaguguuuuaaaaacugagucaaaacaacuaaauugguggagguuacugauagauuuggacuaauuccaaauauucuuugguuuuguuuauuuuugaaaaacugcuuuauuaagauacaauuuacauauaauaaacuguacauauuuaaaauguacaacuugguguuuuaaaauagguguacaccuauggaaaucaugaucacaaucaaaauagugaacauaucuaucaccccuuuuccucauacccuuacauguuccuucucucaaccuccucccuucccccucccccaaaacaacuacugaucugcuuucugucauuaaagcuuggguugccuuuucuagaaucuuagauaaauggcauccuuuauuuguacucuuuauguggcuucuuucagcauaauuauuuugagauugaucuauguuguguauaucaguaguucugaguggaauuccacuguauggaauaccauaguuuguuuauccauucuccuguugauggacauuuagguuguuucugguuuggggcuauuacaaauaaagcugcuaugaacacugacuuacacaccuucauauguucucacuucucucggggaauacuuaggaauaggcugcuuuuaucaaauaguagauguguauguuuaacuuuuuuaaggaacuaccaaguuguuuuccagaguacauauaccauuuuacauugcuaucaguaguguuucuccauauaccugccaacacuugauaugaucagucuuuuaguuuuagccauuuuauuacauuguauuuuuuuuuccuuuuuuuaaaaauuauacuugaaguugugagguacaugccagaacgugguuuguuauguagguauacacgugccauggugguuugcugcacccaucaacucgucaucuacguuagguauuucuccuaaugguauuccuccccuaccuucccacccaccgacaggccccggugugugauguuccccucccuguguccauguguucucauuuuucaacucccacuuaggagugagaacaugcaguguuugguuuucuguuucuguguuaguuugcugagaaugaugguuuccagcuucaaccaugucccugcaaaggacaugaacucauccuuuuuuauggcugcauaguauuccaugguguauaugugccacauuuucuuuauccagucuaucauugaugggcauuuggauugguuccaagucuuugcuauugugaacagugcugcaguaaacauaugagugcaugcaucuuuauaguagaaugauuuauaauccuuuggguguauacccaguaaugggauugcugggucaaaugguaucucugguucuagauccuugaggaaucaccacacuaucuuccccaaugguugaacuaauuuacacuuccaccaacaauguaaaagcauuccuauuuuuccacaaccucuccagcaucuguuguuuccugacuuuuuaaugaucgucuuucuaacuggugugagaugguauguccuugugguuuugauuugcauuucucuaaugaccagugaugaugagcuuuuuuucauauguucguuggcugcauaaaugucuucuuuugagaggugucuguucauauccuucguccacuucuugauggaguuguuuuuuucuuguaaauuuaaguuccuuguagauucuggauauuagugcuuugucagauggauagauugcaaaaauuuucucccauucuguagguugccuguucacucugaugauaguuucuuuugcugugcagaagcucuuuaguugaauuagaucccauuugucaguuugggcuuuuguugccguugcuuuuuguguuuuagucaugaagucuuuguccaugccuauguccugaaugguauugccgagguuuucuucuaggguuuuuaugguuuuaggucuuagguuuaagucuuuaauccaucuugaguuaauuuuugucuaagguguaaggaaggggcccaguuucaguuuucugcauauggcuagccaguuuucccaacaccauuuauuaaauggggaauccuuuccccauuucuuguuuuugucagguuugucaaagaucagaugguuguagauguguagcguuauuucugaggccucuguuguguuucauuggucuauauuucuguuuugguaccaguaccaugcuguuuugguuacuguagccucauaguauaguuugaagucagguaaugugaugccuccagcuuuguucuuuuggcuuaggauugucuuggcuauaugugcucuuuuuugguuccauaugaaauuuaaaguaguuuuuucuaauucugugaagaaagucaaugguagcuuguuggggauagcacugaaucuguaaauuacuaugggcaguauggacauuuucacgauauugauucuucauauucauaagcauggaauguuuuucgauuuguucguguccuuucuuauuuccuugagcagugguuugaauuccuggacacauacacccucccaagacuaaacuaggaagaagucgaaucccugaauagaccaauaacaaguucugaaauugaggcaguaauagucuaugaaccaaaagaagcccaggaccagacagaugcacagccaaauucuaccagagguacaaagaggagcuuguaccuaccauuccuucugaaacuaauccaaacaguagaaaaagagggaaauccuccguaacuuauuuuaugacaucaagaucacccuguuaccaaaaccuggcagagacacaacaaaaaaagaaaauuccaggccaauaucccugaugaacaucgaugcaaaaauccucaauaaaauacuggcaaaccgaauccagcagcacaucaaaaaauuuauccaccaugaucaagucggcuucauccuugggaugcaaggcugguucagcauacacaaaucaauaaacauaauccaucacauaaacagaaccaaggacaaaaaccacgugauuaucucaauagaugcagaaaaggccuucgacaaaauucaacacuccuucaagcuaaaaacucucaauaaacuagauaaugauggaauguaucucaaaauaauaagaccuauuuaugacaaacccacagcuaauauacugagugggcaaaaacuggaagcauucccuuugaaaacuggcacaagauaaggaugcccucucucacuacucccauacaacauaguacuggaaguccuggccagggcagucaggcaagagaaagaaauaaagggcauucaaauaggaagagaggaagucaaauucucuguuugcagaugauaugauuguauguuuagaaaaccccaucgccucagcccaaaaucuccuuaagcugauaagcaacuucagcaaagucucaggauacaaaaucaaugugcaaaaaucacaagcauuucuguacaccaauaauagacaaacagagagccaaaaucaugagugaacucccauucacaauugcuacaaagagaauaaaauaccuaggaauccaacuuacaagggaugugaaggaccucuucaaggagaacuacaauuuuagccauuuuaauagauguguagugguaacucauuuugguuuuaauuagcaguucccaaaugacuaacgauguugaacaucuuuuuuauauacucuuugcuauccauuuaucuucuuugaugaauuaucugaucaaaucucuugucuacugccuauuaaaaacauuauuuucuuaauuguugaguuuugagauuucaguauauauucuggauacaauuccuauaucagauauauucuuggaagguauuuucaccccaucuuuuaauucucuuaauaguguugaaaagcagaagauucuaauuaggaaguccauuuuuccaauuugcuuuuuaugaauuauauuuuaugucauaucuaagaaaucuuugccuaacucaagcacgccuaacccaagcacacaaagauuucuuccuauguuuucuucuaaaaguuuauagauucggguuuuguauuuacaucugugagacauuuugaguugauuuuucuauagggaucaaaguuuauuuuuuuuacauauaaauauucuauuauuucagcaucauugguugaaaaggcuuuccuuuuuucacugcauugccuuugcagcuuuguuaagaaucaguuguacauuuaaguguauguuuauuuuuagacucuauucuguuuguuauuaaaucuacacaaucaacacaguguguaccauccuguuuugaugaguguagauuuauuauaaaugaagucaaauaguguuagccuuccaaauuuguucuuucucaauaguuguuuuugcucucuagguccuuugcauuuucuuucuuucuuuuuuuuucuucuucaacuuuuauuuuaaauucugggcuacaugugcaggaugugcuuguuacauagguaaacgggugccaugguagguugcugcacagaucaacccaucaccuagguauuaagcccagcauccaugagguauucuuccugaugcucucccucccccuauaccuccaaacaggccccaguguguguuguucccccauguauccauguguucucaucauucugcacucacuuauaagugagaacauaugguguuugguuuucuguuccuguauaguuugguuuucuguuccuguauaguuugcugaggcuaauggcuuccagcuccagccaugucccugcaaaggacaugaucuuguuccuuuuuauggcugaauaguauuccaugauguguauguaccacauuuucuuuaugcaguguauuauuaaugggcauuuagguugauuccaugucuucacuauugugaauagugcugcagugaacauaagcuugcauauaucuucauaauagaaugauuuauauuccuuuggguauauauccaguaauggggauuacugggucaaaugguauuucugccucuagaucuucaaggaaucagcacacugucuuccacaaugguugaaauaauuuacacucccaccaccaguauaaaagcaucccuuuuucucuguaaccucaccagcauuuuuuauuuuuugacuuuuuaauaaucauucugacuggugugagaugguuuuucauggugguuuugauuugcauuucucuaaugaucagugauguugagcuuuggaucaguuugaucaauugaucaguuugggauugauuuugauucaauccuuauucuuauugugcauuauuuuuuuuugccucugcaugccugguaauuuuugacuagauucuaugugcuggauauuuuuuuaucccuagaaaucuucuugaacuuugcuuaggguuacaguuaaguuacuuggaaauaauuugaccuguuucuuguuuugcuuuuaggauuuuuuaggugaaucuggugcauugcucagugaggcaagaucuuccugaguacucuacuaaauguccugugaauuaugaauuuuucuugucuggcugguaugaacauccacuguucccaguaggcucuuuguaagcaccaggcaguguucccaccaguccuuucaugugguucuuuccauugucucaguuaguuucuucacgugcaagugcugcucaguacucugcuuaauacucaagggagauccuuugcagaucucugggguucucuuucuuugcacauuuguucucucugguauacuauccuauaaacuguagcuuccccagucuuuccagacucagccuuauuucugaaacuuagagaguccauaggucugugccuuaauuuuuucucucugugccuuugccugaaaauuuucuugaugcaguaauuuacaggcaauaaugggacucaccuuguuuguuuuccaucauuuagcgauuacuauccucuguugucugauguucauugucuugaaaaccaguguuucauguauuuuguccaaaguuuuugguuguuuuagguuucaggcuaagcucaaguacccauuacucuauuuuagccagaagcacuuuuuuaaaaaaaaagucaauuccuauuauguuauuuuuccuccuauuuacugggcauucuuaaaauauccuaccccaugcugccucauuuuuuuacucauuugaguauuugcauauauguauauuuccaucuuuuucuaacaguugcccuugaauuuuaacuuacaucuuguuuauauuuuuucuaacaacaucuagacuuaaucauuacuguaucuucccucugaacaacaugaaaacuuguguacuuucacuaccccauugccuagccuuaucaugaacuugagguucaaagaguuaaucccucuguucauuauugcuuuuugcacacuccauucuauucucuuagauuuuuugcuguaauuuuuagaacacuuccucuaggaguuucuaaugguucguuaccuacaccuuucccucaaccccacccagaugaccuaagucaagaugaaagaaaagauccuucugcaagaaaucucuuuaccuaucaacucauuuauuugcccacuugaucuucuguuucuccagucucagagaauccagcauccacuguucugcccaguauuuauccauugaccugugcucugucuggauccuaucuucucucaacucuugaacuuuuucuuuuuugguguuugcauuuacuuaugcuauauuaaaccucuugguuccuuucucauagccaguagguuccucucucuacuucaacuguuuuucaaugccauagauuccuucuggcaaauauucuguaccucuucuucaugucuugguaaagccuauuuaaaaaaaaaaaggaauagucuauuuuucuuguuugccuucuguucacuucucaauacauugcauucugggcucugcuccccaucacuucacuaaaaauaauuugacccucuuacuguccuauagacuaguccaaaaaaaggacaauguacuagguauugcuguauaacaaaccccucuaaaauuuaguagcuuaaaacaauuuuuuauuucucuggaaucaacagguugccugagugauugugcuuuucuggcuugggcuuugcuuaucuuaucuggguuuguucaugugucugcagguagaugacaaguuggcugaaggcuagcuuggccccacuggggaggacucagcucugcuucauguggucucaucaucuaucaggagauaccaugcuuuuuacauagcagugauaguuccacaaaaagaaguggagcaugcaaggcuucuugaggcuuaggauugaaacuggcacacuguuaacguuuuaccagauucaguuaaacaaagcaaaaugcaaggccaguccaguuucaaaggauggaaauuuguuucauguucuuuacacagcuucuuaaauguugauauuccuagaaauuuuucuucuaacccuuuccauuuugccucaccaaccucaucucuuuuuacaggaugacaaaauuugcccuauauauuggugacauccaaaucagcaauuagcaaacuaugggagaccagccuguggccuguuguuauauggcccacuagcuuagaaugguauauauauauauguucuaggguacaugugcacacgugcaggguuugauacauagguauacaugugacauguugguuugcuguacccaucaacucaucauuuacaacucaccguaugucuuuacaguagcaugauuuauaauccuuuggguauauacccaguaaugggauugcugggucaacugguaauucuaguucuagaucacugaggaauugugacacugucuuccacaaugguugaacuaauuuacacucccaccaacaguguaaaaguguuccuguuuuuccacauccuccacagcaucuguuguuuccugacuuuuuaaugauugccauucuaacuugcgugagaugguaucucauugugguuuugauuugcauuucucugaugaccagugacgaugagcauuuuuucaugugucuguuggcugcauauacagacauauauauaugucucaaaagaagacuguuuugagaagugucuguucauauccuuugcccacuuuuugaugggguuguuuuuuuucuuguaaauuuguuucaguuauuuguagauucuggauauuagccgcuugucagauggguagauugcaaaacuuuucucucauucuguagguugccuguucacucugaugguaguuucuuuugccaugcagaacuucuuuaguuuaauuagaucccauuugucuauuuuggcuuuuguugccauugcuuuugguguuuuagucaugaaguccuucccaugccuauauccugaaugguacugccuagguuuucuucuaggguuuuuaugguuuuaggucuuagguuuaagucuuuaaucuaucuugaauuaauuuuuguaugagauguaaggaaggcauccaguuuuagcuuucuacauauggcuagccaguuuucccagcaccauuuauuaaauagggaauccuuucuccauuucuuguuuuugucagguuugucaaaggucagaugguuguagaugugugguguuauuucugaggccucuuucuguuccauuggucuauauaucuguucugguaccaauaccaugcuguuuugguuacuguagccuuauaguauaguuugaagucagguagcgugaugucuccaacuuuguucuuuuugcuuaggauugucuuggcaaugcaggcucauuuuugguuccauaugaacuuuaaaguaguuuuuuccauuucugugaagaaagucauugguagcuugauggagauggcauugaaucuauaaauuacuuugggcaauauggccauuuucaugauagugguucuuccuaucaaugagcauggaauauucuuccauuuguuuguguccucuuuuauuuaguugagcagugguuuguaguuccccuugaagagguccuucacaucccuuguaaguuggauucuuagguauuuuauucucuuuguagcaguugcaaaugggaguucacucaugauuugggucucaauuugucuguuagugguguacagaaaugcuugugguuuuugcacauugauuuuguauccugagacuuugcugaaguugcuuaucagcuuaaggagauuuugggcugagacgaugggguuuucuaaacauacaaucaugucaucugcaaacggacaauuugacuuccuuuccuaauugaauccccuuuaugucuuucucuugccugauugcccuggccagaacuuccaacacuauguugaauaggaguggugagagagggcauccuugucuugugccaguuuucaaagggaaugcuuccaguuuuugcccauucaguaugcuauuggcuguggguuugucauaaauagcucuuauuauuuugagaugcguuccaucaauaccuaguuuaucacugguauguguuucagguauggggagggauuuugcaucaacuuuuaagagcaucuugacaaauaaucauuguauaaccacaguugacccuugaacaacacagggggguuagagucaccaaccccuuguguaaucaaaacuucacauauaacuuuugacucccccagaaguuaacuacuaauagccuaccguugacccagaagucuuaccaauaacauagugcauauuucguauguuauauauauuauauacuguauucuuaaaguaagccagagaaaauaaaaugucaugaggaaaaucauaaggaagagaaaauacauacacaguacuguacuguguuuauugauguuguaaauuuauguugucuguuuacaagaugaauagucugugucaaaugguggcaacuacaguggcaaaccucaaucuacaguacaaaucaaacaguccaacuuuuuguuguaauaucaugacuuuucgcugcuucuugggaacacuuucagauugcuaguggcacuucauaugggucccaugguguuuuugaagguuuacacuacugugccaaacaaugaaaaauaugcaagaaccaugagaaaucgcuuuuuacugcaauaugcaauuuacugaagacacggagaugauuagugucacaaguuguuuuaaguggaugcucuuaacacuugaguucacugcauagcaaaaagaggugucugugaaauuauuacaguaguaaaguauguacugcaauaaaucuuacacauuuaugauuuaauacugcaucuuuacauuuguuuacauuucucuugacuaucaauggcaccauguaugucuguguauauguaaguuuuaauacauuuuaacuuuuuauaauagauuuguauuucaugauacuaaaugguaaaauagacuaguaucuacacauauguuauucauucgugacacacucaacucuuucuuaauauuuucucuauuucuaggccauguggcuugucuauauguuuuuccacauuguugcaaaucuuaaagauaauuucaauauauuuauuuuuaaaaauucacguguaaguggauccacgcaguucaaaucuguguucaaggguuaaauguuuuaugauuuuucaaagguuuuucugugcaacacauuuuaaaaagguuuucuauguaaaaucaucuugaauaacaaagugguuauaaacuuacaaguuccaugccauaaauaaauacaggaauuaaaccaagauuccuuuagcuuccaugugcuuugguuuuuauucaugauaggacaaacaaugggagcagauuaugagacagaggaauaagaaguuaagcauguauaguauuaacuaauugcaguuaucaaagaaguagugaacuugauaagguuauaguaguacuucugcuucauggaagaagauugaacuauaacgucaccacuguggccauucaucuuucuugagaccauaaugaaaugaaaguagauaaauauuuauaaauaggcauaaacucauaauaauaaaaagauuugaaggcaagggggagguaauaauggacaagauauuucaacaaauuugcagaacauagaguggcugggaauggcuacagagggacuacaggaaagguaacugauggaaucccagagagauuuuggguucauaaacaauagauaccaguaaacaaauauauucaaaguacagcaaaaaccagauauuuauucaaggucguuauguggaacaugggcucuaccugaaauccuuauguuccaccuccaucccugguauuuaccacuagaauaacuauacagcccucuuuuuuaaaaaaucacaugauuucauugaggaaaguuaaagcuuucaauauggauguuaguuucccaaaauaaagucucccuucauugugaaauuuaaccagguccacagucccucaauauccauuccugauucugaaacaaagccuaccaguuagcccauccuuccucaaaguauucuacauagaaagcagccagucaguauucccacucaggggauagaauuagugacaauuaggucuacucaguggaggaacaccugcuauucaguagaggaaacccacacuagcuacccagaacuuuauucuuaagcacggauaauuaaauaaugguugacuacuacagugggauaacauacagaaaugcaaauaaaugauacauaguuacauauaacaacaugguugaaucuugagcuauagaagcuggacaugacaauacgguuacauuuaauuaauauauuaaauauaccaauaggcaaaauaagcucauaguacuugggagaggguaucagaugguaaauguauuaaaaauucaaagaaguaguuaccccaaaaguuaagauauugguuacuuuuuuggugggugggaauuaugauuuugugggauacauggaagguauuguucugacuguggguuauacaaguauucucuauaauaaggagaacauuuauguuuuauaugcuuuucuguauacauguuaaauuucacaguaaaaauauagucaaaaaagggaucccacaggagacagacaauucuauaaacauuuuuaauucuccacuuuagucaaauaacucggagaaguuauauucauagaguaaaaauaggaugcuaugaaaaggaagcaauuagagaaugaaaaaagaguucagauuaaaaguaugauugcugacauuaaagcuucagugaagagacuaaagauaaaauugauuuaauaaaguuccuggaauauacagggagaauaaaggacuaaaauuugagagaaaauaauagaaacucaguccaggagguucaauuuccaauuaaugagcguuucagaggagauaacugagaaaguggaguacagaaaauaucaaagaaauaguagaaaagauuuuucccagagcugaaagauacugaucuuuaguuuguaccuagcacauuguaccuagcacaaugacuguaagaacaaacaaauaaaaaaaagacuauaccuaaauuuaaucaguguuuaagugaagauucuaaaccuuggagaagagagcugagugugaguaaguaagauugggaacauauuaagccuauuaaaaauaacaucagauuucuuaucaauuauacuggauguuagaagguauuggaaugguacuuucaagaagcucugggggaaaauuauuuccaaccuuaaauuugauacccguaugaaauaaaauuaagugagagagcauagcaaugacauuuucggaugaaaggguuugcaucccacacacuuuugugggaaguuauuucagaaugugauucaguaaaacagguguagacaaagacuuaggacugaagaagcaauaggcauaacucuggaaagcaagaaaagagaaguggcaagaugacagcuguggaguaucccuagaaaaugaccagauugggaggaaggucucuagcggaguaaggagggaggggugacucaguauaaguaacaugguugauaggcuaggauacaauaaaugauuagggaaagugaugggagacaauaggaaaccaguuagaaaaucuggagaaaacuaaaagcuauacaagaaagucauaguuaaaacauaaggacaacuaaaauguagcaugauuuuacgcaguugaugucuaagaaaagacugggcagcugauaaaaugguagcgucacugaaugagucaagacauuuuaacauaaccgcaaaauagauguuguaauauugaugggaauauuuugucauaguuguuuugauauauacauauuucaaaauaguuaaaauguaaaaucacugcucucuuguuuauuaccaaaaaaugugcugaaaagguaccacuaaccuuuaccccaucccaaaugcccauuaaguauaagggacucucccuaucuacucuauucauuucuguauuguuuuaauauuuuacaaguuauguguuaacuuuuaugauuuuuuugugauuauaaaaugugucaauuuguuagaauuaauuuagcuucuaacuauaaucuauuguauaaauccaucauacauuaccauccuuauaaaauuauuaauguaaguaugaugaguauggaaagcuauucaaaauuuaauugugaauuucuuguucuaucugaaauguagaauaagacaucuuauuauugcccugucuucuacuccuccaagugacuucuguaauacccagccacuuaauguuugacauucaggaagcuuucauaaagcagagguguccuuuuagauauuuagauggaaaauaaagaauaucauuaaucuuaguugaaagcaaauggcuuuuuuuuuuuuucuugagacagagucucacguuauugcccaggcuggagugcaguguugcaacuucugccuccuggguucaagguauucucaugccucagccucccaaguagcugggauuacaggggugcaccaccaugccuggcuaauuuuuguauuuuuaguagagauggaguuucaccauguuggccaggcugguauggaacuccugaccucaagugaucugaucaccucggccucccaaagugcugggauugcaggcgugagccaccauacccggcugcaaauggccauuuuauauaguguucaaaaccuggcaaaacaaauuuauggugauaauagaaauuagaaaaaaauggugucauuagguauugacugugaaggccacaugaggaaaacuuuuaugaugccagaaauguacuauaguuuuaucuugguuguggcuuuguugguauauacauguguaaacaucaaaauuauacacuuagcauuaaauuaaaaaaagugagaaguaauagcauuugagaugagguaaaagugaauuaugggaauauuagcagacauacugcuuaaggugaaugauagcucuuuucccccauuuauuacuuucuacaacgaaagaugauuuuuaauuauauaaguuacauguauuuagauaauuguaagugucuaaaguuaaaauugaagggcuccuuccuuagagcaucgcuuagcccaggaguuugagaucaaaucuuuucuauguauacaccaacauucuuuaaaaacacauuuugagaaguaucaaacuauauagauaauucugaaauuugcuccuucugcccacucaacagcauauaauagauaucuugcaguguuggauuauagauucacccugauucucuuuaaugauugugcaguccuccauaguacguuuauaucguaacuuagccuccucccuaaacauuucagguuaucuuuaguuuuuuauuaaugaaaauaauucugauuaaguucuuuuacauuuauauuuguauauuucugcaaauauuguuauaggauaauuccagaaguacaauuccuagguuaaauuuuguuagcuucugcaaaauuguccuucaguuucaacaacugggaaccauaaucuugccaacauuggauauuaucagucuuuuaaaauguucacugaucuaauggacaaaaauggaaucucacuguuuuaauuugccuuuuucugaucacuagugaaauugggcauccuuucuuauguuaauuauaaauugauguuucuuuuuuuguuguguguacccuauuuuaauuuuccuuauuugucaggagucgucguuuaugagaguaauccuuuucuuguuacguauguugcacauuucuucuccaauuucuagucuuuuagauuuauuugucuuuuagcuuuaacguacgaagcuauccauuuuuccuuuaugacuccuucauuuuguauuucgcuuaagaucauuuacuugggaagaccagauauguucuuauauuuuguucuggaaacuuauucuuuugcauuuuacuuuuaaaugauuaaucauccacaaguguguuuugugagcuaaauauaugaauauuaauaugcuuuuucuuucccauaauggauagccaguuuuugccauaaaucacugaauaaucugucuuuuccucaccaauuuaaaaaccagggauauuacuguaugagugaaugaggguuauaagaaauguacuuuuuuuuuuuuuaaugcagagaggaggaugucaguuuugaagcagaguucaaggauauagggcaggguuuguagaaaauccaggauaaaggagugugguugccuugggagcuguagugucaaauuggauagguuuaaaaguauaggugggaugaaguaagaauauaucuaggacaaacaaauauaggcauacccauauguuuauaugcuuagcuauaugcuuugcuuuacugcacuucacagauauugcaggguuugguguguguguguguguuugcaaauugcagauuugugauuacccugugcugagcaaauccgucagcaucauuuuuuugacagcauguguucgcuuugugucucugggucacauuuugguaauucuugcaauauuucaaauuuuuuccuuaguauuauguauguuauagugauccguaaucagugaucuuugauauuauuauuguguuuguuuugggcagcaugaacagcacccauagaaaaugacaaacuuaauaaauuauguuguguguguucugacugcucuaccaacuagccauuucccugucucucuccuuuggucucccuauucuuugaaagacaacaauauuaauauaaggccaguuaauaacccuauaauguacaccuaguaugcaucaauauuaaucuuucaauggccucuaaauauuccaaguaaaagagucauaugucucucacuuuacaucaaaagcuagauguaauuaagcuuagugaggaaggcaugucaaaagccaagagaggccaaaggcuaagccucuugcaccaguuaggcagauugugaaaggaaaggaaaaguucuugaaggaaauuaaaaaugcuaugccagugaacacaugaauaaugagaaaacaaaauagccauauugcaggcaugggaaaagucugaauggucuggguaccauucagaccaaaccagcuacaacauucccugaagccaaagcaucauccagagcaaggcucuagcucucuucaauucugugaaugcuaagagaggugaggaagcuguaggagaagaguuugaggcuuacagagguugguuuaugagguuuaaagaaggaagcugccuccaaaacauaaaggugacaggugaagcagcaaaugcugauggaaaaacugcagcaagugauccagaagauuuuuuuuuuccagaagaucuaacuaaguuaauugaugaaggcagcuacacuaaacaacagauuuucaauguagauggaacagguuucuacuggaagaagaugccaucucauagaugaagagaagucaaugcuuggcuuucaaggacgggcugacucuuguugggggcuaaugcagcuguugauuuuaauuugaagucagugcucauuuaccauucugaaaauccuagggccucuaagaauuuuguuacaucuacucccuguguggucuguaaauggaacaacaaaguucaguugagagcacaucuguugauggcagaguuuacugaauauuuuaagcacacuguugagaacugcuaagcaaaaaagaucucuuucaaaauauuacugcucauugacaaugcaccugaucaccauuuucugcagugaagaugcccaaggagauuaauguugguuucaugccugcuaacaacauccauucuguagcccaugggucaaagagugauucagacucucaagucuuauuuaaggauugcauuuuguaaggcuauagcugccauauauagugauuccucugucagaucucagcaaaguaaauggaaaaccuucgggaaaggagucacuauucuagauaccauuaagaacauuugugauucaugggaggaggucaaaguaugaacauuaacaggaguuuggaagaauuugauuccaguccucaugggugauuuugagggguucaaacucaaguggaggaaguaacuguagaugugguggaaauagcaagagaaccagaauuagaaguggggccugaagauaggacugaguuacugcagucuuaugauaagacuugaauggaugaggaguugcuucuuaacagaugagcaaagaagaugguuucuugagauggaaucuacuccuggugaagaagcugugaacauugucgaaaugacaauaaggauuuagaauacuacguaaauuuaguugaugcagcagugucaggauaugagaguggccuccaaguuugaaagaauuuuuacuguggacaaaaugcuaucaaacagcaccacaagcuacagagagaucuuucguccugcagagaaaucaaacaggaagaaucaaucaauacagcagacuuuauuguugucucauuuuaagaaauugccccagccaccccagccuucagcagccaccacccugaucagucagcaaccauuaucaucaaggcaagacccuccaccaucaaaaaagaguaugacuugcugaaagccucagaucauuugcauuuuuagcaauaaaguauuuuuaaaauuaagauuugaacauuguuuauuuaaauauagugcugucaacacaacuuuuauaacuacugggaaaccaaaaaguuugugugacucacuuuguugcaauauuugcuacauugcaguagucuggaaacaaacuugcaguaucucugagguaugccuguguguacuaaaauuuguaugaauaguaaucaaggggagcaagucaacagcuacuuauguuauacaaggugauauuauaaaggaauucuugggcuuuuuuucuuuuuguagauguauuuuaauuuauuaucuuuggcuuaggaauuaccauuaaccauuguauaggaacaugucuaagagugagcucuuuuugcuuaacaucagcuuuaaguugagcuuucauauuuagacauaacuuauuuauuuaaagcuauuaauauauaaaagguaauuaucaauucuggaaaaguuuggcucuaugacagugaacaaacuguaauucaagaaaaagacuacuaaguaugugaagcaccacauccagagaaaaaagauuuucuagcaaauuggauacacauauagaggaaagugauuaugugugauuacuucugggacuaaauuugaaguauguuggaaauaggguugucaauguaauuuuaaaauuauugaccucuaacauagucauuauaauugaaaauguuacuuuauuugucuugucuucccuugccuuuaccucuauccuucuguuuucuccuuuguuacagaucauacaucugucgguggccugggagacaguuuuuaugaauacuuacugaaagcaugguugaugucagauaaaacagaccaugaggcaagaaagauguaugaugaugcuauugaggugauuauuuccagaacauuuuucuacuuaauggauugaauguacaguguauuuuguagugacuagaugaauaucuuauaaccauuuuauuauagacauucaguaaauacauacaaacauuuuauuauaugcauucacuguagaguuuguuacuauuuuaauagaaaagccucauauuaagucuucuuuuauuugugacauuuuuaaagaaauuuuugaagaaagaauuuauuguaguccaggugcaguggcucacgccuguaaucucagcacuuugggaggcugugguaggcagaucacuugaggucaggaguucaagaccagccuggccaacauggugaaaacccaucucuacuaaaaauacaaaaauuagcugggcaugguggugcaugccuguagucccagcuacuugggaggcugcggcaguagaaucgcuugaaccuggaaggcagagguugcagugagcugagaucucaucauuguacuccagccugggugacagagcgagacuccgugucaacaauaaauaaaauaaaauaagaauuuauuuuaguguauucaugaaaauugauuuuauuuacuuuuaguuaauguuuacagagacuggaaaaacuucugacuuuauauacauuuucauaaacauuuuucuuucaaaugaacccuugaaucuacacauugagagccuuauggguaaauacuuaaauaaugacaacacacuuauauaguauuuucuacaugccaggcacuguucuaacccuucuuacauauaugagaucauuuaaucauuaucaccauuuuacacaugaggaccuuaaggaacaaugaaguuaaaguaacuugcugaagguugcauugcugguaauugauggggcguggaacugaacagucuggcugccgagccaguguuuuuaaccacuguauuauauuguuucauauuuaaaugacuucauaccaugauauugugacaguuuauaauuggaacaagauucauucuaggaagaauuuauauggaguauuucuaagaaaaaacugugaaauagaaaaguaagucagaaguguguuaaguguguuuagcagguuauuagcuuccugcucuauuauaaacugauacccacuuaacaauuuuaguuauuuuuuaaaaguuguauauuuuguauauaacaacucugcugauguagucaguaauuaguugucagaguuauaauuucuguuugguuuguuuuuuucauuaaaccaagaaucuuauccauuuuauaucccuacuguucaggcacauaauuuguuacaauuguuuuuaaaaaaugcacaggaguugaacuuaauauguggcucacaguguuuugcccauuauagguacucaacaaguguuuauugagauauuguguuaaauaauaaauugaacuaaagguacaaccaagaauauaaauuuuaguaggagaacuuuauucucuuuuauuaaaauuuaaacguagaaaguuguaugauccaagauggguuauuaucugggaagaauuuaauauucuuagaaccauauuguugaaaauagcucuuaguaauucccacuagacuguggccuccuuugagggcagagacuaauuuauuuaucauuaucucagcaccuagcacaauacuugaaacauaauaaguauuccguaguauuugauaaaugcaugaauauauuuaauauuauauuugagaacaugugauauaucauauaccauguaauaaauuaauuuugucuguuuucuuguaauuuucuuuaaaacuauuuugacuuuugcuuaauuuuuuccaaaggaaaaaaauuguauuugucauuguuuuuuuuaaucauacaugcuuugaaaggcaugauaacugcuuugaaaguuaaccuuauaaauucacacuauuuuucaugaaucaucugcuauauguuauguaucuuguaaauauuucuguacuugcuuucuuuucccuguuuuuauuaguuuuauuaguuuauuaaaucaagaauagguaccuaauaaauguuuuuuaauaacaguugaucagcuuucacuuugagacaugaucucaaguaugcagucuuugcaguguuaauuauuuucaaaaacuauucuauuagcguauuauaaaauaaaugacauauggaauguaugaaagagauaggaaugaccacuuaagacucauuguaauuugaaauacauuauuuuuaaacuuugucuuucugagcuauuuuacuuaaauuauuccauaccccuccuaccuuccccuauccuuacagauacccauauucuuuguuucuacuuucuuuuaaaauuauugguaaaaagcccuaacugacugccuuuuacuuuaguucuaguaaguccagguggauaugcuuggauaucuuuuaauuguaauaugguaagauuuagguuacaaugaacagaaaugacaaacauauggauaccaucuuuaggcauuuuuggaauaccuuauauguggaaaacaugguacuaucaugagguucaaaaagaugaaaaauaccaccccauacucaaaaaacuaaucuuuuugugcuucagagugcuaugguuaaaacaaugacaaaaacuuauaauccaaagauaauuaucauuuugguuaucagccaccucucauuccccaacaucaaauacaauuaucuaagagcaccauucauuuaugaaauuacuuaauaauuaaacauguauugagugcacacuacauuauaugccuucuggaauacaggugaugaguaagacauagucacuccaguucuguuaaacucacauuauuauuauggagaauacagaguaaaauuuuccaaggcugauuguuacuaaacuugucagagaacaacugacaguaaaaauacucuuuuuucagaaagaaaaguuaaccacuaaucauguauaauaguuucuacuaaagaaaacugaguuaauggccauugcuuauacuuuuccauagaaauaccucuaaagguagaaaauagcucaucucagcaaagucuaagaacauauuccaaaggagcaaagcucuugaaaaucucauuuuaaaacugaaaugugauuguuauacucugauauacucaaguuuaauauagacuauuucucucaccauuccuacaucuuuugagaaaaauguauguuccaguaggguagacaguguuuauaauauggcuucucuuauccaugacaaagcauccaaaacaaaugccuaaauuugagaaguaagggacuaaagauaauauuauguagaagguaaucuuuaggccaagucucuccucuuccacucugucuuauuaugguagugauucagauauugguuccagauuauaugcaauuugaucacccacuccgacacuugcuguuaauuaagucucaguuugggaaaguuacuacuuuauagacuaucauauuacccagguuuuauaauggccagaaggauauaguaaguuugaacacuaauaguuugcaucuaaaauuuugaauaucuuuucuuuccuguaggcuauagaaaaacaucuuauuaagaagucucguggaggucuuaccuuuauuggagaauggaagaaugggcacuuggaaaaaaagauggggcauuuggccugcuuugcugggggaauguuugcacuaggagcagaugguuccagagcagauaaagcuggucauuauuuagagcuaggggcagaaauugcacguacuugucaugagucauaugacagaacugguaagaauauuaauaaggcuaauuauauagucuaaaauaaucucuaaguuaaaaauguguucagcaauaagaaggagaauauauaggcacuuuuuacuuccaaauaguuuacaccaacaaggcaaaucauuuucuuaagaacuugaauuuuaauucuggaaaugugucucugcauuauuuuuuaaauucugaauucugcugcuguuucuguuaaagauuuugaaguaauuguuuuaaagacaagaaucgugggguauuugggaauauauggaauaacuuuuaauauaagaaucuauuuuugccauuucagcuucuauaaaaacaguuacuuaaaagaacauaaaauugacugacuucaguuauauugccuugccuauccucuugugauaagaagaauaaccaaaagauaacaauauuuaucuuuauugguaucuggcuaacuaguaguuuuucaauuaguucaccaguaguuuuuggaauuguuuauggcuuuaacuaaaaagauccucugacauugcacugggcaaauauuuucugaacuucaguguccuuacuuggaaaaggagaugauuccuaaauggugacaaaaauuguuuugguuggggcugagaaaauuuuuacucuuuuuauguauaaagcacagauauacauauagucauaaauagauacacaguauauauuugguauuaaaauuuuauggagggagaaggcaauuaggcuuuuuuaaaaaagacaaaagguuucuuaggggugcaguaaugaaaagggggcugaaaaacacuggacuagaccuuccaagguuuucucuggcuuuaaaaacaugaguuucuauaugaaguaauagauaaugagcucccugaaagccaaaaaacuagaaauuucuauuugauuucggaaguugaauuguugauuuuauuaaauaacaauuucuguuuuaggguuaauuuaucaucagauaccaugaaacaaauaugauugaccuaaaauuuaugcuaguucauaaaucugucaaguuauuuuuauacaguaaggaauuaaacuuauggcaaaauugauucuucaguucucauuaacuaaauaaggguuccauuucuugaaagaauauaagucaagaggacggugaaguaguguuauuuuaggguaguuuaaguguuguuguauaauacauauaauggcagcgaucugaguucaaaauagaggcuaaauuaaauuaucguguugauacagaaugccaauuaugccuuaaaauauagcuaaaauuaguaaaacauugaggaccaggauggauauucaauuuuauauuaggauccaugagaauaaggauuguuauuuugcagauuuugaccaaaaaucaaauaauagaccuaaaauaauugaauuucauauagcauacauucuaaaauaugguauaucauaguuacuauaauuaaauauuuacuccaugaaacagggaacagccauuauaugccaaguauuaugcuagaugcuuauagguuaaaguaugaacaagauacauucccugccuuucagaaauucauaguguaccagaguuugaaaggauuuccuuauauuucugauuuuaauguuucauaaugacauugcugaugcugauucuuguucugauugucauuuucacauugcaaguugaugaacccaugacccucuuuguuaugguaaaccaaaaaaugauuauuugauuuguguccuguauuuucaagucuucuguuguuuuuacuugucuuuaaucucaauuuagauccuuuaauuaaaaaguacaauccuaguuuugcuaacuuuccagcagguuauuauauccucugcuguguuuucuuauagcugugcuauaauuuuuggccaccauauuuuaaaauauccauucauuuuuccuuaguaguuauuccagcuaaauauauacuguaauuaucuacaacuaaaucaauucauaaucuaagcucuaaaauguuuccuuauauguguguauuauggcaaaaugucuuuaaaauuaccuugccuuuaaaaaaaacauccacacagugucauuaucuauauacuuuuauuuuagaccacaauggacuguaugaugugcaaaugucuaguuugcauuuguuuccaaaagauuacuagacucuuuuugguagaauuagauuuagcaguauguugauacacauuauucugagaaacauuuuauguuagaauaacaggaauguuuauaagucuauuuuaagaaaaccaaauguggaucuuuuaaaaugacucauuuugcacugagugcaaacagcaacaauaaaaauaaacaacaaaaauuacuucauauucuguucuuucagggaagaaagaaguccuugcaaacaaacauaaaugguuuauuuugcucaguuauuucuuuugucauguuacagcauuaaagcuagguccugaaucauucaaguuugauggugcaguggaggcuguggcuguccggcaggcugaaaaguauuauauccuccguccagaaguaauugaaaccuauugguaccuauggcgauucacucacgauccaagauacaggcaguggggcugggaagcagcacugguaaauaagccaauauuccauuuuaucugcaagaguguuaacucaugcccuccuaugaugccacauacccucacccauguuaccucauuuuuaguaucuguagggcaguuuuuauuuaucugaugaagaaacucuuagucaauuuaaguuucugggcaguagaaauaaaucuuacgauauauauuaaauauauauuaaaauauauuaaaaauauauaaauauauauauuucaaaggaggaauuuuuaaugguuaguuaaguaaaggaagcaagugguuuacucuuaaagucuuucagggaauccauagcuaucaguaccuagggaggaaaaaacuauuagucuuuuaugaaaguauagcuuauucccaggguaagggguuguuuuauucuuugagauuuacuaauugugauaaauagcacuaauuauggugacuauucguauucaaauuguuuaacuuaagcuuacaaucuagauagaaugacuaaggacaucccaaaugaggucaguagugcugguaaauugcccagacaggaauguaugagauauauuuuaaggcaagauguauaccaguuuauguaaagcgaacguuucacaguggcaaagugggagagaagauuggagccauuauguagacagccuuacacaccaaaucaaagguucuuaguuguucaggaaauaagacgugugcacaacucccuccccguaauacacacucucuuaguuacuucugucagcuacugcguuaagugcugucauaugggaaaugguaacagaaaguucuuugcuuauccaaaaagcccuucagaucuuacuuuucuuuuuuccuuagcaucuucuaccugcaaaagcuccuugacuuuugagaauuccuuacagaacugcuaaauguuuuauaagggggaaggaacuccugaaggcuuuuuucaguggggaguaacaaagcaaaaggaucugauuguaauccacaaauugguggguuugggagaccacagccauaaccuaggaauaaugugagaucuugaacuaaggggaguacacuuauuuuucaccugucauucagaccuagauaguccugcuggacuuuaacaauaagagcauauuaauggaaacaagugguuacacaggacaggaacagaugcagcauuuauugaugcugcuuuuccuuggccccuuggcuccagaauugggagcacagcuacuagugaaauucucuguguaggagggugcugccacaguugagaagacagccaaacuauugccacagugguuugggaauagaauacacacacacuucuauuguuagcaguggcuuacuaaugcuuccguaaauuaagcacucuuucauguaagggaaauagguaaaauaaucauauaaugaaucuguuucacuugaauguccccugauauuuaaugcuccuuauuuacaggaaugagggggauaugucugaaucacgugaggaguggaaagugguggcagaagcacuuuuugucauugaggaauacuuuaggauaauucauccuuuuccuaauguccuuuuuuccugugugcuuucuucaaguauggcccuacuuuugucuguuaaggagaggugugacagggucaaacuuuagcccaugucugucuaaauuugaauuauaggagguagaauuuugcuuuuguagccuauaugcacaaacacaaacucaauguauaaucggucaagaacaagaacuagaguaguuauacucuaaauucaaguuucagaagugugcaguggaagugaugagaagagggaggaauggaggcaaaagaggcggugucauaucuuaaauaguauuugcucaugcaucaccauuggccucuccucuugggugcgaagaaagcaaagggaaggcugggugaggcagaauagcaguauagcgugucuucuguagccuuagcuauucuguuuacauauucaaacuuccaaacuugcccucaugacuuuaaaugucuuaaagauuagucaugccuccccacuacuuucuuauuauucuuaaaccauuuugauaguucaugugguggugaagacacaugauuauugugaagaaaaguacuuaaaaacucuuguauccaaaauuucuuuagaauauauuagagaaaagcaccaaaccccuuaaauuuaguuauaaucaaaauggagcuauaaaaugagcagauugauuaaauaaacaccuuuuuaauguuaauuagcuuuucauaggaaggagaagcccagaagaguaagaaaaguagcaagacuaggaacaacaagccauggcagacagcgaugguuaguuaaguaaccaugccuucauuggaugaccuugcaggguuagguagaauagaaaaacaaaacuaccacaugugcuuuccacuuuucaugauugguugaauucuggacugugcuguaccugcauaagcagacuguuugguugcuuugaauuaaaaaauaagguugugaauagauuccauuugauucaguauauuuuauuuaggcaugcccaaagaugcaaaaagaguaagaauuuuaacucucagucaagcaguaaagcacaguaguuaauaauguagagcaaauuacucugugccucaguuuucccaucugaaaagugaggcuguuaaccucauagaguucugaaauucaaaugugacuguauuuaaagcucuuagaacagcauucagcacauaguaaauaccuuauaauuguuaacucuuuauauuguaauuauuauuguaguaggugggcucuuucugccaguugguaccaccuguaauggcuaacucauaggauuaugauaaugcaaugucuggcauaugguauguauuuaguaaauauuaucucuuaccgcuauuacuauagagugcuccuaaguaauauuuuuuagcauguuguggguuauuguuuguccuuggaagugauaaaauugcauuaaaaauuguuaauugaaacugaccuccaucuugauuuguuagaacuaauggaccuuuauuuugccagacagaccccucauuuagaaaaaauagccuaaauuugauuucuaaguuaggaaaauauaagaugucuuaaaaagauuaaagaguuuuggagacagagaaguucuauaggaaacauccuguuucucguaugaguuaauuuuuccaguaugagaauauuuccuuuugauaauauauuauucuuaagccaucaaauuuucauacaaaucuuuaugagcuuuugacuauuguccuucaaaguuuuguuguccuucaaaacuugaaauucuacggaauugcuuauuuugucugaucucuuucauaggccauugaaaaguauugccgaguuaaugguggguuuucuggagucaaagauguauauuccucuacuccuacacaugaugauguacagcagagcuuuuuucuugcugaaacauuaaaguaaguauauagcuuuaaaaaauauuuuuauacuagacugguuuugcugugugaucacuagaugaugaauuacaacuaugugacagguuacacuaaauuuuguuguaaauaucuuuuuauguaauuggguguguaaauuuuuagcuacaucucaaaaagaaugacuuagacuauaagguagguauuuuaucaaaaaaguacuuaguaccuguuaaaauuuuuuguucuuugcucuuuaaugugcauuaaaaucaccuggaaggcuucguaauacacagguaacuagguccacacucacgaaguuucaguagaucuggaguuuagcuuaaaaauuugcauuucuaacaagcucccauguguuacugauaaugcugguccuggacucauaccugagcucccuacuguagcuaaugaaaucuguuaggaaugaucaugcaguuuugauaguacuaaaugaccauagccacucauccacccgaugagccuuacuguaaagauacacauaaaaggaacaauggaaaagaguagacaacuuuauuuucgucuuauacuccaaaccccagguagaggucucuguaaacagaccuggaagagauggagauuguaaauauguccacuucccuaaagacugaccaaauaaauaucucuucauacucgcucuuaaauuuauuauuuguauuucuugcauaucuguacaugaaagccuuguaaacauuuuauuuuuucaacaaauguguauuaccaggcacuguucaagccacuugaggauguuucaguaggcaagcaggacaaaaauuccugccuucuggauuuuacauucuaguauacuuguaguuuacauucucauauauuacaauuaaaauguaccguucucaaacuaaguuucuaaaugucuaucuuauucuaauuuuucuuuuauuaccccaguacuguuguuuuccuaucuuuuuagcuuauacauuauagaaucaucugcuuccuccuuuuaauauaucaccaauucuuuaugcuucuuucuguuacauuuuuuuauuuugcucccuccuuuccauuucuacaauuuacccuaauccagccccuuauuacugcugggaugguuuagaacaucugccugguacucaguuuccuacaucuagauguuucuuauucugacuuauccuuugugauuaggcuugagacuguagaaguugaaagagcacuagacuagaaaauaaagugacgggaacuuuaguuguacacuagcuacaucuagcugaaugaacaugucaaaauaaaauuuuuugcuuuugguuuacaugucuguaaacuauggaauuuggcccagauuguguaguaucucuccuguuuuuuuuuuuuuuuuaaacuucagaaaaacuguaagauaggacaaugauuauuugugucuuuucaccuaguuuugccacauuuccuucucuuucuuucuguguacacucacauauacacauaguuuuacuuuuuuuuuagcuuuuuauuuugcuggacaaguugauggugaccagcaauauauuucaacaguagguuucaagaaaaggucaucaucuuacauaaucaccauucaguucucacacuugcgaaccuuaauauucauauaauaauguugucuaauauguaaucccauuuucaaauuucuccaauuguuccaauaauguacuuuauuuuuguuuaaugccaauucaggauccaguaugggaucauuuguuacguuugguugucaucgucucuuuagucuccuuuaaucuagcacagaguuuuccuguuuuucuuuuaucuuuuaugaaauugacauuuuuaaaguuuucaggcuaguugcuuugaggaauguuccccauuuuagauuuuuuucuaauuguuccacaugaucagauuuagguuaaacauuuucagcaugaacauuauauggaucuguguucuuaucauugcaucccuuaaagagacacauaauaguuuagcccauuauuggugauuuuaaauuugagcauagguuauauuugauuauugucauguaaacaaucuuuuuucuuuuuguaauuaauaacuuaucuguggagugauaauuuugagacugugaauauucuuuuaauccuagauucuauucuuaaaccaaccuaauguacauucaaauauuuacguauauauaaaguuucuucucuugcauuugucuauuuuauauuucauugcuucuggcaggaaugccuuuauccuuucuaucaauuaaugccucucucucauuucuaauuucaguucaaauuucaccucuuugcagacuggcuuucauaauuaauucucaaaucucucaucauuacaacuuggagcacuuuaguacaugcauggcauagggcuggaaauagaugguaugcugccucauccccuucuaguaccuauauggaauaucaccaguuaaucuugguacuuuuccuugccaaguucagucagaacucuucucaacacaacaguaugcuagguaaccaguuauuuauguauaucuaucuauauauauauagauagauauauuugcuacaauuuuugcuuuuagaaaaacauauaucuggagcaauaaaagugaaaaaggucaaacaaaaagaaacauacaaauaauuauaacaucaccuaggcuaagaaaauugucacaguugagcaguacauucagcauugcacuuccuggcaguacauucagcauugcacuuccuggcagcuaaagcaaaaaggaaucauucugcacagugucauuaucauuuuugggaguugagggagcauauuacuuugacaaaugagacagaauuuuuuauguugcuaaauuauaaaaugacuuaaauuggauaacucuauaaaaauauugaacuauuaagugaaccauaugaaauuacccuuuuaaaaaggguaauuugaauauuggcaauuuaguauaguucaaccuaauacauaaugguaaugguaaauauuuugaaaauauuuauuuuguuugaaacagugaucuuagggaagauacaaaaacacucaaucugauuuacucuuuauaaaaacugauggcauaauauuaaaauacaauugaauaaagucauuucugugaagaucuaaauuaauguagcuguaguuuuauuguaaaaauagagcuuaaaacuuuauagaggaaugaagauaaguauggucucuuaaauauuucucaaauaucaguuaauuuaaauaggcuuugucagaagcugucaguuuaagauuauguauucucccaauuggugggaauuuacugcggauucauuaaaaggcaacaaucaauguguuuuagcuaccagagauggaaacugauugucacggcaguggcaaaguuaaaugaaaaaaccuguauucuugacguaaguugaggcucauuuuaccuuuuacaugugucauaggugcuauaccauggaguaguuauugcuauaggcauacuuuuuuccccagaagaggccaugucuccuacuuuuuuuguuucccucaauagaccuuacuucauggauuaauauuuaucuagcauauauacugauggcauaacaaaaacuauguaaugaggaaggucagagauagauuccuucaaagguucuaaaacucuuauacucuaguacaggaaauaaaacacaagcaauauauacaacaaauuuuaaauacauuaagugcauaagagaaauauuaacaaaaugcagaagucuuuuagagaagaaagaguuugcuuaaccugaaaaacaagggaauacuuccuggaaguaguagcauuugaaccagacuugaaggcaagguggguaaaauaggaugaacugguauucaggguaauagcuauaaaguagaccaugggauauuaagaaugagaugagagcucuaaagguagaauugacaaaccugaauaucuaauuagauaugaggagauucaguaagaaggaagaaucagagauaauauuaaaguuuccagugccaaccugacuacaguuucuaaucagcauguuagugccuuacuuuuaaauauuaauaaacaguauugacuuagaaauguuuauugaacgauaaacauguaagauuuggcauauuuguguauguguguuauacuuugacuuuuaaaguuuaaaauaugaauauaacaagguuaagaaaauauccaaaaauagaaggauauguuuccagcuugaaagacaccaucaagaucccagcauagaagaugaaaacagacccacaacaaggcacagcaccuuggaauuucaaaaccacugggguaaaggaaagaucucagcuuccacagggagagagaauagaauaaagucucguagaucuggauucagagugccuucagaccucucaagaacagucaugaaagcuagaagcauuggagcaguugauucaugagagaaaauuaauuccaacuuagaauucuggguuuuuagccauguaagguaucaaaaauccacuuccaauccucuuucucaguaaguuuuuggaacauaugcuccaugaaaacuggauauaaaccaaaaaagaagacauaaauacaggaaagaagugaaaggaagauaaagggauacuguauugagauugaggaggacagaggcucugagagauuucuucaagauuaaauguauagacuguuuauuucugaguauuuugagacaagaauuaguugcugaagauuuuaggugcauuauuacuaauaaauacaagucagcuugcuuuuuaaauaaggggaggagucauguaagaaagaaaagccaugaauagcuuuuaguuaacauaugaacuuguuuaaagacacuugguuggagucuugauuguuuuguaagaagagcuaaaugguacuacuguccccucuccagcugcaagaaagagaaauauguucuuugauaauggcuuuugucccuccaaggauugucuuauucauuggauucagugaaauagcaguuggucaaaagucucuuaagcugaaagaauugcgaggaaauuagcagauagaacaccaagacuccuaggagcgguucucuaguagcagcacuugaauugcugaaugaauaucucccacguggauucucuaugguucuaucacuuuauaccauuuacugucauaagccucuuaucaaaaacuuugaagguguguauuauuuuauauauguaccuuagugucuacacccauucaccuagaucuuucuuugaauuagauuuucauugcaccuuaccucaauucuguugcacauuuauuuaaagaucugauaaacugagaaaaguauacauuuugaggauacauuucaaccauuuuuuucugaguucauauauaucaggcauuaggcagcucagaaaucacaaguuggaaacauagucuuaacaaauuuguuauuaaaggaaagagaaauagcauaaaauuaagaucaaauuuaucaccacaguaugucuacuuucacugguaucagagucucuggggcagaaauuaugucugugucucuugcuugugugcuuuuuuccuccguaucucuugaaauucaaacuuugaauauaguaaaauucuggaaagcuauauaagaauaugucuuauauucuuauauauacuuauauacuuaagaauaaguaaucuuaaauaaucagaguuauggacaaagauuuauguacagagauguuuauugcuguuauaaaaauaagucauuauuuguucaauaauagcugaaugguuaaguaaauuauggcacauccacaauaguaucaugaagccaaaacaauugcauuuuuauagacuuuucacaguauaauauuaagugggcuauuaaguccacaugugcauacguaacacauagaugaacauguuaauaguauuucaacaauaucaaaaugugaacuguaguuuagcuuaauugaaguuauuuuaguuuuuaaaaauacuuuuuguuuuugucucuguaaauauuuaaaaacaucuuuaaaaauacucuauuuugaaaaaaauaggcuggaucacugcuaaguaccaaaacuaaguuucuauagagcaaagcuuuaaauauuaaaaaaagaaauaaaaucaugaaacaauuggaaaguuuuuuucaacccuagggaugaagauggcaugauacaaaacccaaagaucauugaagaaaagauugagaauucaauuacauaaaaauaaaaaacaucuguacaaaaaaaagagcacuaaguaaaguaaaagacagauggcacacugggaaaacauuucuuaaaauuagaaauuauuaagaaaaaauacuaagccuacuaaaaaagguaguagcaguucuuagaaaagaaauggcuguaaacacaugaagaaugcuugauccacuuguaagaaauaaaugaaauaauagaucagaugcuauguuuuauuuacuuucacacugcuuaagauuuaaaaguuuuuguucugguguuggcaaggauguaagaaucuagucacuuucaaacacccuaagugagaguacacuggaaguauauucuuuuucguuguuguuaaggaagcaagguccaccuguggccccugccccgacuuggaaguauauucuuaaaauauccuuaaguguguauuaucaguacuucauuuguccugauagucuaugugaaauauuaauauucucagugcuuuaguuuaguguuugaguuagaacaagcaugcaugcaaucaauguguuuguugagcuauauauacauaacagcauagcacuugucauauuaaaaucaguuguuuaaacacuauaauguguagcuccuaaaaaaucaaguuguuuuuaauacagcuuuuuuugaauuauaaaaauagcauguggauauugcaaaacgaguuaaauagugcagaacugaagaaaugacaaaaaaaaaaaaugaguuucuuugugccucacauccaaucucacuucccaaagagaauaauuauuaaauaguucuugauauagccuucuggaaauuuucuggguauaugcaaacauauaaaaauauauauaauauauauccuuuagccuuuuuucuccauauauaagauuauauauaccuauuauucugaaacuugcauuuccaccuuuuuaucuaggaaagguuuccauauuggcauauauaaauccacugaggaauguuuuauaauuuguuuaaucaguacccuauuguuagauauagaacuugguucuguuuuuuugcucuuauaaacagugcuucagugaauguccuuuuacauauaucucugcucccugugugaagauaaauguugguuagauuccuagaaguaaaauggaugacuagggcaguggcaugugcauuugacauaacuauaauuaagcaaaauaagcugagagagcgaacuuuucagaaaacuucucagagaguuucagaaaauuaauuagaaaugguuaaaaucagauggguauucugagaaguauggagacauuuaggcacuaccugauaauguguaguaagauuugaaugaacaaaccuuuuguuuuaaguaaaucuuagacaacagaguaaaucacuuaaaacuuguuuucuguaaguuaagaacacagaugaaaagucaaacaaucagauucuuaggaaguaaauggaaugacaguuucaguguuugcucauccuuuuaaacuagugcuuucuggaauccuuaauuccaccucuuuguucuuuaucaagaugugagcucuuuuucuacuaaguaaauagugauuaaaauauauaaacaauacaaauguaauauaugaaaugauuuauccaacaaauguuuguuguuaagugccugaugugugccagcuguuuuguaugcuagggcugcaucaaugaauguaaaauaauccugacauaaaauaacuuacauccuaaaaauuucauucacucucccccuaacuuauaauuaugcuguuuugagugccugccuguaaaaauaugcccuauguguauuauccaaacccuucauuauucucuguccuugcccuccuuuauuuuucuucauaacacuaacaucaucuguauuaguccauucucacacugcuauaaagaacugcccaagacuggguaauuuaugaagaaaagagguuuaauugacucacaguucugcauaacuggggaagccucaggaagcuuaaaucguggcagaaggggaggugggcacaucuuacgugguggcaggaaagagagcaugugaaagaggaacugucaaacauuauaaaaccaucagaucucaugagaacucacucauuaucaggagaacaauaugggggaaaccacccccaugauccagucaccucccaccacaucccucccucuacauauggggauuauggggauuacaauucgagaugagauuugggugggacacagagccaauccauaucaccaucugacauaggugugugguguucuuguuugguagagaugcgggucuugcuaauugcccugguuggucuugaacuccuaggcucaagcaauccuucuaccuuagccucccaaagugcugggacuacagguaugagucaucaugcucagccuagauggauuuuuuuuuuuaaucuaucuuccaguagaauguaagccucauagccguagggacuuuuuccuuuuaacuacuaugaucuccccagcaccuagcacaugaggcacucaguaaauauguauugaauuuguugauaaauuuuuagucuguuaggcaagaaaagaacuuggcuauuugcaucuuuacucugaucccucuuuaguuuuuaauuauaucauuuuaucaguuguguuuaaggcauuaccugaucauccuguauacaauuucaaauuguucccuuacucccucuuacuuuucccugcuuuacuuuucuucauagcaccuaucuuccaacauagcacauaauuuucuuaagcauuccccaauuagaauauaaacuacaugaagaguuuacaguauuuuuguauauuuggguuauuguuuuauccgcaguaucuacgguagggccacucauauacuauguauuucaguauuaaauguuugcugaauaaaggauugaaucauuucauuucaaaggagacagcuaaaaaaccccagcaauuuuauaagaucuuguauauaauaagaguaggagggggaaagagaagagaauaauagaccuacuuuauuuccugguuggggcuuagagcuugaucucagaauucacuuaguuuuaggaggugucugauaaugagucaaagaauugauaaagcaagaagaagggacccaaggcaaaaugugaaagcugaggaugucagggcugcggauuuguuuucaguagagagucaaagguccagaugcccacauaaaggagaaaagcagaaacaguaccaacuaauuguuguuagaaguuacacaaaguugguaaccuagaaaagugguucucaaaccugaguguacaucagaaucaccuggaaggccucuuaaaacaugggaugcugggcucuguugaguuucugauaaauaggucuagaguggggccuaagaauuugcguuuuuaacaaguucccaggugaugcugaugcugcuggucugggggaaucacacuuugauaaccacugacaucugugacccaguaaaacacuuauggagacaauuagggauuaagaaauuaacuauacuggcagagaaccuagcauaaagucaggugggcaagucuuugcuuaacugcuguauuuauguaguucagucucuucaaauagguauacuggaagaccagaaccguggucuuuacauuuuuaagugcuuccuauguccuaauacaaugcaaucuaaauauuaggcacugggauacacacacacacacacacacacacacacacacacguaggaacacacaaagugaauuucacuucuacuauuuaauauaagcauuuuuccaguuucaaaaauuuaaucuuugaaauaugcuugccaauuucuuuugcuacaguagagggagcuacaacccaaauuuuacuaauguagcaauacacaauaaggcuauucuucuccauccuuguucauuagucuuuuuaaaaaaacuuuuaaaaucagcuuuauugaaauauguuaaguguacaguuuauugcauuuuggcaaauguuuaagccuggguaaacaucagccuuacuugaugcauggaauauuuccauucuaauuuggcagucaguucuacccacccccaaacucuaaucugcuuucugucacuauagguugcugcuugugaaauuucauauaauuugaaucaugcaguauuagggaggagguaaaggauaaucauuguuuaagggguauagaguuugaguuuuacaagguaaacaaugugaauauacucaacacuacugaacuguacacuuuaaaaugguuaaggugguaaauuuuauguuacguggcuuucaccacaauaacguuuauguuugguuuuuuuuacauaauauuuuuuagguuaauccauguugcauuuaucaauaguucauuccuuucuauugaugaguauuaugcucuuguuuggauauaccacauuuuauuuguccauucacuuuuugaugguccguuaaucauguguuuuugaaaggaaucagaaaaaaagaauuguuuaccauuuggcuacacuuaaucuugcucuuaauuuuuucuuucuaguaauuuucaaauucaucccuuaaaaguaauuucaucuaauuuacuauuauuaaauaaauauuauaaaauaauuugcuauuuauuaaauaaaaauucuaaauguuuuuaaucuggugcuucuaaaagcagaaauguaggagcuaaaauuuguggcaacaguuuuucucucaaaacucagguaaauauuguugccugcaguuuauugcccuaaguuugucuggcuuuuuaaaaaauuucauugucuucuaguucuuccuuugcaaacaauuuuacuaagcaaguuauucuugauauuuaguuugguuugcuaacuuagcuacuuuuucuaagggaacauauuguaguauuguaaagaaagcuaguaauaaaugaauagaguaauagauuugugauaccaacuugauaccaauuugugauaccagcuuaccucuaggagguaaguauaugugcacuucacuguaaaauucuuccaacauuucuauguuuggaaguuuuacaggcugggcacaguggcucaugccuguaaucccagcacuuugggaggccaaggcggguggaucaccugaguucaggaguucgagaccagccuggccaacauggugaaaccccgucucuacuaaaaauacaaaaauuagccgggcaugguggugcauggcuguaaucucagcuacuuaggaggcugagacaggagaaucacuugaacccgggaggcagagguugcagugaaccaagaucaugccacugcacuccagcugggggacacagcaagacuccaucucaaaaaaaaaaaaaagaagaaaaagaaaguuuuauaaaauacugggggccaaagggaggggaaaacuaguaaauuauccagaauagguauugguacugauguuauugucguauccucucauaguuuuaauucucuuuuuuacugcuguuguuaucuucauuugcuuaugaaguuauucucaguauaagcaaaugaaugcacaguuagcuagcuaucagacuauuaaagcaaauucccugagcaagguuuugaaguaaguucagagacaacucuguuaguggcuuuguccauaaaacaucaauaguaguaugacuuuuaaauuucugagcacaagugacuaaguaauauauuuuggagagagagaaucagugggaucauugugggugaggauucucagaugaggggaaaaaacgguuagagaagacugaaaaacaaagccacuauuuccuuuguuuaucuuuuaucuugucugcaacuggaucuugaaguuagccuccuaccaugagagaacuguuuuuccagcuggaugaaaagaguagcaucaaguccccuauucugcuguuuucugcucacuuacuccuggagacaagcuaagucaaaucaauauguacuuauaaguaccugcuuucucagaguuguauuugagaauuaaaguauaugaaauguauacucuacccauaaauagcuuggagucugguuuagaaaucucuuaccuuuaggcauggacaaauuuaauaaaaguacaaaguauauaugcaguuggcccuccaugucaauggguucauggauucaaccaaacauggauugaagauauaguuuuuuaaaaauuacaucuguuuugagcauguauauaccuuuuucuugucauuauucccuaggcaauauaacaacuauuuacauagauuuaaaguaugugggagcauaugcauugguuauaugaauauacuauaccauuuuauaucaaggauuugagcauucaaggauuuuuguaucugcgagagguccuggaaccaaucccccauagauacugagggacaacuguauucagugcuaaauagaaaauaaauguuuuagaaauucagagaagggaauuuuggugcaggccagaguagucaugaagaaagacuaaaaugaugcugaauuaguaagauguuaauaggugggguaaaacagaaaguagcuuugugaaaagaaggauucagccugaaaaaauaccuuuaaaaaaacacuaaagaaacuagaccgacuaaaguacauucacuaggagaaguaguaggaaauaagagcucuagaaucaaaaucagggaagcagcauggaugacccuugaggacauuaugcuaagugaaauaagucagccauaaaaagacaaauauggggugauuccacuucuaugaggucucuaaaguagucacauuuauggaaacaaaguagaauguugguuaccagggaccuggggaggggaauggaaaugaguuuuaguuuugcaaagaacagugugaauauacuuaauacuacugaacuauacgcugaaaaauggugaagaugguaaacuuuaugucauguguuuauuaccacaauaaaaaaaauauaaggaaagcaauggcaugcuaaaaagggaauuauaagauaaaaugcaaagcacucauacuuuaacuccaaccuccucuccucuaaccccuucaauccaacuuuucccuucuuuaaaauuaucuuuuuccuaucccacugcuucccuccauuauuccuaaaauauuaauauuaauugcaaaaucacauuugaaauaguaucuugauauauaauuuauuuggauucuugcaguaauuuaaaauaacagauuauauuccagguaaacaaauauggcuaagaugaaacuagaaccccaaaggaagaaaaguaacugauuauuuuaaauugcuacuacaaaugcaguuggauugaagaaaauauagauguauuuaauguccauuuucacaaaauucuaggaagucaugguaugaagacagaaaggaacuagucaucaugaagaaucagaaaggauuucuaagaacaaguucuugcuggaccaucuaauguucuuuuuggauuggauuaauaauagacuugagaguaggggauuccaugaacauaauuacauggcauucagcaaauuguuugacacagucucucacaauggaugaguggaacuucugcuuacucuaaagauggaaccagauuuacccuucugccugaaauaaaugacaaaauauaugugaaauaaugguuuugaaacaccagacaggaggcaaugaaggacaguaaucucugagaaacaggaaacaaaugaaguaagcccuguaauugccccagcugucuugauagaguuuccaggacaugauacagggaggggacuugagacaaagcccagcgugcucccugaggagaugaagcugugaguguggggaaacuaagguagcuagaauucacaggacaguaccagagagaagagagcugcagagagaaauaaccaagggaaugcacuggaguguucagcagagugcugaucaucacaugcaugugaagaaccuaccugaggugagggaaagaaucauccuagaggauuaaaggcagcaguuucuggcacucacacagggccacauaggguugcaggaacagugccuguuaccagcaaccagacuguaaaaauucauauucaaguggcacuggguagagugaguacucaggaagguccugccucaauaguggggaauaaccugcugcuuuggaccuauguagcaaauaaugaaagcaagaccugaaaggaucagacuguuucuaagugaucuaacuacaucccugaacaaaacucaagguuuauauaaaggaauauaaaaauaacuaccacccaacaaaguaaaaucuguaaugucuagcaucuuagucaaagauuaccaugcaugccaagaggcaguacaaugugaucaauaauuaugaaaauaaaaccaacuuagaacugauaaagauguuagaauuaguagacaaugacaguuaaaauauuuaugauaacuauguucccucuauucaaaaaguugagaccuagaagauauaaaaacccaaaucaaauuucucuaaacaaaaacuguaauguuucaguugaaaaauauaccagaugagauuauuagcauguuagacauugcagaaguaaaaauuagugaacuugaagacuuagcaaugaaacuauccaaaaugaaacaagagcaaaaaauaagaaucuuauaaaaauagaaaguugucagugaugagcuaugagacaacuuacaguggcuuaaaauacaugaacuuagaaucuccaaagaagagaacacaagaagguggacccccaaaaaaacccuuuuuuugaagaaauaauggcaaaaaacuuuccaaacuugauguaaacuauuuacccacagguccaagaagcuaaacaaacuccaagcacaagaaacaugaaugaagaaaacuuuaccaagacaccuuauaaucagauugcucaaaaccagggguaaagaaaaaaaucuuuaaagcaacagaggagaaagaaaaauuagguaaacaggaacaaauauaaaaauggcagcaagaaucaaccauggaauuuuaaaccaucugauauaggaaauggaaagacuuaaaguaauuuuacagaggaucuuuauaucaugacaguucaugaauuucauaaaaauaaaaauauuugccacugaagauugauccaaauucugaaaaagcaagaguuuacuauaaaacaaagacaaaaaccuauuauaaagaagcucgucugauuacccagugaaaaugcauaauuuaaaagaacucaaaaaguaccaacaugaacuaucuaagaauaaaagaaaacuuguuauuuagcagcgcauauacuuuggcaaugaauacuggagaaaagauaaaacuauuuuuacuuuucacauuauucuuggaaaaucacuguucaaaucccuuuuauaaguacauauuuacuaauaaaaacaugguaacagaaagggauguaguauauuuuaaaugguguauguuuucuuuuaugaugaaauguuauggauggcccacaucuuuuaugaggugaaaccauuuuguaaaaauauuagcgaaagaaagugaaauugauuuaaaaaaacaguaaagaagaaaaaguuuuuaaaaagaaugauaguugcuuuaaacuuuaaaacaacagcaauuaaaagagacagagggacauuauauaaugauaaaaggucuuguccaacaggaaaauaucacaguccuaaacauauaugcaccuaacacuggagcucccaaauuuauaaaacaauuacugauagaccuaagaaaucagauagacagcaacacaacaauaauggaggacuucaguacuccacugacagcacuagacaggucaacaagacagaaagucaacaaagaaacaauggauuuaaacuauacccuggaacaaauggacuuaacagauauaugcagaacauuccauccaauaaccgcagaauacacauucuauucaagagugcauggaacuuucuccaagauagaccauaugauaagccauaaaacaagccuuaauaaauuuaagaauauugaaauucugucaagcccucucucagaccacaguggaauaaaacuggaaagcaacuccaaaaggagccuucaaaaccaugcaaauacauagaaauuaaauaaccuguuccugaaugagcauugagucaaaaacgaaaucaagaugaaaauuuaaaaauucuuugaauugaacagcaguagugacacaaccuaucaaaaccucugggauacagcaaaggcagugcuaagaggaaaguucacagcccuaaaugccuacgucagaaagaccgaaagagcacuaacugacauucuaagaucacaccucaaagaacuagagaaacaagaacaaaccauacucaaaccuagcagaagaaaggaaauaaccaagaucagagcagaacuaaaugaaauugaaacaaaaaaaauacaaaagaugaaugaaacaaaaagcugguucuuugaaaagauaaaauugauagaccauuagcaagauuaaccaagaaaagaaagaaaauucaauuaaccucauuaagaaacaaaacaggagauauuacagcugacaccacugaaauacaaaagaucauucaaggcuacugugaacaccuuuacacacauaaacuagaaaaccuagaagagauggauaaauucauggaaaaauacagcccuccuagcuuaaaucagggagaaauagauacccugaacagaccaauagagaagcagcgaaauugaaaugguaauuuaacaauuaccaacaaaaaaaagcccaggaacagacggauucacagcagaauucuaucagacauucuaagaagaauugguaccaauccuuuugacacuauuccgcaagacagagaaagaaguaacccucccuaauucauucuaugaagccagcaucgcccuaauaccaaaaccaggaaaggacauacccaaaaaagaaaacuacagacugauauucuugaugaaccagaugccaaaauccuuuacaaaauacuagcuaaccgaauccaacaacauaucaaaaagauaauccaucauaaucaaguggguuucauacaagggaugcagggaugguuuaacauaugcaagucaauaaaugugauaucccacauaaacagaacuaaaaaucacaugaucaucucaauagauucagaaaaagcauuuggcaaaauccagcauccguuuuaugauuaaaacucucagcaaaaucggcauacaagggacauaccucaauguaauaaaaccaacugugacaaacccacagcaaacauaauagugaauggggaacaguugaaagcauucccucugagaacuggaacaagacaaggaugcccacucucaccacuccucuucaacuagcacuggaaguccuagccagagcaaucaggcaaaagaaagaaagggcauccaaauuaguaaagaggaagucaaacugucaguguuugcugaugauaugaucauuuaccuugaaaacccucaagacuccucuagagagcuccuagaacugauaaaauaauucagcaaaguuuccagauacaaaauuaauguacacaaaucaauagcucuucuauacaacaacagcaaccaaguggagaaucaaaucaagaacucagccgcuuuuacaauaacugcaaaaaauaaaaauaaaacacuuaggaauauaccuaaccaaggaggcaaaagaccuuuacaaggaagacuacaaaacaugcugagagaagucauagaugacacaaacagauggaaacaucccaugcucaugaauggguagaaugaauauugugaaaaugaccauacugccaaaagcaaucuacaaauucaaugcauuuccugucaaaauaccaccaucauucuucaccgaacuagaaaaaacauccuaaaauucauauggaacaaaaaaagagccuacauagccaaggcaagacuaagcaaaaagaacaaaucuggaggcaucacacuuccugauuucagacuauaccucaggccauagucaccaaaacagcaugauacuuguauaaaaauaggcacacagaccaauggaacagaacagagaacccagaaauaaagccaaauaguuacagccaacugaucuucgacaaagcaaacaaacaaagugggguaaagacacccuuuucaacaaacggugcugugauaauuggcuagccacauguagaagaaugaaacuggauccucaucuuucaucuuacacgaaaaucaacauaagauggauuaaggacuuucagaccugaaacuauaaaaauucuagaagauaacauuggaaaaacccuucuagacauuggcuuaggcaaggauuucaugaccaagaacccaaaagcaaaugcaacaaaaacaaagauaaauagcugggacuuaauuaaaccaaagagcuuuugcauggcaaaaggaagagucagcagagugaacagacaacccacagagugggagaagaagauguaaaagugguccacaaacaugagaaaaugcucaacaucacuaaugaucagggaaauguaaaucaaaaccacauugcgacaccaccuuacaccugcaagaauggccauaaucaaaaaaucaaaaaacacuauaugugggcguggaugcagugaucagggaacacuucugcacugcuagugggaacguaaacuuacacaaccacuauggaaaacaguguggagauuccuuaaaucacuaaaaguagaacuaccauuugauccagcaaucccacuaguggguaucuacccacaggaaaauaagucauuauacaaaaacgauucgugcacaugcauguuuauagcagcacaguucaccauugcaacccaaaugcguggaaccaacccaaaugcccauuaaucaaugaguggauaaagaaacugugguauauuuauacgauggacuacuacucagcuauaaaaaggaaccaauuaacagcauuugcagugaccuggaugagauuggaaacuauuauucuaggugaaguaaaucaggaauggaaaaaccaagcaucguauguucucacugauaugugggagcuaagcuaugaggacacaaaggugugagaaugauacaguggacuuuggggaguuugggggaagagugggaggguggcgagggauaaaacacuacaaauaugaggcaguauguacugcuuagguuaugggugcaccaaaaucucucaaaucacugcuaaagaacuuacucauguaaccaaauaccaccuguaccccaguaacuuauggaaaaaaaugaaugacagcagaguccucaucagaaccaauauuccuccugaacauagauagaacuaaacaagauuuugacaaaucaacucuaacaacaaauuacauagauaauauguuaugacuaaauggguuuaucccagguguggaggguugauuuaauguuugaaaaucaaugaacuaaaauagaccaccucaguagacagaaaaauuauuuggcaaaauccaacacccauuucugauaaaaacucucagcaaacugggaauagaaggaaacuucuuacccugauaagggcauauaugaaaaaccuacagcuaacaucauauugaaaaacugaauguguugcucuuaagauuaggaacaagacaaaggugucugcucucuucaccacaccuggccggauuuuuuuuuaaacuguuuuauuucaguaggucuaguuguucaucuuacuggauuucuuauacacuauucugaaaccucuugucuuuguguuuagaucauuugggugucugagguuuauuucuuugauguuuuucaucaaagcugcucaaaauacguuauugguuuucugugccauuaaaagugagcucacuucauguucuuguugaauucuaacugaagcucauuucuccccuuuuuauuuucagauauuuguaucugcuguucuccggugaugaccuuuuaccuuuagaccacuggguguuuaauacagaggcucacccucugccuguguuacauuuagccaacaccacacuuucagguaauccugcuguucgaugaaagcaguuccagaaggaccauucucaccuguguuuuguuuacauggaccacuacagaaauuaguuugaaggggcggcuuuugaaaaccuggaccucuaugucaacaugacagggugaaacuauucccccuaagacuguucaacuuguagauacaucaacuuugaaauuauuccauuuuauaccugaccaaaacauguucugauauguguaggacagagaccuggaugugcuuugaucguuaaugagguggucacaugagaaaugauaccuguuacuacuguauuguuuuuagaguccugaagucuggaggcuagacuuccugaaagcaagucaagaauauagagcaccuugcaggaguucaagauggccuuuggaaccaauuauguauuuguuuccuccuacaguggagcagcauucaaaucaaauauuuacauauugcuuaucacuuuuucuccauuuuaauaauggaaugaacuaaaauaaacaagaacaaaagaauaguauaauuauaucaguaacaagaagacucaaaaaagaaacaggaguaccuaucccuaucugaauuuucaaguuccccauuggaugaccagacuggcaaccauuucaaaucccagucuauuucauugaaauuucuugguuaaguuuaauuuucucugggggcaugaucucacaaagaauacucaagucuuuuucuucuuauggaaucaucgaaacugcuauuuaucauaaucaccacuuaugagccuggguuugggauuuugugcauguaguucagucuaguguugguagcaugacagaaaguggggaaaaugccgcaguuuguugccuugaaaccuaagagcaauccuugguuuuguugcuacauuauuuuuccagaccaacacaucuaccaaguaaauuuuauucacuuuaauuucauaauaaaguuaguagagucacucaacuuacaacuuuauuuauguggcuuggcaaaaaucacuauaaggcagcucuaaauuugccuugauaagcuaaauaaauuacuuuuauaacuuacuaaagcagaacaaacagugaaacuuucuaaaauauucuaucuggaauagggacaggggaucuuuuauuuauaaucucaucagaugagugaguuguucacagauauuuuauguuuuuuuaauuuucuccaagaauauuuauagaauuccaaagaaucagaauaguuucaaaauaauuuucagugauaaaagaguguuguaauuaaucauauuacacuaaaauugggauacaucuaaggaacuuuaucuuacuaucaguagguuuugcauugauauuucuuuuuaaauaaacuacuaguucuuuauauuuugacaaaaagaacuuaaauuuuaucaggaacuguaagauaaauaucuagugcuuauaaauuuucuguccuuaaauuuaugugacagugcaagauacuuuugcucuuuucauuuaauauaggcaucuuccauugacauuaauaaaacuuagaaacaguauaauuaguauaacauuuacucugaauuugaagauuuccugaaacaaaguuuguacaagaagcccaccuuggaauucugaaggcuuauuuucuuguuugauaagcuuuucuuuuaaacuuagguuuuaaguuggggaaagacuuaauuaacuaauauaguauuuucuaagguugaucaucuuauaccacgaaucguuaauuuugacaguucuacugauccguaaaugauaaccacugcaaauuuuuucaguauaaaauuuuucacugcaaaaaaauuucaguagaaaauaaggaugcagggccaguuacaauaguccuuaagagaguuaaauuauagcacauguuuugacauuguaauaucuuuuacuacuugaacauuuaaauuucuaaaugagaaagguauauauauuacuguaacuguagaagggaaaagggaaaguauuugguucuaaaaaauguuagccuuccucguaaaaguagcacaagcccacuuaugaaucacugagaaaaagugaaaaacuugaguuggcaaagaugcagagcagcagugcagauggcaaugaacucucugaauucucuuuuaccuuauuuagaagaaugcagaguaaagggaccuucuugguucugcaggaacuucucaagggaugaggagacagaaccccuacuuccaagugcucuauuuguauuacccagaugacugaagcuuaagagaaggcagggaaguauacaagcagagccaguucugguacaaacaaagaauuugacagggacaauggaagggucuucuucaccacuccuuaccuucuaugugauggaaagacuagagcuuauaaaaguacuuccauuuuuuuauucuccugaauaccaaaggcaauuaaagucagcuacaaaugacuugccagugucauguuuuauuuuuguuauagauuuuuaaauuauuuccuucaagaucaauucuuaucccauauaaugcuuagcuuccaagaauauucuuuacuuucuucugucuuuuacagcucuuugcauuuuguagaccuuaauacucagguuaaauauucauugcauuuauaagaucuucugcaaaaagcccagaaaugguccuuuucaggugccucuucaaagagcugacaccuuaccuugugccuuuggcacaaaugugcagaauagauacaucaguuggugcauaaucgaaaaaaauaggaauuuugaacacuguucuuccuucuacauuuauuucucu

SEQ ID NO: 191322 - RNA, 140536 nt, Homo sapiens
uuauuuagccguugaacugccagccgcccggggcccacgcgcuccgggccgcucaggcugagcgauuucccgccuuuucugagguucugaggcgggagccauugguucuuucuguugcccucauagaccguauguagcaguucgcgugggcacagaacccacgguuucccgcuaguucuucaaaggugagggcaggugccccgaguuauuuuccuggggacugagcccagagcggggcgauguugugcuacugcaccuccccgccgcagcccuccgcuguuuucuuuuggguagugguccaggaacuuaagacaguuccuccuggcgaugugauggaauuuaaugggacaggagaagggaacgggcuuucuuuucaggccagcguggcagcgggcgguagggcgaaagggagaaggaaacgaggguuuauuccguugcccacuccgcgguaagcgacguuguagggcuccacuguagcgagagccccguggauuccuuuuuuuuuagccauuuaguuuguaaacaucacuuuaaagaauacauaguguauucaugacacucggugaaaaaaaacuuuccuuccccucccgcccccccggggcaguagauauuuacaaccguaacagagaaaauggaaaagcaaaagcccuuugcauuguucguaccaccgagaucaagcagcagucaggugucugcggugaaaccucagacccugggaggcgauuccacuuucuucaagguaaauuuccaugugacucuuaauuggacucuucuuaacuuuagggaaaugaagaaaaguguacuuucuuccuggugguguuuuauaauuauuucuucucaauaaauggucucauuuacccaagaauuuugaaucccauugcuuuaaaugaacagugagcauuauuguguaggcaucauucauuuaaauaaugacugcugccguagaacucugcauacauaguggaacgugcuuauuuuaauucuccuucuuuccguauuugauucguggcaacuuauaggacagauacuacgagauaguagaauauguuaggauaaaauuaggaaaauuaucaagaaaaaugaggacuauuuggacaaaugccuauauaugaauaauaauucguguugugacugagcuucagauuuggcucugagcuuccuaguggauagggcaaagagggaaauucauuuauguaaugguguuaucauuggauaggaggaauuauaccaaguuucucaggugaaacagagcuuuaaaaauuaauuaaaaaaauuuaucauguggauccuuauauuggagaugcaaugaugcaaugaauauuuuacuuguauaugcuguaaaacaauucuuguggcugcuauaggcaauaauauauuauuaaaugcuauucaauaaagacaaucuuuaauucuaucaagggaaaucauaaacugaagaaaucuacuaauauuguucuauacuacuaguuagauuuacuauuauucucgaauaccuacaaagccauauauugaguaauuuauaguuuagcuucaucuuacaaguggaaauaucuaauuagaauuuuuucuuuguuuauauagaaaaggcauuugauauuuuaaacacuguauguacauuaaaggauuugcaauuauaguaaccuuuuuaagcagauguauauuacauauguauauauuacacuauuaguauaucagagugguaugaaacagaauauuuaagaacuucuuugugucucuagaguuucaacaaauguacugaagaugauuuugaguuuccauuugcaaagacuaaucucuccaaaaauggggaaaacauugauucagguaggagcauggaaaagcaguguaucagcuuauauagaaacauuguguuacauacaucgauaguuauugaaaauguaacauaaguauuauauaaguauaauugacacaaaagcuagauauaauacuuaauauaaaaaauaaggcuggacacgguggcuaacaccuguaauuccagcacugugggagggaggcugauggagggggaucacuugaggccagguguuugagaccagccugggcaacauaaggagacccugucuguacaaaaaaaaaaaaaaaaaaaaaaaaccagcaaacaaaccccaccacccccaaaacuagcuggacaugguggcaugcgccugcagucccagcuacuugggaggcuaaggugggaggaucauuugagcccuagagauggaggcuuugaggcugcagugagccaugaugggucacugcccucuagucuaggcaauagugccagauguccucucucucucaaaaaaaaaaaaaaaaaaaaagagaaaaaagaaaaaaaaaaagaaagagaaaaagauguuggcguauuuaauaccuguugucuuuuaucuugcagauccugcuuuacaaaaaguuaauuucuugcccgugcuugagcaggucaguuaagcauaguacauguagauauaaucuguuuagguaaugaacugcuuauuugaagacgaaaaaagucuuuaguuauugcauuacuagucuucuguauuuaauuguuauuauuuagaagcucuuaucagaaguauuuucuuauagaaacaucuaucuuuuuagguugguaauucugacugucacuaucaggaaggacuaaaagacucugauuuggaggucagaagauuucccauucauauuaaauuucuuguaauuggaauauaacuuauuaccuauauguauauuucuuuugaagcuucaaaaggauuauuauuugauuaacguuuuaagauauauccuuuaaaaccuuuuuuucugcuucuguauuuuuuggguuaugaaaguuccauuuauguagaggcaauuuaauuuuaaaccaugaaaucaagaagaggggaaacgaguacuauaccugaaaaguauauuaucaagagaguauuuuacaaaaucagccuuuaauuaauagacgaaauugacugguugacugguuuauuguauaaggaauuuguaggacaugcuauauacuuuugauuuuaguuauaaaaauauuucuuauuuauggcauauagugucuuuaaaaugaagagaaauuccauagccugguaagguacuguauguuuguugcugugauuaugguaucacagaauuuaaaauauauagaacuuauuuauauauuuuuauaagaaaaaguugucaaccagcaaaaauugaugugacuaaaaaucucugauauuuacaauauaauguggauuuuaaaaaggcaggaaaucuauauaaaaaucagacuugaugaaaauuauaucuugucuucacuuuuauuuuucuugucauuauauuuuaaacuucauguccuuuagugaaucuucaaacuguuuguauaaucaaaguguuucaagaccauuguuaagauuuauagauuucuuauaggaugauuuauuuuagcuuuuaaccagccagauucugucacuaacuaaaauauuuuuauggagccauuucauuuuauucagcaagguauaauuuagucaagugaccaauaacuuuaaugaaguaguuaauauugccuuaguaguuuaaaagaguuaauguggcuuucaguaugcuauuagugcuuaaauugaggagauauuuggucucaacuauuaguauauggauauuuucaguaggcagcuguaguuugguuauauuagaauuuuggacaauuaauuuuugaaaacauauuuuaauagaauucagagggauugagcagaguguauucaaaacuguauaaggaggcugaaaagauaaaaaaauggaaaguaaguacagaagcugaacugagacagaaagaaaguaaguugcaagaaaacagaaagauaauugaagcacagcgaaaagccauucaggaacugcaaguaugacacaauuuugcauuguaaacauaguauaguaaaucuaaucauaauacuguugaaaguagaguauuaguugggauaaauuggauugaucuuguuuuugugaugaauauuuuaaggauaaugcuuuuuaaaaguuacaucaauacuggauacauuuuaacuuuaagaaugagcauagaggacaaguuguauaacgcuuaaugcaaaugauuagggaaauaauaaaucacuuuauauaaaaauugauuuaaugauucuaauuuauuauaaagaguuucaauuuuuauuccuauugauguuuuauguaaauauauucucuuagauuacaauaguuguagguaacacuuuaaauuugaaacuguguaacuuuauuuuuuuuauuuauuuuugugagacauagucuugcucugucacccaggcuggagugcaguggcaccaucucggcucacugcaaccuucgccucccugguucaagcgauucuucugccucagccucccaaguagcugggacugcaggcuugagccaccacgcccagcuaauuuuuauauuuuuaguagagaugggaugccaccauauuuaccaggcuggucuugaacuccuagaccucgugacccaccugccucggccucccaaagugcugggauuacaggcgugagccacugcucccggccgaaacuguguaacuuuaucuguagcauaaagugaaaaaaauguugagaaaaugugacauuguauuaggacaaagaaaaaaacauuacuucaaaaauauuuagagaagauaauauugcauuaaaauauuguugaauguuucuuggagaugauuuagccuucuuuauuuuagauugaugaaggccauauucuuaagggaaaucauaagcuauuacaaaaauguuuccuuuuuauguggaaagaaaauaauucuuuuagaccauuguguauuaguaaagaaauacugcuuaaugauuauauucguguuuauuuuugcuaauaagcaaaaugggaugaacuuuucuguuuuauaaauuaguuuggaaaugaaaaaguaaguuugaaauuagaagaaggaauacaagaaaauaaagauuuaauaaaagaguaaguaguaauuuaaugaauuuguucuuuucacauuuuuuauuccaaauuuacuacuaaaauaauuuucaaaaacauauugagcacuuucuauacguuauaucauaugaauuuauaaguagaauuauaucugagugcuauggaaaaaggaagauguacauucuuguguuuggcaaacuguggucacugacuaauaacuucacuuuuuaaaaugucaggcaucaggaauaaacauuccuuggugucaaaaaagaugccugauaauucuguaucuacaacuaccuauguauguugucuguuucacugcugucuugaguacaguacuuauaaaacaggacuuaacuuaguuccaaguuaauucuuacucaaauuccuguuuuugaaaauguaacaguuuauuucuacagaaaaaugguaaguuagaaaauuaagucuaacugccauauguguuaguaacuucaagauagccacaggucucaucauucacauaaugaaugccuaaucagaaaguuaccuuauuuuguguuuugaagguuagacauauauuaauuuguuaaugaauggcccaaccuauucucauuauuuuuccuuaggcaaaucuagaccuguuuacugaaaguuuauugauagcaacuuggguagaaacuuguuaaggagcugucacuuuuauuuguuuauuuauuuuaguggccaguuacuagaacuuuuacuuuuaaagggaggcaauuacuaaaucaucuuugcuaguaguacagucaacccacuguuucuucauauagucauuuaugaauaaugugauguaugccaaagauuauaauauuuuaaaaauuucuuaaaaauuguaacaauauauuucauaacuuauauauugugauuuugcuuugagaucagauuacacacaggcaaacucuuuccuuuguuucaggaauaaugccacaaggcauuuauguaaucuacucaaagaaaccugugcuagaucugcagaaaagacaaagaaauguaaauaucuuucuuguuuuaugugauuuuaucaauuuauuuuacugguagagguggagagggaaagaaauuguccuuuuaauuuuuggaaccaauuugauuugaacaaauuauaugugccucagacuauuuuuauauaaguaauaaggagaaucacaguucuuugacuuuugaaagcucaaaauuuuuugaaagguaauauaugucaaaggguauauucuugauauuuauaguuaauccugguuucaaguaagguaugauuuugagacuaaccucugucuggaacaacuaggaaauucaaucgagaauaagauacauagccaugcucguaauagaaaauaccaguagaggcuuugcuaaagccauuguauuuaugaauaguggugcaauguuuauuuucaaucuaaauagaauucucaaauuuuuccuaaagaaaaauucuuuuaaaauauucuaauaugguuguguuguguaugugaaagaacaguuuaaaaauuuuaaagcauguuuucauuuuuuuaaauuauaaaguaggauuuuuucccauuuugaugaaaaauaagugugugauuauaaaauauaauucuuuauuuuugccauaauuugacccuggcuuuacuuuguuucugccaagaauccauugggaaauacugucuaccugcuuuuucgggauauucucuauuuuucuuagcuaaaaauuuuaauuuguaucauacagcuuacuacuuaacagcuugggcuuaaggauuagauagccggugcucaaauuuagacuuucaguuucuguccaccuagggagcuugaauaauuugaguaaauuauguagucugucugucacucuguuuauuaauuaaaugccucuuaguauuguccugaaaauuaaauguuaauaaauaugcuuagaacaaugcaaagugcucaauaaauguuggguauuuuauuauuauuauugucguuauuucuaacauugacuguuagguuuuuuuauucuuuuuuuuuuuuuuuuugagaugugguuucacucuuguugcccaaccuggaguguaauggugugaucucggcucucugcaaccgcugccuccuggguucaggcaauucuccuuccucagccucgcgaguagcugggauuacaggcaugugccaccacacccagcuaauuuuuuguauuuuuaguagaaaggggguuucaccauguuagccaggcuggucucgaccuccugaccucaggugauccucccaccucagccucucaaaaugcugggauuacaggcaugagccacugcacccggccaggauuuuuauucuuagucccugccuguauuaccuugcuuuucaaaacucuauguaucuuccagaauguaccauaccacuaccagcuccucuacuauauccuauguacucaacauucaagauuaauuuuucugccuagauauaaaaaguggugaaaaguacagugauaggguagaaggauaguacauuggcugucuugcagaaaauaacuuggguuagagagacaagucugauaguucuuuuuuguucuuuguuuuuuuuuuuuuuuuagacgaagucuaacucuguggccaggcuggagugcaguggcacaaucucggcucacugcaaccucccaccccuaggguucaagugauucuccugccucagccuccugaguagcugugacuacaggugcccaccaccacgcuggcuaauuuuuuguauuuuuaguagagaugggauuuuaccauguuggccaggauggucucgaucucuugaccaccugccucggccucccaaagugcugggauuacaggcgugagccacugcgcugggcgauaguucuuucuuacauuuaguuuucagcuaaguuagaaaucagauggugaggaagguuuagagaacccaacauuuuucaagguggucucuuuaauaaacuaaaguugagguaugucuugaugugacauguagaaaguuuuuuuuuuaaagucuugacacuugcuuuauuguuaguguaaacucuaugcagauucuugccuuaaguuguugaccagucuuuuuguuauugugcuuuuuucuuucuuuuauucauucauucaauauuuuuuuagugccugcuaugucaugaaaucuucuagaugcugaugaaaaacagcagugaacaaagucucuacucuuacaagaguguauauuccaugguguauaugugccacauuuucuuuauccagucugucauugaugggcauuuggguugguuccaagucuuugcuguuguaaauagugcugcaauaaacauacgugugcaugugucuuuauaguagaaugauuuauaauccuuuggguauacaccuaguaaugggauugcugggucaaaugguauuucugguucuauuuccuugaggaaucaccacacugucuuccacaaugguugaacuaauuuacacucccaccaauaguguaaaaguguuccuaggccaggcacagggcucacgccuguagucccagcacuuugggaggccgaagcaggcagaucacgaggucaagagaucaagaccagccuggccaacauggugaaaccccaucucuacuaaaauacaaaaaaauuagcugggcaugauggcacgcgccuguagucccagcuacucaggagguugaggcaggggaaucgcuugaacccgggaggcggagguugcagugagcugagaucaugccacugcacuccagccuggcaacagagcaagagcccgucucaaaaaaaaaaaguuccuauuucuccacagccucaccagcaucuguuguuuccuggcauuuuaauaauugccauucuaacuggcgugagaugguaucucauuguggucuggauuugcauuucucuaaugaccagugaugaugagcuuuuuuucacauguuuguugguggcauaaaugucuucuuuugagaagugucugguuauagccuuugccgacuuuuugaauggguuucuuuuuuuuucuguaaaagaaugaguucauguccuuugcagggacauggaugaagcuggaaaccaucauucucagcaaacuaauacaggaacagaaaaccaaacaccaaauguucucacucauaagugggaguugaacaaugcgaacacauggacacagggaggggaacaucacacacccgggccuguugggggguggggggcagggggagggagagcauuaggacaaauaccuaaugcagguggggcuuaaaaccuagaugauggguugauaggugcagcaaaccaccauggcacauguauagcuauguaacaaagcuacacauucugcacauguaucccagaacuuaaaaaaaaaaaaagaguauacagucuagugaggggagaggauacagaucauuaaugaauaaauaaaauauauguuaggugauaacugcuuaaggagagaauauuuugggacagggugauugggaaguuuuuucugguuaagugacauuggguagagaccugaauaagggagugggccaucuauuuuaggaaagaauauuucaggcagaggaagcaguuaagugcaaagucccagagaugagagccuguucaaucuuuucaggucacaauaaugaggccacuguucuguauuucugacucuguauuuuucaucuuuuuucucacuguacuccacucaggauacuuuuuucuuucuuucuuuucuuuuuuugauggggggugggguggucucacacuguugcccaggcuggagugcagugguuccaucuuggcucaccauaacccccgcaucccaagcucaagcaaucuuccuaccucaguuucccaaguagcugggacuacagcugcacaccaccagggcugucuaauuuuuguauuuuuuuagagacaggguuucgccauguugcccaggauagucucaaacuccugggcucaagugaucuucccaccuuggccucccaaaauguugggauuauaggugucagccacugcccuggcccacauaauuucuucuaaccucucuuccaguuuacugauuuucuauuuaguuaauucuugucuguuuuauuuuauuuuuauuuuauuauuauuauacuuuaaguuuuaggguacaugugcacaaugugcagguuaguuacauauguauacaugugccaugcuggugugcugcacccauuaacucgucauuuagcauuagguauaucuccuaaugcuaucuugucuguuuuaaaauuuaucaguuggugucuuaauuuguuauuguauuuacugguugaguauuagcuaguucuuuaaaaauuuguagugucacuuuccagaauuuuaaguucuuugcugacuuuuuaaagcucuacuuuuuaucuguaugaacauaauaaacauaguuguauccaauaaugccaacgucugcaauacccugggguccauuucugugauuuuuuuuuugccauagauccuaguuuuauugguuaucucaucagcuaucuuagauaauaauuaauaauuugagacuuagaaugguuaaauuuuccuaguucauugaauguucagcaauucuguauuauauccuggauuauguugugagaaucugaguccucuucagauuuccuagagaauguuuauuuguuuauuuucuaacaggcagucagcucacuuagguuuagaauagguucugucuugccuuuucauuguggguguuccaauaucaguucaauuuucaaugccuuugcugugcugcccugggucuauuucauguaugcuguacucaaggauaguucugggacuuggguaguguuuuaugcagaguccaguuugcaaagcuuuugccccaugcaucuauagccucuccgauuaucaacauaacucaccagaguggcauguuuguuacaauugaugaaccuacauaggcacaucauaauuguccaaaguucauaguuuacauuaguguucacucuugguguuguacacucuauggauuuggacaaauauguccgccauuauaguauaauacagaauaguuucauugcccuaaaauucuguguucugccuauugauucucuacacccuacucugguaaccacugaucuuuuaacugucuccauaauuuugccuuuuccagaauguuauguaguucgaauccuacaguacguaggcuuuucauauuggcuucuuucacuuaguaauaugcauucaaguuuccuccaugucuuuucaucacuugauagcucauuuuuuaagcacugaauaauauuccauucauuguuugcacauaccacagcuuauuuauccauucacuuacuaaaggacaucuugguugcuuccaaguuuuggcaguuaugaauaaagcugcuauaaauauccaugugcaggcuuuuguguggacauuuuaaacuccuuugaguaaauaccaaggagcacaauuccuggaucacaugguaaaaguauguuuaguuuuguaagaaauugccaaacugucuuccaaaguggguguacaauuuuuuauuuccgccagcagugaaugagaguuucuguuguucuauacucucaccagcauuugguguugucaaaguucuggauuuuggccauucgaauagggguauguauugauaucucuuuguuguucuaaauugcauuucucugaugacauaugaugggaaucuuuucaugugauuauuugccaucuguaugucuccuuugguaaggugucuguuaaggucuuugucccauuuuuuaaucagguugcauguuuucuuauuguugaguuuuaaucaacaauaagaaaaaagacuuaacaauuuugagucuuuguauauuauagaaaacaguccuuuaucagauguuucuuuugcagacauuuucucccagucugcggcuuguauucucauucucuugacauuaucuuuuggagagcagaaguuuuuaauuuuaaugaaguccagcucauuauuucuuucuuucauggauuguaucuaaaaaaaaaaagucaucgugauacccaagaucauccagguuuucuccuauuuaucuuggaguuuuaugguuuguauuuuacauuuaggucuaugauaaauuuugaguuaauuuuuguuaaggguguaagaucuguguccagauucuuuuuuuuuuuuugcaugcagauguccacuuguuucagcaucauuuguugaaaagaccaucuuuucucuauuuuauagcuguuacuccuuugucaaauaucaguugacuauauuuguuugggucuauuuguuacuccuuugucaaagaucaguugacuauauauauugggucuguuucuggacucucuauuuuguucccuugauuucuuuguccuuuucccccacaaaucccucacuauguugauuacuguagcuuuauaguaagucuugaauuugaauaguaucaguucuccaacuuuguucuucuccuuuaauaucguguucgcucuucugagucuuuugccucaccauauaaacuuuagaaucaguuuguagauauccacaauauaacuugcugagauuuuuauugggauugcauugaaucuguagaucaaguugggaaggauugacaucuugacaauauugaaucuuccuaucuaugaucauggaaucuuucucuauugauuuaauuauuauuugauuguuuucaucaaaauuuuauaguuuuccucauauagaucuugcauguuuuguuagauuuguaccuaaguauuucauuuuuuuuguauacuaauguaaaugguauuguguuuucaauuucaaauuccgcuuauucauugcugguguauaggaaaaugauugacguuuguauaguauauuaaucuuguaucguguaaccuugcuguaauugcuuauuaguuccaggauuuuuuuuuguuaauucuuucaaauucucuguauagacaguuauguuaucugugaauaaaguaguuuuuauuucuuuuuucucaaucugauuccauuuguuuccuuuuuuuguuuuauuguauuaauuaaaacuuuaaguacaauguugaaaaagaauggugagaggggacauccuugccuuguuccugaucuuagugggaaagcuucuaguuucucaccauuaaguaugauauuagcuauagguuucuguagauauucuuuacuagauugagcaaguucccuucuauuccuaguuuacuaaaaguuuuuaucaugaguggguguuggauuuugucaaauaauuuuucuauaucuauugauaugaucuuguaauuuuuuagccuguuaugugauggauuacaauaauugauuuaaaaugcugagccagccuugcauaccuugacugcaucccauuugguuguguuguauaauuuuuuuuauacuuuuuuuuuuuuuugagacaggaucuugcucugucacccaggcuggagugcaguggcuauucacaggcaugaucauaacucacuauagccuugaacuccugggcuuaagugauccuccugccucagccuccucaguggcugagacuauaggugugugccacugcacccagauaauuuuuaaaauuucuuuuuagagaugggaucuugcuauguugcccaggcuagucucaaacuuuuggccucaagcaauccuuucacuucagucuccugaguagcuggaauugggauuauaggugugggccacugugucaggcuccuuuuauauauuguuggauuugauuugcuaauguuuuguugaguauuuuugcaucuauguucaugagagauauuugucuguaauuuucuuauaaugucuuugucugguuuugguauuaggguacugcuagaaaauauucccucugcuucuaucuucugaaagagauaguagagaauugguauaguuucuuccuuaaauguuuguagaauucaccagugaagcuggcaggccuggugcuuucuguucuggaggguuauuaauuauugacuuaauuucuuuaauagauauaggcuuauucagauugccugcuuuuaauucugugaguuuuggcaguugugucuuuugacaguugguccauuccauuuagguuagcaaaccugugggcauagaauuguucauaauauuucuucauuuuaacauccaugagguuuguagugaugucuccuuuuucauuuauggauuaguaauuugaauccucucucucuuuuucuuagccuggcuagaauuuauugauuuuauugaucuuuucaaauaaccagcuuuugguuucauugauuuuuuaaaauauugauuuucuguuuccacuuucaugguuuuuacucuaauuuuuauuacuucuuuucuccuucuuacuuuggauuuaauuugcucuucucuuucuaguugccuacaguggaaacuuagaugauugauuucagauugucuuuuccaauuuaugcauucaaugcuauaaauuucccucucaguuuuuccuguaucgcacagauuuugauaauauguguuuuaauuuucauuuaguucaaaauguuuuugaauuucucuugagauuucuucuuugacucaggugguauuuagaagugucuugguuauucuccaagcauuuugugauuuuccagguaucuuucuauuauuuauuucugguuuaauuccauugugaucugagagcagauacuguacaauuuauaaucuuuuaaauuuguuaaggugugucuuauggcccagaauauggucuaucuugaugaauauuccaugugagcuucagaagacuaugcauucuguuauuguuggauuaagcagucuguaaaugucaaggugauugaugguuuuauugaauccaacuacagguuaagcagcccuaauccaaaaaucccaaaucuaaaauacuccaaaauccaauugagugccaaaaugaugcucaaaggaaaugcucauuggagcauuucagauuuuggauuuucagauuggggaugcucaacugguaaacacaaugcaaauauuccaaaaucuaaaaagaaaucugaaaucugauauauuaauuguccuggucccaaacauuuuggauaagggacacucaacauacaugucuuacugauuuucugccugcugggucuguccauuucugauagagauguugaaaucuucaacuauaauaguggauuaauuuauuucucuuugcgguucuaccaguuuuugcuucacguauuuugacaccauauuauuaggccuauacauguuaaaaauuguuauaucuccuuggagaaaugacccaaaagcauuuuauuuuuauuuauuuauuuauuuuuugagacagggucuuggucuguuacccagacugcagugcaaugaugugaucauaguucacugcagccuugaaauccugggcucaagcgaucuucuuaccucagccucuugaguaguggggacuauagguguguaucaccacuccuggcuaauuuuucuauuuuuuguagagaagggguuugcuacguugccuaggguggucucgaacucuugggcucaagugauccuccauccucauccucucaaaguacugggauuacgggcaugagccacugugcccagcucuaaaagcauuuugaaauggcccucuuuauaucugacaacuuuccuugcuuugaaguuggcugugucugaaauuaauauagcuacucuuuuuauaugauuauuugccauccauaugucuccuuuuguaaggugucuguuaaggucuuuggcccauuuuuuaaucaaauugcuuguuuucuuaauguugaauuuuaaucaacaauaagagaaaagacuuaauaauauuugagucuuuguauauuauagauaacaguccuucaucagauguuucuuuugcagacauuuucucccagucuguggcuuguauucucauucucuugacauucucuuuuguagaguagaaguuuuuaauuuucuuuugauuaguguuaacaugcuuucuugugauuaguguuaauaugguguaucuuuauccauuuacuuuuauucuagaugugauuuuacauuuaaagugaguuucuuauagacagcauguaguuggguauuguuuuuugauccacucugacaaucucuuaguuggucauuuagacuauugucauucaaagugauuauugauauaguuggauuauuaucuaccacauuuauuacuguuuuucuauuuguuguccuguucuuuguuccuauuuuugucuuuuacucuuuuuaugcuauuugugguuuuaauugagcauuuuaugugauuccaguuucucuccuuucuuagaauauuaguuauacuucuauuuuuacuuuuuaaagugauuucacuagaguuugcaauauauauuuacaguaauccaagucgacuuucaaauaacccucuacugcuucaagguuacagugaguaccuuauaauucuuuccucccaucuuuuuuuuuucuuuuuuuuuuuggauacagagucuuguuuuauugcccagauuggagugcaguggugccaucucgguucaccacaaccuccaccuuccgggaucaagugauucucgugcuucagccuccugaguagcugagauuacaggugcccaccaccaagcccggcuaauuuuuguauuuucaguagugacgggguuuugucauguuggccaggcuggucuugaacucuugaccucaagugauucacccuccuccaccucccaaagugcugagauuaugggcuugagccaccaggcccggcuggccuccucccgucuuuuguaucauugcugucauuaauuucuuuuauauaaagcauaaauaagcauuuauaaucuaauacauuguugcuauuuuuuuguuuguuugucuguuuuuuguuuuuugaggcagagucucauucuguugcccaggcuggagugcaguggcaugauccuggcucacugcaaccuccgccuccuggguucaagugauucuccugccucagccucccgaguagcugguauuacaggcgugugccaauuuuuuuauguuuaguaauaugcuaauuuuuguauguuuaguagagauggauuuucgccauguuggccagacuggucuugaacuccugaccucaagugauccaacugccuuggccucccaaagugcugggauuacaggugugagccacugcgccuggcccauuauugguauuacuauuuuugacaaacuuauauguuagaucaauuaagaaugagaaaaauaaaaguuauuuagccuucacuuauuucugcguugaugcucuuuuuuuucuuucuuuuucuuuuuuuuuuuuuuuggcagagauggggucuugcuauguuauccaggcugguuuugaacuucuggccucaagugauccucccacuuuggccucccaaagcacuggaauuacaggugugagccacugagaccagcuguugcucuuuuuuuucuuuauagagaucugaauuucuuacauaaaucauuuucuuucucuuuaaauaauuucuuuuaacauuucuuggaaggcaggucugcuggcaacacauucugucaacuuuugucaaagaaaguauuuauuucuucacuuuugaaggauaguuucucaaauuacagaauucuguguugcugguuuuuucucucagcauuuuaaauauuuuacuccauucuauucuugccugcgugguuucugaggaggagucagauagaaucuuucuuuuugcuccucuguagguaaaauguuuuuuuccucuagcuuuaucuuugauuuuuuguaguuugaauguaauaugcauagguguagugucuuuggcauuuauccugcuuucuguucucugagcuuucuggaucugugacuuggugucugaaauuaauuuagggaaaauucuuagucauuauuguuacaaauauuuuauguuccuuuuucucuuucuucuccuucugguauucccauuauacuuuuuguaguugucucacaguucuuggauauucuguucuguucuuucuagucuuuuuucucuuugccuuucaguuuuugagguuucuguugaaauaucuucaacuucaaagauuacuuuccucagcugugucuagucuacuaauaagccccucauuucuucguuuuauuuuuuuuagagacagcgucuuucuauguugucuaggcuggucuccaacuccuggccucaaguaaucaucuugccugagccuucugaguggcugggauuaugggaaugagcccccacacccacaagcccuucauuucuguuacagugguuuugauauguagcauuuuuguuuugagucauucuuagaauuuucaccuaucucuuuaaauugcuuaucuauucuugcgugaugucuacuuuauguacuagagcccuuaguauaucaaucauaguuguucuaaauuacuggucugggauaauucugacauccuuaacuguaucagagucugguucuuaugcuugucuugucaaaguguauuuuuugcuuuuaguaugcuuguauuuuuauuguuuuggauagcuacacaugauguacuggguaaaggaauuguuguaaugugcugguaaaguauagggggaggaguauucuauagaccuaugguuaggucucaguuuuuuagcaaauuuuugccuccagauaaugaacuucauaaauacuccucagcccuugcaucccucuccuccuuagaugggacaaggugguagagugggcugcaguugggaauuucccauuuuccaucuggauggcuagagggggauggaguuggauauuuuccuuacuucacauggaaggcuagagcugucuggaauuggguauuucccuucccccagguuaguuaggcucugacaaauucccagcagauuuugcucucccaaaggaggccuuguuaagaacgggacauauugguauaguucaaaacggcuuuuccuguuagaagcacaaggggauguuuuuccuauguucauugugagaaaccugguagagcuccagaagguuaaacucacaagaaucuggggccucucugaugacugggucuccacagagguuuuuuuauuuuuauuuuuugagauagagucucacucugucgcccagcucacugcgaccucugccuucuggguucaagcgauucucauguuucagccuucugaguagcugggauuauaggcaugugguacuaugcuuggagaauuuuuguauuuuuaguagagaugggguuuuaccacauuggccaggguggucuugaacuccuggcaucaagcaaccugccaaccucugccucccaaagugcuaggauuacaggcgugagccaccacacccagccuccacauaguguaucucucagauuuguuuacacugaauuuccagcaaugugucaauuauaguucagguuuucuuucccugacucugguucccacagaguuuucugcuuauggguuucugcccugguaaguuguaauucucucuguguuugccugucucuccaauuuugggguaguaguuugcccugcgacuuuacuucucuuaaggaucugagaagaguuauuaauuuuuuaguuuguucagcuuuuuaccugucguuaggauggagcagugacuucuaagcuucuucacaacagacugaacccaaacagcuuuugaugcaacuuaaaaagacccaguaaugauuuagauaacccaauguucaucauuaacacagaauuuuaaauauuuuaauguuuucuggaggcauuuugaguauugucuuguugacaucuuauuuuaaaauuuaaucuugaaauuuuuauauuaacaauagaugaauaugaacgggaagaaaccaggcaaguuuauauggaucuaaauaauaacauugaggugaguguuaaugaaaucugaguauuuuaaacauaggaauuucugagcaaauuagagcgauugcuacaaagauauggacaacuauucuuacuaaaaagauuauuauuuauuuguugauauauuauuguaucacuaauaaaauuccuaagguucuguacuaugagcauuaauguuauguaggagcuuuuugauuuacauguuagugacaucacuuaauuuaucaaauauuuacugccuuuugucagaaaucagcacauugugacacauaaccauuaauuugaaaacauauaaaguauuauucaucugugucuggcuucuguuuaccuuuguuuucucaucuccugucauuguccacuuugcuuuucugcuguagucacucuuuuauguuucucaaauuugccaagcucuuucugauggugguucuuugaauuuguacccuuugcagaacuuuuaugucuaagaucuuaugcacauuucuaaacuucauucugcuuuuuuguuauucuccccuuaauacuuuaucuaaaauuucuauuugauuauuccauauauauccaucucauuuaacuuuucucaagagcacauaaagcugcauggcauguauuugauauguguguguguguguguguguguguguguauuuguauucuuuuuuacacuuuauuguaagguccaguaggguagagacuuugucuucuuuuuuuuuuuuuuuuuuugagacagucuggcucugucgcccaggcuggagugcaguggcgcaaccucggcucacugcaagcuccgccucucggguucagccauucuccugccucagccuccggaguagcugggacuacaggggacagccacuacgcccggcugauuuuuuguauuuuuaguggagacgggguuucaccguguuagccaggaugguguccaucuccugaucucgugauccgcccgccucggccucccaaaguucugggauuagaggcgugagcccccgcgcccggccgagacuuugucuucuauuccuauuaccuaaaacaguuccuggcacauaauaggcacucaguaauuaauuaauuaauuaaccugauuuuacaaagcaagauuuguugaaugccgaaugaacacaugcugccagcugauggaaguguaacuuuggauucauggggagaggccucacauuaguggagaagacguaaauaaauaagcacaaauaaauacaaaauuacagauuuugauacaugcuauuaaguaaauggcugguguaccaacaauccauuugcugcuauuuuguauuguauaacauguugccagugcauuuaagcaucugggaaacuaacauaaggcccucuuaauacauuuuuaguaaguaauucaaauuacaguguuuuaguuauuccaaauugugugguuuuaaauuuaaugaucacaugauacaaauuugguaauauuuucauaguuugaagaaagcuauuuaaaaaaauuuaaguaugauucuuaaaacuuuauauuucagaaaaugauaacagcuuuugaggaacuucgugugcaagcugagaauuccagacuggaaaugcauuuuaaguguagguauagggaucuuacuuaauuuuuauauuacuguuuugcuauuuauauuuuuaucagauuccguuaaugucuucaucucuuuagccugaugcucugaacuauuuucuauuuuauuuauuucuguaagccccucuaaaucuuguggaauguggcagggaauuaauauuuguuaaaaauaauuuuggguuuuaaaacuacaucuuucaugaaaucaaacuaauuuuauuuuuuuuuuagaaaugugauuuggucucuuuuuacauaucuugguauaguaugcauguuaaaauaauuguauauguaucauauuauacauauuuaaaaccuguuguuucagauuaguguguuuuagagaauaaaguuuuauauauaagaauuauagaauuuuagguuauuauaacugauauuauuuauauuuacuauuuuacuaaacagaaaggaagaaaacagcaauauuagcucauuacaaacuuuuagaguuuaauauaauuuagagauaaauaaagaggugaaauaaacuuuaaauuuuguuuguaauagaaauguuauaaaauuauguuaugacauuacaguauauuuguuuuauuuuuaaaguaaaggaagauuaugaaaaaauccaacaccuugaacaagaauacaagaaggaaauaaaugacaaggaaaagcagguuuuuuaaaaaaccaacucuuuguauucuuuauauuugcuaauucauuaaaaacuuaaaauuucaaaagaaguuuauauuuacugaaaguaugauaaauuccuaugagagaauuuuaauauuauacauauauuaauauuuagccuuuagacucacuuaauuuucauugacucaaauauguacucacucuagcuuuuuuuggguuuuaaucaauuauucuucuauaauauuuauaucaguggguaauaggauauugccucaaaauauauuauuuugugagaacuuuuguucagacaaaaacuucaugaaauguauagaugaucauugacuacucaacuuacauuuugcaguuuguuuugaaaugugcuauucauaauaucaaugaagaggaacuaaaauauucuguugcaucuuucuuuuuucuuuuuuagccuaagaaaacaagacacagauguuuuuuauauucaugucauauaguggaagacuugaaaauguuaacucuauauccuuuggcauucacaagaauguuucagauuauuauuaugccaucucuaucaguuucaagucuucugcuucccaaauggaaagcaauauauauaauagaauccucuucuauuucucacuauauuugcaguuuuucuugucugauuugccacaagauaucuucuaauaugguuaacaaggauaucuacuuaauaauuuaaaaaauuaauucacaguacagagaggauaauaaaaaccacaaaaauagagugaaguacugaaacgcuuuuuggaguucuaggugcaugggcagagcuuacagauuguugggcuuccuuguaaaaugauggcauggccagcuaguguuuuugcugaggacuccuaaaugucauuauuuguaacacuuuuuuugcuggggguuucuaaauucuugcuuguggauauaaacuuggcugauggcauucuggagcugaauugggcaggauagcaaagacagacugaaucuuaccauuauguauguugacuuuuccauuauauauacccccacccaucccugugccuggaauaccgauguuuagagauugccuuuuucaauuugauaugacacugucucuuacaaagauaauagggccaguucucugacuacauuggcugccagggaguagagaccagggugggaggguuaaguggaccagcugaaaagcauguagacaaguacauaaaauaauuguagguauuauaaauguuaaggugucauauuuaaauuuucauauugauaauguauuauuuaaauauuuuagguaucacuacuauugauccaaaucacugagaaagaaaauaaaaugaaagauuuaacauuucugcuagaggaauccagagauaaaguuaaucaauuagaggaaaagacaaguaagaguuuauauaagauaauauaaugugccuuauguauuccucuuguuauguucuaaacauugacuuucauuacaaguuuguuguaaugcuuucuaguacuguacuucucaaucugaguugguucgguuggaggagggcauaauagauuaaccuggggagcuuuuguaaaauacauguacucuucuuuuccuuuuuccaugcucuuaccuuuuucaaauguuucaacuauaugcuccacagagacagagaccuugucuuuuuuguucacugacuuggaacuguugcauuccaagugccgagaacaaugccuggcacauauaaggcacucaaaauuaauaauauuauuuuuguuuuuugagauggagucucacuguaucacccaggcuggagugcaguggcacaaucuuggcucacugcaaccucugccucccgaguucaagcgauucuccugccugagccucccuaguagcugggacuauagguguguaccaccacgccuggcuaauuuuuguauuuuccuagagacggguuuucgccuuguuggccaggcugauuucgaacuccugaccucaggugguccacccgccucagccucccaaaguucugggauuacgggcgugagccacugcgccuagcaaaaauuauuuuuugaaugaacaaaucauaugggagcaugauggagagaguuacuaauuuuucccagagagagaccuuuagaaaggcauuagggaaaaacuguugaacuguuuaaaaguuuacuagacagugaacuggaguagacaauacagguggaauaaacggcuugugcaagucauggaaguaggaauguuaggguauauuuuuaguaaacugacugguguggcaacaucuuauugaacucagacagaugaaauuguaaaagauuuggaucccuuuaugaaggauccugaguguuaugucauguuuagacugucuuauuagggaauauuuuucaaacuuuuuuaaacggcaggacacuuagaaggcauaguguuugugaaacaccaugcaccuuccagaacauuauagggauauuauggcauuuguuguuuuucuauucuucagaacauucucuugucuucacauggcaaauaauuaucugguuucugccaaucuauaccugcuaauuucaucuuacugucauuacuauaugauauacuccagauauauugaaauaauuuaacuucaucuauauuuugugcucuuucaaucccaccccaugcuuuuggcuacuuccuguacucaaaaugaaucucuucucuccaccccaagucuguuggcuaaauucuuaguaagggcauaaacauuaccuguuuguccccugugacuaggaguguauugaggagggauugggucuuaaauaucuuuguaacuguagugcccaguauaugguuuugcacauaauaugaguucaauaguuggaugaaugaaauaauauuuaaucuuaucauauaaacugaaaaaauuaauaaauaacuguaauucuauaugauuccuguagacucauacccacugaaguguguucauuuaagugacuuuucauuguuuuccauaaguauguaucuuccacuuguuuuucucuguguucaguguggauauuuuuuacugaucuguuaucuaauccuggcugugaugugucuaauuugcuuuaaaucuaucuacugaauucuuaacuuuaaaugaaucauguauuuuucauuuugaaguuuccauuugauuacuuaagaguccaauucugugguuaaguuuucuccucuuuuaaaaaucucauuuuucaccucuuaaauauauauucgucauugauauuuuauagcuauucucuguuuauuucaauauaugucucaucuguugguuuauuucuaucguuucuuuuuuaaaacuaugguaaaauacuuguaacauaaaauuuaccaccuuaaucauauuuaaguguccaguucuauagcauuaaguauguucacauuguuaugcaaccauaaccaccaucuuucuucuccaagaacucaccauccaagaacucuuuucaucuugcaaaauggaaacucuguacccauuaaaaaauaacaucccauucccuucuuccugcagcuucuggcaaccacuauuugauuuucuuucuuuuuacuuuuucuuuuuuauuuugcuguuugggcauuuguuguuauccuuuggugugcccuguaauuuuuaaaauuaaauccugugcauuguaauaagaaaaaucuuggagcuucccgaugauguugucuuuucucugcuggagagaaauuggggguauguugggcugauuaucugauuccaguuagagacugagcuaaaugaaaggaaacuggccaaguauauaagguuuuucagguuuucaauuuuguuucuucagcucuuugagaccucucaaaaguaagcuggcuuuucuguaccuuagcaacaggccucugccuggguuaagacagcaucuuagucuuuugcuuaugcccagaucggcagaugucaguuguacuuuaucaguucacuuucagcaguuuucuuuuaagaaucuuagcccguuuaguccuuuuaugucauuuugucuuuucugguuguuuccagcgugagaguugguaugcuacuaacuacuccacccucccuagaaauauucauuuaaauuaauuaugaucaacuaauuuuuguuuuccuuuuuaauguuugcuuguuauugccuaauuuauuuugucacuugcuaauaauaguugguucuuaaagaguauuaauuaucaaaaauuuaaguagauaacaauuagauuuuacaugauuucauuauuucuuauggcugaacaguauuccaauuuguguauauacacacacacacacacacacacacacacacacacacacauuucuuuauccagucaucuguugaugaacacugguugauuccauauugcuauugugaauagugcuacaauauguguauuuuaguucuauagauggaacauuauuauuacuguuuuguacagacaauauuuauuucguuuuacccauguauuuuuuucaauuucuuugcucuuuuuuuugguaucuuaaacuuuucauucagaccauuuucuuucuguuuugaagaggaauauuuagaaucuccuuuagugagaauauguuugugauuagcugucauagauuccauuugucugaaaauuuguuuauucauucucauccauaaaggauauguuugcaugauaugucuuucuagguuggcacacuguacauuauuucuagacauuucuuuuagcacauggaagguauuauccuuccuuccuuccuuccuuccuuccuuccuuccuuccuuucuugauggagucucgcucuguugcccaggcuggagugcaguggcacaaucaugcccucaagugauccucccaacccagccuccugaguagcugggauacaggcagaugccaccacaccuggcuaauuuuaacauuuuuuguagagacaggguuucacuguguugcucaggauggucucaaacuccugggcucuagcgauccuccugccuuggcuucccaaaguccugggauuacagaugugaaccaccacgccuggcuuacuuuguugauuuuaagaagucaguaauaucuuuucccucucuuauggguuuucagauuuucuucaucuucgauuuuuagcauuuacaguauaauauguuaacucauacgcuuaguuuuguuuaauagcuucuucaaucuguaaauuacugucuguuacuauuguuucuuggaaauucucaacaauaaucucuucagauauuguauuugcucuacuuucuguuuccucauuuucugaguaagaaaaaaacguggaaaaaacccguguugcaucuugggaggcugagguggaaggaucacuugagcccaggaguucgagguuacagugagcuaugauugcuccauugcacuccaaccuggguggcagagugagacccugucucaaaacaaacaaacaaacaaacaaacaaacaaaccaaacaaaaccaaacccgaaaccaaaauaaaaaccuucauuaauuuucuaacucuucuuugacucuuaaucucuuuuuucuauuucaacaguuuugccuuucuauaccuuauccuaauuucuuuuuaccuguauuguaauucacuaauuuucuucucuuuuauuucucacacaucaugaaauuccuccauuuuauuuuuaguuacuaagauguuuauuuuaagauguuauucuucuuuuucuaaccugccauucuacuuuaucuaguuuucaguuucuucuuauuuucgagguugucuuuucuuuaaauauacaaaccauagcuguuuuauaguccuuuucugauuuuuuuauuuuaaauguuugugauucucuuucugucuuguuuaugauaguuuuuagucaaaguaccuuguuugcuugugugccuuauuguuuuugacuuuaugcucauuuuuuuuacuugaaaaaaaagauuacuuguaggaauaaguuaaggccugcuuaacauccaccuggaaggauuugcuuuuuuuccccccaugcacaugauauuucuauccauuugggacaaccuuaaggcagcuugaacgcuugggguguccugaacuacgcaggugauuugaaccugggcugcaaaucugccugugaguugguuuacuuuuguuugcuccuuacaucaaaacugucccggcuuauuguacaaaaguuuacuucuuagacacccucuaccuucuguaaucuuuggguuuucauauaucuuaaauucucuaucccaucauauuucaaaccaaaaguccaacuuugccagggucugcaaaugcccucugggcacaagcaaguuuugugguuaccuuacuucuauagguuucuauuuucucuucauuuuuggccuggcaaauuccuauuuuugucaggagcuuaaugcuuuaauauucuuaauauuugaucuugaauuuuuauucccuuuuacagaaguguuuaaaugacaaagcucaucauuaucgcuuuggaguuuucaguuucaauuuuauguauuacuucuaguaguuuuauugauuuacugauaucuuccuuuaguuuacaaaguaugugauaauacuuauuuuuaaauuucauagccaauaauucuaaaauaugaaaucuuuguagaucuaaguuggccuuuuguucauuuugcugacucuguucauggugcuuuguuucccauuguguuuguugauugugaggucauguaacuuuauuuguggaaauucuuuaaggccugaauuagcaguauauuaggccugaagaaaauuugcauauuccauuuucuaggcuccuggggaaacuuaggagcacuucaaauuaaauuuuggcuuggagcucuuuggaaaauucuggcaguauacauuccguuccgauacaugccuaagggcuaguuugugcuuaugauuuuucagaggagacauuuaucaccagaccauaagaaauaguaucauaauggacaccacaaucauuagucaacauuucccucaccaggcuggagugcaguggugcaaucuuggcucacugcaaccuccgccuuccugguucaggugauucuccugccucagccucccgaguagcugggacuacaggcaugcaccaccaugcccaccuaauuuuuguauuuuuaguagagacgggguuucaccauguuggccaggauggucucgaacuccugaccucaugauccacccgccucggccucccaaagugcugggauuacaggcaugaaccaccgggccuggcccagauuuacuuuuucuauuuuuuccccacagucggaccaaugacccuuucauucuauguaguuuuuucagaauggaauuuuaaaaauauaaacuuggcacguacuucuguugcuuaacauccuuuauuguuuugcauggucuucaugaauuaugaaccagaagacucugagcaaguuauauaaguccuguuaugaucuuguccuuguuacguuuccaaucauaucuccugugacuuauucguuauacuucaagccuuaugcuccuaaaauacauuuucucuagaugccagaacgugucauucuaucucuucuguguuuuccuuuguaugugcucuuacacuugcccgugaccuuuucucuccuaacuuccauuaccuuugcuaauuuaauucuuacugucuuucaaauguuucaacucagcugcuacuuucuugaagucuuuaaacuuuuucugucucccuguaccucuaaccuugacugaucuuauuuggcuuagguguccccucuagguaaacucccagaacuuccagugaguacccaucagcacaaucauuguuuauuugccugccugaccaauauauuguaaauuaucaugaauauuaguguucaguuucuaccauauaucaccauuaucaucaucuuaauagcaguuaucauuuauugauuauagauuagacacugugcuuaagcauuuuaaguugcauuaucuuguuuaauucuaacagcaggugacucuucauaauaugaauaauuaucauuauucuaacaugccaggugggaaaaguagucagacugguuaaguaucaugcccgaggccagguagcuuaguaaaaggaaaucguauaauuugaauucagagaauauaaugaacuucuuuuuucuccuauugcuuuuaugauguuuaaaaaugagugcacaaauauaaaacauauagacuaguaccugagacuuaguauuuauuaaaaaugggcucuuaaguggagucaaaagcuuuuauuuaucauuuaauagaguauuuugaaaaauaaaaaaaucaagauaaucaauaaugaaaauaaaaucgugaauaauuuuaccaucgggagauaaauuacuuuucauauuuuaguguguaucuuuuccuuuugcaugcaguguuuaaauauuguuuuaaacccacucuuuuuauucuauguuuuaugaauauccaaauuaauaaucaauaaaauuuguauuacauuuucaguggcuacaugguauaccaucccauauaugugccuccauaauuugucuacuuuuggauauuuagguaguuucuaauguuuugcuauuauaaaaaauguaaauccuuaaauauuuauuuuugaguucuugggagauaacaaucuugaaaagucaauaaagcuugauggugaccaauauuugugugucuauauuugcauauuuucuucucauuuuggacuauuaucuaacggaggaaaaagacuaauugucacaaauaauacuuaguuuucuugguauauaucuucugcuaaguacuaucuauuuauaacuuucucuuuuagaauuacagagugaaaacuuaaaacaaucaauugagaaacagcaucauuugacuaaagaacuagaagauauuaaagugucauuacaaagaagugugguaugauuuaaaaacucauuaguguguaauaagucucacccuaucaaucagucaacaaauauuuauuaaauacuaauacaauguacaaggaccuggaguuucaaauaguuagagaagacacaauccuagucugcaaaaugcuauaguuuagagacauugcauaaaaacacaucaaaaguauaauuaaaauacaagacccuggacaggugacaacagggugguuuagguaauaaauuaauaguucuaagaauugaaagaacaguauggcugguuuggcuaggaaggcuccauggaggagcuggaacuauaggugggauuuggagaacagugaauugaaauaagaguagugggugggcauuccaggguaggaaggaggaauaauaggaaaauaugagggugggaaaggggcagugaauguauagaagcagauaaguucagcuuuuuugguuaaggccuuuggaucauugcucuuguuuuauacuuuauuucauuuagaguacucaaaaggcuuuagaggaagauuuacagauagcaacaaaaacaauuugucagcuaacugaagaaaaagaaacucaaauggaagaaucuaauaaagcuagagcugcucauucguuugugguuacugaauuugaaacuacugucugcagcuuggaagaauuauugagaacagaacagcaaagguaaaauauuuauuauuuuuaauacacaaaauaagugaauaaaaacaauuuacuuuuaauauucaaugccauuuucuuugcauugccaacugauguguguaauucauauaacaacuguagucaggucucauguauaaagugggaauacauuuuaaaaguuucuuuggauagacagauaucuuaggaaaagauguaaaagaagauguucucuaggauaguucucauguaugcuuugccauagaauuuaguuauauacauaaacucaugaaagguugaugcagugauaugauauauuuaaugacucuguagauuauuauuagcuuccuagaaguagcuuccaggcugucagguuuaucuuacugaggucuguagaccuuucugauuuauaaauuuagcagcuagccuggcauagguaaguacuacucuauguuuauuaaauuaaccaauuaaucaguauaaauuuaauuaauauaauuaauuaucauuaacuuauuaaauaaaugguuucacaaaugugauuacauaaaaaauaaacuaguauuuucauuucaucuaaauagcaguuuuucuaaugcuugaguguuaaagacucuauuuuuuacuacucuauauuaaggaaauauuuauauaaagcuguguuaggaggccuagauaauuauuuuuugucucauuagcauuaggguuaauuaaguuugguaggauaaaggagaacagguuucucucugaagccauagccggggccuagcaauaguuuuucucuguugcuugugcauggugagggaaaagcuagccuuucuagcuccccuaauuuauauauuuuugauugaccuauccagugauuuuucauuuuuaaaaagguagguuaccuaagauuccucuaucccuauuaccucaguuuuauacuuugaggaaacagaaagccagagaaguuaaccaaauuauacauguucucauaauuauauuguuccuaaggcagaauucaguauaauaguaguuacauacucaauuucuuucagaguucuaggaugcguuaaucugauuaucaucaacagcuaagagaaaacuuauaccauaagcuuuaagguauaucuauguauauuacauaaauguaauauagaauuauguauuuauaauaguaauaucuuauuuuaaaauguuacacuauauggugcagaguagguacuuaauaaauguuuaacaauccagugggugaaucuauucuaagauauaucaguugcuaaauugcaccaauuuuaguuaugagaugaauucugacuaaaauaauauuuuguauugaaaaugauauauuuuacaagauuggaaaaaaaugaagaucaauugaaaauacuuaccauggagcuucaaaagaaaucaagugagcuggguaagacuuagagaauaauguguguacuuuaauaauauuaacuuauuauagaaucauaaacacuguuuugaaauaaaauauaauuuccccucugucauuugccaguagagauugcuugauaauauuuuuauuucaauauuugaagguagaaaauuuaaaccuuaagaaagaguguuuuauucaguuuuauuaugcaguuaauagauauuuagaaguguggggagccuaagagaggucugagucuccuaacagaauacaacuaagagaaguugauauucuguuuucuuuauuuuaggauucagagaccuuaauaauucuucgugagaaaugucuguuauuguuuaauugaauuuugaaauuucauugcuuugucauguuacauuauguacuauucacaggaaaaugugauccuauuuuaucauaagguguuauuaaaauucaacaacuuucauggccacgagagagacauucucuacaguaguuauuuuauaauuuauggccauguaauucgauaauucuaauaaccuaugcuucauauucauaacucuucauaucuacaaauguggaaaauugcaaagaauaaaauaguuuccaauuuuagugaaaaaauauuuuuuauaaauuaaaaauauucaugaauuggcaaauauuuuauaaaauauuuucauuacuuuauguaagcuuuauuauuagauuuaaauaguuguauaauuaaaauaauuaucaacuaaaauauuaucuaguaucggaaaugugugcuuuacauuucacaaguaguuagguuguuugguugaacuuuuggaccauauuuauccuuuuuuucugugaggcuuaauuuuccacuauagauuaacccuuuaucauguaaaauuguacuaucaaaugcaaauaauuguaucuucuuaggauaacuuuaaauuagaaugguuauaauauaaaccauuccauuuuuuauucuuccuucgagcauaaaauaguguuuuaaaucauuauauauaccuauacuuacuuuuuaaaaauuauuauuauacuuuaaguucuaggguacaugugcacaacguguagguuuguuauauagguauacaugugccacauugguuugcugcaccccucaacuugucauuaacauuagguauuuuuccuaaugcuaucccucccccagccccccaccccgcaacagguccuggugugugagguuccccucccuguguccauguguucucauuguucaacucccacuuaugagugagaacauaugguguuugguuuucuguccuuuugauauuuuugcugagaaugaugguuuccagcuucauccauguccuugcaaaggacaugaauucauucuuuuuuauggcugcguaguauuccaugauguauaugugcuacauuuucuuuauccagucuaucauugauggacauuuggguugguuccaagucuuugcuauugugaauagugcugcaguaaacauaugugugcaugugucuuuauaguagcaugauuuauaauccuuuggguauauacccaguaaugggauugcugggucaaaugguauuucuaguucuagauccuugaggaaucgccucacugucuuccacaaugguugaacuaauuuacacucccaacaguguaaaagcauuccuauuucuccacauccucuccagcaucuguuguuuccugacuuuuuaaugaucgccauucuaacugcugugagaugguaucucauuguaguuuugauuuucauuucucugaugaccagugaugaugagcauuuuuucauaugucuguuggcugcauaaaugucuucuuuuaagaagugucuguucauauccucugcccacuuuuugaugggguuuuuguuuuuuucuuguaaacuuguuuaagcucuuuguagauucuggauauuagcccuuugucagaugaguagauugcaaaaauuuucucccauucuguagguugccuguucacucugaugguaguuucuuuugcugugcagaagcucuuucauuuaauuagaucccauuuaucaauuuuggcuucuguugccguugcuuuugguguuuuaguuaugaagucuuugcccaugccuauguccugaaugguauuaccuagguuuucuuccaggguuuuuaugguuuuaggucuuacauuuaagucuuuaauccaucuugaguuaauuuuuguauaccuauacuuauuuucuuuagaauuguuuaauuuaaugucuuaggcuaaggaagaauuuuguuucuuaaaaugucuuuaauggauauuuauuuguaauaauucagucuaauauugaaauuaaguggcuauuugucauauuaaaaaugcaauuguauuauaugauuuucucacaguagagcaauauauuuugacaaauuugaaaaaaguauucuagaauugugaaauagaaccauguguguuuuuuagcauugccuuagauguuguaggaauguauagaaguaacauaccauccuuuugagaaaucucugauuauuguuggaggaagcuuaaauacauaaaacccuuagaguaaugguguccaaaaugaaggggugagcaaaauuuccuuuaggaaaagggaagaaaauguuagaauuucuauuuuuauuuauuuuuauguuuuaaauauguuuuauaaugaacacuguaauacauauuuauauuuuauaaauuuauauuuauaaacauuaauuuauaacugauuauacauuuauguaaauauaaauaugcauuuguauuuuauacauacuaauauauuuugggugaaugcucacagauuucuuauugauggagguauguuaauacugauaccaagaggaagccuaagauagcaauguguacugcauaguuggaaaaggcuuuauggaaaagguagauuuaaauuuaaaaguagacuuuaaggcuuuggauaguuguagaggaugaaggaguguacaaaacaucauguguaggaagguagcauuaacagugacauagguacucaacuucuuugggugacaauauggucucaaaaccagaaaucuugaaggauauucuguacuauuuauucuccuucccuuaugcuuuacugcuaauugguuaucuggugcuccuuaacaccuaacucauaaaauauaacuaacuuagaaguuccucuuaacuaucauuugaaucuuuuccuuuucuugauuuccacagaucuagaacaguucaauuccucauuuucucuuucuugguuuuagaguuucaggaugcauguaaagaacauaaugguacaaaaauuguauuuguaagauuaaucaucaaaccgugcuucagauuacccccauuuguccuaaucuuuauucauccccccuugcuauauuuaacuaagcuucuguuugcuuugccuuucuuuaauaaucuuuuuucuuaccccaacaacucucauucuucuuuguuuccuggcuacacuuuacauucuuccuugaugguauuuucuuagacuuacaucuugguuaaaguggucuuccaucauuuccucagcagucucaauccucaaaacacuuuuaaccuauguacugcucagauauagccugcucuacuccuuguaucuuuuaggucagacgucuuugaccagugcuauuauaguuacaauagcuugagaaucaguccuuuucuuucuaggauagccaccuuuugcucauuuucuacauugcugcuagaguguuucuuuaaaaauacaaauaugauuauucuauguggcaaauuuaagaggcaucucauugccuaaguucaaacuacuuagauaucaguuaucuuuucauuguucauuuaaagagugggaguacugcauaccaagugaguugaagucaacugcaauaggaaaucuuuggcaaguaauuuuuucucaguuucuuaacuuguuacaguuuucuuugcugcuucaugcguugcccaucuucaauucagucuaauauugcuguaaaugugucuuauucuuguacucauuuuuccauaucuggaucuaucuuugcuuucaauuugguauguaacagauuccccuccuaguagguucuauugcuucugcuuugauuaucagauauauaauauaauaacuauugaacuaaggcuuagauguuuauuccuuauuuagccuuggauauguaaugaggaauguaacagacaugguauuuguucucaugagguuugcacucuucuuggagagacauacaaaacaaauaaucacaaauaaauauuuaauuauaaauugggauaagugcuaugaaggaaauaaaaaugaugcaaugcgguggcugcaauggacugugugggccaguccgcaggccuacaggcaagcgcauaugggugagugccagcuguggugguaguggcaggccuggcugacccuucaucaggcacccaggaggagugcuuaggugcuaauggugguggauggggcagugugaucccuaggcucuuggacaguguacucaggcacuugagggagcagagauaguccucgugggccuaucuucaggcuucccaguuguguuuauaggugcuggcucuggugggcagggguggggugauuccuaugccccugauggagcacucaggugagugcugcagcaguuguggugagcugggagagccugcccuuagagcaugugcaagugugcugcggcccugcugccagggagugugcgauuguuguagguggcagcagcuauaggcaggccucugaggagugugcgcuucagccccaggcaucagcuguccgugagccuguacucagggcaugugaccccgcugcugggggcagugagguugcugcuagugguucuggcuucaccugguagcuggcaguggcagagguuguggcugugagcaagguagcuuguccuugggguguuugcaaaugugugauggcccuucugcuggggugacaugggauugaugccauuggcuuaugcuuuggcuccagcagcagcagccaguaguagcagcugcaggagcgggagccuuuuccuggcgcacgcacgggaagaugugcugcaguccugcuguugguagggggcaggguugcugccaguggggugcacuucagucuugguagcaguagccagcagugaguauuggcaggugggggaugucaguggggcuccagggauauggagaugcggggguuuuugggccccagagcaggauguagucuccugggggcugggcucucaaaaugguacggggcuauagcugcuuagaacucagagggugggugggacccagcauaaauucccucuauggagcaaugccuuugugagaucucuaggcagcuaccuauguuaaucucaggguccaaaggacccuuccuugccuuagguguuuccugacacaucucuuuugaauuccaguguucuuucuuagaggaucuauuugaaguguaauuuaucuacucacuaauuuaguuauucuuuguggaggaggugagugggcagaugccucuagucagccaucuugaagccuuucuuguuuuuaaacuuucgucuuacauuuucuaccucuuuguucuuuuuccugaauugggagguaucucuauccuaucucugucuguaucucuaucuuuaucuguaucuccaucuguaucuguaucuguaucucuaucucaucucuaucuuuaucuguaucuccaucuguaucuguaucuguaucucuaucuaucucaucucuaucucuaucucucuaucuaaauuuguuucucccuugcuaauucaaucuuuaaauaugucuguuuugcuauuuucaaaaucucaguugucaaauuuuaaauuucuaagagcucuagguaaucuauuucagggaucugguauccuguuggaacacuauacuuagucaaauaucuguuucuguucacucuauuaacucuuuuucuuuggguuuuaguuuuuuucacaguuuaauuuggagcuuucuuuuucauuguuuugcuuuucuucacaaauuguugguaccugauuguugacucucuaaguauaaguauucuucuuuucccacuuguguauuacaaucuaauucuucugauuaugggagugagugggaguugcuguggggaaaggugggcauagcagcuugucuuuuacuauaggggauguuuaucuugcuuaagaauaauaagcuauuuguaacacuaccucaucugccacccaaauuccuaggauccuuacuuuauccugaggugggcuuuguggugagagguauggucacuuggucuuguuccacauagccuucauugaauuagugugaguuguuuuuuuuuuuucuccaaggauucguuaauuuucugguuuguuaaugauagucucuuauuuuguuaauguuguucuuuuauauauauuuuuucucguacuuuuuuuucuaauuuugugggauuggggugagagaacauauagagacaugcucaguccacugucuuuaaucaauuuuugaguuuuuaaaaauuaaguauuuuuaccugaaauaacacuuucuaguuaaauaagcuauguauacgccagguuuuucuuuuggauucuauauugacauuuuauauuuuguuaauuuucuuuaaagacuguggacaauuauuacaaguguuuuaaaaaauguacagaguuugagaaauuuucaguaagucuauuacauuuccauuaaucaauaaggacccuuaacagugaggaaggacaauauuucagacacaauaaauuuuuagcugacagcuggacauauuagggaacucuguaggcaguuucuuuuuugguuuaauuuuuugugggcagguuaaaaauauaagaaaguugaaaaaugcgggaggcuugggcuggaaagauuuuucaauuuauuagcauaauguugaacucauggaacuguagaaagaaaaacauugggcuuuauuuuuuaggauggcaagaaagaaggcugucagcaaagaaaacaagaacaggagguagagaggaaacaggacauaugaauagugcaaaaucaaagaggaaaaaauggggagaaguuaauaguaucaaauaguacaaaccuccacaaugaugaagacuuaagaauuguaucacaaaaugguuauuggugauccuuaagaugacaauuuuauuauuauggugauaagcauuaguuuuacuuggaguucaaaaugaaauguguagguaacaaauaggaauuuguuggaaaaacaaacuaagaaauuugauagcugcuugaaagagcagaaaggucagauauuguuuuauaaucaaauagaauguuuagacgagauaagggaaauuaaagauuccucuacauagaaucuguguauauugguagcguaagggcagagucucagaggaggugggaauguugaauccaaaguacaaugcucagaguuagcuugagaaaagagaaucacuucuuuuaaguuuggagugaagauuaaaaugucagauguuuagacagugaugaguugaagguaaauguacauucugaccucauuucaaauauauuuuauauagauuuauugcuuauuuugcuuuaugaacuuuggguuauuuggcaauggcauuaacuuuagagaaacauuacuauuaauauuuaucuuuuauuagcuuuucauaguuagauuuggacucccucuaugcuuuacauugcucuaguugcauuugucucuccugauuuuucccuuuugcguaguauuaugcuuguuccuucugucucuuuuccuauucuuuuaauccagcuuuuuaacacauuuuuuuuuugcucauuuuagaagagaugacuaagcuuacaaauaacaaagaaguagaacuugaagaauugaaaaaagucuugguaaguauagucuuuccuauuaauauauagcaauuacuuuucagaagaauauugaaucccuuaacuuauagacucucacacuauagauguuuuauacuaauuuuuucagcuaaaauguaaaaauuauauuugguuuuaaguaaagaugcauuuuuuagaccaauuuuuauauaccuuguuaacugucuucaucaagcuguuuauaucauuugaauauguguugauagcacacuaagaucaaauuugcauguuauguagcugauuguaaauuugguaauuuuggauguuguacccuuugaacaauaaagaugcaauuuugaaaaagguguaugauauauauucaguaccuauauuuaauguucagguaaaaucauguuuagugaagauguaggguaaaauuucauuguauuuuaauugauuacaguauauagaacaugggucagcaaacugucuguagaggacuagauaguaaauauuuuacaguuugugggccauacauggucucucuuuucuccuucucugccuuugccuccucugccuucucucuuuuauuuuuaagaaccuuguaaaaauauaaaaaccauuccuagcuuaagggucuaggaaaacagacugcaggcugaauuugucuugcauacugcaguuuucuggccccugauguagaauauaauauuguuuaugaugacugauaauugauuuuguguuuaccuaucacaucucuaccugauuuugcagcuccuaguucuucugucccuuggggagcauuauuuuaaaauauuuuucuuuucuccauuuaauugcuccgggacaaacucuuuguaacuaauaauaauguuuucagugcuuucagauuuauuaaugcauacuuauacaagucuuagcuuaaaugucagugcuuuaugaaaccucucuugauacucuaggcuagguuuaggucuuuguauggcuuauuuccauagcacccugaauuuuuccuuuguaacacuuaucacaaaugaaauucauuuauuuuugguauuauuauuuaaggcuuuauucacccuuuagacuccuuaccuagcauaguggcuggcacauaguaggugcucaauaaauaaauaguggaaugaauguaugcuucaauaaggguuaggagccuuuguguuguuuaccuuguaacucuaguacuuagcacagaaagugacacuuuguaacacuuuauaaauauuuguugaaugaauacuaaagcauuggcuuuuauauaacgauucacuucugcauggacaaggacugguuuggagguuuuguuauuguuguaggaaaaaacuagguucuugucacaugaccaggaaagauuaggcucgcagacauuuugaaggguguguaaggcaggcuuuauuuggugaaaagugaaaaaagggaaacagggacugucagcaaagugagagugcugcuagcaagcuuucugccucacagauugaauccccaguuaccacacaggaauaggaggggucaggcuccucuuucuugcaaauggcaugaacuucccaaggccccagccuguccucccagugcacaggcuggucggagguucuccggggagaccuuuuuacuuggagaccuuuuuaccuucuccauucuaaagaaguacaucuaacugccauuagaauaaggauaaggauaaggacaaagaccaaucuuaauugcuuccugcugacaggaggugcuguuuugggaaaacagcagucagaucucccucagagacauaucuaaggauuccuggcaaaaggggccaaugucugaagcucugguugcaugaccguuuuggaguuuguuugauggccugaaggugagaagacacaaacaggguuauuagaaaauauguaucaaaauaaaaugugggguaggugguaaggacagcucaaaaaucccaaggccuuuuaccaguuugcacagggaagggagggccaaaagccugacugguaagaaaaacuuuuacccuuuugcugguaugucaggcuucuagguucccuuccccugagcccaauccuaagcugaccaguuuaagguuugagaaauuaacucuucccaguuuggaggaugcaucugaggggaaucucccauaguacagagacacaauuaccuaucagcgaagagaggagauaggaggaaaaaggaaaaaacaagguuuuuuuccaaaggagucccaggaguucaggaugcauuugaaagggguacagacugaagaugaauggcuacucaucuagaaaaaggagagcaggcaucacuagcaaauaccagggauaugugagggagggaaagugaggcauuccucuuucuuuccucuguucuugcaucccugaguccuggcaaccaugacagguaccacccauugguguuuuaguggcuuucacucauguuaacaggggagccuagaggguggaaguaucugcucuuacccacauaugcuaugucuccccugcugucaguagccuuugaauucccuagaccucauuuaugucauggaugugagcauagacuuuauccaugaaaugggaagcuuggcuuaauuggcaggaaucagccacacucaccugcacugugccuuuuaacuucccuuauugucagccucuggauccaguuuucuuuccuagugcuuugacccaaagcuuggaauugaguuugggaccaaaaugugucucagggguguugcauggacuccuuaucguaagcugaaugcuaagguaacacuguggaacugaguuuuccuccaacaagggagagaaaaggaugucuuaugacaugcccagauaacugguggcuaucauuaugcuugcuaagauuugggugcauugugcuuggcuuuggcuagcucccuuggucuuacuuucccaaaaaagaaaccuccaggugaugggcaccuuauuuauucccaucaucuguccggauuugcaagauaauugcucagaacuagaauauugauccagauuuuuacauuacccauccccuuuucuuccuucugagccacaucuggagaaugcugcuugguucauaggaacaagcaggauuagucuaaaauguaggcaaaaacuuaaaaacaacuaaugaguuuagaaaguaaugacaaauguaugauaaauuuugaaacauaauuucucucucuccaguccucauuuuugcuaaaaaaacaaaucaugauaggacugaguuguuugcaaaauagacuuuagucuuauacuuggccugauuuuuugcauaaaguacagcaagaauaacuauuucuacauaggacuucuagauuggcuuugaugguacucuguuccacaaggaaucucagauaagaccuuuuaaagcuaggcccagccauggauuuguauccucaaauaccucugaguuggguaauccucuccuucuaaggucccaagauauacuuggaacuccuggccuguuagaaagugacauucuuuacugaccacaggucaggaacccuguauggggcugugcagacaacggugugaggccaguuuuuucccaaggggcuuuuauuggcucugcaagucaaguuugacugcuuaaagggaagcauacccuuccagucaaagccuugguaaaacaaccaguuucuuuaauugcauccuguugcaaaagaaaaugaauucuuauugcacugaugcaaacaacuauauugccguaaguuaagaauacacacagauaguuuccaaauucuagaggaaccaggcagagagaaauaaacaugcucuaaauuuuguucacaagaguauaccuuacucaauuauuaaaggcuguaaauaguccaaaauguuuccuuuacucugaaaaacaaaacaaggaucagcaauauuccaagcaaaagucaaaaagauugcuucaguuuucugaauucauucaguuagcucuucuuuuccuugauauucaugaacauuuuagcucuucaugaauucuguacauuucccuuuauuccagugucauaaucuucaaaguuaucagaccuguauuugagagcaccugucaaaguucuauagcuuauuauaaaccaucuuuugaaaagaauuaaaacaagacaacaauugucugugaauaacgaaauguccaggguaguuacaauuagaaacacaauugacaaagaaguuugguaccuccgugguuuacaauaacuuaaccuuaauugugauugauaguauacucagacauuagaauuuuagaaaucccauacaauuugggaacauauauuaguauuauucaccaaaauauaaccuaaagaauauugaacaccauuuuggcaauccuauguaaguaaacaugucacauaauccuguuuaccucuuuucuggauacuccagaggcccuucugaagcaucggaaaagccuggcgucaggaaaggcaauuuugaaacugaaguuugauuuugggaagccuguaaaauauguuagagguugaaaacacuuaauguuaugaaauagaauuccagaugacauaaaucauuuauuuugccaaagucgugauucagaaacuuuuauaaccuguuacaaauuuugcuuaagagcagauuagugccuuaugaauacuucguugugcuuuuauuuuaaugcucaauuuacagaaaaacccuauaaugccuuuuugaauuuagucaauauaugcacacacagaguuuuugcaagauuaguuuuuacaauccuuccaccacuuguuugaacuuuuaacuuuauuuuaucuaauuugaaacaauucuuuaaccuuaggcaacaauuuacauuuuuaaugccuucuuauaacauuuuuuuuuuugagauggaauuucgcucugucacccaggcuggagugcgguggcgugaucucagcucacugcaaccucugccucccagguucaagugauuuuccugccugagccuccugaguagcugggauuauaggcgcccaccaccaugccuggcuaauuuuuguauuuuuuguagagaugggauuuugccauguuggccaggcuggucucaaauuccugaccacaagugauccaccucccucggccucccgaagugcugggauuacaggcaugagccacugcgccuagccucuuauaaccuuuuauuaaaaacacauuuuacuguucuuacacaccucacauguaaaucuauuuccaguagucucaauuacaugucauaauaguaacuuuuagcaauuuuuaacuucaauguaaaaucugguaaguuguuuugaguaugugcuaggagcagcuaagguuugacuucuuccugcauaauuaagggugugguuaguuccauauguccccaugccuuaccaaguugaacaguucucaaaaaccaaaaagcaguuuauaaccuuaaaacacuuaacaaaccuugcaucugaccugcauaauuuaguccaccuauuuauauuuugaugauaucugcuuuuuaccaauaaucuuuaagucagucuuuauuuuacaaagauuaaaguuauaugaacugaaagguaccacagcuuuuaucuucccuuuaaaaaauauuugauccaagcacuuaucuuccuuuaagccaauuaauuagagcucuuuuuagagacaucacacauauguaacuacauaggcagaagaaaccccaguugucauaagaucuuuucaaauggggagaggaaucuaucugcuuuuaauuccugggguuccaugaggauagcagaggucucuccccacucagaugugcauuaaaaguggcaaggcaaaaucgagaaaaauaauuuagucaacugaaaaaaaccuuuucccagaaaaacaagguccaauaaaaggaaaacauaaaggccuuauaaauagagcuauaacuuggauauccacuuuaauuaagcugaguacuccuuaagaaaauccuuuuaacuccauuauuagccaacuuuaguugggccaagcuaccaauacuucuggcuuucaaacuuuacuaaaggcucagagaaaggaaaauccaaggcagugcguggaggggaagagagucaauaagcagcaaaagguuaugcagauaugaaaccauaaaggacucauucgcuaagcuaggauugaaccuggggccaccauuguaaaauggcaaaggcuagaauaaaacauugcuaugugguuacaggucuugcucccaaggacagcaagauggaggccugcagcaaaauuugcugaggacuauacagaaagucaugcaaagcacgcuagauugguugcagcuuaagacgaaccucacaaauccuuucucacaacuaaaacuacagaaaauauaaauagugauccccaucauuccuggcccagcaaaaugucuuccaaaaagaaaaaaaccugguuuaaaaguuaccugcugacaagguagagaaaaggaugagacagcuuagaugcugggcuguguuaacugcugacagggugaagagaaaaggaugccugggggaagaacuuauuauucuuaugcaaguuguuccuccacuagggagagaagcauaauugcugugggauggagcuggacuccuuggcugggggagggggagacuccacgggcgcuuggcagggagugccagccagccucguggggcccuugggucaugcuucccaacggggaggggagggcggcggggaacugcugcucgcccaucuguaccaaaaaaagaaagaaaaggccauggaaaggcuggguuggacugaggccgacauuccagaucuccgggagcaaugggaguagggguacaguuuccucuauccucagaagaaauccgaaggaaaaaaggcuuagaagcgaaagagaaaaagauguuuuuuuuugguuugcauuucacucacccuuucucaagccuuauguuucucaaacaauauguuguaggaaaaaccggguucuugucgcaggaucaggaaagauuaggcuugcagacacuuuaaagggugaguagggcaggguuuauugggugaaaaggacaaaaagggccacagggacucucagcaaagagagaguccugcuagcaggcuuucugcaucacagauugaaucccugguuaccacauaagagcaggaggggucaaguucaucccccaccccgcaaacggcaggagcuuccugaggccccgcccuguccucccagugggcaggcuuaucggagguucuccagggugcucuuuuuacuuggccgucucauuauauaugaacaacaucaauaucuggauucucaggaucagaaugucuugauuggugugcagcucuuuacuuguuagcuauaugaucaagagcaguuuaccuaaacucuugaugccucaguuuuuccaucuaugaaauggaaaaaauaauuguacauauuucauagggugauugugaggaauaaauaagacaauucacuuacucauuuaacaaacauuuguugaguuuuucagcugggcaugcuggcucacaccuguaaucucagcacuuugggaagcugaggugagcggaucacuugaggccaggaguucgagaucggccuagacaguauggcaaaacccugucucuacuaaaaauacaaaaauuagcugggcgugguggcagugugacuauaaucccagcuacuugggaggcugagacagagaaucgcuugagcccgggaggcggagguugcagugagcugagauugaaccacugcacuccagccugggcaacagaguggacccugucugaagaacaaaaacaaacauuuguugaguuuuaauuaugcuaaaacucuggggauacaguggggagcaaauggacccauauacugccuucauggaacaacagccaucaaguagucacacuuaaauucaaucacucauugaaauguaacauuacaauggugacaagggcauuaaaggauuaguucauaguaugaugaggccuaugauaaaaggacuugaacuaguuagguuaggauaggcuuuuuugaagaaguaaggauugaacugaaaucuggagaaaaaauacagcauaucagauagaggaaacaugcuaagauucuuuucaugggagggaguauggugaguacaugaugaagugaaagaugcugcuggagaguuagauaggagccuuacaauucauggccuuguaaaucauaucaaaggaauuuuguauuuauccuaagagggaugggacacuccagaugauuuuagcagggagugacuugaucagauuugcauuucaaaaagcacauuuggccugaaggagaauaguguauuaaggcagaacaguuaagaguagacagacaaucacaguagccagaggagagaugaugguggcuuagucugggaggucguaguaguagugagaaaaagugauguaggaugacauuaccauuuguuuaaaauacucuccuuucuccauugaauugcuuuugcacauuuauuauaaaaaucaauuggccauguuuguaugggucuauuucuggacucucuuacauuuucuugguguauuugucuauucauuugccaauauugcagugucuugauuacuguagauuuaauacuaagucuuagaauugaguaaugugauuccuccaacuuuauuauucauuuucaaaauuguuguagcuauucuaguuccuuuacauuuccauauaaauuuuauaauuagcuuuucuuucuuucuuuuuuuuuuuuuugagacggagucuugcucuguugcccaggcuggagugcaguggugcgaucuuggcucacugcaagcuccaccucccagauucaugccauucuccugucucagccucccgaguagcugggacuacaggugcccaccaccacgccuggcuacuuuuuuguauuuuuaguagagaugggguuucaccguguuagccaggauggucucgaucuccugaccuugugaucugcccaccucggccucccaaagugcugggauuacaggugugagccaccucgccccgccuagaauuagcuuuucuauaccuuaaaaaacucuugcugaaauuuuuauuggaauugugugaaauauauagauuaauucagguugaacugacaucauuaguacguugaaucuucuaguacaugaacguaguaucuguuucuauuuuuauagaucuucuuuauaaugauuuauuucauuagcauuuugcaguauucagcauacaguacuguaaauguuauauuagguuuauaccuaaguauuucucuuuuugcagguauuuuaaauaacuaccaaauaggcauuugauuucuuuuucuugccuuauugcauggccucagacugccaguaugcugaauaacaguggugagcuuguaaaucuuugauauccugaucuuaagagaaaaacauucaguguuuuaccauuaaguuaugauguuacuugcagguuuuuuguagaaaguucucuuguauuucuaguucacugaaaguuuauauuaugaauugaaguugaauugugugaaacgcuuuuucugugucaauuuauaugaucaugugguuuuucuucuuuagaccauuaaugugguguauucauugauuuacaaauauugaaugaaccuugcauuuccaggauaaaccccauuugguguugaguauuguacuuuuuuucuauuucacugaauuuuauuuguuaauauuuugcugaggauuuuuauauuugaguucauaagagauauuggucuguagauuucuuuucuuuugcuaucugugucugguuuuggagacaaaguaaugcuggcuuuguaaaaugaacugagaagcuguuucacagaggcaggucuuugcaaaccuauuccaaaguucaaagaagcuuagaggcugaagaaagaggcuuauaaauccaguuucuuggaaacauuuaauagggacuuacaaacagaagccaugugugucucaaguagugguaagacaagaugaugaaucccugcaucguuaacccccagacccaaggauuauauaccuuagaggagggguacaugugcuucagaggcaauacuagaaauauguccuaagggcaggauuuacgggaaguaccuucuuguacacaaggaacaauagauaaacuggaaaucuuagaggacuuucuggaacagggguuaagcagaagccaacaugguagauuagcuuccaagauagaguuguuuuaugcuccauagaagcuuuuguuucuuuucuguuuucuggaagagauuguguaaaauugguauaauuucuucuuuaagugguagaauucucuagugaaaccacuugggucuagagauuucuuuuuggcaaggucuucacuauggauuuaauuuuuuuuauuguuauagaacuaugcagguuaccuguuuaaucuugaaugauuuugguaguuuuugguuuuaaagaaauuaguccauuucccccaaguugucaaauuucugugcauagaauuuuuuguagcauuuccuguuauccuuuuaaauaucuguacagucuguaggauuaccuucuuuuuguuacugauauugguuguugugucauuucucuuuuuugucucuuuuuuuuuggagauggagucuuguucugucacccaggcuggagugcaauggcaugaucuaggcucacugcaaccuacaccuccuggguucaagucauucuccugcuucagccuccugaguagcugggauuauaggcaugcacuaccacacccuacuaauuuuuuguauuuuuaguagagaugggguuucaccguauuggccaggcuggucucgaacuccugaccucaagugaugcacccgccuugaccucccaaagugcugggauuacaagugugagccaccgugaccggccccuuuuuuauuagucugguagagguuucuuaauuucauagaucuuuucaaauaauuaguuuauauuucauugauucuuucuauuguuuuucuguuuucaaucucauuguuuucugcucauaucuuuauuauuuccuuccuucugcuacuuugaguuuauuuugcucucuuucuagauuccuaagguggaaguuuagauuguuuugagaccuuucuuuuuuguaagcauuugcaugcuauaaauuuccucuagucaccuuuucagcugcauuucacaaauuuuuauguguuguauucucauuuaguuuaaaauaguuuuaaauuucucuugaggguuuuccuuugaucccauuuagaagucuauuguucaauuuccauguauuuggagaauuuccuguuauuuuuuguuauucuuuccuaguuuaacuuuguuauggucagagaauguacuuuuguaaaaaauuucuuaagguuuguuuuauguaucagauaugauauaucuuagugaauguuccaugugcacugaaaauaauauguauucugcuauuguuagguagaguguucuguaauugucaauuaggcucaguuggcugaugguguuguacaaauauauguuuuuaauugaauuuuugggucuaauucuauuauuuacugagagaagaguuaaaacuaguaggauuuuggaauuguuuauuuaucuauuuaauucuaucagugauugcuucguguguuuugaacuucugcuauaaacuucacauuuauaucuaacuaccauaucuucuugaugaauugacccuuugauuauaauuaaaugcccucaauuucugauaauacuuuuuuguuuuaaagucuauuuuaacauauuauuauagccacuccauguuucuuaugcuuguuguuugcaugauauaucuuacaaccuacauuugacuuuauauuuguacauaugugcuuauauguagccugcauauaauugggucuucuuucuuuaugcacuccgacaaucacugcuaauuggagaauuuagaccauugauaucuuuaaaaauuguuguuuaaguguugauguggcuuagauuagauucaccauuuaaaaguuguuuuccguuugcuccuuuguuuuguuccucuuuuaaacucucugccuucuuuuggguuauuugaauauuuuuuggcauuccguuuuaauguaucuacugguauuuuaucuauacuucucugcauuuauuuuuguggcuguucuaaggauuacagcauguauccauuaccuugucuauauugaguuaauauuguaccacuucauguuaaauguugaaacuuuuuuuuuuuuuuuuuuagauggagucuugcucuguugcccaggcuggagugcaguggcaugaucuccgcucacugcaagcuccgccuccuggguucaugccguucuccugccucagccucccgaguagcugggacuacaggcgcccgccaugacgccuggcuaauuuuuuguauuuuuaguagagaugggguuucaccguguuagccaggauggucucgaucuccugaccucgugauccacccgccucggccucccuauuuauguccuuuucccacuuuguccuuuaugcuagaguugucauauauauuacaccuacaugcauuuacaucuuccaagacagugcuauaauuuuugcuuuaguagucauauguuuuuuaaauaacuugaagaaaaaugaucuuuuauauuuauugcaauauuuaccaguugugauauucuuuauuuuuuccugaagauccacguuuaccucuaauauuguucuccuucagccuaaagaacuuccuuuaguauuucuuguagugcaguuuugcugcugacaaauuuucuuaguuuuucuuuuugaauauauuauuuauuuacucuucauucuggaaggauuuuuuuuuuuuuuuguuauaggauuguggguugacaguuuuguuucuuucagcaccuuaaagaugaugucuuauugucuuugauccuccauguuuucuaaugagagacucacaugcuuucaagauuuucucccuaacuuugauuuucagcaguauguaagugaaguugaauuauuauauuugagauucacugcacuucauaaaucuguaaauuuuuaacuuucuucaaauaugggaaguuuuggccauuuaaauauuuuucugcccuauuuuugcugucuucuccuucuaagauuacaauuauacauugauuugaucuuuuuauauuguuccacggguuccugaggugcuauucauuuuauuucaauguuuuuucucuguauucuucagacuaucgauucuguuguucugauagucagauucacugucucuuuccuuguaaucuccauugugcucccaugagcauucaaugaauuuuuuuuuaccagcucuaaaauuuccauuuguucuuauuuucuauuucuuuccuuagauuuucuaucuuuuuauucauuuuaagaguauuuccuauaccugauugagcaaaacugaauuagcugcauuaaaguucucaucugauaaaguucucacaucuugguuauacugggguuagcauauaucuguugccuuuucccuugagaauguugacauuuuaccaguucuuuguauguugaauaauuuuggauuauauucaggacauugugaagguuauauuauguagauucuguuacauucuucugaauaauguaaauguuuuuguuuuaucuaucaguuugcuagauucaaaaauaaacuuuaucucaccuucuauaaauggugcuucaaaucuuaguuuaauucucugagccuuugguguacuacuuuugacucuguauaugaauguaugcuucauggguuguuuuuaaauuuguguaguauucauacauagaaucaggagauuacuuucagugguucuuuguucuguaugauuucuccuuuauauucuggcagcugguugugggucccagggcuccuuucccugguucuaccagguuccucuagcaagagagauggugggguuucuauuguaguuuuagcugccuauaccacacugcuuagcagugacauuucaccauugggacaaagcuaccaaaacugacaaacucacuccucuuccagccacuuguguuaauuuuuuuuuuacuuguuaaaauccuuagguuauauauugucucucucucucucucccccgcccucccucccuccuuccuucuuucccucucucucccuugcuguacacacacacacacacacacacacacacacacacacacacguuuauauguauuuauguauuuuguccagaguuuauagaaguuuucagugggagaguuggucucugggcaugagauuauagugacauacugaaagcuaaaagacugcuucuauuuuuugauccuucaaauggagacauaaaaaucugacuuccauagaguaguguaaagaaugaaaauauauuuuaagcaucuagugagggcuggucauacagaagucaucugaaagcaugaaaccaugguuauuguuaucaaucugucuccacaguccuugauauaauuuaaacacuuuucaucuugcauuuguuuuggcacaguagucucauuacuggcuuucuuguuuuuagguucgcccuacuuaagcuuucuucugcacuauugcuaguguuaucuuuuaaaaucgcaaauaggauuauauauuguuacaguaacauuuaugaugauuccacauugucuauagauaaaauucaaacuccuuaacuacaauuaguaguuuuuaugguuaauaauauaggaccuuuuauugugaggccuuuuauaaaaucauugugaugucaugcuugggaagacaaaguaaaaagugaguucauaaauauaugcuguguuggauaguagaaggaaugaugagaaauuaaucaucuguaacuaaacaauuaauuauuguguuccagggcugugucuacugaauugucugucaucauguuuagucuuugaauuuacuuaauauugacuaauuuucucuuuuuaaagaauuuuagccagggggaagcucauaguucuuuccacagcuccauuugggcaguuugauuacuuucacuauguguaugguuuggcauuccugauuuguuaauguuuauaaauagggagaaaaggaaacacuuuuauaugaaaauaaacaauuugagaagauugcugaagaauuaaaaggaacagaacaagaacuaauuggucuucuccaagccagagagguuuguuuaaggaaacauuuuuauuuuaaauauuuuguuaauagaacauagauuuauggauuaugguauaaguauuucuuuuguuaaagauuucuucacaaaauuccuuuccaagcauuuauuauuacauuaauauauuuaugauugauuuaaaacacaucuagacaacccccauauuauaaugugagaaagaucagcauuuaaaagaucaauaugaugcauuaugcuaugguuuauaauagugauauuucuugaugucuugaguauuuuuucuuuugagacagagucuugcuauguugcccaggcuggagugaaguagcuaauucaaaugcacaaucauugcacacugcagcuuugaacuccugugcuuccuggcucauccccucaaguagcuaggauuauaggggcacaccaucaugccuagccaaguauuucuuaauugguacauuugaaauuuagacuucauuaaguuagguucuuaguuuauaguacuuuuuauagugcucauguuauaguuuuagaauuuguauuuuaaaguauguuuccaguccaugacaguauuacaucuugucuuuuuacaauaauaagaacauuauaguucuuauuauuuuauaauaauaagaacauuuuaguuuuuuaagacacuaccugauuucaucaauuaauauauuucuccuugauaauauaacauuuuaauagaaauuaguuacuuggcagagugagaauauuuuauagcauauaaauguuuuucugguugaauuuuacaauaucgagauagaauuuacuuauacugaauaugucauuguucauuguuuuaaaauuauagugauuauucacuuuaaauuuacucguuuaaaauauuugacauaaccugccaaauuuuugccaaauauaugacuuaauuacacagugacuauaccuuuuaaaugagaaaauucgaaaaacacuugccauaguuauauauguuuauuuugcagaaagaaguacaugauuuggaaauacaguuaacugccauuaccacaagugaacaguauuauucaaaagagguuaaagaucuaaaaacugagcuugaaaacgagaaguauguuuuccauuuaucuaaaaauaguuuauguacucaauuccuaagcuuucugauaauaaauaauaauuuaguaaauuauauuuaauauuuauuugaauggauuugaaauuguauuuuacucuuaaggaucuaaauaaugugcuaauuucauugcuaaagaaaguacauaucacugacauaaagaaagaguacaucccaaauuugagaaccacuuuagaucaauguguuacuuuucuuagagguauuuaguuccccauaaaaauaaucauuuucaguucuaacugguuguuuugguuguuuugcuaaauuauuuuauagguuuuugcugauaaagugucaaaauaaaaaauuauuucuuacauuauccaaauaaaauauugaauuggaugauuuuaccuacucaguaaguuuaauuuggagagaaagcggggaaauuauuauuguauuauuacucagagaaaaguaaauucaaguagccaguauagugguggugagcaugauuuuccccuuuugguggcuucucagugcuagauuaaauaugagaaguaaacaguuuaugcagcauccucucccuuccuuuuuaucuaauucucuauuucugguaccuuuucaauaguacuuuuuuaagggcccuagguuaaacucaucuauuaacuaaugucccuuuuaaugaauggacugguuaguuauuuguacuuuaauguaaauuuguuauccuuaguauauuugcuuuucaacuuuucauuggcuuagugaaacacuuuaucuccucuuugaugaauuuccaguaucauuaaguagaaauagauaauagaugcuccuaaaaucacucuguagagccacauacuccuccgccuucauuuaaaauugauauuggauguaagcaauacagcaauaaucucucuuccaaaguagaacauuugagaucuuuuaagagcaaguuagguguugugcaaaaaaguuaaauucaguuuuuuuuuuaaauacuuuaaguuuuaggguacaugugcacaacgugcagguaaaaauaucuuaauuaaacacagcuaaugcuucguguacuacuuuaaucagguuauaggaaguuugaaauaacuucuaagagacagucuaauggagaggaaaaaauuauugaagaaaauaaugugcucuucaaaauuuguggaaaguaugaaaggaugagcaaacagggaacaugcaaggaaauauauuguaugacauuugaaaauuuaguaaagaaaaauuucaaaaauauaaaaauuagaaggaauaauguaaugaucaaccuaucacccagcuucaggaauuauaaaccaauagucaauuuuguuucauguuuuucccccagcccuucaucccuuuccccuaucauuauguugaauaaaauuccauauuaugucauuacauuuguaaauauuuugguaugacuuuuuuuuuuaaaaaauaggcuuaagaauacugaauuaacuucacacugcaacaagcuuucacuagaaaacaaagagcucacacaggaaacaagugauaugacccuagaacucaagaaucagcaagaagauauuaaugugaguugaaaaagaaagugcuggugacuuaguuuucuuccaauuagcagguuagaauagaugaccucuaaagacccuuugaccuuuaaagucugauugcuuuagagcuaaaacuuuguuuuagcagaaaaauaugcauauuggucuuauagggugguaauaggcaacagaggcuacccucugauuaaaauuaaaauggaagccauuacuagaaaaaguuaauuuaauuuuaggcaucaagauuuuuaaaaaguauuuagucaauagguauuuauuaagucauacaagauuguggaggauacaaugaugaauaaaaugucacccuuucucuuuaagaacuuaugacuuaauaaaaaauaguaauuucucacauaacuuaagcaaaauaguaugucauauauguuguuagugggacaaggugcuaucagaguuugcaggaucacuucugcuuuggauaaagagaaggcuucugagagaauauagcauugauuuuggucuuaaaaggugaauuaugaguucaguagguaacaaugaauggaaaacauuacuugaagugacaauaugaacaaaggauacagacucaaaguaacgcuggaaaaccaaaugauacuuguuuuguuaacuguuauauagagauuguugggagaauaauuaaaguaaggcuuaaaaaaguaguauggaacuauacaaguugaaaagcccauuuuuuugcuuuauauauaacuaaauaaauuuuaugcugauagauaaaggucuuaaauaguaguuuaaauuuuauuuuuguuuaaacaaaauaauugauauaaacaacauuauuucuuuagaauaacaaaaagcaagaagaaaggauguugaaacaaauagaaaaucuucaagaaacagaaacccaauuaaggcaagacuaacaaauuggccuuuuuuugucuggcaaaagauuuugauauuucuuuucuauuaacuuguuaucauuaauuuaaauuggacugcuguugaauauuuuauaaaguaaaaauuagauauaaaucacuguuguggaauccugcuuaaaaauaaaauuauaauaaugucuacuuuauacuuaguguuaaaaguuagugagauuagacagaaauuuuaaagcaucauaaaccuucuaauucuuuaauauuuaauuaagaaaauauauuaaucacauuuaauaaaauauagaaaucuuaaaaauuacuucuaaucauaugaacuauuauaauacuagaguauuuauacccacucuauauuuuuuuuuuuacauuuuaaaaaauuaucuuuauuuagguuucugauucagcacauguaucaaagacuaaucaacauaaaggaguaaauaagacauuaguugaaggucuuacaucucucuaaacucugaccaagaaugucaagauugccacuauuaccagaacuccaaccuagucaaguuguagacaagcuaucaugaacaacauacagugugcacagauaugcagaggcaaaaggcaugcuagcgcuuggcucuccucuuuuccuuguugacaucuuucuguuggacaguccacuuuugcuuucuaggcuaaguuccaaauuaaguccaaagaaggcucagggugaaccugaccagauacuuuucuggaggaaugcauucuuaaacuguugugccugcaacuuuguuuuugcuaggaugaaguucagaccgagauguacaauacaaucuagaugauggugcagacuaagucaagaacuaaaguugagcaguaacccgaguuaaggcaugaaugcagacacacacaugcacacacacagcauccaugcuaucaagacacaggauuuuuucacgagaggcaaccugggcuuugcaguuaaucagaaaaugccccccacgacuuuaugcuaacagcuguguguauguuuuaaucaaaaaauuaaagaaagaagaaaaaaaacuaaaaaaaaaacaaacuaaaaaacaaagaaaaaaacaaacaaaaaaucaccaaaaaccuagaaaccccuuaaucucuuacaauggcucuugagcauggaacucagguagcagcaucaauggcuggcucuuuaacaauuuggaaauaaaagguuguuuuuuuguauuucuuugguagccaucacuacaaaguuuucaguguugguuaccuauaagacaaguacuagacagaagaucaaguuacacagaaauauuucuucuguacugauaagauacaaauauugagcucucaaagcacaaguuacuaugcuuuuucuugccuuauugggcauucucuaaaagcaaggcuuugugcaggaaaaguucaugucuaccuaacaaagggugauacguguucuauuuuccuacaagugaacaauuaacacaaauucacauuaucaguuauuucugguugaauccguuagaagccaauuacaaagggacagcagcacuuggugucaaagccacuuucuggucacacauucauuccaugguugcuagucaguaucucaggagcucagaauuuaaaacucuuuucagucaaauaaggaguaaguucaauuaaagacuuccacuaucugccaaauuucuagaauucugucuagagggcuagcaugcuugaugagagaaagcaguucagagcccaaagaggugucagguauuagguaaguuaauuugguuuuguauaaaaggcaugguaauccggcaacagaguacuuauccuauuagcagcacagugguagccaagggucucugucugcaagacaggaaaaugaagcuacugaagccccuguugucccgccugccugcaggauggcuacugauuuuacaaaggcguucugggagccaauccagggcucaccugggagaguggguaacagaauggcaggaaccauguucagcccccaugagaagugcccgacugagggaagucagcuucccauagguguacccacucuauauuuuaaagaauguauuuggucauugcuuauaaucauacauauauaauuuuguaugugguuuuuccauuuaauauuauuuuuagcauuauuaauguuuuuauguguuuucacagucaucuauuuuaaugcccaucuaccagucauucaaguggauguaaugacauuauuuuagucauuuuuacuuuuggauauuuauguuuuuuaguuuuucauuuucauagauaauacuaguaaacauguuggcacauaaauacuuuuuccuuauuuugaauuggaucauaguaauaaugauuucuauggcuugaugguuaguuuccaauagguuguaucauuguaaaccaugcaauacaacaaauauuauaugaaaaugcugguccuaaaauguuuuaauugauauuggguauuauuaauuuauugauaauuuaaaagauaaggauaagucauuuuugguaugauuugugauuuuuaguuuuuggauaagcuuuggaagcuuucaaguuugauuuuagaauuucuucuuuuuaaaauugucugcuuauaccuguugcccucuaaucuuuugagguuuuuuuuuuuuauugauuugcuuaagcuucuaaaaauauauuaaucuuuuaccugguuuauuuauagcacauauuuucccuaaccuguuguuuuccuuuaacuucagagaacuuuuuauuauaugaaagguuucaauuuuuuauuaaacuugauugucuuuugugauuuuaccauugcuucuuuuaagguuucuuuuuaauuuucgauuuuuaauuuuugugggugcauaguagguauauauaaguaugggguauauaagacauuuugauacaggcauacaauguguaauaaucauaucagaguaaaugggguaugcaucacuuuaagcauuuauccuuuguguuacaaauagcccaauuauacuuuuacuuuuaaaaaaaguacauguaaauuauuauugauuauaaucaccuuguugugcuauuaaauacuagaugugauucacuuucuauuuuuuguacucauuaaccaucuccauuuccuccuaucaccacuacucuuccuagccccuggaaacccucuuucuacucucuaucuuaaugaguucaauuguuguaacuuuagcuccuucaaauaagugaacaugcaaaguuugucugucuguaccugucuuauugcaguuaacuuaaugaccuccaguuccaucuaugcuguuacaaaugacaagaucucauucuuuauuauggcugaauaguacuccaugguguauaugcaucacauuuuuguuauccauucaccuguugauggacacuuacauagcuuccaaauauuggccauugugaacagugcuucaauuaacagagugcaaaugucucuuagauauacugauuuccuuucuuuuggguguauacacaggagugggauugcugggugauacgguagcucuauuuuugaggaaccuccaagccauucuccauagugguuguacgaauuuacauucccaccagcaguguaugaggguuuccuuuuucucugcauccucgccaguauuuuuuauugccugacuuuuggauaaaagccauuuuaacugggguaagaugauaucucauuguaguuuugauuugcauuucucugaugaucaaugauguugaucaccuuuucauauaccuguuugccauugguaugucuucuuuugaaaaaugccuauuuagaucuuucgcccauuuuuucccauaggauuauuagacuuauucccauagaguuuuuugagccccuuauauauuguguguauuaaucccuugucagauggauaguuuacaaauauuuuuucccaugcuguggguuguguccucccuuuguugauuuuuuuuuuucugugcagaagcuuuuuaacuugaugugaucugacuuaucuauuuuugcuuugguugucuguaauugugggauauuacucaagaaaucuuugcccaguccaauguccuggagaguuuccucgacgguuucuuuuaguaauuucauagcuugagaucuuggauuuaaguccuugauccauuuugauuugauuuuuauauauggcaagagauaggggucuaguuucauucuucugcauauggauauauggauauccaguuuucccagcacuguguaucgagacuauccuuuccccaaugugugaucuuggcaccuuugucaaaaaugaguucacugcagaugaauggauuuguuugugaguucucuguucuguuucauuggucuauauuucuguuuuuaugcuaaugccaugcuguuuugguuacuauagcuagguaguacauuuugaaaucagguaauguaauuccucuaguuuuguucuuuuugcccagaauaucuugggcuauucugggucuuuugugguucuauauaaauuuuaggauugauucuucuauuucugugaauaaugucauugguauuuugauagagauugcauugaaucuguagacugcuuuggguaguacagacauuuuaacaguauugauuguuccaguccgugaacacguagugucuuuccuuuuuuuguguguccucuuaaauuucauuaaucaguguuuuauaguuugcauuguaaagauuuuucacuuuuuugguuggguuaauuucuggguguuuaauuuuauuuauagcuauuguaaaugggaguacuuucuugauuuauuuuucagauuguuugcuguuggcauauagaaaugcuacugauucuuuuauccugaaacuuuccugaauuugcuuauuaguucuaauaguuuuuuggugagaucauuaggcuuuuccaaguauaagauuauacuuggaaauauacauguuuccaagaaauauacaucugcacgcaaggauaauuugacuucuuuuccaauuugaaugcccuuuauuucuuccuuuugucuaauuccuguagcuaagaccuccaguacuauguugaauaacaguggugaaagugggcauccuugcuguguuccaggucuaagaggaaagaccuucaguguuuccccauucaguaugauacuaacugugggucagucauauaugcuuuuauuauguugagcuauguuccuuccguaccccguuuuuugaggguuuuuaucaugaacagauguugaauuuuaucaaaugcuuuucagcaucaauugaaaugaucauaugguuuuuguccuauagcauguugauauaauguaucacauugauuuauuuguauauguugauuauccuuacauuugugggauaaaucucacuugguuaugauuaaugaucuuuuuaauguauuguugaauuugguuugcuaguauguuguugaagauuuuugcaucaauguucaucagggauauuggccuuuaguuuccuuuuuuuaugugucuuuauuuggcuuugguaucaggguaauacuugccucacagaaugaguuuagcuauauucccuccuccuuuauuuuuuggaauaguuucuguaggauugauauuaauucuuuaaauguuuugaaaaauucagcagugaagccaucagguccuggguuuuucuuugcuggaagacuuuuuauuauagcuuugaucuuauuacuuguuuuucgucuguucagguuuuagauuucuucaugguucaauuuuggaggguuguaugugucuagguauuuauccauuuguucuagguuuuccaauuuauugauguguaguugcuuagaguagccucuaaugauccuuugaauuucugugauauugguuauaaugucucccuuuucaucuccuuuuuaaaauuuauuuuggucuucucucuuuuuuucuuaguucgucuuccuaaaguuuugucaauuuuaucuuuucaaaaaaccaacuuuuuguuuuguugauguuuuguauuguuuucuuuaauuucauuuauuucugcucugaucuuuauuauucucuucuacuaauuuggguuugguuugcucuucuuuuuguaguuuuuuaagaugcaucauuagguuauuugacuuuuuaaaacuuuuuugauguaggcacuuacaaacacaccucuuaauacuccuuuugcuguaucccauagguuuugguauguuaucuuucuauuauccuuuguuucaagacauuuuucaguuuucuucuuaaucucuuuauugacccacuaaccauucaggagcauauuuuuaaauuuucauguguuuuuacaguuuucaaaauucuucuuguuauuaacuuucaguucaauuucauuguagucagaguagguacuugaucugauuucaauuuuuuaaauguuuuaagacuuguuuuguggcuuaacguauggucuguccuugagaauguuccaugugcuuaggagaaggauguuuauucugcaauuguuggaugaaauguucuguaaauauauauuagguucauuuggucuaaagugcagauugauugauguuucuuuggaugcucaaagucugggugauuuguccagugcugaaagugggguguuuaaguuaccagcuauuauuuuacuggaaccuaucucucuuuagcucuaauaauauuuguuuuauauaucugugugcuccaguguugggugcauauaucuuuguaauuguuauauucucuagcugaauucaucccuuuaucauuauauaaugaccuucuuugucucuuuuuauaguuuuuguauugaaauccauaaugucuggcauaaguauagcuauuucugcucuuuuuuaguuuccauuugcauggaguuucuuuuaccguuccuauauuuucagucucuguguaucuuuacaggugaagagguguuucuuguuaggcaacagccuguugggucuuguuuuucuauccauucaauugcucuaugucuuuugauugaagaguuuaguccauuuacauucaauguuauuauugauaaguaaggacuuacucuagccauuucguuauuuguuuucugguuguuuuguggucucuucuuucuuuccuucauguuuuccuuuuagugaaggcaauuuucuuuggugguauauuuuaauuucuuacuuuuucauuuuuguuuauuuguuguauuuuuuuuauuugaaguuaccauuaggcuugcaaauaauaucuuauaacccauuauuuuaaacugaugacaaguuaacugauugcauaagcaaauaaacaaagagaaaacuaauaaaaacucuauacuuuguuucccugguuuuaaacuuuuuguuguuuuuauuuauauuuuauuauuguguuuaugucuggaaaaauuguuauuauuuuucaucaguucaucuuuuugucuuccuacuuaagauacgaggccagguacgguggcucacuccuguaaucccagcacuuugggaggcugaggggggcagaucaccugaggucaggaguuugagaccagccaggccaacauggugaaacccugucucuacuaaaaauagaaaaauuagccgggugugguggcgggugccuguaauccuagcuacuggggaggcugaggcaggagaauugcuugaaucugggagguggagguugcagugagugacaagagugagacucugucucaaaaaaaaaaaacaaaaacagauaugaguaguuacauuccacaauuacaguguuauaauguucuauguauuuacuguuaccagugaguuguguaucuucagaugauuucuuauugcucauuaacauucuuuucuuucagauggaagaacucucuuuaccauuucuuguaagacaggucugguguuaaugaaauuucuuagcuuauguuugucugaaaaagucuuuauuucuccuucauguuugaaggauauuuucacuggauauacuauucuaggguaaaaguuuuuuccuucagcacuuuaaauaugucaugacccucucugggccuguaagguuuccauugaaaagucugcugccagacauacuauauguuauuuauuucuuuucucuugcugcuuuugggauucuuucuuuauccuugaccuuugugaguuugauuuuuaagugccuuaaggaagccuucuuugguuuaaauauaguugguauucuaauaaccuucuuguccuugaauauuuagaucuuucucuagguugggaaguucucuguuauuauccccuugaaucaacuuucuacccuuaucucugucucuaccuccucuuuaaggccaaugacucuuagauuugcccuuuugaggcuguuuucuagaucuuguaggcaugucuacuaggcauucuuguauugcuauaaagaaauaccugagacuggguaauuucuaaagaaaagagguuaauugguucauaguuccauaggucauacagaaagcauggugauggcaucugcucagcuucuuggaaggccuuagggaaauuuuacucaugguagaaagcaaaggaggcacuucacauggcaaaagcaggagcaagagugguggggaggacacacuuuuaaacauccaaauguugcaagaguucgcuauugcaggcaucaccaagccaugagggauccucccccacaacccaaaccccucccaccaggccccaccuccaauauuggugauuacauuucaauaugaaauuugggugagagcaaauauccaaacuguaucauugcacuuccccgcacccaaaucucauguacuuuucacauuccuaaauacaaucaugccuuccaaauagucccccagagucuaacucauuccaccauuaacucaaaaauccaaaagccaaaaucucaucugagacaaggcaaauccccuccaccuguaaaaucaaaacaaguuaauuacuuccaagauacaauugauaaauacucccauuccaaaauggagaaaucagccagaagaauugaguucagguuccaugcaaaucuaaaacccagcagggcagucauuaaaucuuaaagcuccaaaauaaucuccuuugacucuauauaccacauucagggaacacugcugcaaaggguggacuccuaaggccuugggcagcucugccccuguugcuuuguauuuugauauuuaguuucucuuuuuuaaaacuauaaaaacauuuuaagccaucaauuuacuucugaacacaaugaugaauuuaugauauaguguuugauauguaguguuuccauguucauuauuuucuaaacaacuuguuuuuauauuuuaaguuucuguuuaauccauuaguagccuagaugaauuccacauauuugggggcucuuguuuguacuuauauuaugaaguauucaguuuugguuuuuuacauuugguuaaagaauguggucuuuaagacuuccuuauuuugaguuauuugagaucuucuauaggccuaauaauuuuuaguauaaugucacucuuccauuuucuuuuagaaaugaacuagaauaugugagagaagagcuaaaacagaaaagagaugaaguuaaauguaaauuggacaagagugaagaaaauguauguuauauuuaauaauggaucguaucacaaaauuucaaauuauaaaagcaacaccauaugucuaaacuaaaauaaagggaaguauacuguuguauaaauaauagugaucuagagacugucaucagccaucaaccuuaaauaucuaggaaagguuggauuauuuuacuauugauaucuauaucuagaagaaauaguggcauaauucugauuuucuuuuaacguguuaaauauuuaauguagacuuaacauuuuuuaggcaaaauaaaaggcucauacuucaguaauauaaaauauauggaugacaaauuauuuaauaaguuugugucaugcuuuggugaauaugauaucaaauuaagauaauaagguguuuagggaagagugucaugaaaauggaauaguacaagauaugugacaugauuauaguauauauuauacagauuggaagaaaauucugccaaaguggaaaauugaucuagauuuugaggucuuugauuguguuuuuucauucauucaacaaauauugaccaccuacuaugugccaggcacuguucuggguguuacguuuggauuucauuuauuugguagagaguagugaucuaauuaaaguuuuuuauugagcaggugacaccuuuuaauauuugagaauggaauggggagagauaaaaggcauuggaaucaguuggaaagcuauuaaaagucaucuugaaaguucuaaaaaaaucuuggagaggacucuggccuaguucaguucacacuuauuccugagucaaucacuguggcuaggggauagaguaaccuggcuaagccugagcugcaugucgacucauagagauagaguuagccagcaggacuacuguggauuuuauaguagaggaauucuugcaagaaagggugcuggccagaccaaacauagguucucuaucuggauacuauuagagucuauagaaaggacaucuaauccaaacuugagcuagggcgugcuuccugaaagaagucacauucaaugugaagccuuagauuaauagggauuaguggaggacaggugguggauacaaguauagcagggaggauaauauucuaaguuaaaaaaacauaaacauuauauggguaagccugaaaguaucagagcauggcauauuuaaguaacuacaaaaaauucauuguaacuaaaagauggaguuuaagguaguggugguagagggcagagugaggaaagaugaggguagggagagguaagcauggagagaugaagguggggaaaaaugaggguggaucauuuaaggccaccuaagcuacauuuaagaguuugaggucauugaagaauuuugacaugaagauuguuaaaauuauauuuacacuuuugagagcuguaaaacuauuggaauaguucaaggaugaaauaagguaccauuuuaaagggcuuacaauagaccaggugcauucuagguucuuucuauguauuaucuuacuuaacuagaagucauuauugcucuuauuuuauaaauugggaaaucagaccuccaaaggauaaaaaccuucaaaagguuacaugacuaagagguaguagagguggucuucuacauucuuuaaauuauaacacauuuuccucccugaaaagcuauuuuuccuuuaguucauauuuauuaguuaaauucaaccugaaaaaaaugaacuuaaugugcuaaauacuugguauguaauucacuacuuuaaaauuuguaucagaggccacugcagaucauuaagccuguuguuuguuaauggagaaaaacaugaauuuaauuuuuaauguaaaauaaaauccuccauuaagaauuuaagacauacuuuauuuugccaauauagaaaauauuagugacgauuuaaggaaaaaaauuaaaugcaugacaaauuuuuagcauauuucaguuuuccauauuuggauuucaacuuaccuguuaaaacaguuucccagaaagaauccagguuguaaauauuucccagauauuuugugugacauugaauuucauuacacuuuucuucccccaaucugcuaccuuaguucagacauuuuuuauuuuauauauauuuuaucuaucugagccuuaguuuccucaucucucaaauggagauaauaccgauccuuucuaucucauuggauuguugcaaaguucagaauuaauaaauguuugugaaagcuauauuuaggggauuauaaacauuuauguacaagacaauuuaaaaaauucgagauaaacugggaaagcugauaaaacauugcaaagauaagaaugaugaauguugacauauaaguaacaugaaaaugauuuuuuuaacugagagaaauuauauauauuaaugguauacaaagugauguuuugauauauguauacauugugaaaugauuaaaucaugcuaguuaacauauucaucacuucacauacaaagauaauuuuuuuuuuaaaaaaagagauacugaggcugaguauaguggcucacaccuguaaucccagcacuuugggaggcuggggugagaggaucacuugaacccaggaguuggaaguugcagugagcuaugauugcauuuguauuuagaugaucuuuauugaaauuugugauuuuaguauaauuuuuauauuaauggaauuaccaugauuuugaagugaccuuuaucaguacuuuaugcaauauuuuuauuagucugaaauugccuguuucaacugguauacugaauaaaauagcuauaauuucucacaauuuuuuaguguaacaauuuaaggaaacaaguugaaaauaaaaacaaguauauugaagaacuucagcaggagguauguauuuuuuauaaauauucucaaaaucaaacugauauuuucaccacaguuuuagagaauaaugcuuucccuuccuuuaguaauuuaagucuaagucaguagcaagguaaguuugaauaacuuuaguacuaaauauaauuauuuuuaauuuuaacagaauaaggccuugaaaaaaaaagguacagcagaaagcaagcaacugaauguuuaugagauaaagguauuuggcaucuuuauuuuuguuuuuuaaauacuaauagauagaugagaauuuagacauuuuauuccacuuguuuauacaguauaaauucaauuuauaccauaacaguaucaauugaaaaguugaaagguuguuaucuuuuuaaauagaggagaucaacucuuuuaguuguaauagaguacacaucugugauuuagcaugcacauauauucuuaagcuuggauucaagcagcuuaagaauauaugugcaugcaugagcucuuuguguguggucauauucccuacuuccauauuaaaaagugaaauugaguaaguggaauggauucuuggaaucuacauuuuaaaaagcucuaugugugauuauccugcugcagaaagggauugaaaaccauuuacuuguauaaaacaaauuaaagccuuacaguguaagcuccugauauuagagccauauuuuguaaucuuauuccuaugucuuugaacaaugacugacaguaaguauucaauaaauaguuuuugaauuaugaauggaaaacagcauuucucauuguauuaauuaugugcuuuuuggaaggaaacauaaaaaucuuauaccuuauuuuaauaauauuugaaauuaaaaauauauaaaugugauuaaaaauuaaguaaggauuuucauaaaugguugauauucuauauaaaaguagcagauucauauaucuuauaauucagcucuucuacuccuagguagaguaaggagaaagguacaaaaauauucacagcaacauucuuuguauuauccccaaacagaagacaacaaaaaugucaaccaauaguauaaaaaucagucaauaaaaaauaacacugaaauaacccagauguuagaauuagcagauaaagucuuuuaugcagcuauuauaaacaucuucaaagacagaaaggaaaauauggucauaaugaaagacuagauggggaaugucagugaagaaauggaaacugaaaauaaucaaauggaaguuuuagaacugaaaaguaaaaugucuuuaaaaaccaaaaccaaaacaaaaaccaaaugguccuaauaguagauugaauacaaaugaaucaagugucaguaaacuggaaguuggguaaguagaaauuacccagucagaaguacacagaagaagaguuuuuaaaagaaaggaauagugccucgguggccuguagaacaauaacaaguauuuuuaaguguguaauuggaguccccaaguaagaagagagagagaauagggcaaauaaaauuuucguuuuugagacagagucucacucuggcaccaaggcuggagugugcaguggagugaucacagcucaccgcagccucgaucuccuggacucaggugauccuccuaccucagccuccugaguagcugagacuacaggaguaugccaucacauccagcuaauuuuuguauuuuugguagagaugggguuuugccauguuucccaggcugaucuggaacuccuaggcucaagugauccaccugccucagccucccaaauugcuaggauuacaggugugagugacugugccugaccugggcagaaaaaauuaauugagaaauuucucaaaaauuuaucacacuuaaaacaaacuugcagauccauggcccucagcaaauccaaagcaagauaggcacaaaaccauauguaggcagucauaucuuagucaaagugcuaaaaccaaagauaaaaagaaacuuuuaaaggcagacagaaaaaaaugucacauugcacaacagugacacagaugauggcugaccuuguaucaggacagugaaggucagaugacaaaggaaugacauuuauaaaaugcuaacaaaaauaaaccaucaacccagaauucuguaugcagcaaaaagcuuuauuaaaugaagacaacaugacuucaaaagcuguacccuaagcaauacuuaaggaauuucuucaaguugaaggaaaauggcauuagauggaaacugaucaaugaaaagcacuggaaauaguaaauauugagaugaauuuaaaaggcgauauauuuuucuuuuaauuuuaaaacgguauauauggcugcuuaaaggaaaacaaauugcuauuauagaguuuauaaucugugugacuaccauaacacaaaggacaggggaguaaauauaacuauuuuguuguagcauuuuuacauuacaugugaaauaguacaauauuaacacuuaaauagaguuugguaaguuagugauacauacuauccuccuuagagcaaccccuacaaaauaaugcaacugaaguauagcugucuuaguuuagguuucuaaaacaaaauaccacagacuggguggcauauaaacaaugaacauuuauuucuuacaguacuggagacugggaauuaaaaaaucaagucacuggcagauucagugucuggugggacccugauuccugguucauaaacagccaacuuuucauugugucucaaauggcagaagggacaagagagcucucugggauccuuuuuacaacgugacacuaaucccauuaaugaaggcuccauccuuaugaccuaaucacuucccacaggcccuaccuucuaauacuaucacacuggagguaggauuucaacauaugaauuuuaggggaauacaaauaucuaguccauaacaauagcaaaaaagucaguagaggaauugaaaugaaguggaauaugaaaaaacuuugauaaacuccaaagggagggcagagaaacaaaaaaacagauaugaauagaagacaaauaacauaaugaucugaacucaagcauaucaauaauuauauuaaaugugaauggacaaauguuuuaauaaaaaggcagaaauggucaugcuagauuaaaaaaaucaagggcaaaccauauacuauuacaagagauacauuguauuuaguauaaagacacaaagagguuuaaaggaaaaagaugaaggaaagaaauacuaucaugccaauaguaagcauaagaaaguggagugacaauuuuaauaagaaaugacaauuuuaauaacaaauauaagacaaguaguauuauuaaagaucaguaggggcauuuuauaaugauaaaguugucaauucauuaaaaagauauaacaauuaauuagguauaucuuugcaccuaauaauaaagcuucaaaauaaaugaagcaaaaacuugauaaaaugagcaauagaaaauacuauacucauaauaucccccuuucagcaacugauagaacaacuauuaaaacaucuauaaggauguagaaaaucugaacaucacuauuaacuaccuugauuuaaaugauauuuauagaacacuauaucugcaacuauaaauuguugaaauucacauagaauguuuaccaaaauagacuacaugcugagccauaaacaagucuccauauauuucagaagacugaagucuuacagaauauguucucucacuccaguagaauugaaucaggaguagguaaguauaagauaucuggaaaagcccggauauuugagaauuaaacaucagacuaauaaauaauucaugggccaaagaagaaaucacaaggaaaaugauaaauuauuuuaaacggaaugaugagauagacauaaaacauaaaaauuuguaagguacaaauaaaggagcucuuagagggaaauuuagaguuuuaaauguuuauuuuagaaaagaagaagugaucuagguuuuuaucuagaaacuaaaaaagugagcaaauuaaauucacagaaaguagacaaaaggaaauaauuagaauaagacauaucaaauaaauaggagaaacaauuaaaugaagucaaaaguugauuauuugaaaauaucaauaaagcugauaagcccuagcagaacugaccacaaaaaaagggagagaaaguaaaauucacugcaggcaagaaugaaagaguacauaauuagcauagauaauacaagcauuaaaaagauaagaaaggggggacugugauggauuacuucaugccaguaaauuugaaauguagauaaaaugggcaaauuucuuauguaucuuuuagggaaguugaaauugucauuaaaauaucuccuagagaaaaauccagaucuggaugauuucacugguaaauucugucaaacacuuuaggaagaaauaauaccagucuuccacaaaaaauagaagagugaaaacaauucucaaguagguuuuugauaccaaauccuaacaaagacauuauaauaaaagaaaauuacagaccaauauccaucugaauaaaagaaaauuacaggccaauaucccuaugaauaugaguauaaauauaaaauuauuaauaaaguauuaguaaaucuaaucuagauuuuaauacaugauaaaaaccauauuacaucaaacaauuuaucaggaaugggauuuaucagaaauguaagguugguuuaaaauuugaagcuaucaguguaauuuacuguaccaaguaauaaaggagaaaaauaauauaauuaucucaauaguugcagaaaggcauuugacagaauugaacacuuauucaugauuaaaaaaaaaacuuccagcaaacuaggaauagauaaggacuucuccaaucugauaaagaacaucuacaaaauaccuacaguuagcauccuauuuacugaugaaaggcagugucaagagcaaugucugcucuuaccacaccuauucaacauuguacuggaggcucuggcaacaaaaauaaauauauacaaaugagaaaggaauacauaaaacugucucuucauaaaugacaugacuaucuacauggaaauuuccaagguuucuacaaagucacuacaagauuaguaaaugaauuugacaaagucacuggauacaaggucaauggccaaaaaucaauuuuauuucuauaugcuaacagcuaguaauugaaaaauuaauuuuaaaacaugauaccauuuacaguagcauaaaaauccauuaaauagggauaaauuuuacaaaaugugugcaagacccauacagagaacaguacugaacauuacugagaccaaugaaagaagaccuaaguaaauacauauguaccauauucacugauuggauguuuuaauguuuuuaaaaugucagauuucacugaauucaucuagagauucagucaccaugauaauuccagcaguauuuuuuaguagacuuuuacauacugcuuguaaaaugcaugugaacaucaaaauacccaacaauuuugagaaaguagaacaaaauuggaagauuuagguugccugauuucaagauuugcuguaaagcuauaauaauuaagacaaugagguauuauuuuuaagauagacaaagagaucaguggaaucuaauagaaaguuuagaaauagacuaaauguacagacuguuaauuuucaacaaagaugcaaaaaaauucaauggagagaaaugaaagucuuucaacaaaugauuuggaauaaccagauauucauaugggaaagaaaaaaaacaaaccuugacccuuacaucagaucauauacaaacauuaauuuuaaauggguuauaggcauacaaucuugaacucugaagucuucagaagaaaacguaggaggguacuuucauggccaaggucagcaaagauuucuuagggcaaagaaagcaauauucuuaacaugucaaauaaguuagacuacaucaaaacuugaaagaucuguuuaucaaaaggcauuauuaagcaaaugaauagacaagguacaaagaaaaagaaaacacugacuaaacauuuauuugacagaugacauguauccagaauauauaaauaacucuugaaacucaauaauaaaaaaauaaauaucucaacucaaaauaggcaaaagacuguaaaauaaacugguuaaaauauuggcaaagggggaaaacuggguugcaagauggcugaauaggaacagcuccagucuacagcucccagcaugagugacgcagaagaugggugauuucugcauuuccaacugagguacuggguucaucccacuggggcuugucggacagugggugcagcccacagagcgugagcugaagcaggguagggcaucgccucaccugggaagcacaagggguuggggaauucccuuuccuaaccaagagaagccgugacugaugguaccaggaaaauugggacacucccacccuaauacugcacuuuuccaauggucuuagcaaacaacacaccaggagauuauaucccuugccuggcugggagggucccacgcccaaggagccucgcucacugcuagugcagcagucugagaucgaacugcaaggaggcagugagacugggggaggggcaucugccauuguugaggcuugaguggguaaacaaagaaaagcucgaacuggguggaacccacuacagcucaaggaggccugccugccucuguagacuccaccucugggggcagggcguagcugaacacaaggcagcagaaacuucggcagacuuaauccucccugucugacagcuuugaagagaguagugguccucccagcauggaguuugagaucugagaacagacagacugccuccucaagugggucccugaccccugaguagccuaacugggaggcaccucccaguaggggcagacugacaccucacauggcuggguaccccucugagaugaagcuuccagaggaacgaucaggcagcaacauuugcuguucagcaauauucacuauucugcagccuccgcuggugauacccaggcaaacagggucugaaauggaccuccagcaaacuccaacagaccugcagcugagaguccugacuguuagaagaaaagcuaacaaacagaaacaacauccacaccaaaacccuaucuguacgucaccuuccucaaagaccaaagguagauaaaaccacaaagauggggagaaaccagagcagaaaagcugaaaauuguaaaaaucagagugccucuucuccuccaaaggaaugcagcuccucgccagcaauggaacaaagcuggauggagaaugauuuugaugaguugagagaagaaggcuucagaugaucaguaauaacaaacuucuccgagcuaaaggaggauguucgaacccauugcaaagaagcuaaaaaccuugagaaaagauuagacagacggcuaacuagaauaaacagcauagagaagaccuuaaaugaccggauggagcugaaaaccauggcaugagaacuaugugaugcaugcaugcacaagcuucaguagcugauucgaucaaguggaagaaaggguaucagugauugaagaucaaaugaaugaaaugaagcgagaagagaaguuuagagaaaaaagaguaaaaagaaaugaauaaauccuccaagaaauaugggacuaugugaaaagaagaccaaaucuacgucugauugguguaccugaaagugauggggagaauggaacaaaguuggaaaacacucugcaggauauuauccaggagaacuuccccaaccuagcaaggcaggccaacauucaaauucaggaaauacagagaacaccacaaagauacuccucgagaagagcaacuccaagauacauaauugucagauucaccaaaguugaaaugaaggaaaaaauguuaagggcagccagagagaaaggucagguuaccuacaaagggaaggccaucagacuaacagcggaucucuggagaaacucuacaagccagaagagagugggggccaauauucaacauucuuaaagaaaagaauuuucaacccagaauuucauauccagccaaacuaaacuucauaagugaaggagaaauaaaauccuuuacagacaagcaaaugcugagagauuuugucaccaccaggccugccuuacaagagcucaugaaggaagcacuaaacauggaaaagaacaaccgguaccagccacugcaaaaacaugccaaauuauaaagaccaucgaugcuaggaagaaacugcaucaaauaacgagcaaaauaaccagcuaacaucauaaugacaggaucaaauucacacauaacaauauuaaccuuaaauguaaaugggcuaaauacuccaauuaaaagauacagacuggcaaauuggauaaagagucaagacccaucagugugcuguauucaggagacccaucucaugugcagagacacacaggaucagaauaaagggguggagaaagaucuaccaagcaaauggaaaacaaaaaaaagcagggguugccaucccagucucugauaaaacagacuuuaaaccaacaaagaucaaaagagacaaagaagaccauagcauaaugauaaaggaucaauucaacaagaagagcuaaccauccuaaauauauauguacccaauacaggagcacccagauucauaaagcaaguccuuagagaccuagaaagguacuuagacucccacacaauaauaaugggagacuuuaacacccaacugucaacauuagacagaucaaugagacagaaaguuaacaaggauauccaggaauugaacucagcucugcaccaagccgaccuaauagacaucuacagaacucuccaccccaaaucaacagaauguacauuauuuucagcaccacacaacaccuauuccaaaauugaccacauaguuggaaguaaagcacuccucagcaaauguaaaagaacagaaauuguaacaaauugucucucagaccacagugcaaucaaacuagaacucaggauuaagaaacucacucaaaaccacucaacuacauggaaacugaacaaccugcuccugaaugacuacugguacauaacgaaaugaaggcagaaauaaauauguucuuugaaaccaaugagaagaaagacacaacauaccagaaucucugggacacauuuaaagcaguguguagagggaaauuuguaucacuaaaugcccacaaaagaaagcaggaaagaucuaaaauugacacccuaacaucacaauuaaaagaacuagagaagcaagagcaaacacauucaaaagcuagcagaaggcaagaaauaacuaagaucagagcagaacugaagaugagacacaagaaacccuuccaaaaaaucaaugaauccaggagcugguuuuuugaaaagaucaacaaaauugacagacugcuagcaagacuaauacagaagaaaagagaaaagaaucaaauagaugcaauaaaaaaugauaaaggggauaucaccagugaucccacagaaauacaaacuaccaucagagaauacuauaaacaccucuaugcaaauaaaguagaaaaucuagaagaaauggacaaauuccuggauacauacacccuccuaagacuaaaccaggaagaaguugaaucacugaguagaccaaaaagguucugaaauugaggcaauaauuaguagccuaccaaccaaaauaaguccaggaccagacggagucacagccgaauucuaccagagguacaaacagaagcugguaccauuccuucugaaacuauuccaaucgauagaaaaagagggaauccucccuaacucauuuuaugaggccagcaucauccugauaccaaaggcuggccgagacacaacaaaaaaagagaauuuuagaccaauaucccugaugaacauugacgcaaaaauccucaauaaaauacuggcaaaccaaauccagcagcacaucacaaagcuuauccaccacaaucaaguuggcuucaucccugggaugcaaggcugauucaacauacgcaaaucaauaaacguaauccaucacauaaacagaaccaaagacaaaaaucgcaugauuaucucaauagaugcagaaaaggccuuuggcaaaauucaacaccccuucaugcuaaaaacacucaauaaacuagguauugauggaacauaucucaaaauaauaagagcuauuuaugacaaacccacagccaauaccauacugagugggcaaaaacuggaagcauucccuuugaaaacaggcacaagacagggaugcccucucucaccacucccauucaacauaguguuggaaguucuggccagggcaaucaggcaggagaaagaaauaaaggcuauucaauuaggaaaagaggaagucuaauugucccuguuugcagaugacaugauuguauauuuagaaaaccccauugucucagccccaaaucuccuuaagcugauaagcaacuuccccaaagucucagaauacaaaaucaaugugcaaaaaucacaagcauuccuauacaccaauaacggagagccaaaucaugagugaacucccauucacaauugcuucaaagagaauaaaauaccuaggaauccaacuuacaagggaugcgaaggaccucuucaaggagaacuacaaaccacugcucaacaaaauaaaagaggacacagcaaauggaagaacauuccaugcucauggauaggaagaaucaagaucaugaaaauggccauacugcccaagguaauuuauagguucaaugccauccccaucaagcuaccaaucacuuucuucacagaauuggaaaaaacuccuuuaaaguucauauggaaccaaaaaagagcccgcauugccaagacaauucuaagcgaaaagaacaaagcuggaggcaucaugcuaccugacuucaaacuauacuacaaggcuacaguaaccaaaacagcaugguacuuguaccaaaacagagauauagaccaauggaacagaacagagcccucagaaauaauaccacacaucuacaaccaucugaucuuugacaaaccugacaaaaacaagaaauggggaaaggauucccuauuuaauaaauggugcuuggaaaacuggcuagccauauguagaaagcugaaacuggaucccuuccuuauaccuuauacaaaaauuaauucaagauggauuaaagacuuaaauguuagaccuaaaaucauaaaaacccuagaagaaaaccuaggcgauaccauucaggacauaggcaugggcaaggacuucaugacuaaaacaccaaaagcaauggcaacaaaagccaaaauugacaaaugggaucuaauuaaacuaaagagcuucugcacagcaaaagaaacuaccaucagagugaacaggcaaccuacagaaugggagaaaauuuuuacaaucuacccaucugacaaauggcuaauauccagaaucuacaaagaacuuaaacaaauuuacaagaaaaaaaucaaaccaccccaucaaaaagugggugaaggauaugaacagacacuucucaaaagaagacauuuaugcagccaacagacacaugaaaagaugcucaucaucacuggccaucagagaaaugcaaaucaaaaccacaaugagauaccaucucaugccaguuagaguggcagucauuaaaaagucaggaaacaacaggugcuggagaggauguggagaaauaggaacacuuuuacacuguuggugggacuguaaaguaguucaaccauuguggaagacaguguggugauuccucagggaccuagaacuagaaauaccauuugacccagagaucccauuacugguuauauacccaaaggauuauaaaucaugcugcuauaaaggcacaugcacauguauguuuauugcagcacuauucacaauagcaaagacuuggaaccaacccaaauguccaucaaugauagacuggauuaagaaaauguggcacauauacaccauggaauacuaugcagccauaaaaaaggacgaguucauguccuuuguagggacauggaugaagcuggaaaccaucauucugagcaaacuauugccaggacagaaaaaccaaacaccucauguucucacucauaggugugaauugaacaaugagaacacuuggacacaggguggggaacaucacacaccagggccuguugugggauggggggaggggggagggauagcauuaggagauauaccuaauguaaaugacgaguuaacagguacagcacaccaacauggcacauguauauguauguaacgaaccugcacauugugcacauguacccuagaacuuaaaguauaauuaaaaaaauaaauaaaucaaaaauaaauaaguaaauacauaaauaaauuugauaaaggaaaaaaaagaaugaguggaaacuauacccuccucuucaauauucuggaaccauuuguuuagaacugguauuauuuuuuccucaauagcuuuguaggauucauccauaaauucaucuuggccuggaaaaaaaaauaaaguaugggcaaaggacuugaauagauauuucuccaaauauacacaaauggccaauaagcacauaaaaaugaaaauaugcuuaauaucaguaaucauugcaaaucaaaaucucaugagauauuaccucauacccauuagaauggguacuaaugaaagaacagaaaauaacauguuaaugagguuguggagaaauuggaauucucgagcacuguugaugggaaugucagaugguacagucacuguggagaacaauuuugugguuccccaaaaaaauaaaacuaaaauaacuauaugauccacuaauuucacuucuagauauauaccuaaaagaauugaaagcauagucucaaagagauauauguucaccuauguucauagcaacauuauucacaauagccaaaaguuggaagcaacccauguguccauugacagaugaauggguagacuaaauguggccucuacauacaguauuccauacaguauggaaaauguuuuggugguuucuucuaaaacuaaacaugcaucuacugugugauccaacaauuauuuuccuagauauuuacuuaaaauaaauggaaacauguccacuaaaaaucuuguacaagaauauucaugguggcuuuauccacaaugauaaaaaauggaaacacauaaaauguucauuaagaagagacuggauaaacaaauuugguauauucauauaauggaauacuacucagaaguaaaaaagaccuacugauagucacaggaacauggaugaaucuuguaauaugcugaaugaauaaccuauauacaagagaguauguuugucaugauuucauuuaaaugaaguuuuugaaucaacaaaaccaauuuauggagacagaaagaacaaugguugccucagugggguacuauuaguuuguuaagggauaugagggaacuuucugggauuauggaaauuaugucuugguugguauugccauuacaugguuuuaaaaacaauuugucaaagcuuauuaaacuuuacacuuaaaaccaugcguuuuauuauauguaaauuaugucucauugaaguugaacucaucgacgaaagcuacugggccuagaguucuguuuaugcaaaggcuuuuaauuucugaagcaauuuaaucauaguuacaguauaacuugguuguccuauuucuucaaguuugauaaauaauauuuuucuggguuucauccaguucaucuacauuuucuacaguuucagaauugucuguagcauuuacuguuaaaaacaguaauagccuguuuuuaaucugauguugguuauuuguuccuucuuuuguuuuuuucuuuaucagugucaccaggaguuugucaauuugggaagucuuuuuccuuuguuuuuugagauggagucugccucugucacccacgcuggagugcaguggcugugaucucggcucacugcaaccucuaccuccuggguucaagcaacucucaugccucagcuuccugaguaguugggauuacaggcgugugccuccaugccggcuaauuuuuguauuuuuaguagagaagggguuucauuauguuggccagacuggucucaaacucuuggccucaagugaucugcccacgucagucucccaaagugcugagguuacaggugugagccacugugcccagaccuaucuuaagaugaguucuuagaucauuaauuuucagucuuucuaauguacacauuucaaugcuguaaauuucccacuaaguauugcuguaucuguguccuauagguuuugauauauaguaaauuaguauuguuuagcccaaugcccuccuguaucucuuaauuucuaaauuuaaggggacauguuguguuuuuguuacugauuucuagcauaacugaauuguuacuagagagcacacucugguaugacuuuaguacuuugaaauuuauugauauuugccugauggcccaauauauggggucacuuuuuguaaacaucccuuacauacaugaaaauaauguauauuguauaguuguuggguguuuccuuuauguaaagauuaccaguuauauucuuuauauuuguguaucuuuuuuucauucuguaccucugcuuuuuuuuauuuguguuuuauuaaguaguugacugagauagauguguuuaaaaacuuuacacaaugauuguggauuucuguuuucuaauuucaguucuguuaacuugucuuuauuucaaggccauauuauuggguguacauuauuuugaauaugugcaacuuuuuauuacauacgauagaacuuuauguguauaguuguucccuugguuuauacaugggggauugguuccagaaccccccaggaauaccaaaaucugcgcauacucauauccccuagucagcccuguggaacccaugcaaacuagaaguuggcccuccauauaugugaguuucauauccuguggauacuguauuguccauuuaaauuugguugaaaaaaaauccacauauaaauggaugcaguucaaacccauguuguucaaaguucaacuguauacuuaauauguauuuuacauguuuauauauaauggaaauuguuguuaaaacaagauaccuccuuuaucucuaguagagauaaacuugccuuagagcaaguuuuuauguuauuauuauaacuauaccauuuuuuauucuguuucauguuugcuuguuauaucuuuuaaaucuguuuacucuuauccucuaucuuuauguuuuaaaugacucuuauaaauagcauguagccagaguuuauaauuuuaugcacucugacaaucuuugucucuuuuacugguauauuuggccuuagacuacauuaucuccuuuaucucuuaugucuuacuuauauguuaguauacuauuauuguugucauguacuuugaugauuuuuuuuccuaaggguuuuguauuguccaagaagaaagaaaaaauagagugaacuggggguaagcaguaauuacaggguauuucuaaucugaaaauccaaaaucuaaaaugcucccaaguccaaaacuuuauagcacagacauaaugccacaaguggagaaguccaugcacaaguacuuaacacauacuuuuucaugaacaaaauuauuaaaauauuguauuaaauuaccuucaggcuauguguaagguauauacaaaauauaaaugaguuuuguguuuagacauagguccuauccuuaggauaucucauuagauaaaucugaaauauuuuuggucccaagcauuuuggaaaaggaauacucaaccucuacugagaauauuuagaauugaugaaagaccugaauucacagauauagaaagagaaauuuauaccaagcaagaaaaauuaaaagaaauccacauuuagacuugguauaacuaaagaauauuggacacauaaaaguauuaaaaguaucuggagagaaaugaaagaugaaagugaagaaaugacauauuggccaugaacaucucaacaaacaacaauagaagucagaaaacagugagaaaguauuuucaugggcuaagaagauuacugucaacauuaaauuuuguccgcaacauaccuaucuuuuaagaauguuggagaaauaaggauaauuuuauauuaaaaagugaggaaaacaugcuuuucaagaacacucggacauuuaacaaaaaugaucauauaggccaagaauaacuaaagcaaucuuuaagaacaaaguaggaaaaugugcccuaccagauauaaagauuaauuguauagcuaagguaauuaagacaguaugacacuggcacagaaguugucaagucaauugaauaaaagagaagccuagaaaaagauacagggguacaugguaacuagacacaauacagaagugauauugcagauauguagugcuagaacauuugacuaucuauauggaaaaauaugaaagucuaccucuacacuacauacaaacacaaauuccuuaaggauauaaauaaaugugaagggcagggcuucaaaacauuugaagaagaugugggacaauaucuuugugaccugguaguaaagaaagauuuccuaaauaagauuaaaaaacacaaccauauuugaaaauauugauacauucauauauacuaaaauaauuucugguuacuuggaaaguaaaguaacaaaccucaaaauuggagaaauaucccaacuuuacauauauaaagaacaaaggauuagaacccauuaaauguaauuaagaagaaaaugaagcaccaaguacauaaaugaguaaaauauaugaacagagauggucacagaacagaaaauaugaagaguuaaacauguuacauaauuuucuggaaagugcaaauuauacaacaaaacuucagucaaauacuuuugucugacacuaucaacucuuggugaaguugugaagcaggaaaagucauaaccuuguugcugagaauuuaaauugguauaaaugcauauggaaaauaaugucaucuuuaaaguugaauauguaaccugcccuaugacccggcaauuccaauccuagguauauacuauagagaaauucuacauuugcaccaggagguguuuacaagaacauucauagcacuauuguguguguaccagucccaaaauggagacaacucagugcccugaacaauugauuacauaaacaguguuauauucauacaauagaacacuacucagcagugaaaaugaaagaacuguauuuuuacacauaaauaccucaaacauaacuguucaaugagaaaagcaagccagaaaaauaauguacuaugaaaacauuuauaugaaguucaaaaaaaaucuugaaauauuguuuagggacacauaauuaugcaaugaaucuauaaagaagaguaagggaauauaaauuaagaauguuuuuuaugcucgaaagggcaguaggggaaaacuaaugaagagggaggggcauuuaauagcuuuuaucaauauugguaauggucuauauuuuaaagucgaugauugacucauggauacaaaauacagucugauucaucauuauauuacccauaacccucuucccaauuccugucccugccguauaacaccuugccaguauuaauuuagcccuaagauaaaagugaauaugaagggugcuaauucagggcuuuccuucccucuuaauaauuucuauauuugaauuauaucuacacaacucaguaaauauuuauacaaaguaugugaaaauaauauaaauggaaguuguugcuucuuuauagaaaauuaaucucauuaagaauaugccuuugaaucacaugaguuuucuguacaauggaaauacuuauucuaauaaagcguauuaaacugagugagaguaaccaauguaaauauuguugagaaauucauuaaaaauaaaugcauggguguuuauuuuauauuacuugucaagaaaaaauacauauuuuaggggagaagauagauuuuuugaaaacaaaacacuucucaccauaugaaaauguaaggaaagugauccaaccuaauuuccaugaauaaguaaucuucuaagauucacaaaaccacaaaaugaauauggaauguuuucaaguaauccauagcauuuacuaauauucaugcuauuuuucuuuacuuaaaggucaauaaauuagaguuagaacuagaaagugccaaacagaaauuuggagaaaucacagacaccuaucagaaagaaauugaggacaaaaagauaucagaagaaaaucuuuuggaagaggugggaaaaacuuaauguauuaagaacuuauuauacuaaaaaucuauauuuuuauuaggauuuuaagaggaaaguaaaaaaaucuuaacuauuaaauuacaauuuuagaaaaggguuaguaaauuuauauaagggucaguuuaucaguuuuuauagaaacuaaaaguauccuugcuauucuaaguauuugaguauauaauuauuuugaaaggauuaaaugauugccacagugguauagugucaucuuacuucauaaaacaccccgaaaaaaccccaaacagugcauuuucuacuuguuuuuccaguuuccugguguuugagguuugcuuuuauuuaaguagaacauauacuuuuuacacuuguuuguuuuuugugcauuuauuuuaagaaacuuuuuuuuuuugcuuauuugauagguugagaaagcaaaaguaauagcugaugaagcaguaaaauuacagaaagaaauugauaagcgaugucaacauaaaauagcugaaaugguagcacuuauggaaaaacauaagguaauuuuuuucuucuuauauaaugaaaauuauuaauuggagccauauuucuguuaaauaauggugaaaucaagauaguauucuuauuugucagagaagauuauugucuaugcaacagugacugucuauagcuagaauacccuugaugcccauuucuucaaguucagaucuuaaccauacaaaguugagccugugugucacauccuugaggaaaucucucuuuguuaucugugaugaauggaaguaaucacucuuuuucuggauucugcuaauagucucuuauagcacuuucuaccuuauauauuuuuaaguacauaaccaggauaaguaucucauugauaucuaacauauaauaggcuaaaucaauuuuuaucaaaggaauaaauagaugaaauacuuaguguuugauguguuuuugucuuauauuuuuaauuguuguuuuagaguauccauuuguuaaggaauuaagccucauuccccuuaagauuuggagaagagguaggguauaccuaccuauucaauuaaaaaaaaaagcugcuggaauacgagauuauuaugagggaaguggugaggauuuaaaaaauaauuuaaauaacauugugaacucauagauuugaacacauuugguauguuucaauccagugcagcaucuguccuuauugauaacucacauuuucccaccuuuggcuagcaggagccucuuuaagcuguguggcaaguccuuuugacuuaacuguaauuuucucugauaacuuucuuugaguuaugacaaaauguuuaaggcuucuuuuuuugauguaauaauuuuuuuauuauacuuuaaguucuaggguacaugugcacaacaugcagguuugucacauauguauacaugugccauguuggugugcugcacccauuaacucaucauuuacauuagguauaucuccuaaugcuaguuuaaggcuuguauuuccugucccagauuugaaaucagucaguuuuguagaagcccugguguuucuggcaaauuuuuaaauguuaaaauucaauguuuccaaagauaaaagaauuaucuuuugcucuuugguuauuuccaagacuguuguguguuucacuauugagguuguuugaaugaaaaaauauaauugaaacauuaaaaauauauacccauauauauuacugaauuuauaaacauaaguuucugcaaaauuaaauacuaaauaauuaauuaaauacuaaauuaaauauuaaaauauguuaggauaccaaucuuauaaucuauucaguuuuaauauaucuaaaaugucuucuuuguuuaauauagcaccaauaugauaagaucauugaagaaagagacucagaauuaggacuuuauaagagcaaagaacaagaacagucaucacugagagcaucuuuggugagauacagaaaaaauugcaguaacggccaguuuucauaaugucagcagugacuggugguaaagaauaauauuaaguaaaacuaauuuuugagcuauagaaucagagucuuaacucugaaagggaucuuauagaucuucuaguuacauguuuuuuucuaauuuaguuuuugaaauaguggaacaaacuauuuuuucaagugaaauuuuauaaacuccaguaaacaaauaaguuuggaccucugauugaaauugggagaggagggugggauaaacugggagagaacgaggagagauauacuuuguguugaaguuuucuuuaaagaaaacuacaaaaaacuugauuuuguuuuguuuuguuuuguuuuuguuuuuugaguuggagucuuucugugucccccaggcuggagugcacuggcaugaucuuggcucacugcaaccuccaccucccggguucaagcaguucucuggccucagccuccugaguagcugggacuacaggugugcaucaccacacccggcuaauuuuuguauuaauauuuuuaguagagacgggguuucaccauguuggccaggcuuuccucaaacuccugaccucgagugauaugccugccucugccucccagggaagugcugggauuacaggcaugagccacugcacccagcccaaaaacuuguuuaaaugagguuuuuagcuauguuaagcuagcagccuuuauaucaguugacuuuaaaaguaucuacauuuuaugagugaauuuauuucucuacaauauuaaauuuacucagagcacuaguuuauauuuucauugucuugagaaauacauggaagcucuucuaaacuucauguuucuuuuucuuuaggagauugaacuauccaaucucaaagcugaacuuuugucuguuaagaagcaacuugaaauagaaagagaagagaagguagguuuuuuggcauuauagauaaaaugauuacaagguuuaggggcaacuuugcauuuuuagaauuaugucauauuauaaaauaauuugauaaauuuuaauaacgggaugagaaaauaauuuucccccagaagcuuuuuucuagaaacauuuagaauauuuccuaauguaaaugcaaaacacacguaaauauaaguguacuuuuaagaaaagaacacuuuuguggcucaugucuguaaucccagcacuuugggaggccgaggcgggcggaucaugaggucaggagaucgagaccauccuggcuaacacggugaaacccugucucuacuaaaaauacaaaaaauuagccgggugcgguggcgggcgccuguagucccagcuacucgggaggcugaggcaggagaauggcgugaacccgggaggcggagcuugcagcagccgagaucgcgccacugcacucuagccugggagacagagcgagacuccgucucaaaaaaaaaaaaaaaaaaaaaaaaaaaaaaagaaaaggaacccuuuuuuuucugcaaauacuguuaacauuuuuaauguauauccuucuagcauguuuccuuuuuuuuuauuauacuuuaaguuuuaggguacaugugcacaacgugcagguuuguuacauauguauacaugugacauguuggugugcugcacccauuaacucgucguuuaacguuagguauaucuccuaaugcuaucccuacccccuggaacacuuuuaaauauacuguauaugaguaauauuaucucguauuaaaaugcuuauauauuuagauaugcuuuuuuugaagcuauucaucauguuucagaaaaaaaggcuaucucuguaguguuuuacaguuugcaaggugaauugauucacccuauaaaugacaaauacuauuuuuuuugguuucuaugagaugggaacuguguuuaguacccuacuuacauuuaauuuaaucuuuacagcaauguuauaucccacaauuuauuauuaucuuuacuuugacagagguuacauuauuuauucaggauuacguaguaagagagcagaaugacuagauuucaaaccuaggucuauuuuugcauggcuucaaaccuauucucuuaaucacucugcaacagcuuagguaacauacacuuucaauuucaagccucugagaauuuguuuacuuuguuuccugcauuuaauuccuuucauccuuuucuaucuuggaaaaucucacacaucuuucaucuuauaguugugagcuuacuauauauguguguauucucauagcacuuuguuuuuaauguuaaaaugguuauuucacucugugcccccuguuauauugcaagcucugcaaggucuaauuaugccuuauuuaucuuuguuuucccuuuaucugaguacagggcuuugaaauuuuuauauuuucaauuaaaggacuaacaaaauggcuuucccuucaucugcaauaauaagauucaugcuuaccuuuauccuacuguuucaguagaagaggaauucuucuguggcuuaacucuugaugcuauuaaacccucagcaaucuuuacuuuuuacucuagucaguaaacauaaauaagaauaagaauucuguuacuguagcuuguaucucaaguucuuuggcucucacauaaguagaaauuaacaccaggccaaagagacauuuuucucagggaagguuuaauaggcuuguggcucaaucaaagcaagggagcaguuuacggcaaagggaucuccgugcuagcucccugaggcucagcuccugucauuuuagaagcugaggcagaaaaugaaaugauguacaagcauguuuaggcgaaauuuucuuuguguuugcgcaauggggcaucaugcucugacauacauugcaugaucagaaaaugguggauaagcccugccuuggguggagauuuuaguauuaaaaugauacuauaaugaggaaaaaaucagugaaaggucaguguuggagucugucuugucuucagcagacuggaucugguccaguucuuaucgggaaugccagagccucacuaaccuugaaagauggucagguucuuaucaggaaugcuagagucccacuuuuaguaaccuugggagacauuacuucaaggagauaaacaauuaguuucuucuuuugauaguuaagaauucagccuagucagcuaaguuaggagaggcccuccuucugcuaugugacuugggucagcuuauuaagggagacaggaagguaggggagagaauaugccuugauaugugaggcccauggggucuugauuacuaugucuguggucuaccagggcucaaucccuucccuauacugucucauuucuaucaucuuauaaaaacuuaaaccauuaaacugcuuaagcugcuauacuauucuguucuuuucuuaaguauuagucuguuuuuucaggucuuaucuccucaccuauuacaauuuagcuauuggccuaacugcuuucuugucuugggucacacugaacuccuuauuaacaaauuuaagggcuucuuuuuuauuugcauaucaaaaauaauuuaggaccuccauuuacaucguauuguguuucuuucugaucaucuaugaaaaaauauauaaacacaaacaugugcacacaugcacacacacaaauaugccuguacauagauagauauaaaaaauuugggcuugugauagauuguuuuauucaaaauguaugcugcccuuuucuauuagggucccucccaaaggaagaauuauguauuuccaccucgcugacuucagauuuggccaaagguuuuguuuugcccaauggaaugugagcaaaaguggcuuuucugagaggaugcuuuaagagacaccacaucgucuucccagccucucuuuucuuuuggccuugagacugacguagaaguugcuucuucagccuagauuccuggagauaacaaggaguaggguagaaaccagucuauaauugacauguaaugugguugagaaauaaacuucucuuguaauccacuaagaucugggguuguuacuacaguguaauuuagucuaagcucauugauauaaggauuuauuguauaccuaaauuuauauuguuuaauaaaaacacauuauguuuauauuuuauaaaauauuaauacagaaaaauacaaaaaggguaaaaauagccuacaaacccauaucucagaguuuacuguuuuuccaucugcuuuccaacuuucuauauacugagauuggacuaacaguuauagagauaauaccuuuagguguucuucuucuauuuaaaaaauguccacuuuuauugcauugucuauacuauuguuacuuuuuugaaauuucuuuagcauuuucuuuaugcuguaaaauauagucaguauuuaugaauguacaugaggacauaaaaugaagguauaauuauaaucuauagacugauuaucuagcuaaugaugaaugcuaauuauacauacauauauacauaauuauguuaaauuacacucuuuuuuuuuuuuugagacagagucucacgucucacucugucucccaggcuggagugcaguggugcaaucucagcucacugcaagcuccaccucccggguucacgccauucuccugccucagccucccuaguagcugggacuacaggugucugccaccacgccuggauaauuuuuuguauuuuuaguagagaugggguuucacuguguuagccaggauggucucaaucuccugaccuugugauccgcccgccucagccccccaaagugcugggauuacaggcgugagccaccacgcccggccuaaauuacacuuuuauacacauuuuaagaauguaaguaauacauacaaauguaaaggaaaauguugauggaauucuagagcuuacaucccagaauaacuuuuaucuauuuugggcguguaucacuucauauggcuccuuuaugaaaaaacaaaaacauaaacaaaaagaaccauagucagauacacuuacacauaucaagaaagauaaagaaagaauaccuuugaaaaaaaugccauauuagcuacuuuaaacuaaaauauacauauuauauuugaauuuaucggaaaaaauaauuugaaauuggaauugcagaauuauuauuaaacuuaagauagauauuucuuuacaaaauauuuaauaguucuugaaagggcugagauucuagggugaagaaaacagacugaaaaacauuuugaagagggaggaaaguuguaggugccaguguaguuucuuuuaauuaagcuuuuuauuuugagauaauuguagauucacaugcaguuguaagaaauaauguagagagaucccauguauccuuuauuaaguuuccccccauggucacaucuuacaaauuguaggacaauaucacaaccaggauuuugacauugacacaauuaagauacagaacaguuccaucuccauaaagauuccucauauugcccuuuuauagccacauccaccucccucccccaccccuggcaaucacuaacauguucuccauuucuauaauuuugccauuucgagaauguuaucuagauggauucauacacuauguaaccuuuguuacagcuuuguuucuuggagauuuauccaaguuguuaguccaaccugaguauauagaaaguuggaaagcagauagaaaaauguaaauacuuuuuuuuaguuuuuauugccaaguaguauucugugguauggagguaccacaguuuaagaguuugcccagucaaggguaccuaguuguuucuaguuuugagcuauuauaaauaaagcuguuaugaacaucuguguacagguuuuggugugaaccuguuuucauuuuucugaaacaacuaccuaagaauacaauugcuaaauuguauggcaguugcauauuaguuucauaagcaacugccaaacuauuuuccaaaguggugguaccauuuuacauuaccauaagcacuguauaaaugauccaguuucucugcauccuuaccagcagcaacuugcuauuuuuuauuuuaguuauuccuguagguuuguagucauaauucauugugguucuaauuugcguuuuucugcuguugaacaguguauuagucuauucucaugcugccaauaaagacauaccugagacuggguaauuuauaaagaaaagagguuuaauugacucacaguuccacagggcuggggaggccucaggaaacuuacaauuaugguggaaggggaagcaaacauguccuucacauggcagcaggaaggauaaugaaugccaagcaaagggggaaaagccccuuauaaaaccauuagaucuugugagaacucacugucacgagaacagcagcauggggguaaccaaccucaugauucaauuacuucccacuggguacucucccacaacauguggggauaaugggaacuacaauucaagaugagauuuguaucuguguuuuuauuuuuaacuaauuuucuaauuagacuuguuuuuaccuguugaauuuuaagaauucuuuauauaauguaauuauuaguccucugucagaggacuuauuccauuuguguugcuauaacagaauacuugagacuggguaauuuauaaagaacagaaauguauuuuucucacaguucuggaaaaugggaaguucaagaucaaggugccagcaucuggugagggccuuuuguggcauccuccagagagagaaaugaccugucuucauaugguggaagauaaaaaggcaaagaauaacaagagggccaaacaugucuuuuuaugaugggauuccugccacccauaagggcagagcccucauggcccuaucaccuuccaaauguccuacuuccuaacaaugccacaaugacaaccaaauuucaacaugaguuuuggaggguacaaacauucaaaccauagcaucagauaugugguuugccaguguaugcucccagucuauagcuugucuuuuuauucuaacaguuuuuuugcagaacaaguuuuuaaucuugauaaauuuuaauuucucaguuuuuccuuuuauggauugugcuuuugaucccaagucuaagaacucuuucccuagcccuagaucccaaagacuuuggccugugucuuuuuguaaaagcuuuagaauuuuauuuuuuauacuuacaucugugauccauuuugaguuaauuguuauauaaagcgugaaguucaguuuuuugccuauggaucucagauugcucugucaccagcuguugaaaagacugcuuuaucuccauugaauuacuuucaaacuuuugucaaaaacuaguuaggcauguucuuauggaucuauuucuauggucuuuauucuguuccauugaucuaugugucucuucaccaauaucacugccaugcuuacuuuauacuaagccuuaauaucaaguaaaaugauucuccuacuuuauuuuucucugucaagauuguuuuagauguuuuaguaccuguuacuuuccauauauuuuagaauaaauuuauuuuuacaaaaaccuugcugggauuuugauagaaaauuuauuaaaccuauagaucacaguuugaggaaaauugacaucuuuacuuuguugaguuuucaaaucuauagcaugguauuuuucuccauuuauuagauauuugauuucuuucauaagaauuucauaauuuucauuauauagccucuaaaccuguuuuguuaaauguauaucuauuucauuuccuuucaugcaauugaaaaaaauagacauuuguucuuauuuuuauuaauuuuuaauugacaaauaguaauuguguacauuuaugaggugcaaucugacauguugauauacguacguguacguuauagaagauucaaucaaacuaauuaacaugucuaugaccuugccaacuuaucauuuuuuugacgugagaacauuaaaaaucuuuuagcaauuuuaaaauaugcaauaucuuauuauuagugguggucaucaugcagugcaauagauuguguuuuuaauuuuguuuccuauaugcuuaucauuaguguacagaaacaugauugauuuuuguguuuauuuuguauccugugcccaugcuaaacuuauuuauuagcucuacaaugcuuauuuuuauucuuugugauuuucugugcagacauuugucaucuucaggaugauuggaaaggaugaagcacuaauauuaauaaauacaauaauaauuaauuauauuuuauuuuauccuuuccagucaguaugcuuuuuauuuauuuauuuauuuauuuauuuauuuauuuuuuauuuauuuauuuuugagacggagucuugcucugucaccaggcuggagugcaguggcgugaucucggcucacugcaaccuccaccaucuggguucaagagauucuccugccucagcuucccgagcagcugggacuacaggcacacgccgccaugcccagcuaauuuuugucuuuguacuagagacggaguuucaccauguuguccaggauggccucaaucucuugaccucgcgauccgccugccucggccucccaaagugcuggcauuacaggcaugagccaccgcgccuggccuuuauuucuuuuucuugacuuauuacagugaaugacuagaacuuccaguaccaugugguagacugauaaguggcgagagcauacaugcuugcaguauugauaaauguagggagaaaagcauucaauuuuuuaaccaauaaguaugauguuagcuauagauuuuuucuagauuuaaaaaaucaaguugauguaaucucccuguaguaauuuaauuagaguuuuuaaaaaucgugaauugguacuggauuuuaucagaugcuuuuucugcauugauugauauuaucauauuauuuuucuuuuuaucuuguugauaugguggauuaccuugguugauuuuuugaaugcuauucccuagaauaaaucccauuugguguaugacauauacauauggagagugagaaacagggagagagagagagagggcacuugcuagauuuaaucugcuaauuuuuuguugaggauuuaaaauauaaguucaugagaaauauuggucuguaguuuucuucucuauacuaucuugucugguuaugauaucaugagucuggaaguguuuuccuugcuucuguuuucgggaagagauuguauaaaauugguguuaauuuuucuuucuguuugguagacugguagccuucuccagugaaacuauccaggcuuguagauuucugaaaaggacuuuuaaacaauaaauucaauuucuguaaugguuaauuaggcuguuucagggucaccauuaacccacucuuaucuccucaaaacaacaagaauucugcaccuauccagucaaaaucucacuuugggagccucaggacucaagagggagucucugaaacccucauggaaccaaagaccuuggagggucauuuugagagugcagacugacagcacuuggagggucauuuugagagugcagacugacaguagguuacagguggcugaccuacugaguuugcucccagguucaagcccaggaauggcccaguccucuaaguggcuuggcuauagcccucuuugucccugagcuugcaaucaaaaccaucugccaaagaguccgggggaaucacacuauuagugccuugauagaaaggcuugucugcuugcugauauugguuuuggcagugaacauaauaguuguuuuguggcacuucccuagcccacuuuaucugaggucccagcugagagcugcuaacacaaggacccagagggagacucacccauaccucgcagcugaggagucuaagccauccugaauaggaucaccaaccucuuuccuugugcugucucugagaucuaucuugucugggagauguguaccuguuugggcuaacaagaugggcucuccagccugugucccccagcagaucuuggaugggugguggggggacagucacaggucuaguccuuccugcugcaaucagggaacuauccugucugugcagggcccugcugagagauguacacuccucuaauccaaugggauaggcauuccaaccucuaucucacaauaauccugagggagcuaauucucagcuccaguccauccugcuacacuuaggaaacuauugucugugcaggguucuccuaggagacauguguucucucagccaccaagauuaggcucuucagccuccaacccacagcagauccugaggggaacuauggucaacuccagccccucaagcugcacuugacauccuaucuugcccaugcagagaccugcugggaggcauguccaucucagccacucggacaaucuucugaacucaggucccuggucagcauucccauacagcucuaguacccuccuuggaucuuucccaggcuuaucugggcuggaauggcaugucaaccuuggaguccuugcaagacucauggcaaguguggacuuagagcauccucuagugcugagauggcugcaguggucacaggcucaggaaacacaacaaccagacuucuuagaaucacuagaaucacugagaaccacaaacaaaggcagacugugccuacaauuaaauacuuaaucucucagugugcagacauugucacacauccacaagcaucaagaacauuaagggaaauauaaccucaccaaacagacaaaauaaggugccagagacugacccuaaauugauggaaaugugugaucucucaaagaauuagaaauggccagguuuuguuguuguuguuguuguuuguuuguuuuuguagaaacaggguuucucucucuugcccaggaugaagugcaaugguacaaucauagcucacuggaaucuccaacuccuggguucaagagauccuguggucucagccuacuaaguagcugggacuacaagugaccaccaccccacccagcuaauuuuuaaauuuuuugcaggggucuugcuauguugccuaaacuggucuugaacuccuuaaguaaacauuaaguuuacuuagauguaagaccugaaacuaugaaauuacugaaagaaaacacuggguaaaugcuacagggcauugguccggucaaagauuauuugagugagaccucaaaaagcauaggcaaugaaagcaaaaauggauaaaacaggauuauaucaagcuacaaagucucugcacagcaaaggaaacagcaaagugagaaaaaucaacccuuggaaugggagaacauguuuggaaacuauccauccaacaagagaugaauaaccagaauauauaagaaacucaaacaauucaauagcaaaaaaccccaaauuaucugauuaaaaauuggacaaaacauuucucaaaagaagacauacagauggaaacagguauaugaaaacaugcucaacaucacuaaucaucagggaaacacaaaucaacaccaccacaaugagauauaaccucacaccuauuaggauggcuguugcuaaaagucaaaagauagcaaguguugaugaggauguggaacaaagggaacccuuguuuacuguugcugggaguguaaauugguacagccauuauggaaaacagucuagagguuccucaaaaaacuaaaaauagagcuaccuuaugacccagcaaucccauuacugaguauauauccaaaagaaaggaaaucagcauauugaagagagaucuaaauucccauguuuacuguagcacuauucacaauugccaaaauauggaaucaacuaaguguucauuaacaagugauuggauaaagaaaaugugguauacauuccauaugcaauggaauauuaaucagccauaaaaaagaaggaaacuuugucauuugcaacuacauggauggagcuggaggauauuguguuaugugaaauaagcuaggcacagaaaaacagcuguuaaauauucucacucauaugugggagcuuaaaaaauuaucucauggagguaguaaauacagcggugguuacuggaggcugggaaggguaguggggagggagggaugaagagggauugauuaauggguacaaauauacaauuagauaaaagauauaaguuccaguguuugguagcacaauagggcuaguguagguuucaaaauauugaauacuucaaaauagcuauaggagaagaauuggaauauucccaacacaaagaaaugauaaauguuugagaugauagauauccuaauuacucugauuuugauuauuauguaucauauacagauaucaaaauaucacauguacucccaaaauauguacaacuauuauauaucaauaaaaauuauuuaguaauuuaucuuuuuauuauucaguuuuaaaaguucuuuauuucaggccgggugcgguggcccaugccuguaaucccagcacuuugggaggcugaggcgggcggaucacaaggucaggagauugaguccauccuggcuaacacggugaaacccugucucuacuaaaaaaaaaaaaaaaaaaaaaaaauuagccgggcaugguggugggugcccguagucccagcuacucgggaggcugaggcaggagaauggcaugaaccugggagguggagcuugcagugagccgagauugugccacugcacuccagccugggcaacagagugagacuccgucucaaaaaaaaaaaaaaaagaguucuuuauuucagauacauguucuuuauaugauguacuauuugcagauauuuucucucauucuguggguuguuuuuucaguuucuuguugguaucauuugcaacacaaaaguuuucauuuugaugaaauucaguguaucuagaugcccuuuaucaaacugagaaaguucucuucuauuccuaauuaguuuaaagguuguuuuguucucuuuuguuuuaccauaaaaggguguuagauuugugaaaugcuuuuuccaugucuguugaggugaucauguggguuucuccguuuauuccauuaauauuauguauuacaguaauugauuuucagaugugaaaccaacuuuacauucuuggcagaaauucuacuuggucuugguauauaauccccauuuuauuuugcuggauuugguuugcuagcauuuugaguugagaauuuuuugcaucuacauuuaugagagcuauugagcuauaguuuucugucuuuuaauuuuuaauuuuuguggguacauuguagguguguauauuuaugggguguaugggauauuuugauagaagcauacauuguguaauaauuuuaucagagugaaugagguauccaucaccucaagcauuuauccuuuguauuacaaacaauccaauuauacuuuuaguuauuuuaaaauguccacuuaaauuauuggccauaaucacccuauugugcuaucaaaugcuauaucuuauucauucuuucuauuuuuuauauccauuaaccauucuccuuuccccacacacccccuccccuccucccuacuacccuucccagccucugauaaucauccuucuauucucuaucuccaugaguucaauggcuauaauuuuuaguacccacagacaagugagaacauggaaaguuugucuuucugugccuggcuuauuucacuuaacauaaugaccuccaguuccacccaugcugcugcaaaucacaggaucuuauucuuuuuuauggcugaauaguaguucaggguguguaugcaccacauuuucuuuacccagucaucaggugauggacauuuggguugcuuccaaaucuuggcuauugugaacaguguuacaguaaacaugggagugcagauauuucuuagguaaauggauuucuuuucuuuuggguauauaccuagcagugggauggcuggaucauacagucuauagcagcugauuauuuuuaguuugcuuguuuuuuuuuuuuuuuuuuuuuugagauggagucuugcucuguugcccaugcuggagugcaguggugugaucucggcucacugcaaccuccaccuccuggguucaagugauucuccugccucagccucccgaguagcugggaucacaggcaugcaccaucaccccuggcuaauuuuuguauuuuuaguagagaugggguuuugccauguuggccaggcuugucucgaacuccugaccucaggugauccacucgccuuggccucccuaagugcugggauuacgggcgugagccaccacgcccagccuauuuuuaguuuuuugaggaaccuccacagugguuguacuaauuuacauucccaccagcaguguaugaggguucccuuuucuccacguccucgucagcauuuguuauugccugacuuuuggauaaaagccauuuuaacugggguaagaugauaucucauuguaguuuugauuugcauuucucugaugaucaguaauguugaguacguuuucauauaccuguuugccauugguauaucuucuuuugagaaauguauuaucuuuuugauaugcuguuagacucgguuagcuaguauuuuguugaggauuugugcaucuauguucaucagggauauuugucuguaauuuucuuuuuucguuuuguccucuccugguuuugguauuagggugauacuggcuucauagaaugauuuaggggggauuuucucuuacucuaucuuuuggaauaguuucaguaggauuggugccaauucuuugaaugucugacagaauucaacugugaauccaucugguccugaacuucuuuuauuggcaguuuuuaaaaauuaccauuucagucuugcugcuuguuauuggucuguucagaguuucucuugcuuccugguuuaaucuaggaggguuguauauuuccaggaauuuauccaucucuucuagguuuucuaguuugugcauguuaagguguucauaguagccuugaucuuuuuuauuucucugguaucaguuguaauaucuccuguuucauuucugauugagcuuauuugaaucuucucuuuucuugguuaaucucacaaauggucuaucaauuuuguuuauguuuucaaagaacuagcuuuuuguuucauuuaucuuuuguauuuuuuguuucaauuucauuuaguuaugcucugaucuuuguaauuucuuuucuucugcugaauuuggguuugguuuguucuuguuccucuagcuccuugagaugugaccuuagauugucuauuugugcucuuucagacuuuuugauguaggcauuuaaugcuaugaacuuuccucuuagcacugcuuuugcuguaucucagaggcauugauaggcugugucacuauuaucguuuaguugaaagaauuuaagaauuuccaucuugauuucacuguugacccagagaccauucaggagaagauuauuuaauuuucacguauuugccugauuuugagaguuccuuuuggaguugauuuccaauuuuauuccacuguggucugagagaguacuugauauaauuucgauguucuuaauucauugagaccuguuuuguggccuuucauauggucugucuuggagaauguuacauguggugaugaauagaauguauauucugcaguuguuagguagaauguucuguaaauaccuguuaagugcaucuguuccaggguauagauuaaguccauuuuuucuuuguugauuuucugucuugaugaccugucuagugcugccagugaaguauugaagucccccacuauuauuuguguugccaucuaucuuuuuuuuuuuuuuuuuuugagauggagucuuaccuuuuugcccaggcuggagugcagugacacaauuucggcucacuaaaaccuucgccucccagguucaagugauucuccugcaucagccgccugaguagaguagcugagauuacaggcagccggcacaacacccagcuaauuuuuguauuuuuuuaguagagacaggguuucgcuguguuggccaggcuggucucgaacuccugaccucaggugauccagcccgccucagccucccaaagugcugggauuauaggugugagccacugcacccaacaugucuaucucauuuuuaaggucugguagucauuguuuuauacauuugggagaaccaguguuaggugcauauauuuuuaggucugugauauuuuccuguuaaacaaguccuuuuaucauuauguaaugucucuuuuugucuuuuuaaacuguuguugcuuuaaagucuguuuugucugauguaagaauaacuauucuugccugcuuuugguguccauuugcauggaauaucuuuuuccaccccuuuaccuuaaguuuaugugagucuguauguguuauguuaggugagucccuuaaagacagcacauacuuggguuggugaauucuuauauauucugccauucuguaucuuuuaaguggagcauuuaggccauuuacauucaacauuaguauugagaugugagguacucuuccauucauugugcuauuuguugccugaauaccuugauuuuuuuucauuguguuauuguuuuauaggcuuuguaagauuuaugcuuuaaggaaauucuauuuugguguauuuuuagguuuuguuucaagauguagagcuccuuuuagcaguuauuguagugcuaacuugguaguggcgaauucucucagcauuuguuugucugaaaaagacuuuaucuuuucuucauuuuugaagcuuaguuacacuggauacaaaauucuuggcugauaauuauuuuguuuaaggagccuaaagauaagaccccagucccuacuagcuuguaagguuucugcugagaagucugcuguuaauccaauagguuuuccuuuauagguuagcuugaugcuuuugccucacagcucuuaagauucuuuccuucaucuugacuuuagacaauuugaugacuaugugccuagauuacgaucuuuugcgaugaauuuccuggguauucuuugagccucuuguauuuggaugucuagaucucuagcaaggucagggaaguuuuccuugauuacucccucaaauaaauuuuccaaagucuuagauuucucuucuuccugaggaacacaaauuuucuuagguugguuuguuuaacauaaucccaagcuucuuggaggcuuuguucauuuuuuuaaaaguauuuuuucuuuuuuauuauacuuuaaauucugggauacgugugcagaacaugcaaguuuguuacauagguauacaugugccauggugguuugcugcacucaccaaucuaucaucuacauuagguauuucuucuaaugcugucccuccccuugcccccaaccccugacagaccccaaugugugauguucccaucccugugccuguauguucucauuguccagcuuccacuuacaagugagaacaugugguguuugguuuucuguuucuguguuaguuugcugagaaugaugguuuccagcuucauccaugucccuguaaaggacaugaacuaauucuuuuuuauggcugcauaguauuucaugguguauaugugccacauuuucuuuauccagucuaucauugaugggcauuuggguugguuccaagucuuugcuauugugaauaaugcugcagcaaacauaugugugcaugugucuuuauaguagaaugauuuauaauccuuuggguauauacccaguaaugggauugcugggucaaaugguauuucugguucuagauccuugaggaaucaccacacugucuuccacaaugguugaacuaauuuacacucccaccaacuguguaaaagcauuccuauuucuccacauccucuccagcaucuguuguuuccugacuuuuuaaugauugccauucuaacucgugugagaugauaucuucuugugguuuugauuugcauuucucuaaugaucagugaugaugagcuuuuuuuucauguuuguuggcugcaaaaaugucuucuuuugagaagugucucuucauauccuuugcccacuuuuugaugggguuguuuguuauuuucuuguaaauuuguuuaaguuccuuguagauucuggauacuagucuuuugucagauggauagauugcaaaaauuuucucccauucuguagguugccuguucacucugaugauaguuucuuuggcugugcagaagcucuuucauuuaauuagaucccauuugucuauuuuggcuuuuguugcaauuguuuuugguguuuuaguuaugaagucuuugcccaugccuauguccugaaugguauugccuagguuuuuuuucuaggguuuuuaauggguuuaggucuuaaguuuaagucuuuaauccaucuugaguuaauuuuuguauaagauguaaggaagggguccaguuucaguuuucugcauauggcuagccaguuuucccaauaccauuuauuaaauagggaauccuuuccccauuucuuguuuuugucauguuugucaaagaucagaugguuguagaugugugguguuauuucugagggcucuguucuguuccauccuguuuugguaccaguaccaugcuguuuugguuacugagccuuguaguauaguuugaagucacguagcaugaugccuccagcuuuguucuuuuggcuuaggauugucuuggauauaugggcucuuuuuuguuccauaugaaauuuaaaguaguuuuuucuaauucuaugaagaaagucaaugguagcuugauggggauagcauugaaucuguaaauuacuuugggcagcauggccauuuucaugguauugauucuuccuauccaugagcauggaauguuuuuccauuuguuuguguccucucuuauuuccuugagcagugguuugucguucuccuugaagagguccuucacaucccuuguaaguuguauucguagguauuuuauucucuuuguagcaauugugaaugggaguucacucaugauuuggcuguuugucuguuauugguguauaagaaugcuugugauuuuuguacauugauuuuguauccugaguuugcugaaguugcuuaucagcuuaaggaguuuuugggcugagaugauaggguuuucuaaauauacaaucaugucuucugcaaacagagacaauuugacuugcucucuuccuauuugaaugcccuuuauuuguuucucuuaccugauuucccuggccagaacuucccauacuauguugaauaggaguggugagagagggcauccuugucuugugcugguuuucaaagggaauacuuccagguuuggccuauucaguaugauauuggcuaugaguuugucauaauuagcucuuauuauuuugagauauguuccaucaauaccuaguuuauugaguguuuuuagcaugaagggguguugaauuuuaucgaaggccuuuucugcaucuauugagauaaucauguggcuuuuacaugguucuguuuaugugauggauuauguuuauugauuugcauauguugaaccagcguugcaucccaggaauugaucgcgguggauaagcuuuuugaugugcugcuggauuagguuugccaguauuuuauugaggauuaucacaucgauguucaucagggauauuggccugaaauuuuccuuuuuuguugugucucugccagguuuugguauaaggaugaugcuggccucauaaacugaguuaggcaggagucccucuuuuucuuuuuggaauaguuucagaaggaaugguaccggcuccucuuuguaccucugguagaauuuggcugugaacccaucugguccugggcuuuuuuugguugguaggcuauuaauuacugccucaauuucagagcuuguuauuggucuauucagggauuugacuucucccugguuuggucuugggaggguguauguguccaggaauuuauucauuucuucuagauuuucuaguuuauuuguguagagguguuuauaguauucucugaugguaguuucuguuucugugggaucaguggugauauccccuuuaucauuuuuuauugugucuauuugauuuuucucucuuuuccucuuuauuagucuggcuagcagucuaucuauuuuguuaaucuuuucaaaaaaccagcuccuagauucguugauuuuuuugaaggguuuuucaugucucgauguccuucaguucugcucugaucuuaauuauuucuugucuucugccagcuuuugaaucuguuuguuuuuucuucucuaguucuuuuaauugugauguuaggguauugguuuuggaucuuucccacuuucugaugugggcauuuagugcuacaaauuucccuauaaacacugcuuuagcugugucccagagauucugguacguuguguguuuguucucaaugguuuuaaagaacuuauuuaguuccaccuuaauuuuguuacuuacccaguagucauucaggagcagguuguuuaguuuucauguaguugugugguuuugagugaauuccuguuuucuuuuuucuuucuuucuuuuuuuuuuuuuuagauggagucucgcucugccacugaggcuggagugcaguggcgccaucuugacucacugcaaccucugccuccuggguucaagcgauucuccugucucagccucccaaguagccgggacuacaggcaugugccagcauaccuggcuaauuuuuguacuuuuuguagagacaggguuucaccauguuggcuaggcuguuguugaacuucugaccucaggugauuggccuuccucggccucccaaagugcugggauuacaggcgugagccacugcacucggccuugagugaguuucuuaauccugaguucuaauuuccuugcacuguggucugagagacuguuuguaaugauuuccguucuuuugcauuugcugaggguguuuuauuuccaauuauguguucaauuuuagaauaagugcuaugcggugcugagaagaauguauauucuguugcuuugggguggagaguucuguagaugucuauuaggucuguuugguccggagcugaguucaagucgugaauauccuuguuaauuuucugucucauucuucuaucuaauauugacaguggaguguuaaaguuuccuacuauuacugugugggagucuaagucucuuuguaggucucuuaaaacuugcuuuaugaaucugggugcucuuauauugggugcauguauuuaggauaguuagcucuucuuguugcauugaucccuuuaccauuauguaaugcccuucuuugucuuuuuugaucuuuguugguuuaaagucuguuuuaucagagacuaggauugcaaucucugcuuuuuguuuguuuguuugcuuuccauuugcuugguaaauauuccuccaucccuuuauuuugagucuaugugugucuuugcacgugagaugggucuccugaauacagcacaccgaugggucuugacucuucauccacugugccagucugugucuuuuaauuggggcauuuagcuuguuuacauuuaagguuaauauuguugugugugaauuugguccugucauuaugaugcuagcugguuauuuugcccauuaguugaugcaguuucuucauaguguugauggucuuuacauuuugguauguuuuugcaguggcugguaccaguuuuuccuuuccauauuuagugcuuccuucaggagcucuuguaaggcaggccugguggugacaaaaucccuuagcauugcuugucuguaaaggauuuuauuuuccuucacuuuaagguuaguuuggcuggauaugaaauucuggguugaaaauucuuuucuuuaagaauguugaauauuggccccuacucucuucuggcuuguaggguuucugcagagagagccacuguuaaucugaugggcuucccuuuguggguaacccgaccuuucucucuggcugcccuuaagauuuuuuccuucauuucaaccuuggugaaucugacaauuaugugucuugggguuguucuucucuaggaguaucuuugugguguucucuguauuuccugaauuugaauguuggccugucuugcuagauuggggaauuucuccuggauaauauccugaaguguguuuuccaacuugguuccauucucccugucacuuucagguacaccaaucaaauguugguuuggucuuuucacauagucccauauuucuuggaggcuuuguucauuccuuucauucuguuuucucuaaucuugucuucacacuuuauuucauuaaguugaucuucagucucugauaucguuucuuccucuugguugauucagcuauugauacuuguguauguuucacgaaguucucaugcuguguuuuucagcuccaucaggucuuuucuguucucuaaacugguuauucuaguuagcacuuccuguaaccuuuuaucaagguucuuagcuucuuugcauuggguuagaacaugcuuuuuuagcuuggaggagguuguuauuaccuaccuucugaagccuacuucugucaauucaucaaacucagucuccauccaguuuuguuuccuugcuggcaaggaguugugauccuuuggaggagaagaggcauucugguuuuuggaauuuucagccuuuuugcacugguuuuuccucaucuucauggauuuaucuacuuuuggucuuugauguuggagaccuucaguugggguuuuugcgugggcauccuuuuaguugauguugaugauacugcuuucuguuuguuaguuuuacuucuaauagucaggguccucuucuguaggucugcuggaguuugcuggggguguacuccagacccuguuuuccuggguaucaccagcggaggcugcagaacagcaaauauugcugccugcuccuuccucuggaagcuucaucccagaggggcacucgccagauaccagcuggagucuuccuauaugagguguauguuggccccugcugggaggugucucccaaacaggaggcacgugggucagggacccacuugaggaggcagucugucccuuagcagaacucgagcacugugcugggagauccucugcucucuucagagcuggcaggcaggaacauuuaagucugcugaagcugcacccacaggugccccuucccccaggugcuuuguuccagggcauuucucucagagaugcccugcccagagaggaggaaacuagagagguggucuggcuacaguggcuuugccaugcuguggugggcucugcuuaguucgaacuucccuguggcuuuguuuacacugugaagggaaaaccgccuacugaagccucaguaaugguggacuccccuccaccucccccaacaagcucaagcaucccagguugacuuuagacugcuguuuuggcagugagaauuugaagccaguggaucuuagcuuguugggcuccauggggaugggaucuacugagcaagacuacucggcucccaggcuucagccccuuuuccaggggagcgaacaguucugucucauuggaguuucaugugcaacugggguacaaaaacaaacaccuucagcuagcuaggugucuucccaaacacccacccaguuuugugcuugaaacccagggcccugguuguguaggcacccaauggaaucuccuggucuguggguugcagaaaccauaagaaaaacauaguaucugggccagguagcaccaucccucauggcacaguuccucauggcuucccuuggcuaguagauggaguuccccggucccuugcacuucccaggugaggcaacacccaccccugcuucugcucgcccucugugggcugcacccacugucuaaccagucccaaugagaugaacuggguaucucaguuggaaaugcagaaaucacccaccuucugcauuggucucacugggagcugcagaccagaucuguucuauuugaccaucuugccagcccccuguccccauauuuucuuugucuuuguuggauuggauuaauuugaaagccuugucuuugagcucuaaagucuuuuccuuuacuuguucgguucuauuguugaaauuuuccaguguauuuugcauuucuguaagcaugucuuucauuuccagaagcugugauuuuuuuuuaugauaucuguuucuucagagauuuuuuuucaaucauauccuguauuauuuuuuaaguuucuuuaaguuuguuuucaccuuucucuggugccuccuugaguagcuuaauaaucgaccuucugaauucuuuuucuggcaauucagagauuucuccuugguuuugauccauugcuggugagcuagugugaucuuuugaugguguuauagaaccuuguuuugucauauuaccagaauuguuuuuuuuuuuucuaguuuggauagacuaugucagaggaaagaucugggacucaagggcugcuguucagauucuuuugucccauggggugaucccuugauguggugcucucccucuuccccuagggauggggcuuccugagagcaugacugcagugauuguuauugcucuucugggucuagcuacccaguggagcuaucaggcuuuaggcugguaguggggagugucugugaagaguacuaugaugugauucaucuucaggucucucagccguggcuaccagcaccuucuccaguggagguggcagggcagugaagcagacucuaugagaguccuugguuguaguuuuguuuaguaugcugguuuucucaaaugcugguuaugcuggcagugaaguugugaugugaacaaguucaggaccucugguuagccaggguguuacagccgguggaauuagauguuguuuuccccuuccuuggaguaggguuggucuguuaugaguugcuguaaugccuugaguugguuggcuuccagccacaugguguugucuuuaagagagcaacaucgaugguaguguggagggauacaaacuuggccuaacaucaccuggauaaguauucagguuucucagguaaugggcagagccauagagcucccaugaauuuaugucuuuugucuucaguuacuacgucagguagagaaaaaccaucaggugggggcaggguuaggcguuucugagcucagacuuuccuugggcagggcuugcugcugccacugugaggggugggguagugguucucaggccaauggaguuauguuccaagggggauuauggcucccucugaugcuuuguacaguucgccagggaaguagggggaaaguuggcauugacaggccucacccagcucccacacagccagcaaggccaguuucacucccucuguacucccacaacagccaacagagccaaauuuauauccagaccuccaguguguagggcugagaucuugcuccagcagcuuucaguacuucgccauucaguaugauacuagcugugagucugucauauacggcuuuuauuauguugagauacauuccuucuauacccaguuuuauugaggguuuuuaucaugaagggauguuaaauuuuaucaaaagcuuuuucagcaucaauugaaaugaucauaugguuugauaugauauaucacacugauuuauuuguguauguugaaucauucuugcauccaugggauaaaucacacagccaugaugaaugauguuucaauguguuguugaauuugguuugcucguauuuuuugaggauuuuugcaucaauguucauccgggauaugggccuuuaguuuucuuuuuuugaugugucuuugugucugguuuugguuuaaggguacuacuggccucauagaaugaguuuggaaguaacccccucuccucuauuuuucagaauaguuugagcaggggugguauuaauucuucuuuaaauguuugguaaaauuuugcaguaaagccauuggguccuagguuuuucuuugcugggagacuuuuuauuauagcuucaaucuugcuagauguuauugauuuauucaaguuuuggauuucuucaugguucaaucuuuguagauuguauguggcuaggaauuuauuuauuuuuagguuuuaaaauuuauuggcauauauuuaccucauaguaaccucuagcgauccuuugaauuucugugguauugauuguaaugucuccuuuuccuucucucauuuuauuuauuugaggccucucucuuuuuuuccuuagucugccuggcuaacgguuugucauucuguuuaucuuuucaaaaaaguaaacuuuuuguuucguugaucuuuuguaucauuuucuucaauuucauuuauuucugcucugaucuuuauuguuucuucuacuaacuuuggguuugguuugcucaugcuuuucuaguucuuuaagaugcaucauuagguuauuugaaguuuuucuuccuuuuugauguagguguuuauagcuauauacaucccucuuaguacugcauuugcuguauccuuuagauuuuguuguuguauuccaauuauuuguuucaauaaauuuuuugauugccauuuuaaucuccucuuugacccacuggucauucuggagcauauuguuuaaauuccaugugauuuuauaguuuccaaaauucccuuuguuauugauuucugguuuauuucauuguugucagagaagauacuugaugugauuuccauuuuugaauguuuaagacuuguuuuguggcuagcauauggucuguccuuaagacugauucaugugcuuaggagaagaauguuuauuuugcaacuguuggaugaaauauuuauaaauaucuauuagauccauuuggucuauagugcagauuaaguccaguguuucguaguuuucuuguuauguauuucccucaggcuucagaucuuuuuaccagcucaguguagagcccuggggccugugugucuaucugauaggauaagccgugguuauuuauuuuugccauuuuacgucucuucaagcucuuguuaugucacuugcacagcuuugugagugaaaagauauaaauaugauuugggauauucugcuuacagggugaugaaaggagcccagagaaaaagauaaaauuuaccuggugcucuuagugagucucuuuuugugcuuuguauucuuuuagaggaaucuucuguuuaagaaguuuaucuuuugacuuuaugucuaguauguucuguuuauuggcaaggauaacuaauucuuuaugguugugguugugcuuccuuucuccaaucgagagagaccaaaauauaaacuuaagugguuuuuuccugcugaucacucauuaugcauuuucuaggcaucuuuuuccuggauugccuauuuauguccucaaaucucuucuuacaaaauucagguauauuagugaccuuuacuuucauuauuauauguuuucauuuucuuucaccaauacuauacaaguaguaauagggugaggagccacagugaguagggugaaaugagcacauuuguauauuguggcucucuuacugagccucacuaguauuaccgauuauagcaugagauuguauguuuuuguuguugaauguauuuuugccaguuuuuaacuacuuuuguuucuuuccucucuuccugucuugcuuuuuuguuguuguuguuaguuuaggagaaggaagauuuuguaagcuggcuuuaccaucuuuaccaagaaguuugauuuacuguauuauuucaauuauguguacuucaaauuucuuauauauuuuuucuguuugaucagucaugagcuaaaaggaguuaaggguucuauuacuauuaucuuucucuuccuuuugaauucucuacuaauuuugcauugcauauuuugaugaauacuauuuguuguauaaaaguuuauacuaauucauuguuuuuuuuggaaauaguauacuuuauuuuuguauuuuugccccaaagucagcuuuaucugguauucauauugugacccucacuuucuucuuguauuugucuccuguguuuuugucuacuuuuuauuaaccuugauugaaucuguaauccaagagucuuuuuuugacuaauaggcuaguuuuccugauuguauuuguugauaugauauguaucaguuuugauuuauucuuguguuucuguaauaaacucuauuugguuaugauguauuuuuaaaaugugauguuagauaaugcuggccaauauuuuauuuagcacuuuuauguugauaugcauaaguugaaugguuuguacuuuaacuuuguuauugugauaaaaacauauaacauuaagugcaccaucuuaacacuuuuuaaauguacaguucagcaguguuaaguauauucauccuguugugcaacagaucucuaguaguuuuccaucuuguaaaacuaaaagucuauacccauucaacacgaauucccuuuuccucuuccucccaguccuuggcaaccaccuuugcacauccuguuucugauuuugaauacuuuauaugaguggaaucauacaguauuugugcuuaugugacuggcuuauuucacuuagcauaauguccucgagguuuaucuauguuguaguauguaacaggaugcccuuuuuaaaggcugcauaauauucuauuauauguguauaccaucuuuuccuuauuauuuuucuuuugauggacauuugaguugcuucuaccucuugcuauugugaauaaugcuguaaugaaugugagugugcaacuaucucuuuaaaaucuugcuuugaauucuuuuggauauauuuccagaagugggauucuuagaucauauggcaacuguaucauuaauuuucugagaaccucuauauuggcuguagugacuguaccauuugacauucccacacagcagugcauaaggauucuaauuucuccacauccacaucagcauuuguuauuuccuauucauuugauaguggccauccuaauguguguaggcaauaucucauguggcugugauuugcauuucucauaugauuagcaauggugacuauuuuuaauaugccuguuggacauuguauaucuucuuuggugguuugauuauucaagucuuuugcccauuuuugaauuggguuaauaauaauuuuaauccaauuuuuguguuguugaguuguaggaguuguuuaugauucuggauauuaacucuucauugauuauauaucuuaauaauguuuuugucaucuuauuuuucacuacauauucacuacauauuuucuuucuuauucucuaaaguaagugugugugugugugugugugugugucuuacuuugguugauuuggaagguauauguagucuuuuaaauuaguuuauugauuaccuuuauauuuuaaaauaauguaucuaauacugucuccuguuucauauugcccuacauauacaauuuuaguauuuauuauuuuacauugucaagauugauaaaaauguauauucuauuauuucacuaugauuccuguaucucuuuaacuugagcuuuauauuuacauagauucagcucaucuuuuauaugcaacuuuuuuccaaguucucagucaauaugacaauccccacuuuaccuauaagcccauugguauaggaaacuguuacuagaugacugucuuaacuucuaauuaaaauagauuggcuuuuugggauuaugauaaaucauuuuuccuauaucuuucauuaauuugauggggccuuaaucucugccuagcaaugugaaauuuguuuacuaucuugauauggagagagagauucaaaguugguccuuucaacuuuaaaaucucuuacucugugacucuguggucagaacaaacauggggauuauuccuuuuauugaguuuguucaaacuauauucuuagaaucuaaaaaaaugagcacaagauagguuuaugguuccaugggcucaccaugaaguagacucugauaaaauucuaauuauugcuugaugcugauaugcuugcacucugaccagugaaaaaauaguggcauuauagauucccaauaauuaauguuaguugaugugcaauuacccaugucuuaauauuuuaauccuuggugcacaagauaguaggaaggaugcaguauguauuugugauauuauuucagaacuuuuccacuagaguaccaggcuuccuuuuuauucaaaaggcuauaggcugauacguuuauuuagauccaaaauuugguuacaagguugucauucucuacucuggugaucaagucaacucucuguuugccaggccguauuauaggaauaucuuacuuauucagauuaaauaggaaccuuaguggucuggccaucucuuugguuuaagggaacugaugauuauuuagcuaccacuaaagauacgcauucuuguaugagcuguuucauaccuuggaaacauauauuauauuagaagagacuuuaccaagaucuccagacgaggaaaagucagaauugcagagacagugcaguuguaggcgaugguuucucccgucuguccucuagaagccaagauacauauucugagagucauuacgauauugcugguuuagaaaaugugcuuuguccuaaaagacagcauuccagccccuuagaguagacuccaauugucacuauaacugaagaucaaccauugguagguuauaggauacauaauaagaacaguaaauacuauugcaucaguuuacagccagcuucuuucauagugaagugaguucugugauuaggagcaaugcuaugggagagauaacaugguguaugcaagguauucagugaggauagauacuggcauagacaucaugggcgaguuuuacugccuaaaauucugcacacuuggagauuuuuacuuucuaagaccucuaauacucccuggaguuguaaaaauuuugugcuucagaugguugucauauuacaggcacccuacauauucauuuauguaggccaggcuuuucuuuuaucuuacugaauaaauucuaucuaaugauauuagcauaucacucuuuccauucugaccacagcucuccuuuccauuuuuaucuugacuauacacauacccaaagucuaacugaacugcaccuuuucucaacaugcauagaaaaaucuaauucugccuguaaaggcucacaauauuuuagaucuuuuugcaacuuuucacagcuuaguuacuugugcguaucucucauucuguaauuuguuccauuagcuuuauuuuacaaauaagaaagcugagauucagaguuuuaagagacuuauucaaaaguccacagauauacacuagagacugauuagaauaaaggaagagauaaucaaaaccaaauaauaccucuguagaaaggaacuaacuuuucuuuuuuuucuuuuuauuacuuuauaagauugagagguucgucaucuuucuuuguuaauacuuacuaggaaagauuuugauaauauucauuugugaucauugugauguuuauguuacuuguacuugauauuuauuuuuaauaggaaaaacucaaaagagaggcaaaagaaaacacagcuacucuuaaagaaaaaaaagacaagguaagagcauauaauucucauaguuuuaaaauaccaauucauuuucuaacuucuacuuagaaaugauuuuuuguuuauaaguaggaaaauaacauuuuacauauaucauacaauuucauuuucuaaauuguuucuugcuauuuauuaauucaaaagcauuuuagcuaaaaauuucaaaauuuugucauuuggagauuuggagaagguuucagucuaaugcagaaacaaaaaagaagaaaaaaagaagguuucagucuuucucuacaauucuuauuauaguuuuaauuuaauuagguaccucuguguuucucucuuaagaauuuuuuaauguuagaggcaaaauauuuucauaaacaauucuaaaguuuauuuagauuaugucuaauuuuggguuuugagggggcuuaauaaaugacauccuguuuuccucacuuauauucugaaccaauugagaaagacaagggagaauaaaaauaauauuuuuauuauugaagacuuuauuaaaaaguaucaauauuuuaaauacuggagaaugcaguuuauauuugaaggcaauaggaucucuuaaucuugaaaucccaaauuagacaaauuuaucuucugccacaaguagagcuugacuagcauaggucuacccacuugaucaucugcucuuguaaaacuuaggguauaaaggagaagagcagaauuuauguguaauucuaauaguucucaaggggaguaauaaggaagaggcugagcuguauguguccagcuucuccuuuucuuuaaauucaccaaucacauuaaguaauuuuuucuccccuaaggaaucaggaagagguuuggaauguuacccuagugguacucccuacauauggaaggaaacaucagucauagagaagaagaauaccccucagcuucuaaccuauuugauaauauaggaucauugcagaagaauuuugauuuagcaaauuuuugguuaaaaugauuaagaauuuucuuuacauauagugauauaaucuccuaaguucccacagagguugcucugauuauaguuaaacuggaaggaaaugacacucagaguaguuugagaacaguucauuauauuuuauuacacuugaguuaaaagagaauaaaggaaagaugcacugaaccugugagugaauacugagugcuuuguauguuccagacacugugcuagacacuugaaaacauuauaucugaagaaauuauaaucauaauaaaauuaugcagaaugguuagauauagacuuaaggaaguaucuaaugaauauaagcaaauugguuaaucuccaauauucuuuuuuaaauuuagaaugucuucauauuaugaaaguauguaucacauauucuuauagagauauuuugauucauguacaauucuauauguuuccauuaucaaguagauuagcaaaugccauauauuuuaucugagagucuagauauauauguuggaaaaugaaccauauauauguuggaaaaugagaaaaaugaugaaugaagaaauuuaacuaggcuuuuuuuuuuuuugcugugcuuuauuccaacacuacugaaacauaaggcuuguuaaauuuaccaaacguuucugaguuuggacaaguuacuuaacuucuucguguuucaauuuucucaucuauaaagggauaauaauaauaccuauuuccuaaaguuguuaugaggauuaaaugagaugguauuuguaaaacauuuaaaauagugcuugggacauagcacaugccuuauaaauguuuguuugaaaaauacaacagagaaaauugugaauuuucuggaaagggauaguucaguauugucacaugagaauuuucuuuaggcuaccagcgaaaugucaaauuccagauauggccacaagguggugcagugaccuuaaauugucauucuccuaccuguagggaggaacaauuuguccauuaaagcaguuacauuuuggcgguuccaaaguuuaccccugaugaauccagagagcaguaaaaaaauugcucucaucaaaauuuugucaucaacuaugauguauaaauauguagggaaaaggauacagaaaugcaauucugaaaaaauucauacuugcuagaaaaaggauuaugaaaugacagaucacuagaauuacgcaggaaagauauaagccaucucauuuagccucuugauuuauagaugaauaaauuuaagcuuggagauacuugaagauuuacuuaaauaauccggaaagauaggaaagaucuaggagaaaagaccauaugauguaccuggcuccuaguucaaugauuuuuuuauaguacauguaguugccucuuuauccuauacucuaauuuaaacgcacugaaaguucagccaccaugcuuucaaauuuuguccuuguauucccuuuuugugugugugugcucuagagaauucagagaaaggagagauguucucagaagaacaugguccuguaaaggagggcucuacaaugaaaggcaguaggagaacugaaagaacacgauucuagaaaaaggggaauuugaguuucacagcuaacuagcuguggaauugaguaaauuaacaugccucaauuuccuuacaauuuccuuaugaauaauugccacgauuguauucguggagaugguggugaccaaagaaacuguaaaauagaaagugaugagcaugaguuucauguagaaucccacuaaagcaacuauuacuagcuuuuacuagaaaguuaggucaggugcuaaaagaagcuguauacaaagguagagugaaagagaacugaggaaacugaguugaaaaaaugucaaguauuuagaguaaacuugcaauuuauuuauuuagaauugaagcaaauagccauuuucucaguuuuuuucccugaaaauuuuucucauucuuuacuuucauaauuauucuccuugcuuuuggaggcaaguuaggcugguggauaggaaaaggcugauauuuuuauaggugaaaaagaagaaguaucaauguaugaaagagaacgaaugaaaguuagaauagauuuccuucugacuuuuaggcuauuguaaugaaccauagauuagggcuuuuugccaccaggaguaaagauuuuuuuuuauuuuuuaaagagaauccucaacuuuuggucagagaguugagauaucuuauuuguuuucauuuuuaaaaauuuaacuuuuauuuuaaguucagggguacauguacagauuuauuauauagguaaacuucugucauggggguuuguuguacagauuauuuugucacccagguauuaaaccuauacccguuaguuauuuuuccugauccucuuccuccucccauccugcaugcucccauaggccccaguguguuuuguugucucccucuauguguccauguguucucaugauuuagcucccacuuauaaaugaguccaugugguauuuggcuuucuguuccugcauuaguuugcuaagaauaacgaccuccaggauaucuuauuuguuuucauagaggcucugugaagacaggcaggggcagauaacauuugcaucuuaaauggacaaguaaagugacaaagaagauaacuguaacuuauucaaacuuaucuagucagugauaaauuuagggauaaauuugcuuauuuuguugugaauucuacuaguugcugcacuuuaauuaaagaaauaaauaauuaaugugacauuuagugaugguuuuauucauucuuguuguucaaugcagaaaacacaaacauuuuuauuggaaacaccugaaauuuauuggaaauuggauucuaaagcaguuccuucacaaacuguaucucgaaauuucacaucaguugaucauggcauauccaaagauaaaagagacuaucuguggacaucugccaaaaauacuuuaucuacaccauugccaaagguuugugucuaaauuuuccauguuaguaguaauuuuuuaaauaaauaaauaaaguucuguuaucaccauauaucuggcaucacgcacacauauauaacuaguuucuugaaaguuucaauuuuuuuugugguaucagcaugaaauguaaagacaaggucuugcuguguugccuaggauggucuugaacuccuggccuuaacucauccuccugucuuggccucccaaaguauugggauuauagguguaagccacugugccuggccuucaacaugaaauuguuucauuuuuuucgaucacuguccacaacuuaaugucaucuugggcagauuucauaacuuaauaguuauuuaucaguguuuaaggcccugacacaggaaaucugauucugacuugacauuuuauagcaucaccacaguuacuacuucccuuugcuguuuaccccaaucaucuugcaucuguaguccuuggcagucaucuuggagcagaugccucuagcaaaguggcucaguucugacugucuuucauauagccacuuaauccauggggaauucauacaacuuuuccaugcuaaauggcagugcagaugcuuuacuuuugaucucucuuaccucucucucguuuccuuuuccucuccucagcuagauacaaagacaaacaaauuugcugccuacauucauaucuaacuagggaaugagaugccagucuuucuuucuuggaagcacuccuaauauucuuuauaaagaugcucuuggaguuccugccucacuugucuugggaguugaaaaggaucucaauugucuccaucccacuaaguuuaaauguuacgccuuuuccuucucaguuucccaguuguguuugauggugucugcaaggugucugcaagucucugagacuuuguuuuucuucauuuuuuuucuauuccauaucaguugaauuauauucaggcucauggauucuucuucugcuugcccaaaucugcuauugagcccuucuaguaaauuuuucauuucagcuauuguauuuuuuaauuccagaauuucuauuugguucuuuugauaauuuauuucuuuuuauugauauuccauuuagugagauguuguuuucaugcuuuucuucauuucuuugacauaauuuucuuuagcucuuugaacauauuuaaaauagcugacuuuaaaucuuugucuaguuaaguccaaugucaaggcuuccucagggagaguuucuguuguuuguucuuuuacuuuucuauuugggccauacuuucuucuuucuuugcaugucucauauuuuuuguuuaaacuggccauuuaaaaauauaacaacucuggaaaucagauucucuccuauucccaugauuuguuguugcuacuuguuguaguuauuguuuguuuugugacuuuucuagacuaauucuguaaaguuuguauuuuuuguugugagugccacuaaagguucuccuugauuagcuuaguuuuuagcuaauguuuggacacaaauuucuucaaaugccuagaaugaauaaauuucccaaucuuugucaaaggucucuauuauauguguauaagggcaugcuuucaacacuuagccagguaguugacaacucugccuuagcuuuccauuccugcuuguagagaaucucaagauuagccaguggugaaaacuuagggccuuuucaggaccuuccugagccuauagauagcccuacacauaugcguggccuucuauauuuccaggaauauaucaaggcuuuucaaagcuuccccauggauauuucauuuccuagcuuuucuuucaagguuuuugguuagucuuuuguuugucccaacuauucaucacugcuucacguugcugcaaaguuaaaacguuuguuguuuuugacaaauucugcccccuacuucacacacacaccaaggagaaggcauuuuuucacuagugagcccucagguugaauguaaucagcuaucagccuuguaagugggaucuugcagagacucaccagacaaaucaaauacugacaauucuuugggaauaaagcuuugaaagagcuucaguucuguucuguucuguucugucuggugguugccaggcugccccaggaacgugggcuguuauucuuuaaggauaacauagagcuagagcaggggaugggacuggggaaguuaagacaccacgaaguuuggguuuccuaaagagguuuagccauuuuauuuuauuuuuuuaaagaauaagcacucuccagguggcugcaagccuuugguuaauuuccagaguucugaaaaaaacugauuccgacaaguuuuuaccaauauuuuuauggcuuuuauggaggagugaauuuuuagagcucauuacucugccauuuguacugaugucucugaccuuaacuuuuuaaauuacauuuaauuuaauuuuuguuuuugcucuguugccugggcugggcugcaguggcaugaucauggcccacugcuaccuugaacuccuggcucaagcaauucuccugcuucagccuccugaguagcugaggcuauagggaugggccaccauaccuggcuauguuuuuuuaauuaaaaaaaauuuuagaguuggggucuugcuauguugcucagucuaguuuugaacuggccucaagcaauccuccugccuuggucuuccaaagugcugggauuacaggcauaagccacuguacuuggcuuuugaccuuacuuuuuaaagauacuuuuacaaauuauaaaaauuacaagauaguauagaaugugaaacauugacuaaugugaauuacuuuaccaauauaaaaauaagcaagcauauuuucucacaauguaauaagguguuuuguagagagagcaaagcucacucaguuauuuuuuucgaucaugauuagaaauauuaaggccccuaagauuguugauugcugaaucuggagugugucugucucucuguuucacucuuucucuuucuuauuuucuucagcaaguuaaaggaaaggcagagaaagucuaccauuguaaauuuuugaagaaagacaacuuauaguaucaaaaacauuugaauuaaauucuuauccaaaauuuuugccucauauacuugccaauaauaauggagguuucugauugcuaaggacucaaauugccuuaaaauuauuugugaaacccuuuauuaauaaugcauauuuuauuugauaugauaauguaugguuuuuuauuuuuggauaggcauauacagugaagacaccaacaaaaccaaaacuacagcaaagagaaaacuugaauauacccauugaagaaaguaaaaaaaagagaaaaauggccuuugaauuugauauuaauucagauaguucagaaacuacugaucuuuugguaaaaauuuuacaaauaauauuuaguauuuauuuauauuacuuauuuguauacuauuuuccuugauauacauguauaauauauuuacauaguaccuaccauugcaauacugauauacaguggagcucugcuaaaaugcagauccuugugcuuuugcagcauuucagaaaaauuaggguucaaauaauuucccuguaaauuucagaaaaccuggcacuuugaaaauacuugauauagcacaaugggcauacgauaugauuaaucauugucuuguuuucuagaagaaugucauaaaggaguucuuacuauauuuuuaaaaagagagauggagugaauauuuuacugugccaaaucuguuauuuaggcguccccucuauuuugcauauuauacaugcuccuuuuacaucacugguugauauuuauaucaagguauugguugacaacuauaacauuuccaucacucuaaagaaguuaauguauuaaggacagcauguuuaagcaggcuauuuccucuagcacuuuguaucacuaauuacucccauucacauauaccacuguuuucugaaggcauaauaaugguuuauugagaauaaugaagcuuagauucauuuaauuuuuuuaaaaaggugaaccauaccagaguaaauggagcaaugcaccaaaaauucuuaaugacaaaaucccaguuaaauucauuuguuuuauuauucccacuuauaacuagaagauccuucaagcuuuucuacuacuuugggaccuucuauuuucauuuuuuucuggaauaaugaguaguugaagucuuaaaacccuaaauauugaaguuaacauauagagucccuacuucagaaccccuuuguuuuauagauaauuaucaacaucuuaacaauuaaaacugugaaccagguacuauuguaaacacuuuauacaacgaagauuacuuuaauuauuucuuauaacaauuccagccuuuagaaauacaguuggccuucuguauucacagguucuacaucuguguauucaaccaacuacaggccaaaaaauuugaaaaaaaaaaaaauaaauaacaauucaguagaaaauaauauaaauaagaaagcaauacaacauaacuauuuauauaguguuuacauuguauuggguauuauaaguaaccuagagaugauuaaaguauacaggaggaaguacauagguuacaugcaaauauuauaucauuuuacauaaacauccacagauuuuggcaugcauggagggauccuggauccaaucccccauggauacuaagagaucacaguauauacuguucuuuccaguuuacagaugaggaaacugagucacacaaguauauuuuucaagaucacauaguuaguaagacauggaaccaaaauuugaacacagucuggcuucauagacuauguaagucauugcacaugauaacugccaauucaaaauguaguccagauauauaaaaauguaaugagaauuagaaagaaaaugagcuuuagaauuaaacauucuaggauuguaaucccuguuauuauucuagcaguuugaguuuaggccaauuucuuagcugaucugagauucagaaugauucaacaugauucauuucauuucuaaaaggagcaucacaaacuugcaacacaauaaacauauuacaguauuauagaauugcacacaauuguucaaacuagucuaaaaacacauuucacaaucaguuuccugguuauaauuauuauaugaaccuauuagucauuuuguaauuuucuuagcuuauguaguuaaauuuugaacauucaaauuauaaaaauuaagauuuaaaaauggguuguugagcaugaccucaggaagaugguggaguaggaagugccaggaauccaucucucuaccuagacaaaaaguauacuggcagaaacugucugaaguaacuauuuuauaaguaugcagucuuauuugaauguuuauagcuuccaggggaaagguuagcugguaaauugcaguuaauuuagguugauuucagccuaaaauaugauagcagcuaccagucuccccagccuacaguccugugucaggaagccaugcucauguucccugagugacuugcuggugccagagggggcaauaggacuuguccuucaaacaucagaguucaguguuucaacccccacuggcugaagcaacuuccaggaauuuacaugaagcacaucuaucuuuuuuuuuuuuuccuuuucucuuuuuccaucuuuacccuuugggaagccaggcauuuaaggauuaggauauucaaaagcaaagcaaaaaggaauuuagcuauagcacauguuuaagcaaagaggcuuaaaaaagacgggagaagaccauaagcuuuuaucucaggcugaucccuggcacagacuuucaacaguaaaacaaaagaaaacagaacacaaacaaaaacagaaaaucccggggaagagggaaaaucuuauuuccagaguuaccaaaguauaauauucaaauguccaguuuucaacaacaagggccaggcacaauagcucacgccuguaauuucaccacuuugggaggccaagguaggaagguuucuugaggccaagaguuugagacuaaguugggcaacagugagacccucucuauacaaaaauuuaaaaaauuagccaggugugguggcacauggccuguagucuaacuacucaggaggcugagguagaaggaucacuugagcccaggaguucaaaguuauagucagcuaugauuaugucacuacacuccagccuaggugacagagugagaccuugucucuaaaaauuuuuuuaaaccaaaagaccaauaguaacaaaucauaaggcauacaaauaaauaggaaaauaugauccauucaaaggaacaaaacaaaccaacagaaauuauccuugaggaagcucagacauuggaauuacuagacaaagacuucaaaacagcugucuuaaaguagcucaaauugcuaaaggaagacauggacaaagaaaaaaaaacccuaauuuugugugaauaaaaugagaauauugauagagaguuagaaauuauaaaaagaaccagaaaaaaacucuggaacugaaaguacaauaaccgaaaugagaaacccacuagagggauuuaaaagcagauuugaguaagcagaaaaaagaauuggugaacguaaagauagacaauugaaguuacugagucugauaaacggcaaaaaaaaaaaaaaaagaaaaagaaaagaaaagaaaagugaacagagccucagagucuuguagcacaccaucagcugggccaauauauacauuguaggaauuccagaaggagaagagggagagaggaagagguggggggguagacagagagagaaaaagagagagagagguggaaagaguuauaugaagaaauaaaugcuaaaaacuucccaaauuuugaugaaagacaugaauauacaaauucacgaagcucaacaaacuccaaaaagcccccaucaagacauuuuauaaucaaacuguugggagaaaaaaugaaucuugaaagcagcaagagagaugcaacucauuacaugcaaguuauucucaacaaaauuaucagcugauuuuucaucagaaauguuagaugccagaagacagugaauuuauauauucaaagugcugaaagaccaaaauuaucaacugagaauuuuauauccagcaaaacugucauucaaaaugaagaagaaauugagauauuuccagauaaacaaaagccauaaagagucuguuaccacuaaaccugcucuucaaaaaguacuaaagggacaucuucagauggaaaggcugcuagacagugaagcuguaugaauaaauaaauaucucugguaaacguaaauacaugggcaauuuauaaaagcuaguaguauuguuauucugguuuguaacuucaguuuuuauuuucuauaugauuuuaaagacaaaugcauauaaaugguuaauuuauguuacuaggcgcacaauguauaaagauguaguuugugacaucaauaacagaaaaugggcugggcacaguggcucacaccuguaaacccagcauuuugggaggcugaggcagguggaaguuugagaccagccuggguaacacaaugagauccugucucuacaaaaaauauggaaauuagucaggcauuguggugcacaucuguagacccagguacuuaggaggcugagguguaaggaucauuugagccugggaggucagggaugcagugagccauaaucacaccacugaccuccagccugggugacagaauuagauccugucaaaacaaaacaaaacaaaaaaccaaaaaaaaccccaaaaacaaaacagggaagauggagcuguguaggggcagaguuuuuauaggcuauugaaguucaguugguauaaauuugaauuagauuguuauagcauuaggaaguuaaauguaaucuccaugguaacuacaaugaaauuauauaauauacacaaaaagaaaugagaauggaaucagaauguucaaguacaaaagucaccuaaauggaaaauaagacaguaauggaggagacaaaacccuauaauaauggagacaaaacccuauaagacauauugaaaacaaauagcaaaauucagagcuauguccuuccuuauagaucauuacuuuaaauguaaauagauuauacucuccuaucaaaagauauagauuggcagaauauauuuuaaaaacaugaaaacuauaugcuguuuucaagacacucauuuuagauccaaagccacaaauugauaaaacgugaaagaauggaaaaagauauucugugcauauaguaaccaaaaaauagcugaagugucuauacuacuaucagacacaauagacuuuaaauuaaaaagugcaagaaacacaaaggacauuaauaauaaaaaguuuaauauagcaagaagauaugacaauuuuaaacauguccacgccuaauaacagaccuucuaaauauaugaagcaaaacuucauagaauugaagggagaaacagacaguucuaaaauaauuguuggacacuucaguaacccacuuucaauaaugaauagaacaaccagacagaagauaaggagauagaggacuugaacaacacaauaagcuaauuaggucuaacagacauguauaacauucuacccaacaacaacagcauacauauucuuucaggugcccaugagacauuccccaggauagaucauauguuaggucacaaaucucauagguuuuaaaggauagacauuacacaagauauuuuauuugaccacaaugggaugcaguuagaaaucaauaagauaaggaaaacuggaauauuuacaaauuuguggaaauuaaacaacacacucuuagccaaucagugggucaaagaagaauucacaagggaaauuagaaaauacuuagagauuaaugaaaaggacaacacaauauaccuaaacuuaugggauacagcaaaaacagugcucagagaggaauuuguaguuauaagugccuauuaagaaagaucucaaaucaauaaccuaacuuuauaccuuaguaaagaacuagaaaaaaaagagcaaacuaaacucaaaccuaguagauugagggaaauaauaaagauuagaacagagcuaaguuagagaauagaaaacaagaaagucaaugaaaccaaaaauaguugguucuuugaaaagaucaacaaaauaggcacaccuuuagcuagagagagagaacaaaauuaaaaaugaaaguggggauacuacugaccguucagagauaaaaugaaucauaagacaauacuauaaauaauuguaugccaacaaauuagauaacccagaauaaauggaaauauuccuuauaacucacaaauuccuuagaugaacucaaaaagaaauagaaaaccucuauagaccuguaacaaguaaagaguuuaaauugguaaucaaaaaccucaacaaagaaaaguucuggaccaguuggcuucauugauaaauucuaccaaauauuuaaagaauuaacacuagagcuucuggauaacugaacacagggaauuucccacaggguggcacacccaagaaaggcaugaaagugccaugcaccuucccccauaccuugcccuacgcaucucuuuaucuguaucccuugcauacagauaauauuaguaaucaccucacggcuuuuugagaauaaguuaaauaaugcuuauaaaauguuuagcagaucaucuggcacagggcaaaugaucaauuaauauuaaaauugugauuauuauuauuggaagcuugaauccaaauacacugauagaggaguauaaauugguaaaaacuucucagaauaaaaauuugacauauauguuaagaccuuaaaaauaauuaacaucaauucuucuuaaauucuuccaaaaaguugaagaaggaacaccuccuaacucauuguaugaggccagcauuaauuaccuugauaccaaagcauauaaaggcaccacaagaaaggaaaauuacggaccaauaucucuuaugaauuagauguaaaacuacucaacagaauauuggcgaaucaaauucaauagcauauuaaaaauuauuugccauggccaaguggaauuuaucccaggaaugccagggagguucaacauaagaaaauaaaacaguguaauaaaccacauuaauagagcaaaggaaaaaauagccauaucaucaucgugaugcaaaaaaagguaccuggcaaaauccaacaugcuucaugguagaaaaccucucagaaaauuaggaauagagggaaaucuccucaacaugauaaaggguauuuauggaaaccccuagcuaacaucauacucaauggugaaagacugaaagacuuacccccuaauauuaagaaugaggcagggugcccacuuucacugcugcuauucaacauuguacuguaaauucuaacuagagauacuauaaaagaaaaauaauagaaggcauucagauggaaaggaagagguaaaacugccucucuucacagaugacaugaucuuaugcauagaaaauugcgaagacucuuuaagaaagcuauuagagcuaauaaauaaauucagcaaaguuguaggguacaauaucaacauacaaaaauugauuauguuuuuauauaccagcgaugaacaaucaaaaaaugaaauuaagaaagaaauucuauucacaauagcaucuaaaagaauuuaaauacuuaggaacaaaucuaaccaaggaaguaaaauacuuguacacugaaaauuacaaaacacuggugagagaaauuuugaaagaccuaaauaaauggaaagacauccuauguuuauugauagaaagacuaaauauuguuaagaugucagugguacccaaaucuccagauucaaugcaauuucuauaaaaauuccaacaauuuuuuuugcauaaauggaaaaaauacucaaauuaauguggaauugcaaagggccccaaaaggcuaaaacaaucuugaaaaauaaggauagaguuggaggacucacaguuccuaacuuugaaacuuacuacaaagcuaguaauuaaaacagcauaguacuuguauaaggucagacaggcagaccaauggaauagaauagagagccuagagauaaacccucacauacauagucaguugauuuuugacaagagugccaagaccauucaauggggaaggaacauuuuuuucaacauauggugcugggaaaacuguccacaugucaaaagaauuaaguuggauccuuuauaucauauaaaaaaugacucaaaauggaugaaagaccuaaacuuaagagcuaaaacuauaaaacuauagacgaaaacacugucaaaaucuucaugacacuggauuuggcagcaacuuuuauggaugacaccaaaagcacagguaaugaaagaaaaaaagauaaauuggacugcaucaaaauuaagaacuguugugaauuaaaggagacuaucaagaaagugaaaagacaagguaaauagugagaggaaauauuuaaaaaucauauauaugacaagggauugauaucuaggauauauaaagaacucccacaauuaauaaccacaaaaagucccaauugaaaaguggggagaaaagauucgaauagccauuucuccaaagaugaaacauaaauggccuauaaacacaugaaaagaugaaugcuaugaagagucaugaggacagaugauaagguuuuguuguuuuaaauugaauuaacuuauuaaucauuuuuauauggagacucaugaugaauaaucaauuaccuugcacuaaguaaaauuguaaugauaguuuaaaccacaugauuuuaaagauaauuuaucuuguuuaagcuggucaguugguacacacugauucugaguauaucugcaaagguagcucuaugacuuauuuauugaauucuguugaaaucuuagauuuauaaaaaucuguuugaaauuucucauccacaaagcuucugaaguuuuuguuaaauguggcuuuaaugagcaugaaaaaauugugugaacugacugcuuacaugacuaaauuguguuucauauucauuaagagaagggauucuggagccagauuaccugaauuugaauuuccuuccaccucuuccuagcuauauaaucuaggguacauuacuuaauauuuguaugccugaguuuucucacuugcaaaauggggauaaugguauaccuacuuuauaaaauuguuaugaagauuaaaaggaauuaaaauaugcaaagugauuaaaauagagacugguacuagaaaguacuaaauaaguguuagcuaucauuauuugggagaauuacaauaauuguaaauuaagugacaacauuauauuuauuucuuauuuugguauaauacacauaaaacuuaccaucuuaacucuuuuuaauuauauaguucaauguuauuaaauacauuuauaauguuguguaaccaucaccaccauccagcuccauaacucuucaucacaacuaaaaccuucuacccauuaaacaauaacucuuuauuccacuuucccccaggcccuggcagucaccauucuacuuucugucucuaugauuuucccuacacuaaauaucucauauaaguagaaucauacaggauuuguucuuuugugaccauuuuuuuuuucauuuauguccucaagguuuaucuauguuguagcauauaucagaauuuucuuccuuuuugaggcugaauaauauuccauuguauguauacaccacauuuugcuuauuuauucauccacggauggauacuuggguugcuuccauguuuuaacuauugugaauaaugcugcuauuaacauggguguacaauuaucucuucaagacucugcuuucaauucuacugaguauauauccagaaguggaauugcuggaucauagauaauauuauaaguuuuuuuagaauuauaaauacuuguuauaagcuauaaaugugaguuugaauaaacggggucagggaaggaggacaagauggcauuauaaagacucugaaacugaaauagaaaucaguagagaaaugcuacucgcuauacaugucuuguauuucacauagccuuucaguaauacaguuaauagaauaaaaaucuagguccuuucuuggccaauugauuuauuuuguuacuguuuucuuuguuuggucuucuuucuucucucuauaaucuucuuucucuuuccuccucccuuugcccuucucccuucuacauccuuccucuuucuacucuuuguucuccucacaugugauauguugacaaaauguuaauaauauaauauuaaugaugguaaacccaacaucauauuuuuuuauuuuucuucaagagcaugguuucagaagaagagacauugaaaacacuguauaggaacaauaauccaccagcuucucaucuuugugucaaaacaccaaaaaagguagcuuuuaaauuuuauuucagaaagcaaauuuuaaaagcugcacuuaaaaaauuaaacauguuaugauuuuuaaauuuuauuuuguacucaggccccuucaucucuaacaaccccuggaucuacacugaaguuuggagcuauaagaaaaaugcgggaggaccguugggcuguaauugcuaaaauggauagaaaaaaaaaacuaaaagaagcugaaaaguuauuuguuuaauuucagagaaucaguguaguuaaggagccuaauaacgugaaacuuauaguuaauauuuuguucuuauuugccagagccaaauuuuaucuggaaguugagacuuaaaaaauacuugcaugaaugauuuguguuucuuuauauuuuuagccuaaauguuaacuacauauugucuggaaaccugucauuguauucagauaauuagaugauuauauauuguuguuacuuuuucuuguauucaugaaaacuguuuuuacuaaguuuucaaauuuguaaaguuagccuuugaaugcuaagaaugcauuauugagggucauucuuuauucuuuacuauuaaaauauuuuggaugcaa

SEQ ID NO: 191323 - RNA, 85537 nt, Homo sapiens
ggggcuaggggguggggcugcagccgggacggggccuucggcagggccugcgggggcgggacggagcggacccgagugauacccgggagacuagcuuggccacaggagacaacguugagguacagacagguaagagucggggugauucggcgcgggguuuuaagccgcaggggcuucggacucucggggcugucggcaucacccuucugggcgucgggugcggggcuguggcgccgcggcguaguccucggacggugcgagccgagcuggcggagguggugucuccgcgccccgcugucucggcaccuccuccguccggaggagcaaccgguuguugggcccagcuuugggacguccucucguggccgcacggguuguggcggagccuggcugaagaccuccucgcuaccucaggggcuuggggaccccuaggcugggcgccgcucucugcuggggaagagggagggagcgcccggcagccuggggaaacgcgggcuuucuccaaaauuagccagugagcuugaacuucgacaugcugggacgaugcacuuccaaacaauauuuugcuuuuuuugguguuuugauucuuaacagcaucuaauacgcacaauaccgaaaguugucaaguagaauuuuaauuuaaaagucugacaguggaacaccuaagagcuuuugaguaacuagagcuguauagcagcugaugauuagauuaugagucaaaaggcucaagucuagggccagaacccgcggaaccagaugugauaccucggccaaauuaacuuccugggccucucuuuccguaacugugaaacuggcaaguucaugccuauggguauucucagggucaaaucagaugagugacaguauucuacaaaugucagauauuugaacgugcguguggagcguguauauucugugaagcaacuacuacuugccugguacauaguaggcacuuuacaaacguuuacccuaaagcuagugauucuucugcaguguuuuagauaaagugauagauccuugcuuacuguguaaauaaguuguuuaaacuuuucccacaaagugacccccauuguuugaguguguccuauuuuuaaaugauugaugaaauuuucuagaauagcacagugguguuaucuauacacuguugcugaaucauuuaccgcgaagucuguagcaaucaaauaaucuacuucuuugucuuagcuaaauaguuguaguuuaagauaccugcuaaaguaagcugggaauauuguuccaaaucaagacuuuaauuuguuuuugugaauugacgggcugcuuauaggaagauuuaaaucuuccaaaauauuguuaauauauagccauauuuuuucauacagccuuuauuauagacguuuuuguucuuuacuauggauaugugugcgagggauuuuagcggggagaugggaaauaaaaaagaaaauggcaguuuuguaaccuguaggcuuuugcuggggauacuuguaggccuguucugaguuugccaggcagaaaccaggaaauguaguaauuaugugucuuggucuuucauuaguugggguguguguguguguguguguguguguguguguguugaauguggcaguacguuuuuuaaaugcagcaauaaaggaagaauauuuauuuuucuuaaugacaauaagcaguuuucuaaagcuggaaauuauauuacuuuuaaauggucuguagugagucuuaaguuauaggcaagaauuuuagaccacuggauaccaagaucaaauuaaaugaaguaguagagggaaaguuacuagugaauguaauuuuuguguguguugcuuuagaaguuuuacuuaaacauguuucagcaauucaguggaggaugggucuuuugaagcuacuuuaaaacaugaguuuuaaacguacuccauguauaaauuuuucugugauuuacaauuucuugaucuuggaggucugaaaccuuacauucacauuguuuuuugagggccuacuacacaauaggcacaagauuauauuuauguaagagcaguauguaauuccugucaucuaggagauuccauucuaccaagugggcuaaaauaaguacugaaaaaacaaaagcuguuuuuaaagcggaugguaacaauaacaacaucagcuaucauucauugguaccuagucugugccaggcaguauucuaaauucuuuacauguauuagcuuacuuaauccucacaacagcaccaugagggauguuauuaugauuaucucauuaagaggcauagagagguugaguaacuugcccaugauuagacaaccuagauagcaaaaguaggauucaaaucagucauucuccaaggaccugauuguaaccuuugcgcuauacugaguuucaaauucugugagugagauacaaaugacaucuaauagguauuuuaaaaagaggucuauaaaaaacuauuucaaaaagaaggaaagaaagaggaaaaaauaaacugguauugcaauaccaguuuuauugcaauuaaaacgauguaauuauaguuuaucugugggaacccuuuuuuuguuauuguugccagugaaugacauggggaugauucuaagcucucagucccucaguaacaacaguuauggcauuaucuuaacaauaugaggugcuuauuuuucauuaaaaagcaccucauaacuucuuucauuaagaaguuaaaaauaucuguucucagacuguaaauuaaguauuagauucaagaagagaaaaugcuucccugucuuuaagaagcuuauaacccaacauguaaauaaggcucuacaauuucagcaugauaagagcuguaaagaaguauagauuuagguacguuugaagaguugcaagaaaaagaaagaaguauagauagaauuuaaccacugaugaggaaaaaucauucugcgugugguagggaggacgauuagagagaagauauuaaauuuggcuuugaaggaugaauaggaguuugcugaaauugggucaggaaacaggagauaugaaugaaaaccagggauaagugugcaaguauaugguauguuugaggaauguguuguaguccauuguacugaaggccaggguguguagaaaugggugguuuggcuaaaggagauggugccuggaaauaagaugaaaaaauaaaauugcaaagcuuccuugcugauugcauuaggaucacuaaaauugcuagguaaugugguauuucacuucccuucauuuggaacaaugaaaugaguaauuaguucaguuuggcagaauguuucacuaaaaaauaugguguuaaagguacuuuuaauacuuugaaguacaagauauaagauaacauuacagacuuagguaaguaaaaaguuaagauuuagggccaggcgugguggcucaugccuguaaucccagcacucugggaggccaaggcagguggaucaagaggucaggagaucgggagcauccuggucaacauggcgaaaccccaucucuacuaaaauacaaaaauuauacgggugugguggcgugugccuguaaucccagcuacuugggaggcugaggcaggagaaucauuugaaccagggagucagagguugcggugagcugaggucgugcaccugcacuccagccuggcaacagagugagacugucuuuaaaaaaaaaaguuaugauucagaaaaagagggaaaaaagucuucugaugcuaggucuugaagagccagaguaucgugcuaaggacuuuggacuugauucuaaagacaauggagagccagugaaggauuuuagauauagguguuuaggaaagauaagcugaaaaugguuuggaggcugaauuggaugaagagagacaaaagguagggagauaaguuaggaggcuguugcuauugaaauaguccagauaagggaggauaggggccuggaguaggaaaauaguaauagggauggagaggagaggauagauagugaagguguagaauuugacagggcuuuaaaaucaauuggcucaaaagaggaacagaaaaguaaaugacuuaguuuuuuagcuuggaaaacuguuuggaugaagggucuuguuuuauuuuuuaauauuggaggaagauaauuguuuccauuuugaauucauguugaguuugaauugucuuuggagcauucaaguggagaugucgagagaggaucuagaguccagaagccaggcuaaaauuggugauucagauuucagagguagccaguaaguguuaauugaagccguaagagcagaugaaauugcucaagggaguauguagaauuagaagagaagagggccaagaauaaaugauuugcuuuauguaaguagaaggaauuauuuaucuaugcuaauuuuguccaacaaauuauuauuauaaagcaaugaaauggauuuuaauugaaaguugaacaacuuuuacauccaaaugaguccuguucuuuuaaaauuucauuuggaagucacucauuuauuccagaaguacagaugcuccucaauuuucgauaggguuaugucugaauaaacccaucauaaguugaaaauauuguuagucaacaugugauaaacuuacgaaggguuuauccgaauguaaccccaucauaaguuaaggaggguacugagcacauacugcuuuggcaccaucauaaaguugaaaaauuguuaauuuaaaccaucauuaagucagggacugucuguauugcccaaaguauuauuggagcuucucuuuguaaaaagcuuuauagcaaauucacagcuacacaagaacguagaucuucuggcuuuauuauggaauuguuuuucugucucuuuauuugcauggcacauauaacuuauuuacuuuuuuuuuuuuuuuuucaagagacagggucuugcucugcuacccuggcuggaauacagugaugcaaucauagcucacugcagccuggaccucuugggcucaagggauccuccugcuucagucuccugagaaacuaggacuacaggcaugcaccaccacccccugcuaauuuuuauuuuuuauuuuauuuuucuugagacagagucucucucuguugcccaggcuggagugcaguagugugaucucagcucacugcaaccucugccucccagguccaagugauucuccugucucagccucccaaguagcugggacuacaggcgcacaccaccaugccuggguaauuuuuuguauuuuugguagagaugggguuucaccauauugaucaggcuggucucgaacuccugaccucaggugauccacccgccuuggccucccaaagugcugggauuacaggugugagccaccacacccggccugacccccugcuaauuaaaaaacaauuuuuuuugcccaggcacaguggcucacaccuguaauccuagcacuuugggaggccaaggcggugggucacuucagucaggaguuugagacccaccuggccaacauggugaaaccccaucucuacuaaaaacacagaaauuagcuggaugugguggcgcgugucuguagucccagcuccuugggagacugaggcaggagaaucacuugaacccaggagguggagguugcagugagcugagauugugccauuguacuccagccugagagacaagagcgaaacucuccaucucaaaaaaauuuaaauaaauaaauaaauacauaaauuuuuuucuuuuguagagaugggguuucacuguguugcccauucugaucuuaaacuucugggccuaagcacuccuucugccucagccuauccaaguguuaggauuacaggcaugagccacugugcccagcuuccguucacaaucaaucaaagcuucgaaagcauauuccuaucccaucacuggaucuuuaguucuuggaagucauagacaaagcuuaaaaaacaacaaaagacuguguccccaugccuauaaucagcacguugggaggccaagaugggaagaucacuugagcccaggaguucuagaccagccugagcaacauaaggagaccucgucucuacaaaaaauuuuaaaaaauuagcuggcaugguggcacaugccuguggucccagccgcuugggaggcugaggugggagaauugcuagaacccgggaggcagagauugcaguuagccaagaucgugccauugcacuccagcuugggugacaagacaaaaaaaaaaaaaaaaaagaauagcaguauggucuucuaaggcagggguuagcaaauauucuguaaagggcuagauagcaaauauuaauauuuuguacuuugugugccauacggucucugucauaacuacccaauucugccaaaaagcagccauagacaacgcuucaaugaauaagcauggacuguguuccaauaaaacuuuauuuauggacacugaaauuugaauuucauauaauuuucacaucacaaaauguuauacuuauuugaucuuuccacccaaccauuaaaaaauguaaaaaccacucuuaacucagaggccuugcaaaaacaggcagugggccaaauuuggcccacagguaggccauagucugccaaccuuaacggaucuuugaaauauuugaauucguaagcuugguuuagaaaaaaaaaaucaugguucuucgaaaucauaccuccuguuuuuaaauucuaguacauuucuuaaaauaauuaaaacauuuucauucaucccccauuucucauuuaaauggaaaauacucccuuuacugguuuggaacuuuagauacagagaaauagauuaacuuguacagagucagaauaaaaaaguauguuugaaaaauguuuuuugauauucaguguucuuuacugaaucaauaaaacauugaucuuuucgcuucagugaaaguggggacauugaaaccugggugaaauaaaagauaaauuugaagggguauucugcacugguucccagaggguuggacaggauggaauuuuauucucuuuuucuucugcccugaaugaauaaguuuuauccuaaagaaaagaaaacaugauaaugucuucacuuuauaagcaguauagcaaauuauaagacugaaggauuaaguagaugaugauaagagaaaaaaauuuaaaggacugacuuuuucacaucuaucuauuccagguauuuacccauuuuuuuccuuccucccuuuccuuuucccucuuccuucuuccuuuuccuuuucuuuucuuggucuuucucugucacccaggcuggagugcaguggcacaaucauaguucacugcagccuccaaccccugggcucacacgaucccuccaccucagccucccaguuagcucgcauuacaggugcacgccaccaagacuggcuaauuuuuuaaaaaacuuuuuguagagauggggucucaauacguugucuagguugggcuugaacucccgaccucgggauccucccaucucagccucccaaagcgcuggggguacgaagccauuaugccuggccccuauuuuugaggaauaaauucaagauuuuuuuuuuuuucuuaugaaucuuagacuucugguuaguggcgugaaaacagaguuuuuagcauuuaguucuggcaauauuaauccauuuauauuauuugaagguugugcuguacuuuuuaaaguuaaaugucuaacuuucguaguuuucauagcagugauaaauauuuacaacaaaggauauggagagaaauuauuauuuuuuuuccuucaaguuugaauucauagaaaugacauauuugcggauuuuuuguuuggauguuaaaauucagggacagauuggugggggagagagagaguuauuuuugcugcuacuuaaaagggauuugcauuuuucucugucuuuuuuucuguuggaguaaaaaacaaaaucucccagcugugugggauguguuugaauugguuacuuagcaguguaaagcauaauuuuguauuuaaauauuuaucuguacucuuugauauucugauuaaauaaggaucuauuaaggcuauaauaauagagccuucugugaggaaaugacauaggcugcuccacaacaguauuuacugaaaauuuccuuuucccugggcccuauuuaaacuauaagggguaauuggaacaaaaggggaaaauuaugugaauuagagugauggucaauuuaaucaugaguguaaugugauagcuaucaauguauaguuuuauugacauaaaucaggguugagcaaagagugggagaauuuugucugcuguuguuaaaaauggugagucguugaaccaaauuuuauuuuugaacuuugcauucgucaagugugauauuuucaagagucuggugauaauuguauuuuuaaaucaaauuggaucaauuugccuuucaaauuuguuguuucauuauuagaagaaaaaaacgaaguaaaaaauacagagguaugugcaaugacuggaucuggaagaacaaaaauauugagggaaauggucaccugagaaaaacuauuaagacuuucaaugaagauuauuuaaaauauggcuuugucaaaugggcaaaaucugaguaaaaugacagacccaugucuucauauaauguugcaaaugaaaauuaaaaaccuuuaaaguuaaaaagauucuuggaaacauagcauacuggacuuuuaaauaagcccuuucaaauauuuucaaagaaagaaaaagagauaaaguuaucucaguuuccuauuuauucaagaaucauuccugagaaagauuauugucucauuuaguuguguaucaguggcauaagggaaaaauggcuacauaucucuugaaaaaaguauucaucuauaauucauggaaguugugcucaugauuuuugaugcuaaaucagcuggaaauuaaaaauuauacuucuuagugaugacauagcucuauucuuuaccauuauuggacauuucagcagugcuugcaagauggguagagucuggugcagauuuugcaauccaaaucgauggggucgcugauauuguaaguuguacugugcuuuuagguagugaagauaauaaggaggauuuucuuuucuuuuuuuuuuuuuuuuuuuugagacggagucucgcucugucgcccaggugcacaguggcacaauaccggcucacugcaaccuccgccucccggguucaagcgauucuccugccucaaccuccugaguaacugggauuacaggugcgagccaccaugcccggcugauuuuuguauuuuuaguagagacaggguuucaccauguuggucaggcuggucucaaacuccugaccuugugaucugccugccucggccucccaaagugcagggauuacaggcaugagacaccacgcccggcaggauuuucuuguuguuuaaauuuaaccacagcuguauggguauauuuacagaauuuuaaaaaauaaauuguugauccucagaaauuaaacugggaaaaaacuauuaaauaauuaugagcaauugaauagcaaaugugguuagaaaauauaaagcaguuauuuuaagcauuguuugaagcugcuacuaacaguguucccucccccuguccagccucccgugcaagucucacaguguguuuuaaugaguaucuccucaaagcaccuuccaacacucaaggggagggagggaauuagagacaggcaaacuuacagccaguagucaaaacaauacagcugaaaguauagacauccuccugcuuucuucugaauguccagggcagcaggaaagcuuggagcuuucccuccagcaaaaacaauaggcugggugugggugaacauacuguccagcaagucacugcugggcuccguuucuguccuguuuguucuaagggcuaagaaugguguuugaaacugcuguuuuauauauugcaaagcuuugguaugcacagaaaacuuucugaaucucaugaauauauugaaaguuguuaauuauauuaaaggaagcuugcugaguaaccaacauuuuaaaauauucagaguuaacuguaccuauuuacuauaucacauuggaguuugauaguugagauaaggagcuaagcagauuuuaugaauccagaauuuuucuagcugagaggcaaucucagucaggcaugguggcucaugccuuuaaucccagcacuuggaaggcugaggcuggaguaucacuugagcccaugaguuugagaccagccuaggcaacauggcgaaacccagucuuuacuaaaaauaaaaaaauuagccaggcguggugauguguuccuguggucuuagcuauccgggagauugagguagaaggaucgcguaagcccaaagagugaggcuacagugaguugcaauuaugccagugcacugcauccugggcaagaggauaagaccuugggaaggaaggaagggagggagggagggagggaaggaaggaaggaagacggagggagggaaggaagaaaggaaaggaaaaaggaaaggaaaggaaaggaaucucuugggcagauauuuuucaauauuuuagaauaacaaaauuugcaaaguugcugcuuuuggcagucuagugaacuaccuuugaagcuauaugcugaaggguuccaaaagacauuguuaugacaaaugacacuugguacuauugucuauaucuggcuacuguaucuuucaagcaucacuacugcacuuuuuuuguuuuguuuuguuuuguuugagacagagucuagcucuguagcucaggcuggagugcaguggugggaucuccgcucacugcaaccucugccuccuggguucaagugauucuccugccucagcuuccaaaguagcugggacuacaggugccggccaccaugccuggcuaauuuuuuguauuuuuaguagagacaggguuucgccguguugaccaggcuggucucgaacuccugaccgcaagugauccacccgccucuaccucccaaagugcugggguuauaggcgugagucaccgcgccuggccacuacugcaucuugaacauggcauuaucagugaagaaaguuugaacaaaauaaaauauagagagauuguuaguucuuauuacuauuaccagacuuucaguuguuauuuuccugaagagaaaccugaaacauuaaagaaaaauauuuggccaagagauucauuugugcccuaucacaucaauacacuugaucuuagccagaagacugagaagcgaugcaucacaucaauaacugaguuuaaugugcacuccaaaaagagaaugaauucuugcagcuuaguucuucuuuuaguuugaagaaugauuaagugacauugcuuaucaucauuuaaaaaauuuuaaaaacagagacagggucucacuauguugcucaggcuggucuugaacuucugggcucaagcaauccuccucugccuaaguuaucauuuuguauuaagacuaaagaacuguugcaaaguaguacugccauucuuuugacccucuugugagucguagcaccuuucuuccaucagacuuucuccucccucuuccauguauuuauuauaucuuucauuauuuuuugcugcaguuuuaaaaaauaucgauuuuccccaacuuuaaaauguuucauuugaaguugcaucuucuuuuuguuuuuauuaucccucuuacugaguuucaaauaaauguugucuucauacuuuguccauuuccucacuaauuuucuuuuuaauuuuugcuguuaucugccuucaccauccuuuagaaaccauuuauuuaaugcccucuuaccaaaugcaaggaucguuucucaguuuuuauucuccuuacuuguaugacacugguuugcaucuuucuuuucuuuuuagaauuuuuuccucucaugauguuauccugguuuuguuaccucucaccagucuuucucccacucuuuaucugaugcuuuuucuucuuaucuauggucccuaaucaugaugaauauucucaaagguuuuuuucauaacucugaaaacucucugcuuagggaaccuguguauucuugcaccuuuucuccucacacuuccuauuuuaaaccuucuuccuucuccuuaaaccuuuggcuuuucugucucucacuuuacucucagcagauaacuguggcuguuaaaauagaaaauagaagccaucagauggaaaguucaucaguguauagccccuaaaccuggaaauuuaccugcacucuuaucuuucuuuuaucauuuaccuucaguuccaguggaagaccugucccucuuccuggcagaugcugauaaucuuuccggucccauuggaggcccaugcucucucuccuucuuuaggucuuugcuuuauacccuuguuucuuuucuucucuccucuuuagcgacuccuucccacugguguuugaacaagauuaaacuuguauaagaaacaaguuuagaaagauuuccuggacuucacguuccuguccagcuccacucuauugucuauucgucuauuuggauaaacuccuugaauggauugucuacaguugauauuugcauucuuuuuucucauccaauucucaauucacuuauuuuccuucagccuccaugccacugaaccugcucuuguccaaguccuaaugaccaacagacacugcaguuuuuaucuuacuugaccuuuugacaauguaucugucaauuguugaccacucuuuccuucuugauagagucucuuccuuuggcuuccaugauuccacacauugauaguacuucuaccaucuuuugucuacuuucgugacuuaaacugccaucugugauacaugaggacuuaccuaaaaugucugagaacugacuuacgcuugauuaccaauguuuuggaguuuauaaagcucaauucuaacagaacaugaugauguauaaaaauaaucuuaaaaaauaaaauaugaugguacaguaauaaaguaaaaauaaauaugguacgauaagaaacaaacaaacaaacaaaagaaaaaaaugaguuugaaaaguugacauggaaaccacagugagaugcuacuacauaccagaauggcuaaaauuaaaaagacuaacaauuccaguaugacugaggagugacugcaaccucauauauugcuggugagaguguaaauuaguacagccucuuuggaaaacucuggcaguguccacuuaaguuaaacauaugccuacuuggccaggugcgguggcucaggccuguaaucccagcacuuugggaggccaaggugggcagaucaccugaggucaggaguucgagaccagccuggccaacauggggaaaccccaucccuacuaaaauacaaaaguuagccaggugugguggcaugcaccuguagucccagcuacucaggaggcugaggcaggagaauugcuugaacccaggagguggagguugcagugagccaagacugcaccacugcguuccagccccagaacauaugccuauucuauaacccagcaauucuacuccuagauaauacccaaaagaagugugauugugucuaucaaagauacauauaagaauguuuaggccgggugcggcggcucaugccuguaaucccagcacuuugggaggccgaggcaggcagaucacaaggucaggagaucgagaccauccuggccaacacggugaaacuacgucucuacuaaaaauacaaaaaaugagcugggcgugguggugcaugccuguagucccagcuacuugagaggcugaggcaggagaaucgcuugaucccaggaggcagagguuacagugagccgagaucgcaccacugcacuccagccuggcaacugagcaagacucugucucaaaaaaaaaaaaaagaaagaaagaaaaagaauguuuauaacaggcugaacauaguggcucucuucuguaaucccagcacuuugggagccugaagcaggaggaucgcuugaggccaggaguuuaagaccagcuuggacaacauaguaagaccccauuucuacaaaaaaaguuuuuaaacaauuagccaggcaugguggcacacaccuguggucccagauacuugggaagcugaggugggaggaucacuuuaagcccaggugguugaguuggcagugagccgugauuguaccauugcacuccagccuggaugacagagcaagacccccaucuccgaaaaaaaagaaaaaaauuguuuagaacagcuuucuucguaauaaccaaaaccuggaaacaguccacauaucagucaacaggagaauggauaaauaaauacuggcauuaccauuaaaugaaauaguauacagaaacgaagaaaaaccgacugcuauaugcaacaauaugacugacauacauauuauauauauauauauauuuauacauauauauauaaaaguucuuugagcuguacauguaagauuaguggacuuuaugugcuuuauguauguuacauuuuaaaacauuuacaggcuuugggcugggcacaguggcucaugccuauaaucccagcacuuugggaggccgagguggguggaucaccugaggucaggaguucaagaccagccuagccaacauggcaaaaccccgucuuuccugaaaauacaaagauuagcugggcaugguggugggcgccuguaaucccagcuacucgggaggcugaggcagaagaaucacuugaacccgggagauggaaguugcagugagccgagaucacaccacugcacuccagccugggcaacagagcgagacuccaucucaaacaacaacaaaaaaauuuuuuauagguuuuugaaaacacuuggugcaucauaggugcuucauaaauaauuuguugcugauguuccauuugccaggaaugcgcucuuaguuuuguucauuuuguagaugacuucucaucuaucaauaaucucauuuaguaauaaacugccuuuaaucauauauaaauguccugugagugugcuuauauuuuauuuugaugcauauaauuuucuaaugggacacagaguguguagugaaagguauauagacagcuuucaaauuaugcucugccauuuaaccauuugauucuguaccucuguuuucugugugcaaaugaggauaauaauaccugcuuguggcagagauuuuuugccuaaucuaauauccauucuucuaaguaauagaacucaguaguuuaccugaggcacauugcaggauaaaaugauuaaagauuauauuucccagccuggcuugcaguuuguacaugugacuuaaguccuggucaauaagccauagcaaaaguguuauaugggacuuccaggaaggcugcuuaaauagagcguuuuuccuuuuugcuuccuggaauguggauguaauagcuggagcuccgugugugaacuaugaagugaucuugaagacagaauccauauguugaggguggcauagcagaaauauaggcaccuggggaccugaugacaucuuagacugccuacuuugucuuuuuuuuuuuuuuuuuuagguggcagagaaacaaacaucgguauugcuuaaaccacuugcuauuuccaguuccggcuguauguaccaaaacuuaaucuuauauaguaccccaaagaggugcuaugaaaauuaauugugauagugugauugaagugauuggcacauaguauuuaacaaaauauuuaaugaaguguaaucacuguucuugcuguuuuaauucucacaauacucuguaugaaguggguguucaauaaguauuugaugaaucuuuaaaaaguaaguuaucuccuuuugaaacaaaugcuauaaaagugauuuaugcuuauuuuuauuuauuuauuuuuuugagacggcugucucccaggcugucgcccaggcuggagugcaguggcgugaucuuggcucacugcaagcucugccucccggguucaugccauuccccugccucagccuccugaguagcugggacuacaggugcccaccaccacgcccggcuaauuauuuguauuuuuaguagagacaggguuucaccauguuagccaggauggucuugaucuccugacuucgugauccacccaccucagccucccaaagggcugagauuacaggcaugagccaccgugucuggccuguuuauuuuuuauaauuagaaaauacagauaaaccaaaagaaaauucaaccauaguuacaucacccagagauaaucauuguuagcuuuuuggugcguauccauauuaacuauaaauucuauuuauucuuacagauuaaaguuaauuuauauuacacaaccuuuuauaacauucauuuacuuaauagaucuugaucauguuacaacuucaucguauuucagaguauggcuuuaccaugguacauuuaaucaucaccuauuggaaauuuauucucaguuauauaauauucuaaaucuccucuuguacauauaucuuugucaauuugucuacuuaauucauuaggauaaauuauuggaagugauaucucugcaucaucauauguguucauuuuuaaaaaacauuuacuaggguuuuacuuaauauagaaaaauacaacaaauaccacuuaaaagguccauuauuccaccauucagauccuguuauaacauuuaaaaacaacaaaaaacacaaaacguuuaaucauuauaaaaaguuauaaaauaaaaaguaaauaacuuguuucccuaccccaaguucucucacugguaccauuguugacaauuucuugcauaaccaccguaauuuaauaaauggggaccaaaaaauucaaucuuauaaaaaucuugagucuuguuauaaggauaaugaaaaaacauuuuaaaaauaugguuugauauuaauaguauaaaaaguacuaauaggaggcugggcgcaguggcucacaccuguaaucccagcacuuggggaggcugaggcaggcggauugcuugaguuaaggaguucaagaccagccuggguaacaugaugaaacccgaucucuacuaaaaacauaccagaauuagccgugugguggugcacaccuguaaucccaguaacucggguggcugaggcaagagaaucgauugaacccaggaggcagaggcugcagugagccaagauugcaccacugcacuccagccuggucgacaaagugagacucugucucaaaaaaaaaaguaccaaugugaaguuaaaaaaaacuuuauugguacaacugaucauauacagucagcuuucuguauccauggauuuugcaccuguggauacaaccaaucacggaucgaaaagauucagaaaaaacuggaugguugcaucuguacugaacacguauggacuuuuuuuugcuugucacuguucccuaagcaauacaguauaauaguaauuuacauagcauuuacguugcauuagguauuauaaguaaucucgagauuauuuaaagcaugugggagauagagccaggcauggggccuguagucccagcuacuugggaggcugaggugggacaaucacuugagcccgggaguucaaggcuguagugcaccaugauugugucugugaauagccacuacacuucagguugggcaaugaggagacucugccucuuuaaaaaaaaaaaaaaaaaaaaaaaaaaguaaauguaaggcuauaaguuguaaguagguuuuaugaugcaaauucgacaccauuuuauauaagagacuucagccuuuauggguuuugguauccgaaggagguccuggaaccaauccccacacauaccaagggauuacuauacugaauugaaaaaguucaaauggucagaaaaugauugcuuccuaacuacccaucuccuacaauuugaggaagagaacuauagccugcccaccccccauuugagaaaagggggcuggacagagaauaagagucaauuguguaacuuucaaauucacauuauugcagugcaugugugaggggagggcuuguauauagauguauguauagcagguauauagauauauguauauccuuuuuaaaaaguguauugaaaauuguuuuuccacuugcuuuuccccacuuuuauuuuggacaucuuugcauaucugcauacagaucucuaccucauccuuuuuaauaguugcauagcauucagucagggugcuguguuugauuggguaguuugugcauuacacacaggcauccagccaaggagcugaaaucaagcccaagguccacuugccaauacucugugccagucggcucccuccuaggaugcuuuccucaccuuguccugacucuuacaaccccgcaccaggccaucuaucagccuggauacccuccucauucugcugaagcucuaacaucccaugcugggcuaccccucugugggacugcacuccuuaccuuguuuaggcucugauacuuccacaguaggcagcccuccuacacagaugcucuccuuaccuugcuccuuagcaugaggcaagugugccugccuuacuuacucugcuuugccuaauuagggccaaauuguucaggaagaagaguuggaaauaacuuuuccuuuuucuuucuuuuuugagucaaaaucucacucugucacccaggcuagagugcaguggcgugaucucagcucugcaggauccgccucccaacuucaagucauucuccugccucagccucccaaguagcugggauuauaggcacaugccaccaugcccagcuaauuuuuguauuuuuaguagagaugggguuucaccauguuggccaggcuggucucgaacuccugaccucaggugaucugcccaccucagccucccaaagugcugggauuacaggcacuuuuuacuuuuauuuuuuauuuuuagggacagucuugcuccauugcccaggcuggagugcaguggugcaaucauggcucacuguagccuccagcuccugggcucaagugauccaccugccuuagccuccugaguaucugggacuacaggcacauguuucauacuuggcguguguguguguguguguguguguguguguauguguagggaaggucucacuguguugcccaggcuggucucaaacucuuagccucaagugauccuccugccuuggccucccaaagugcuggguuuacagguguaagccaccaugccuagcccuuacuauguuuuguuguugguuuuguuuuguuuuguuuugagauggagucucgagucucacugugucgcccaggcuggagugcagcagcacgaucucggcucacugcaaccuccaccuccugaguucaagugauucuccugccucagccucccaaguagcugggacuacaggcgcuugccaccacacccagcuaaugcccuuacuguguuuuaaauggcacugugaaggauacgagauguauuuaauguccauguuacugcaguuuuacuuuuguugcucuuuuauugucaaaugagauaaaauaugcaaaggauauauaauuuuguaaugucauuugaaaauuugagaaauacaucuucuggauuuuaagcuuuagaaugaaauagaaaguuacauuguacaauuguuaugaauguguguuucuuaagaaagccuguuaugucuguagucugaaauucuuuuuuuuuuuuuuuuuuuuuugagacggagucucgcucugucgcccaggcuggagugcaguggcgcaaucucagcucacugcaagcuccaccuccuggguuugcgccauucuccugccucagccuccugaguagcugggacuacaggcgcccgccacuaugccuggcuaaauuuuuuuuuuuuuuuguauuuuuaguagagacagcauuucacugcauuagccaggauggucucgaucuccugaccucgugauccauccgccucggccucccaaagugcugggauuacaggcgugagccaccgcacccagccauagucugaaauucuugaaaauugcugaaauucuugaaaauugcaucuuuuuuuuuuuuaagacagaauuucgcucuuauugcccagguuggcgugcaauggcaugaucucagcccacugcaaccuccgccuccuggguucaagcgauucuccugccucagccuccugaguaacugggauuacaggcgugcaacaccacgccuggcuaauuuuuuauauuuuuaguagaaacaggguuucaccacguuagccaggcuggucuugaacuccucaccucaggugauccacccaccucggccucccaaagugcugggauuacaggcaugagccaccgagucuggccaaaauugcaucauuuuauauaacucugaaugaaaaaaagcaggauacaauuauguauacacuguaauugcaucuguauaaaaaugugcuuaaaaaacagaagauacaccaaaaugucccagugaccauguuggagguaguagacuuacggguauuuuucuccuguuuccucuauuuucaaaauuucugaaaaguaguaguauuacuuugugacuuuuaaaacuuuuuuuuauugcuucuuuuuagcuuuuggaaaauuucuucaaccuuugaauacuuuaguaaugauuuugcugccuuuauuuuucagugucuugcuaagaauuuaccaagucugaauuugugguuuaaaaacuagguuuuauuguccaggcguauuggcucaaaauuuauaauaccaacacuuuggaaagcugaggcaggaggauugagcccaagaguucaagaccagcccuggcaacacagcgagacccugucucuauuuaaaaaaaaauuaaaaauuagccagauguggugggaugcucuguauucccagcuacuugggaggcagaggcaggagaauugcuugagcccagggagucaaggcugcaguaaacuaugaucacaccgugccucugggcaacagagugagaccgaucucaaaaacaaaacaaaacaaaaacacuaggaaaacacuagguuacauuaaaguuguuuugaagcaauuuguguagcugaaaaguucuaguuugggacaguuauuuuuuacuuugaaggggauuuuuaaaaggauaauuaagugaaaagugccgggugcaauggcucacaccuguaaucccagcauuuugggaggccaaggcgggcugauuacuugaggucaggaguuugagaucagccuggucaacaugcugaaacccugucucuacuaaaaauacaaaaauuagucaggcaugguggcaggcgccuguaaucccagcuacucgggaggcugaggcaggagaaucauuugaaccugggagguggauguugcagugagccaagaucacgucacugcacucuagccugggcgacaagagugagacucugucucaaaaaaaaaaaaggauaauuaugugaaaagagacauuuuauuuaauuauauggacaguuaauaacauugcauuaauauaauuaaauucuaaaagcuuaauguuauuaaaguuaguuuuacgugccauuuuccacacuguggcauuuuguagaacuucugcugaaauuucucauuugacuguugugccugaguggucuuuaaaauuuagcuacaugucagcucuuuuuauccaccaggugggagucagauaccagucccugugucucuguacuucccuaagucuggggauaugccucaagcacuuugagugguugucuugagguuucagucccugucuugagguaggcaagagguauaucccucuuucccuguaggaggcagggaaacacaccaccuaguuuccuuaaagaaguccucucuguugucccuuguaauccucacaauuuaauaaauuguaauucuucucuuauacagccuuaaggguagugaacuaaugucagcagagccaauuuuuggcaaccucacuuucuaagccuugcacuuuucuuagaauauggggguauucgacuccuauuguuuugguuuuggccuuugaggcccugcugaaacucggagaacacaggaaaaguugcauuugacauccuguugcauuaguuuauauuauuguuaugucuaccaacuaacaaguaguauaauauacagugguuuagugcacaaacuuuggaguaaaguagaacuagguuuguguuaguuuggguaauuaaccaguucagcuucagcuuccccauucacaaaauaauaaaacuuucuacuauugcagguaauaguaacuaucuguuaggguuguuguaagaauuaaaugaaggccaggcgcggugacucacgccuguaaucccagcacuuugggaggccaaggcggguggaucaccugaggucaggaguuugagaccagccuggccaacauggugaaaccaugccucuacuaaaaauacaaaaauuagcugcgcaugguggagggcaccuguaaucucagcuacucgggaggcugaggcaggagaauugcuggaaccugggaagcagaguuugcagugagccaagauggcgccauugcauucuagcccuggugacaacagugagacugucucaaaaaaaaaaagaguuaaaaguaguaaugaaaguagauacauagcauggugccuggcaaauguaaacacuuaauaaguaauaauuauuuaaaauauaugcuauacaggucaggcguaguggcucacaucuguaaucucagcacuuugggaggcugaggcaggcgaaucacuugagguuaggggucacagaccagccuggccaacauggcaaaaccccgucucuacuaaaaauacaaaaauuagccagacuuggcagugcauuccuuucacaaacauuaccuaaugguauaaagaagugauuuagaagccaacuaaauggcuugagaaaccaggagaauauuagagacuauugucaccagguuguacaauaguggauuauugaacccgagaggcagagguugcagggagucgagaucacgcacccagccucggugacagagcaagacucugucuaaaaaaaaaaaaaaucacauuguacuccauaaacauacacaauuggaauugaucaguuaaaaauaaaaauuaaaaaagaaauaauucuuccuucuucugaguaaacaaaggaaaggguuguuuacauuauauauucauacaacuuuuggccaccugguuauuuuagcagaccccugaauauucucucucucucucucucucuuuuuuuuuuuaagauagaaucucacucuuuugcccaggcuggaguucaguggugcaaucuuggcccacugcaaccugugugccuccaggguugaagcaguucuccugcgucagcccccugaguagcugggauuacaggcaugcaccaccacguccagcuuauuuuuguauuuuuaguagagacaggguuucgccauguuggccaggcuggucucaaacucccgaccucaggugauccucccaccucagccucccaaagugcugggauuacaggcaugagcuaccgugccugcccuaaauauucucuguuuaccuaggugaaauggugaacauuaaagcuaaugcauguguaagucagaauaccuuauuauggacucaugaucuaccagagguacacaagaugguacauuaggaugugaaaaaagcauuagaaaugcuacuuguauucauuuucaucuaaaaauaaauuaagcuuuucuaaauauuuaauauacaguuugacacuggugcuuucucuggaucagacuuuauauaaggaaugauccccaagggaagaguagacauucccucaaacaaaacggaguuggcggugacauccucacuuguuugugcacuuuuagcuguugcaacauagagcaguucauauguguccaaguagguggauuuacagauuauaucuuaaauaauagaaucauuauaauccuuugaaaaugagaagugucacagucaugaaaauauaucgcacacuaguuuuuugauuacguuauggaaaaguauuuuuuaaaguugcaaaacuuaaaaugucacaccauuuuccuuuuccaaagaaaaguguucuaaaauuguugauuuucuguaaugacaagugguugucagcaaaaaauuaucuuaaacauguucagugugucccuacgagguaaacaugauguuuuaacaaugaauaacaggccgggcgcaguggcucacaccuguaaucccagcacuuugggaggcugaggcaggcggaucacaaggucaggagaucgagaccauccuggcuaacauggugaaaccccgucucuacuaaaaauacaaaaaaauuagccgggugugguggcgggcgccuguagucccagcuauucaggaggcugaggcaggagaauggcgugaacccgggaggcagagcuugcagugagccaaaacggcgccacugcacuccagccugggcgacagagcgagacucugucucaaaaaaaaaaaagaaugagaaauuguuuuucuaaagaaacaugauuugcagacaaaauuugauauuucauaauauaucaauuauuacuuaauguugcccaaaacaaagaauguguuaucuguaaagcucuccuaucuacacacuuagauuuugaaucaguuuguuaaaaauuuuuaaauguucaguuaguuugaaaguacagaugauaaacauuagagaagaugaaaauuuacuagucaaauuucaacaaaaauccuugcuuaauuuaaggugaauagaauugacaaauaaguauucugauucagucagugaagcucuucuuucauuguuuuccauguauuuguggugaguuaucuuuuucuauuacuguggccuuuuguauuaguuugcuaggucuaccauaaccaaauaccgcagauugagugguucaaacgccagagauugauauucucacaagucuggaggcuguagaaaucuaacaucaaggugccaacaggguaaguuucuugugaggccuguuuccuuggcucguagauagcagucuucucccugugucuucacauggucuccccucugucugucugugucuagguuuccucuuuuuuucgaaguacaccagucauuggauuaaggcccacccuacugaccucauuuuaacuuaauuaccucucaagagaccugaucuccaaauccagucauauucugaggugcuggggguuaggacuucaacauaugaauuuucaggggacacgguucgaucuauaacacccuuagaaccaaguauugaaauaaacugaguuuuggacuaaaucuuugaaucacuguaucaaaaaaaaccacguuuaaucacauugcucuuacucaaaauauuuguaguuaaacuucagugagaaugaaaugguuacuauacccuccuuuuacauauuuaauuuuuacuaauuuaaacuaguaaaaugauuuuuuaaaucucaugccuuuaaauuuuuaguuucaguaugcuuuauaauguucaugauauuauuauaguuuuauguuuacaauuuauaaauaaauacauauaaaucaauuauuuucuucauuggagaccccugacuuagauauugccccuucucaaaaugucuuucuauccugaagguaguauguuaugugcuauuaaauuaugcuuuucaaauuguaacaacguauaugaccuuagaaagccaucgaaacuugcuaaaccucaguuuccucaucuagaaaaugaagauaucuuccucuaaggauuguuaugaggauagaaugagauuaugcauguagugcuuggcaaauaguaaauauacaaaaaacauucuuauuguggugugaauuauuuaaauaaguuauuuugguguuacucguauucuuaaacuauucuaagaagcuuccccauucuacaaauggggcagcuucaaaucauuggaggcacuuaaaguaauaggcacugcagauuuuucguaagccuuuuccuuuuaagcauucuuauauuuaggauuuugucauucauucaacaaauacuuacugagggauuacuguauggugcauacucuucugggugcuggggauacaguaguaaaaaagcuuauauuccagugagggagagaaguaaacaaauaaauaacacaauuucagauaaaugauaaguucuauggagaaaauauagcagagugaagacauagaaaaucauguuggaaaaggagcuuuauuuuagauagaaugaacacagaaggugaaaauugacuagaaauagaaaaugagagaggaagaagugaugguggccugguuugguguguuagcaguaaagaugauaaguggugggaauuugauuuguuuuaaagguggaguuaacaggaauuaccauuggauuaguuauggggauaacaccuagggucauguagcuguggcaaauaaacccuccaguaguacccguuacaaucaguaaacagcaaagaaaaggaauuguagucauuuggaagguuuuaugaauagugcggauaaccaaccauguaacacaaucaugaaauuagcauuauucuaagucuuuggcuuaugccucaaaauucugaauauaaucugcauaugucagcuaucauuuuucauucuuucauuuuaaaaaaccugaaaaaauuuccaugacaaauaucucaacagacuugauggaacuguuaaagaauuaaauuuauuuuuuaaagauucuuacauauuucuugauuuacuaauaggcacaguaauggcuugagaaauuuauauuauguguuauaagcaauauuaggaguuuauuuaaaguuucuuuguuauuuugggaaccauuuuuaguuacuuauaaggcuguuuccucugauaggagugagauaaaaggcugguauccuguaugugcuugcuuugaagauuuguuauucaaggaacagucaacaagaugauagagguuugaaaaguagaagccuguuugacacuuuuuuucccuauuagucugguccuuuauuauuuguuuuaaaauauuuuuagccacauuuaaugaagaaucuuaugcaagauauauuccugugggcuuuauuaaaaauguauugaggcuuucgauuaaauaauguguuaauguaauagaaauuugaaaaaccaaauaaugcgaacagugcaaguucccacccaacuuccugagcagaauuuauguuguucauuuuuuucccugacacaagccuuagcauccucugcuguaacaaguucaggagugacauucugagauugagguuuacuuuaagucuucuaagacagcauugcagaagcauuuacuugucacuauucauacuaccuccccuucagucuuaucccugacuuuccucuuuuucuaagugucuccagcaagaaugaguguuaagagucuugaggucauggcaaagacauacacagguauuugcuauaaggcaaauucagaauuguaaaaguauaacaauaugcaaauagguguaauagaagcacacaaaaggagugauuaacucuggggaaagggcuaaggaagcuuucacggaaaaacuuucaacugaucuugaaaguacaugguguauucagagagaaauuuauaguaccugucauuuauugagcaguuacuguauuccagucacugucuuaaacauuuuauuuacuuuaucugauauuuaauccucacaaccuuauaaaauaaauaucuguaucuguugugccaaaggaugcuaagacauguauuuguuacuuaaccucuuggugccucauugccuuaucuguaaaaugagauuaacaguaguaucuaccucaugggguuguuacaagaauuaggugaguuaauaugguuaaaguuaguagagcuaugccuggcucauauuaagugcucaguaaguauuaucuguaaacauugugaucauucuacagauaagaaaacaagcuuagaaggguuaauuggacuaaugauuuacaaccaagaaccaaaucuauguuaguguuugaauucuaacucgaacauucuaacuuuggacugcuaauaguuccagauuauuuggcauuauuggaaaauauguagcuggugaguaaggcaaguggcaagagucagagcuugaauuagagggugaaagaccuuauaugucauauuaaggaguauagacuuuaucuuaucucuugcacaccaugaaauauuuaccugcuuaauuuuauuagcugggcgcgguggcucacaccuguaauccuagcacuuugggaggccgaggcggacggaucacuugagaccaggaguuugagaccagccggcccaacagggugaaacccgucucuaccaaaaauacaaaaauuagcugggcgugguggcauaugccuguaaucccagcuacuugggaggcuaagguaggagaaccacuugaaccgggaggcagagguugcagugugcugagauugugccacuucacuccagccaaggugacagagcaagacuccaucucaaaaaaauauauauauauacauauauguguguauauauaugauauauaccggaaacuaguuuaguggcaaaauuaugaucuuauuuuuguaugcaucauaaaaacacaaguuuuguguaccuacgacauuuuaaaauagguuuaaaacugugcaguuggcuuuucccaauuguuucauaaguauuuguugacuauuguauuuguccauugugcguugcuauaaaggauuaccugaggcuggguaauuuauaaagaaaagagguuuauuuggcuuaugguucuucaggcuggacaagaagcaugacccuagcaucuucuucuggugaggccucaggaagguuacaaucaugguggaaagugaagggggaggagacgugucacauggcaagagagggagcaagagaguugagaggaggugccaggaucuuucaaauaaccagcuguuguguuaacuaauagagcaagaacucacuuguuaccuuagggagggcaguuagccauucaugagggauccaucccugugacacaaacaccucccacucaaccccacuuccaacauuggagaucagauuucagcaugagauuuggaggggacaaauauccaaacuguaucagcuauauauuuguuuugccauuauguuaguauugccucuaauugcugaguucaaagcgauuuuuuuucuuuuucuuuucuuuuuuuuuuuuuuuuugagaaaggaucucgcuauguugcccaggcuggucucuugggcucaagcaauucucccaccuugaccucccaacagguacugggauuacaggcaugagcuaccaugcccggccaaagugauuuauucuguucaccuaggaauggcuuuccuaccuucagagaaucuucuuaucucuuuccugcucucuaaaaaacagauuuuagaaagauuuuuuuuuaaggaagccaaacauaacaggaacauauucucucuucagaauuucugugcauugucaagcuaauaauagcaaucaguaagcaauaaauugagacaaauugagacuaguacacaggcacucaaacuauuaaauagcuuuaauuaaaaaaucaaaggcuguuuguuauuaaaauaucugcauguguuuuacucuuuaacagcaguuauuuauuauguuaaaauuguguuuuguguuaaauugugauaaaacuuaaaaaaaauuuauguuuuuguguauuuuuccagagacugacuuuguucuguguugauguguaaaagccuucggguuuccgaacaguuucagugcaugaaguugaucuagcuguagacuauuuucuuuaaagauucguguccuugcaucuuuucucugaacuccugcuuagcacugaaguggaccuuaaugucucuagaacagacgcuuuccacaaguuucugaccauaccccaccauggucacacacacaugcacacaccucugaaacaaacauuucugaagcaauacuuacaugcaguguacucugauguauucuauucuacacuaucuuauuucauugauuauuucaagacuuccauuuaggauguagaaggacauaaaaauaccuuugcucugauaguaacaagaacagucuagacaaaauaaaaaucauauauuucucucgggcuagugacuagcaguggaugcaaauaaacuuucaugaacugauuuucaaaguaaaaauagccucucauaaaugagcagagggccacaggaacuuuuacaccugggacaagcacaugaucuggauuuaaguagcucugacauagaugguaagacuuuauggagccaagggaaaaucagacaagccuuaguuaaugguguaaaucguugaaauugaaauguagauuggaaucuggaagaaucucaaauggaaaaacaaaccauuuagcccaggaauuaucugcuguguccucuuucucccagcuuuugcuacaaaagcagcauugaaggaggacaggagagauacaaagaaauuguguagucccacauauuaugcagucccacauauuaugcaguaaugcccugccagaguugauuacagaggugaaccaaaacuaugugaaacugcagccaugcucuuuccagcuuaauauugauagaauuaaaaaggcagugguggccagguaguucaugccuguaauuucagcacuucagauugcuugaaccaggaggccgaaguugcagugagccgagaucaagccauugcacuccagccugggcaacaagagcaaaacuccaucucaaaaaaaaaaaaaauuaauauaauggaugaagagauggaauauuucaaaauacaguuggaauaugaagaaaaaaagaaccaaauagaaaauuaagagcugauaaauauaauaacugaaauaaaaauucuuuuuuuuuuuuuuucaagauggagucucccuccugcugcccaugcuagagugcaauggcacaaucucagcucacugcaaccuccaccucauggguucaagcaauucuccugccucagccucccaaauagcugggauuauuacaggcacccaccaccagucuagcuaauuuuuuguauuuuuaguagaggugggguuucaccauguuggccaggcuggucucaaacuccugaccucgugaucuaccggccucagccucccgaagugcugagauuacaagcaugagccaccgcgccuggccaaauggcuucaucauauagcaauuauauguuaaauuuuguaagaaacugcuuuccaaagggguugcaccauguuacgcuagcaauacuugagaguugcaggugcuccaaucuuuuguauugucauucuuuuaaauuuuagccauucuaguggguguguaauuuuagaaucuuguguuuuaauuugcauguucuuggugacucaggauggugugcaucuuuucaugugcuuuauugugcuuauuggcuacucauaaaucuuuuguaaaguguucaaaucuuacucauauuuuaguuguguuguuugacuuuuuagguguaauaauuuuuuauucuggauuuaaguccucaucagauauauguauggcagauauuuuuucccagucuguggcuugccauuuauuucuuuguuucuugccaauuaagucaaguugauugauagugauauucaagucuuuauauauuuacugauuuucugucuauauauucuuucuuuucuuucuuuuuuuuucuuuuuucucuuuuuuuuuuuuuuuuugagacaaggucuggcucuguugcccaggcuggagugcaguaguguaaucaucgcucacuacauccuugacuucccaggcucaagcaauccucccaccucagccucccaaguagcugggauuacagacgcacaacgccaugcccgccuaauuuuuuaaaaaauuuuuuguagagacggaguuuuacuauguugccagggcuggucucagauuccugggcucaaaugauccucccaccugggccccccaaagugcugggauuacaggugugagccacugcacccagcuccauuuaauuuuuaagccaaugucuuaagugagcagaagguuuuaauuuugaugaaguccaauguauccauucuuuuucuuuaugguuaauguguuuuguguccuaagacaucuuuuucuuccucaaggucgugaagauuuuuuucuuccagaaaguuugugguuuuagcucuuaguaguuagguuuaugaucuauuucaacuuaaauuuuguaaauguuauggguaaagguugagguucauuuuuuuuuacagauagauaccuauuuguucugaugccauuuauugaaaagauuauucuuuccccagcuuuguggaaaucaauugacuauauauauguggguucauuucuggacucugugcucuucugcugauccuuuugucuguccugucaacuaauauacauuguugugauuacuuaguuuuauaagucuuaaaaucagguagucuaugcccuccagcuuuauucuucguuuugaaaauuauuuaggcuaaucuagauucuuugccuuuccuuauaaacuugaaaaucaacuugucaauuucuacagcaaaaccugcugugauuuuguugaaucuacagauucaacaaucuggagauuguguugaaucuguagaucaauuuugagauaauuuuuuauaguaacaaaguugaauauuccuagccaggcccagugguucacgccuguaauccuagcacuuugggaggccaaggcaggcggaucacuugaggccaggaguucaagaccagccugggcaacauggcaaaaccacauuuuagucucuucuaaagauauaaaaauuagccaggugugguggcauacaccugcagucuugggaggcugaagcacaagaauugcuugaacccgagagguugaggcagcagugagccgagaucccaccacugcacuccaaccugggcgacagagcaagacucugucucaacaaaaaaaaaaaucuugaauauuccaguacauuaauguguaauaucuguguauguaguuauucuuuauuuuuuacuccacauuagcuugugguuuucagucuacacaucuugaaucccuaaguauuucuuuuucuuuucuuuucuuuuuuuuuuuuuuuuuuugagacagagucuugcucuguugcccagucuagaguuacaguagcacgaucuuggcucacuacagccuccaccuccuggguucaagcgauuccugugccucagccuccugaguagcugggacuacagcuacuccuaccacuuugggaggcuaagacaggcggaucacuugaggccaggaguucaagaccagccugggcaacauggcaaaaccacauuuuagucucuuuuagcaugcaccaccacgccuagcuaagguuuuuuuuuguauuuuuguuuuguuuuguuuuaguaaagacaggguuuaaccauauugcccaggcuggucucgaacuccugaccucaagugaucugccugccuugaccucccaaagugcugggauuacaguugugagccaccauaccuggccaauguuucauguuuuuaugcuguuguaccuguuauuuugaauuucauuuuccaaucguuuauucuuaguauauagaggcacaguuaauucuucuauacugaccauguguucugagaccuugcuaaauucucuuaugaauucucauaucuuguaacauagauuucuuaggaauuccuacauuuacaaucauauuguuugcaggaaaaaaaaaacagcuuuacuucuuuuacaaucucuaugccuuuuacuuaguuuuucuugccuuauucauuauguuuuuuuuguugcuguuguuugagacaggguuucacucugucacccaggcuggaaugacgagaucugcucacugcagccucgaccucucagacugaagcaguccuccccccauucccaccuuaaucucccaaguagcugugacugcaggcacgcaccaccaugccuggcuaauuuugguauuuuuuguagagacuggauucaccacuuugcccacgauggucuugaacuccugagcucaagccaucuguccuccuuggccucccaaaguguuaggauuacaggcaugagccacugcaccuggccuuuguaaacuucuuuuacaauguugaauaaaagugguaagaggagacauccuugccuuuuucccauucuuaaggaaaaaguauuuggucuuuaccacuuauugugauaucagcaguggguuuuuuuauuuauagauacuuuaucagauuguggaaauucucuucuauuuccgauuugcugaaaguguaaauuuuuucaaaugcuuuuucuucaucuauuaagauaaauacauaguuuucuuuaucccauaaacauggugacuuuuaauguuaaagcaaccuugcauucugguauccuuucuguauauuuauuuaugaguuugauuugcuuauauauauauuauauauuuuuauauguuuuauuuauuuauuuauuuuugagauggagucuugcucuguugcccagguuggagugcagaggcgugaucuuggcucagugcaaccuccaccaccuggguucaagcaauccuccuaccucagucuuucaagaaacugggauuauaggugcacgccacuaugccuggcuacuuuuuauauuuuuaguagagaccgguuucaccauguucccuaggcuggucucgaacuccuaaccucaagugaucugcccuccucagccucccaaauuguugggauuacaggugugagugaucgcgcccaguggacuuacuaauauuuuagagggacuuuugcauuuauguucaugaguuauauuauucuguauuuuucuuuucuaaguuuuuugcccaguuaccugguaagguaaugcuggucucauaaaaugaguugaaauuguuucuacuuccucuguuuucugaaugaguuuguauaugauugguauuauuucuuuuucuucuccuauuuuuuguuaagagacggucuugcucugucacccaggcuggaaugcaguggugcaaucauagcccacugcagccugagacucuuuuuuuguucgcuuugccuagagaucugucaauuuacuaauguuuucaaagaagcaguuuuuuguuucauugauuuuuauccuauguucaucuauuucauuaauacucauuuuuuauuuuccuccaguuucuuuggguuuaugcuuuuuuucuucuuaagggagaacuuuaaauauugaucuuuuuaaagauauuauuagguggaaugaugacacucaaauuucaguauagaauguugaagaccacaauguugaaaagguugguacauuuuaugcaggauuagcaaugggacaauuuaaacaaauguuaagguagagcaccuaaccuagagagaaauuuaaaauaguaauuugaaacuuuuaugagguaaaguguguuccaguuuuuuucuuuuuuuucuuuuuuuuuuuuuuuuuuagacggagucucacucuaucacucaggcuggagugcaguggcaugaucucggcucacugcaaccuccgccucccagguucaagcgauucucgugccucagccuccccaguagcugggauuacaggugcaugacaccucgccuggcuaauuuuuguauuuuuaauagaggcaggguuuugccauguuugccaggcugguguugaacuccuaacuucagaugaucugcucgccucggccucccaaagugcugggauuacaggcuugagccaccaugcccggccguguuccaguuucaaauaucaagaaguaguauccucacuuauuguuuuuaaacuuuuuuauuuuaaaagauuuguuuccaaauaauuugggauuuuccagauaucuuuuuguuacugauuucucuuucaguuccauuuugggcuagagaacauucucaguaugaugucagucuuuuaaaauuuauugagucuuauuuuauggcccaacauauggucuauuggugaauguuucaugcacacuugaaaagaguauuuuugguggcacgcgucuauagucccagcuacucaggaggcugaggcaggaggauugcuugaacccaggaggcggaggcugcagugagccgagauugugccagugcacuccagccugggcaacagagugagacucugucucaaaaaaauaaaaaaaagaaagaaaagaguauguacuuuauguuuguugaguaaaguguucuaaaaugucaauuaagucaaguugauugauagugauauugaaaucuuuuauauauuuacugauuuucugucuauauguuuuaucaacuacuguugaaaaguuaaaauccccaacuaaaauuguggauuuguccauuuggcuuuuuaguucugauauuuucuugcuucuuacauuuuugaaacucuuauuaggugcaugaacauuaggauugcuagguauucuugaugaauugcaccuauuaccuucuuuguaauguccuucuuuaucacugcuguuauuucuugcucaggagucuaccuugucugauauuaacauagacaauccagcuuucuuaugauaguguuuacuguuuaugucucuuuaacagaucuaucucuuuguauucaaagugcauuuuuuuaugaacagcauagaguuaggucuugcuuuuuaaauuaaguuugauaaucuuugccuuguacuuagagcuuaacccauuuauauacaguauaauuauugauauagucaaauuuaaguguaccaucuugcuauucauuuucuguuuguuccaugugaguuuuuuacuauuguuguuaccguucuuaggguucccccuccaacuccccugcuuuuuuggcaucaauuauuuuuuuagaauuccauuucaucuuucuuuguugacuucuuagccauuccuuuuuuuuucuuuuaauaguuucauuaggguuuauaacacaacuuuaacacaucacuuucaaauuauguauaaaguaccacuucauaucauauauaaagugauuucuuuuuccuuccuuccuuccuucauuccuuccuuccuuccuucuuuuucuuuuuuuuuuuuuuuuuuuuuuugagauagggucucacucuguugcccaagcuggagcacaguggugcgaucuuggcuuacugcaaccucgcuugcuucaagcgauucuaaugcuuuagccucuugaguagcuaggauuacuggcaggcaccaccacgccuggccaguuucuguauuuuuaguagggacggggcuucacaauguuggccaggccgauuuugaacuccugaccucaagauccaccugccucugccucccaaagugcugggauuacaggcgugagccaccgcgccggcauaaagugauuuuuaauucaguuccauuguggguuagagaaacuuacaacaccauacacaauuuuccaucccuaccuuuaugccuugucuuacauuuauuuccacauuguuguaaauuucacagugcauuauguuuacuuuagucaagucaucuucuaaagagauuaauaaaaaaauaugccuuguauauuuauccacaaguaccauuuuuuguucuccucauuccuuuuuuagauccagauaucuaucugguaucauuuuuucuucaacuugaagaacuuuaaaauuuuuacgugauccugcauacgaguugaaugugcucauauuugcauuuaaaaugggcacuaaauacagauaaguguaaaauuucugcuaauagcauaauuuucuuuguuuacuuaaaacaauguuaaauagaaaauuuaaaaaaaaccccacaaguugaaagcaaggcugcagaagaaaagaaaaaacuuuauguguaccuuuaaaggcacuuuuacugccuuuugaacagggaucucacauuuucaauuuguacuuggacucauaaauuaugucacuggcucugaaugcaggccugcuguugacaaauuuuuacagcuuauguuuaacugaaagcauuuuuauuucaccuucauuuugaagauugugucuagaauucuagauuugcaguuguugguuuuuuuccuagcacuuuaaaaauuuuccuuguuuucuggcuuaccuuguuuccccuguauauauauuuuuuuucucugacuucuuaagaauuuucuccuuaucacugguuuuuagcaacuugguuaugguuuuccuuguggcuuucuuuguguuuauccuguuugggguuuguugagccucuuggaucuuuggguuuagaguuuucaucaaauuuagaaaauuuucaucuguuauuacuugaaauauuuguccccacucccgaccccuucauuucugcgacuccaguuauauguaggguaaagcaaaaccacuugauguugucccagugaagcucuguuuuucaucuuuguuuuagcuuuuuuucuucacuuugugcuucaggcuuuuuaaaaacaguuucuauugcuacuuauucaacuuuauuggucauuccuucuaaaacaacuaaaaucugcuauucaacacauccagugaauuuuucauuucagauaguauauuuuuaagcuccagaaguuuuauuuguugucuuuuuuaaauaucuuccauuacucuacuuauguucauguuuuccuucaaauuuaugaaaauauuuauaauagcugaauugaagucccugucugccaauuccaucaugucuguuguuuugguucgauuucucuuauuuuguauuauuuugguucuacuuuuuuuuucucuuuuuugagacagagucucgcucuguugcccaggcuggagugcagugucacaaucucggcucacugcaagcuccgccucccauguucuggccauucuccugccucagucucccgaguagcugggacuacaggcacccgccaccacucccgguuaauuuuuguauuuuuaguagagaugggguuucaccguguuagccaggauggucucgaucuccugaccucaugauccgccugccuuggccucccaaagugcugggauuacaggcgugagccaccacgccuggcccgguucuacuucuauugauugauuuuucuccuggguauaggucucauuuucagguuucuuuguauguuuaguaauuuugauuagaugacggacauuuuauuuuauuucauuuuauuuuuuuuaauuuauuuuuugagauggagucuugcucugucgccaaggcuugagugcuaucuugacugacugcaaccuccuccuccuguguacaagcaguuccccucccucagccaccccaguagcugggauuacaggcaugugccaccacauucagcugauuuuuguauuuuuaguagagaugggguuucgccauguuugccagacuggucucaaacuucugaccucaggugaucuacccaccuuggccucccaaagugcugggauuacaggcaucagccacagugcccagacauuuuaaauguuacauugcugggugucuggauuuaguugucuucauguaaaaauuauugaauuuuguuuuugugaguacuuaaauuucauaagaaucaacuuaauccuuguuaggguggcucuaagauagucuuuacucuaggguuaauuucauccugcugguaaaucaugaccucuuguuucucuucugaauuaccugggcauucaaugagguugcuccucuguuguuggacuuugaagguuucccagagcuagugaacccuggguuagcuuaaaaaucucccauaguuuuucuuucuccacuaguuguuuguugucuagccucauguaguauuauccuaugcauuagcaacuuaguauucaaccaaagauucaaggggacucuauguagauuucuggagcuuuuucucuauguugcucucuuuucugauacugugcccugaaaauuccauuugccucagucuccauauuccaaucuuguuauccucaacucgguaagguugccaugucuguuuggguucucccuccugacccuacuuucuggaguuuccagggagaaagcugggccaucauaggaccugccucauuuuccucucuucuuucagggaucacaaucuuaagcugucuguuauccaguaucugaaagcacuuauuuuauauauuuuuccaguuuuauaguuauugaugugggaaaggcaagccuaguucagcuacuccaucauggccagaagugaaguuucccuggucccuuucauaaauuuucuuuucuuuucuuuucuuuuuuuuuuugaacgaaucucgcucugucgccagacuggaaugaaguggcgcgaucucggcucacugaagccucuaccucccggguucaagcgauucuccugccucagccuccugaguaguagcugggaugacaggcguaugccaccaugcccagcuaauuuuuaguagagaugggguuucacuguguuggccaggauggucucaaucucuugaccucaugauccgcccgccucagccucccaaagugcugggauuacaggcgugagccaccacgcccagccaguuuucuuuuuaauuaagguaaaauucacuauuuuuacaguguaccccuucauuauuuuguaaaucagguuuuagaauguuccaaauucuuccaaguuauuuuuccagaugcuuauaucuaaucaaauaaaauauuuuaaaagauuuggagugagaaacuugcccuauccaagacuugaauugguaaaauagaacaucaguauccucuuucccaaagagaauuuaauuuacuggagugaauucagauugguuucucuuaauauguuaaaaacacagaauucuauauaugauagguuauguuauaaauuauauuuuaagcugauaaacuacaguugguauauuucuuggaugaaaauaaauacacagaagagcaauagaaaauaaaaagaaagggacaugauuaagagucaucuccaaguaugcuguuugauuaugcuucuaaaaaucaugcuuggccaggcacaguggcucacgcuuguaaucccagcacuuugggaggcuaaggcggguggaucaccugaggucaggaguucgaaaccagccuggccaacauggugaaacccugucucuacuaaaaacauaaaaaacuagcuggguguggugaugggcaccuguaaucccagcuacucaggaggcugaggcgggagaauuguuugaaccugggaggcggagguugcagugagccgagguugcaccauugcacuccagccugggcaacaagagcaaaacuucaucucauaaaagaaaaaagucaugcuugaguuuuuauguuuauacuucuauuguucaggugaggaacugaaugaccgcuguuguuucuuuuguugagauuguccauugugguuaugugugcucuaccuucucuuuuugugaauccuaccugacuucaauaguuuuuaauagcuggaaaagucucugacucauuuccugcuguuaaaagaaaagacaaaaugauuuuuaaaauuguugaaacuguuagauuuucucaaccucuguuucuguuggaacuguuaaagcaagcuugagaaagcagucucuaggacaaguauacaaauaaguuggcuuuaggaaguuuucaaaagauaaaucuugggagagaucuaggauuugaaaguugggccagcacuuaggaguuaggaugucuaccaauaauggagguuaaggcaagaaacugggaagaugaggaaugggaugaauaagaucuugcaggcuaggagagccaugggagaggaggcgcugaggagcaagguggcucagaauauaauuagguuaaagggacagaugugagguuccuguaagaaaauaacugaagugagcaacucuuauuuuuacacgggacaaaaucacaaccuguaugugagaacacgcaagccacauuauaaaggguauaaguuaauuuggcaaaaauugggacugugaaaucagcucuaagaaagauuuucuguguuaucaguaacagucauagaucuaguuaaaauucauuaaagugcuuuuauuuuugaaauaguucauuuuucgaaagcuaucauguauuaaagcauacauuuaggagaaagaaaauaccuacauauuuuaggagagucuuacccugcugugcuacucuguucaacugaaacaccaucaguacacaucauuuauauuugugugugaauuccguagauuuagccauuuguugccagucauuugacuuuuaccuuuuuuuuuuuuuuuuugaguuggggucucgcuccaucacccaggcuaaauugcaaugcugugaucauaacuuacugcagcuuccaacaucugggcucaagcaguccuccugccucagccucccagcuuguagcugggacuacagguacaugccaccaugcacagcuaauuuuauuuauuuauuuauuuauuuaguagagaugaagucucacuauauugcccaggcuggucgcaaacuccuggccucaagugaugcuccugccucagcauccuaaaguccugggaugacaaguaugagccaccacacccagccauguugcuaguaauuuucaaguuaaaauuuuuuuuuagcccugacaauuuucauuuuuuuuucucaauuugagccauucacacuuaagacacauuaaccagagaaaaauaaagaaaggguuaaccaggaccaccaaaaaccucuagggacuucccaggagcuggagaaaaaaguccugucuugucuauagugaagaaaaccugagucucaaagacacccuaaaauccuaggaauuccuuauaaauaccagaagcaagaaaagaauuuucaguuuuaauaaucaacaguagcagauuagaucuuuaaauuguaugcauuaguuuuuuaucaagaguucugugcaacaguuuuggugcuuugggcuuuggguauaguuauuuuuuuucauccacaugagcuuaauuucuuaaaguuuuuuggauuuuuuuuuuuuuuuuuuuugcgucagacuaucaccaaaguuuauuugcuggcaaagcugguuuucccagaaauuuguauguaggaaugguuuaaauaaaaguugauggaauucuuaguuagcaguugcucugccaagaauaacacuuuugugugcuuucuguauauaacaguuuuggucagcuauacugacagagcugggcuaagauauuuuccugccuguuaaucaaggccacacagacaaagcucaaggaaggaugaucccugccucaggaaguuuugaaucaacugcuauuuuuaacaaguauacaguagaacuugagaucaggucuucacucaguugguaggaaaaguuuuccgcugaagcuuacauauaaggaaacgguuuaugggccugaaugaagccucugugugaaaggaaggaaugugacaguggcuguaaguauuuguauugauuugggucaagggugugguagcauagaugugggaaguccagucgucaaauagguuauuacauuuuaaggcaacugauaguucaugggcaccuugaguugucuuuaguguauauggaauccugugcugcuaauaguaaaguugaaauaggcuaugugaugggcugauauuauuaaucaacguaggacaggaggagaaaguuggcuauugguguguuuccaugcuaacuggcucuugcuguggacauauauaaauuuuggggggguuuugagauguaauucuguguauauauaugcuccuuguuucauuaagagaagguuucauaaagaauuaauuuaugccugggugcgguaccucaugccuguaaucccagcacuuuuggaggccaaggggguggauugcuugaacucaggaaguucaagaccagccugggcaacauggagaaacuccgucucuacgaaaaauacaaaaacuuaguugggugugguggcauguaccuguagucacagcuacucaggaggcugagggggaagaucacuugaacccaggaggcagagguugcagugagccaagaucaccaccacugcacuccagacuuagugacagagcgagacucugucucaaaaaaaaaaaaaaaaaagaauuaauuuauuacaaaaauauuguauacugcuauguauaaucucuucuaaaaccucauucuaccuaacuuuaggaaauuaaauauggcagaacauuaaagcugacaaucugaaaaauaccacaaauaauguuuuguuaguauuauuaucucaccaucuuaggagugccuuuauguaguugaauuacuuaauagauuacagguauguuuuuacauaugcaauguauaugaauuauguagggauaggugggcaauguuuuaguggaguuuuaaauuaggaaauuauaaaauguguuaacauauuuuugugucauuuuaacaggauuauucaagaucagguuguagccauuuucaacaaggaucacugaucaaaauuuucuuuuuacaaagagauuuacaaguuaaacaugaagggaaaauacuggaaucauuuggauucugacaggauaaagaauacaauauuucacauuuacuuguaauggaaccuuuguaagauucaucacuugucauucacccaguugggaacauggauguugguuuuucucguacuacuguucagacacugucaagaagccacugcaaaaacaucaaacaaaaaauuucucaaugggaaggaagggcuaaugguauaucuaauccagaaaagugguguccaaaggacuuuggagugagauauaacugucaccaagagauccgucuuaagaaaaauccuauagcugagagaaagagcaaaaacuuggauguaaccagccgugaaaaugugggucuagauauaaaugaaaauaccaaaagccaugaucaaagugagaaugaaaauaagaaacaugaauaugacgauacacacuucuuuaaaaaugaaucagaauccaacuggguauguucucgggucaaagaaauugaaagcuguaaagaagaugucuuagauccagagacuucauuaccuccaggaaacuucuauaccucacaaauacuguggaagaaaauagaagcacuucccccagauaaacucuuaaauuuggcuuuagaacauugugacucuucagaaaaagaacugaacuucagaguucuggauaguucauacggaauaaccaagagcuuagaaaauauuuacucugaaccugaggggcaagaauguggaccuuccauaaauccuuugccaaaaccucguaggacauucagauauuuauccgaaucugguguuacgccguauaaagaaagaaacugugacaaaaaauacugugaaaauaacucuugugcacaaucuucuuuggccucuucucaggaaccugaaccaaagaaauaugguggaaaaaucagaggaagaucuaaaagguauguuuuuauccuacagauaaagacuuguagguauuuuccuuacaggauuauugagcuucuuuuuccuuuucaaaccaguuuccauuucccagcuuaggugaugccccugcuuugaacaugcagguguugauuaauguggaaggaaaauaagaagugaaaaaaguagaaauguaguaauagcuaagauaaucuguugacauaagagcaucagaacaccuuccauuuuauuaauauaucuuuaagaaucugggccagcgccaggcacgguagcucgcuccuguaaucccagcacuuugggaggcugaggcuggcagaucacuugaggucaggaguucaagaccagccuggccaacauggugaaacccugucucuacuaaaaauacaaaauuagcugggcgugguggugugcaccuguagucccagcuauaugggaugcugaggcagaagaaacgcuugaaccugggaggcugagcuugcagugagcugagaucgugacacugcacuucagccuggcugacagagcaagacucagucucaaaaaaaaaaaaaaagaaaaaaagaaaauuaaucuauaggagcugggugugguggcucagucccagcacuuuggguggcuggggcaggaggaucacuugaggccaggaguucaagaccagccaaacacuagacagggcaacauagugagacccugucucuauaaaaaaaaagaaaaaagaaaaaauuagccagguguagugauguguuccugucguccuaccuacuugcgaguauuacuugagcccaaaagcucaggcuacagugagccaugaucacuucacugcacuccagccugggcagcagaaugagacccugccucuaaaauaacauaaaauaaaaauuaaauucaaaaaaaucuguagggaagcaguaacauucuuccacuucauuuagggcaugcuggccucagccccacuuuuccuuacaaagugagcuuaauaaaggaacccaaugaagaacaugaaugugauuggcuacaagcauccaauuuucucaugguguucguaaggcacagccuacuucauuauucuuagaucucugauaaaacaccuuuguaauuuugcacacuaguucuguacuuauuuauuucugucucccauaccaauuuaaagaagauuagaauuuucuguaauccuagcacuuugggaggccgaggcaggcagaucaccugaagucaggaguucaagaccagccuggcggucauggugaaaccucaucucuacuaaaacacaaaaaagagcugagcaugguggcacgcgccucuaaucccaggugcaacaucccuacagcaauguagaaucgcuugaaccugggaggcagagguuucagugagccaagacugugccacugaacucuagccuaugcaacagacugagauucugucucaaaaaauaauaauaaaacaaacaaucaaacaaauaaauaaauaaaaauuuuaaaaaauaaagauuagaguuuugaaagauauaacuuuaaaauauaucuccuuuuuuaaggaaauccuuugaauuugaggauauucagcacuuucgaaaucggaacucacagacgauucgugaagaacuuggaagaaauucugggucagcacuuuauuacacacagucugaggacaauaucuaugaagauaucauauguagguguugacaacuuugcaguuaaauuuagugauuauauauuuggugaagcccuuaauuguaggaugguauuuucuucuauaaucaagcauauauugcucuagguuuuucucuuuagcauggaaacguuugguguauaaauuauuuuauucucuaaugaauuuuacaacuaaugugauagacugcucagcuuauaaguacauguuuauaauauauuauuuugagaauucuuuuagcucuguugaacccauaagcuuaaauugcuguugaucuggaaacccacaucccuacagcaauguagaauaagaaagcugaacauaguuagcuuuuucuuucuuuugccagcugugguuaucuuugcauuuaauuauguucauguaaacauuuuuuuaaauuauuuuuuaagaucccaccaaagaaaauccauaugaagauauuccagugcagccuuuaccuauguggagauccccuucagcauggaagcuaccacccgcuaaaagugcuuuuaaagcacccaagguauaaccagauaaugaauugaagaaaacauuagaaucuuauucaugguaucuacaaaaagauuaaggggauuuaacuggguccagaacuaagaggcacugaaauguaaguuuuaauguuggugguaguuuuuuuaauuuuuguuuuguuuuuugggauaacauacagcuuuuuuuuuuuuuugguuguuguuuuaacacuucaaaaauaauugaauauauaugccuuuagacagccaugaacuuuucaguuuacuauaguucccacucccccuauuagucuacaucaaucuuuggccauuaaauuaccuuccuagucccugaaaguaugugagacgccuagaagcaaaggcucccuagaguucaugaaaacugugagccauuguuuucugggaauuugauuaccuuguaguggaacuuuggauuagaaaccugagaaacuucuuuacaaauggugagaaagaaauuauguuaucuucauuugaaaugauuuuaaauuaaauauaggauaaauacauuucuggaauagcuuugacuuuguaugauaauacaggcauuaacuagaugaugcuggccaggugcaguggcucacaccuguaaucccagaacuuugggaggcugaggugggaggauugcuugagcccaggaguuugagacuagccugggcaaccuggcaaaaccccaucucuaccaaaaaaaagaaaaaauuagccggauguggugacacgugccuguagucccagcugcucaaggggcugagguggggggaucacuugagcucaggagaucaaggcugcaaugagccaugaucgugccacugcauuccagccugggcgacagagcaagaccccaucucaaacaaacaaacaagcaacaacagcaaaacuaggugaucuuaccaguacaucuucuccuguuuuagcucccuccaaaaccucaguuccuucaccggaagacuauggaaguaaagaacucacaggcuuauuugcggucaaagcuuacaaaagauacaacuuugccggucacuuuaacggaauggaagcuuuuccgagcuggugaaguugcaaacacgaaaaggaaaaaucuuccaaggguaaagacuccagugcuuucauucuuugacucuuacuucagcauuuccaugaaugagaauaaguaaacuuuagaccgaaaugaauaauagguuagaacugaccuacugggauuagaagacuuagaaggcagcguuauguuuuaaauuuuugcucaugcuagagaagugcaugaauggcuuuugccagaguuucguuguggauuuuuaaauugauuuagauggggacuucacuucaguuaccuuagcucucauuaaaaucgucugccuauuucaaggaagcaccagaaucuuauauaaaagggcguucucucaggauggcuucaguguuguucuaauucacucauucauaugauugccaaagugaguucaguuuugugcuugaguuuacagauuuucaguaaugaaaaaguauaugccauuuauuuggggcaaaaauuuccaaagaaaaaaacaaaucuauuacuugggaauggaaauuaucagcaaucauaauaaauaaaugacuucucccucaagggagaaaaggcaguaagucuguacaucaucucuacuagaagcauugcaaccaaaaugaagaaauugagauugcuugcaggcagacauauauuuuuuuuucuuauuuauuuacuuauuuuguagagacagagucucgcuauauugcccaggcuggucuugaacuccuggccucaagcaauccucuugcccuggcccccagaguuccgggacugcaggugugagccacugcaccugacuaauagacauuuucuuuugggagaaacacuuaagaaauuauaugaaaaaauuuuaaacuuucucuguuacuuuguucuucuguaaugcaggguguuuucaggauugucaaaauacuaugcacauacucugcuguagugaagaaaucagaucacuuaaauauuauuccuucuuuaaucccaucugaauuagcuauauguguucauuuaacauguaauuuuuguaccugauuuuaacauuaaacaaaagucacaucuguuucuuggguuaguaacuguugauuuguuccuugggaaauauucuauuccacaguuuuaauucuuaucaguuuucugccccuuccucuuuacuaugugaaaaguuaaagacauagagguuuuuuaaagcuaaacugaucucucuuagugaaaaaaaaaauguaacuguuuaucuuucugugcaucaugaggaauauuuuuuuaaaaagagucuuaaagaacugccaggcaucuugcaguagcugcgcccucugguagaucauguuggcacaacaaagcagccucccacauggcccagcaacaacaaauuguguguuaauagggagaagaaugcaaacaccuuaagggauugcauuuaagaugugguucuuauaauggcauuaacaaauauuuaggaauuauggauuauagaguuuaaugagacccagggaagcuuuauagugcuuucgauuucuugccucaauguuuuauguauuauggaucucaaguacucaaaacuuguucuguaucugauuguaggugauaggaucuaacuuuucccuuucuaauauuuuuucugaagguuuuuggagaagugaggagaaaaaaaugauuaugaauucuuaauugucaggcaggaacaagccaugacagcauuucuaccugugacccuccuuggauugaaucuuuuuaggaugucccuuaugcaauacaaauuuuggcuuuggaguaucuucuagaaaacauucuauaagaaaguccauuuucauuuauuuccccuuuaaugccuccagcugucccuggaagggaaacugcuucacaguuucaccucacugaucuaguccauuugccucuuccccacucuuccuuuccuucccugcuguggaagccugugugggauuguuugcuagaguacauuuccuacuaccuuuauuguuuguguuguguguacagcaguaugauuuccgucauuucuuaggaagaauauucuacaguauuucuuguaacuagaaggcucuucuuccuagcucaugacagaaauuuaaauuuaucacuuuaucgcauaguuuuagaacaguuaucuuuccuuuauacuugaauauacuuuugauucuacuuuucaaaugcaaauuaauaauuaugcuauuuugggucauuauguaacccaaauauauauuuauuuccauacaucuuuccuauagcccuuaguacuuuuuuauuuuagauucucuuguuuuuuguaauaguaauauuuaagaacauuggcaauuuuucacuugaauugcagugauaaaaaucuuuaagagcacaaacucauccaaaaauguuguaauaaucuguguuuuggaagcauauguuucuugcauguuuuuuggggggugagugguuggcaggggacagugguuugcacuggacugauucauugccugucgauugucaggauggcuagagaaacaaggacaaaagagaauacaagagcguuuuucucgggcaacuuuauugguuguuaucauauauaauguuccuaacaauuguaauucuaggcauuaaguauguuaaaucaggacuaauacuuaagaaaagcuuggaauuuuaagaaaaaaagaaaaguauuuauggaaaaacugaucaauuccuccuuuuaaaaguaccuguugaucagcuccgaaucuuuccucuuuuuuaccgcauucugugugugucuccugucuguuucucuuacacacacacacaucucucccaguagcaaagaaaaauuucuaaugaguaauacuuaugaaauggagagaagcaauuauauaacaauuuaaaaauaaauagucuggauuuuacuugcuugagaaauagauugaugaguggaagaaaaaacauaguuuuuguauuugaguauauuuggcucuccuaauuuuaugacauauuucuaaaauaaauuauaauguuaguacucuuagaauauucccuuugacaaaagcuuucuaaguauguuuaucugcuccuugggaagaauuucugggagcagaaauaacuauaccucacccugccuuucagauaaaugaguguuccacuuccuacuccaggcaagugaaaacuugaguuuaauaguaaaggcuugaucacuauacaaagggcaauagccacauuuccugcauguugugacauggagugacaaggaaucuaaaagccugugcuggguucauccaauauccuuuccugcuuuccuuccccauguuaugugaacuugguauuagaacaacauaucaucuaauuaaagaucaucauuuuaaauccaaaauucaaaaagguaaagguuucuauuuauaaaauaggucuuuucucugaauaagaaucccuaauagauuaaugucaucaaacugugaaacuuuuggguguuggucuuaauuuguauuuuucuggucuuuuuucagcuuguauugaaaauagaugacauauuugaaucuaaaagagggaagaagaagguaaaguuacauucuuacacuggaaaggaauuaccuccgacaaaagguaagaauuguuuuucguuccagcuauccuguagcugucaggauaugagaggagaaucaccauauaacuuaauguuugauguguauuaaaaauuuuggggccgggcgugguggcucacaccuguaaucccagcacuuugggaggccaaggcggguggaucacaaggucaggagaucgagacuauccuggcuaaaacggugaaacccugucucuacuaaaaauacaaaaaauuagccaggcgugguggcgggcgccuguagucccagcuacucaagaggcugaggcaggagaauggcgugaacccgggaggccgagcuugcagugagcugaaaucgcaccacugcacuccagucuggacgacagagcaagacuccaucucaaaaaaaaaaaaaaaauuugguuuacuuuccuguuaucccacuuaagcauaaacuucuuuaagauaagggauuguuucucaaauccauuuuauuuuauucucugccaaguaauaacuauuggaugaacaaauaaaugaaugaaaaaauaaucauaaaccauugagacuaaauuucauagacaaauugaaucacuauuacuuugauuuauaaucauuuaucaguauagacucuuuuguuguagcuaggaaaacauuagucuuuuuuuuuuucucugaggauauuuuaaaauuuuucaaucuguucuucagacuggauaauuuauauugauuuaucugguuuuuuuuuuuugacugaagguaugugguacucaacuuguagucauuuaauaaguauuauccuggccaggugugguggcuuacgccuguaaucccagcacuugggaggcugaggcaggcagaucacaaggucaggaguucgagaccagccugaccaacauagagaaaccugucucuacuaaaaauacaaaaauuagcugggcgugguggcgugugcccauaaucccagcuacucaggaggcugaggcaggagaaucacuugaacccaggaggcagagguugcagugaggugagaucgcgccacugcacugcagccugggugacagagugagacuccaucucaaaaaagaaaaaaaauaauaaguuuuauccuucagaugccuagauaaaacuuacauuguuaauuaagaaauugucaacauucauaauaaaucauuagaacuuucuuaaaaacuuacgcaagauucuuaacuugguugucuggggauaugguuuggcuguguccccacccaaaucucaacuugaaucauaucucccagaauucccauauguugugggagggacccagggggaaguaauugaaucaugggggauggucuuucccgugcuauucucaugagagugaauaagucucacgagaacugauggguuuaucagggguuucugcauuugcuucgucugauuuucucuugcugccaccauguaagaagugccuuuugccucccaccaugauucugaggccucccuagccauauggaacuguaagucgaauucagccucuuuugcuucccagucucacguaugucuuuuuuuuugagauggaguuuugcucuuguugccaaggcuggagugcaauggcaugaucucggcucagugcaaccuuuaucuccuggguucaagggauuccuuugccucagacucccaaguagcugggauuacaagugccugccaccacacccggcuaauuuuuuguauuuguaguagagacgggguuucaucguguuggccaggcugaucuugaacuccugaccucaggugauccaccagcucagccucucaaagugcugggauuacagacaugagccaccaugcccagccuuggguaugucuuuaucagcagugugaaaauggacuaaugcaucuggcaaauauguagaauuuagcaguuuuuguuuauaaguuccuuagugagaaacaccagcuaagucauagcagaggagaauguuucuucuuuuugcagacuucuaaagacagaauuuucuuuuuuuuuuuucuuuuggauacagagucucacucugucacccaggcuggagugcaguggugcaauuucagcucacugcaaccucugccuucuggauucaagugauucuccugccucuuucuccugagaagcuugggauuacaggcacacggcaccacacccagcuaauuuuuuguauuuuuaguugagaugggauuucaccauauuggccaggcugaucuugaacuccugaccucaaaugauccaccugccugggccucccagagugcuaggauuacaggcaugagccaccauaccuggccagaauuuucuuuuucuuuuucuuuucuuuucuuuugagacagucuugcucugucacccaggcuggaguccaguagugcgaucucggcucacugcaagcuccgccucccggguucaugccauucuccugccucagccucccgaguagcugggauuacaggugcccaccaccacacccggcuaauuuuuuguauuuuuaguagagacgggguuucaccauguuagccaggauggucucgaucuucugaccucgugauccacccgccucagucucccaaagugcugggauuacaggcgugagccacugcgcccggcccccagccagaauuuucuuaauuacccuuaaaaaccuauuuuauauucuaacaacuuacuauaugaaaauaaaaucuucuggguuacaucuuaagucucuuuccugcuauguacugauuaaaaucaacuggucacuguuuuuaacgugaguuuucauaauuugagaggcaauuacuaaaacauguuucaaucuucucuggggaagaaauacuuuuggucauuguuauuaauaguagcuaccauuuauggaaugaaguaauaguuucuuuacauauuuuaucucauguauaacguaugacaacacuaggagguagggacuauuauaauuuuacaaacaaagaagcuaagacagaggaggaagcauagauuugaaucaaggagcauggcuccacauagcuuaucuuuuucuaucaucaacgguuaacuuucucauaaaucuugauuuuuagcaguuuaaucaucucuuuuccguguauuuuuuaucuucaacaaugguauugucaaagguauuuuuguguguuauuuaaaacuagacauagaaaaugaaaacucgugccagguauugugcugcauccuuucugaugcauuauuauuaauuuucuaaauaacucuguggcagauaguauuuucauuauuuuacagauaaggaaauaaauuacacauugcaaaucacauaaauuaucauauacuggggccaggacaagugcuuguaaaacauuaacauuuucucagauuaacagcagucuauucauaacuacucucuucagguuuuuuuuuuuuugagacggagucuugcucuguugcccaggcuggggugcaguugugcgaucucggcucacugcaaccucugcuuccuggguuuaagcaauucuccugccucagccucccgaguagcugugauuacaggcgugugucaccacgcccagcuaauuuuuguauuuuuuuuagaagagacaagguuucaccacguuggccaggauggucucaaucucuugaccucgugauccacccgccucggccucccaaaguacugggauuacaggcaugagccacugcgcccagguauuucuaaguagguuauuaccaagcccuuaauuuauuuguaugucuaugccuuauggauuaggaacauuguaguaaauuugguucuaagacaaguuuuugaagagccaaaaauuuguuuuaacuguuuuaauguugaaaagaaaaaaaaaauccuccaacuucuagccaacuucugcuguccaaaacaaaaguaaagaaaaaaggagcagccucuacauuguaacacuucacuuguggcucaaauaaaauaagcauuuaccuuuaccuaccucugugaccaacuccuccaaugcaccagaggaauuucucucaugccugacgaucuccuggcuuugucaucacaguucucagauuuucauuuuccuccuuaagcuuuugucuguauaucaacaaugccuaauacaauagauaauuauauuuaccuacugugaagucccugcuagaguuuacugaauauauuccaaccuaaauauuucuucaguuuuuuuuuuuuuuuucaagacagagucucacucugucacacaggcuggggugcaaugaugcaaacauggcucacugcagccucaaccuccuggguucaagcgauccucccaccagagccuccugaguagcugggaccacaggcucaugcccaccacaccuggcuaauuuuuaauuuuucguagagacaaaaucucaccauguugccaggcuggucuugaauuccugggcucaagcgauccuucugccuuggccuccgaaaaugcugggauuauagguaugagccaccauaccuggcccuaaauauuucuuaacuuucaguuuucagguauuacaaaaugacuuaucagccuucuucaauucugucauuauaauuuuguguguugaagucucauauuaaaagaggacaaucugguacuuuuucgaucccuguggauucucaguagauuuuucucuuggcucauaaucccacuaaccuucauucauugucuuagaauacacaucaucaaaacccauagaugugaauauauuaagccaauuaagugaucuuuuauaagggcuuuuccaguuauauugccuuuucucccuuucuucucucuuuucuuucuuuccaaacacuuccuaaguuucuaagagauaccugguacuaagacuauagauaggaccaggagcucacaguguuuauuucuuucucugaauaauauuuuauagucacacuauacuuuuugucauggugguuaauuuugaguuauaaaacauauguaauaugcaauauuuaaauaagcauuuuuucuguaacaucucuuaugugucuuucccaccuaucuuaagaauaggcagcauuuauuuuaauguucucuuauuccuuauuauaaaaugaaaagccagaguuuuccaaaccuccuccuugcacaccuagaaaauuucaugugcacgcaaauacauuuucuacacaaauacucuuacacuauucagacuuuguaugccugccuuuuuaaaaaagcuuaauuaauguacuucagagcucuuucaguaucaacacauagagauccacauagcuguacuguauuucauugcauagauguaaaauuuuauuuagcuaguagacaguuuaguuguuucuaaccuuuuauuuaaccuguggauauuuaaaagugugugugucuacauaaaaaucuucaaacaaugcugcaaaugcaucuuuuacuuauauuucuauauaagacuauuuuuguagaauaaguuccuagcagugagcuuaaucaaagaacauauggauuuaaaauguuggccaggcaugguggcucacaccuguaacuccagcacuuugggaggcugaggcggguggaucacuugaccccaggaguuugagacuagccugggcaacaugacgaaaccccgucucuacaaaaaauacaaaaauuagcuggguggcugggugcgguggcucaugccuauaaucccagcacuuugggaggccaagaugggcagaucacgaggucaggaauucaagaccagccugaccaacacggugaaacccugucucuacuaaaaauauaaaaauuagcccaguguggcggcacacgccuguaaucccagcuacucaggaggcugaggcaggagaacugcuugaacccuggagguggagguuguagugagccgagauugugccacugcacuccagccugggcgacagagugagacucugucucaaaaaaaaaaaaaaaaauuagcugggugugguggcacacgccuguagucccagccuacucuggaagcugagguaggggggaucaguugaguccgggaggcagagguugcagugagccaagauugugccacugcacuguagccugugcagcagagugagacccugucucaaaaaaaaaaaaaaaaaauuuauaacugcugccaaauugucccacaaacagauuguaacagcuuguuucuacaaacaucauuugaaaauaccucuuuccccauaaucuucaucaauaaauacuaugcuuuauuaaagcuuuuuauggcaauaucaugguugaaaauguaugucuuguuuauuguuuuaauuuacauuuauuucguuaugaauuugggcaguuuucauguuuaucaacaacuuauaaaucuuuuucuaugaauugccuauucccacccuuuauuccuuuuucuguugugcuuuuucuucuugauuuguaacaguucuuugaauauuaagaaacuuagccuugugucugcaauguguuuacaaauauuuucccaguuuauuguucacuuuuugaguuuaauacugauuuuuaaauuagauacaaguuuauauaaucaaauuucacuuaugacuucuaggccuuauuuuuucccuuucuuuguauuucuauuuugcuuuaacuuuucaaacuuaaucuagaaauguuuuauuuuaaaagcugcuuuguguguguguguguguguguguguguguguguguguguugccugugcucucagaauuauacaaaaacacucccuugggaaaacaagauagccccuuguccccaaaauacuuaaaaucggauuggggaaaguaagaauaguucaaagcaguaugaguacugugagaauuuggaguaaagauccauauggacuagaaguaguuuagaggcacuuagaggcaccauagaagagguaggcugacuugguaauaucucucuccuaguucucauguuuuccuguuauucuaaauuuauagucugguugguguuuagauucuuguuuagcccuguugguguuugccuuugauacucuauuuggaauauacaaacaacuauguggauauagaaauagaauccacucugaacuagacucuuaaaacuggucugaaaugcaauuaguuucuagaauuagggaugagaggggagccgaggagugaaguaggguaugggaagaagauguaguagaggaguuuccucuuugagcuuuuuacucucuuuugguaacuaucccaacuugauacaaccaagugguuuggagaaaggcucagcagcuuuauuauuccuuacuccaaguccccagguuuguggguuuacauuguucucauccucauguacuuccuacuguuggacaauacaaauggaaacuccuucucucuuuucaggugaaaccagugggaacgaaagugaugccgaguaucugccaaagagugagugagucaauggggcugcucccguuguugugaugaucauggguuagguggaguggcaccuaccuuugugacuaagcauguuuuuucccacaugaaguuccauuuuguagaugauuuccuuauuuucagagccuguugagguuuggagaauuaaacagucagaauuaaacacugucagauguuugacagcauuuaaagucucccauaguggagugaggcaaaacaguaugguucuuaugauggaauauucuuaggggagcggcagagagcugcauguccagacauauaugcaguaguuuccuggcagccaaaacagagugugugaaucauccucugagcaguaaauaucugauuuuuuuuuuuuuuuuuugagacggagucucccucugucacucaggcuggagugcaguggcgcaagcucggcucacugcaaccucugccucccggguucaggcaauucuccugccucagccuccugaguagcugggauuauaggcaugugccaccacgccaagcuaauuuuuguauuuuuaguagagaugggguuucaccauauuggucaagcuggucucgaacuccugaccucguugaucugccugccuuggccucccaaagugcugggauuacaggcgugagccaccgcacccagccaaaugucugauuuuuuauagccacucaaguguaauuauuuaaguaacuuugauaucucugacauugaaaaaggaaauaucuauuuguuauuuauaggcauuuauauuccagauuauugugcuguuuacuuucuaguagaauauagaaugcaccaugcauuucugacucucuuuguccaagcacuucauggugccuucauccuucaucuaacgaugaugcuuucuaguuaucacagcaaguuaucuacuuccuauuuaagugacugucauacuaagccauggaaaaaguagaagacaugcauuaucaaagcugaguacagggcaguuccaguuccuaaucugacacccuaauuuuaugauuaauagucuugugcucccuccacuggccugaauugcuuuagguguuugauucuguagccugacugaaggugaaauuuaauaaucaucagguucagccuagaugugugaagaugacuaauuuagggcuguuacuacugagaaacaggaccuaaaauuuucuugacuugaacucagcccuuugagguaaguaaagcuuugacuagagcacugaauguacuggauaauuccggggagccauuccaggaugcauuuuuuaaaaaugcucuuaauauuuugaucuauaguauaacuucuuuugggacagaaugcauuguaucaaaaagaaaggaaagacaauuagagguugagucuaucaguggcucggaauuauacauaagcaaaucacugggacguguagacuauuuuuucugcaaguccacaguuuccuucaguggggaccaccccagauugcucaaaauuuagagauaaaugagaauagaggauagaugcuauccaguuuuaauugguauugcuaugacuguuuaaauaguaugcuuccauaauuuuauucuuuuaagaaagucagcuaauggaugucuucuuccacuuaauuuuuuucucuuguguguagcaccauuuacugauacaaguauauauucauuguuaguaauauguggcaaggagagaagggaacuggacaguuucuucaaugugaggaaaauuuuuauuuuaauuuaucaaacucccccuuucuguacuuaggacugaauuauuuuaucagaucucugcccccugccccgugccaccuggcacccugugauuucauggcauucccagcaguagcaucuguugucagucuagcgcuuuuucgugacauuuuccauguguccugguuugaugccaugaaagaugggauagcauagauuauuuguugggacauacauaaguauugguugggacauggaaugucagucccacugcuggccagaaguggagugaggccccugcacacuugugagggucugcacuucuucccccuaguaugucacagccuuaacagguaugucuauguggcagaugcugguuauucaacauucauucagcagugacugugugaagauuaauccuaugugggucaugaccucuggaugcugaaaggaagguagggcuacagagaaaaaaacauuucuccaugauuucauuacagaucgccauaaacgcuuagcacaacugcaaccgucuuccaagaggaauccucacuaccagaccuuggagcgggaucuuauugaauuacaggagcagcagcuguuugaacuuuuugugguggugucucuacagaagaaaccaucaggaauaagcuauauuccccaggucauacaacaauucccuggcaagguaggcacaaggaggccaagaggcauucaggaauguuccugugucucuguguacauguauuuccuguccucuugguuuuuguuaucucaacaaguuuuuaccaauacuguucuugugguaggaucugguggcuuugaaaacaucuuauguuagguaugagcugcaacccagcaaaacaaagcaaaacaaaacaagcucauuuuccuaguuaguuuuuuaaauuuuuggcucugccauuuaauaaucuuuaacaaguuacaaaaccuuaguuuucucauccuuaaggaggggaauaauaaaugugacagaauaggguagugguuuagagcauggacucugugugaaagcucugcauuucccacuuacuaguuccgugacuuuaagcaguuacuuuucuuuuucuuucuuuuuuuuuuuuagauggagucuugcucuguugcccaggcuggagugcaguggugcaguuuuggcucacugcaaccccugcaaccuccaccucccagguucaagccucuugaguagcugggacuacaggcgugugccaccacaccccgcuaauuuuuauguuuuuaguagagacaggguuucaccauguuggccagggugaucuagaacuccugaccucaagugaucugcccacaucagccucccaaagugcugggauuacaggcgugagccaccacguugugucuuaguuguuuaauuuguaaaauggggguaaucacaauaguaucuaccccucugagucauagugaggauuaaauaagcuaauuuauauaaggcacuuagaacagugucuggcauauaguaagcugaauaugauguuauccauuaucaguaaggauuuagugagguaauguauauagugcuaaugccaucccuggcacauaguauguacucaauaaaugguagguauuaauuuuugguagccauuauuauuaacaauaauauuugguuucucuaccuuuuuuuaaaaaauuguucauucuuuuaaucaaauauuuuaaaaauaccuaauauuugccaggauuagaugaugggaguacuacugaaaaagaucuucuuagucucuguuucacagagcuuauugagccugugaaccaguuaagcccacagacaugguuggguuucuuuugcuuugcauaguguuuguguaaaagaacaacaauaauuuuuguugccaacauuuaacaaucaaauuucacauacaaaucuguauuucugccuuuuccugagaaacuggaaagacugccaacacagccugcauuccuaagugucaggaauggguugaagcuuaauaaggagcaggacuucagagcaggugaccaguguaguuacauaaggcccucacucagaagggcccugcguguaggguuuaaugaucugcagucaccaucuugaaaugcuaaauaauuuuaucuuugaauuuguguuuuguaaaugaagucugguaggaaaacugggcaugugccaaggucuuaaagccugaguucaugcauggugucaccuucugcugcuucccuaggaugaguucucuuguuguccuguucuccacugccugauucccugggcccuaguaagugcccuuuccaccccuacucagugacuacugccacuuucucccccuggcugggcacaggcauugggaggguuaggaucagaccagcauugcccugcaacaucuccaggcaaggcauggggcagcuuucccuggccugggcugguggugccacuugugggugacuacuuggggauugcucaacugcuguggguuggaaugguggcccccaugggaaggggagaugccuggcuuaacuucccaaccccuagucgaaacacagagucucaauucugcagcuacccagagaggaaacccagcaccuugugggccacuuguguaccggauugcagacugcagcaccugggugucugggagagucuacagucaucccccaggauccucaugucugagggagugugacauuaaauagcaaauaaaaacuccauuacagaggccacagaagaaaaaagauguuuuauauuuaauuuguucugcuuuuugaacaaggggcuccacauuuucauuuugcauuaugcuaucugaauuauguaguuuuccuuaguaaggagugaucccuuuaauagggacauuuagucacucuccugcuuauuacuuggacgacuucuuucauuucaguuaucugcuuggccacuuuaggacuguuggguuuauaacccugaguuacauguuucacuaaaaaagcuggugaaguacaacuguacuggaaucuaagagacauuuccugcauggauucucauuuucaaaaaguccucaaaaauaucccugcaguaaauaaucaguaaguuuaauuucuuauaaaauuucucaauguagccugaaaguacaaugucacagcacuguuaagugacccagaauggcuacauaguuuguuuuuuuuuaagaaauuaaaggagcugugcacaguggcacauaauuguaaucccagcuaguuggccagcugagacacgaggaucacuggagcacaggaguuugaggccagccugggcaacauggcaagaccuccuucucaacaacaacaaaaaagaaauuaaaagggagaucauuguuauuaguuaucugaaggcaauaugguaauuagacuuaagggcuuguuuuuauagaggacaggucauacuaauuucuaaaugucugguuuacugaaauuuagacugucauauaaguacaguaccagauuuaugcaaaaggaucuucuaugcuaaaauuuuacaagaaguuccaaaccagcaauuagguagcaaagauucuaugcuaaaggaaaugauuauauaugggguggauucucaaaauaguaucuuuuauguuuucuuuuuuugagacagguuucucucugucacccaggcucgaguacaaggcgcaaucaugccucacugcagccucguccucccaggcucaagaaauccucucacuucucagccuccugaguagcugggacuacaggcaugugccaccacacccagcuaacuuuucuauuuuuuguagagaugggguuucaccauguugcccaggcuggucuccaacuccugggcucaagugaugcgcccaccuugggcucccaaagugcugggauuacaggccagugcaucuggccguaucuuuucuaaauaacauucaucuaccauuucaaagcuucuuugauuauuguuuggaaagugucuugagccgacuagguuuuuguucucaguacauugaagaauggauuuuuaucuuauaccccacgguucauaaaaauacuggguucccauuuagugugugaauccugaauuaagauuuuaccucuugauaggaaacuuuucacuaaucucucuuacaguagaugcugagauauccacagauaccauuucuaaguaaaaacaggauucuuuuuucuuaguaacucuguucucagugcauccucagugauuuccagaauugacuuuuuaauuuaguuaagcaguacaaaaccaugcugaggcuuaucagcaacuacucaggcuuaucagagaccuuuuuuccugagacaaggcugaguuuuuuauuucuauuccccacuuacauaguauaauuuaagucaccuaugguguuaucuuuuucaggaugaucauggcuauaagcaguccaaagacauggaagagagacuuaaaguuauuccaaaauuuuguuuuccugauucaaaggacuggaugccaaccucagaacucaagagguaaaugggcuaauuuaucugauuucuauucauuagaccugcaaaaauaaaucagaguauuugagaaauggguacagccauuagugaagcuaugugaauacuguggcaagucaaggaugugguaggaggaaaggaagaagcagaacuagaacauuuccuauguggggcuuaaaaaaauaaaaacguggaauaauuucagugucaaaaggaaaacaaauuugagagucucuucaguuugccaguucuacaaaaaaaaaaaaaaguucuauuuuacauacaaucagaaaugcucccaaguggacagaaaaugaaaaaagacuuggauuuugagacucaaccuagaaacagagauaaaacagagcagugucuucaucuuuaucuucuuucuucuucaaauuaacagaauaauccacagcccagcuuuuauguuccucuguggaaccuguacaaagggaggcuccaguuugggaaguguaguauauuaagaaaggaaguuauuaaaggauuucuuccagguaucuagaggaaauuacuacuuuuaauuaauaaacuaucauaaucucugaauucugcuuguaaauauuaauagaugccugcuuuguucaaaacuauaauuauugaugaugccauuuaguuugaaaagcuuuauucauugaaccguaucacaugguaaugaccuucuggauaauagccucagcuguugcuuaaauaucucugcacuucaacuucguguugcuuccagacuaagcuacuaucucucauaagcaguuuagccugauugacacucucaucucucagccaucacuguugaugcucuuguguugucaguugcacugcuaccuuuauaaacagcagcuuucauaguggccuggcugcucuguggcuggcuuuuccccacaacaaguuauauauguuuauucuagacuauuugggaaacacagaagaguaaauaaaaagcagaaauuacagaucacuggcagucugguuacucaaaaguaaucacuguaaauauuuugucauauucccuuccaaucuuuauuuuuagccaaauacagacauguauauauuguucaaguuuggauuuaggccaggugcaguggcucacaccuguaauccuagcacuuugaggcuaaggugggaggaucauuugaggccagguuugagaccauccugggcaacauagcaagucccugucucuacaaaaaauaccaaaagaacuagccagacacgguggugugcaguagcuacucgggaggcugaggcaggaggaucacuugagcccaggaguucaagguugcagugagcuaugauugugccacaguacuccagccugggcaacagagcaagacccuguccaaaaauaauaauaauaauaauaaaaggaaggaaggaagggagggagggaggaaagaagguagauaauaaauaugucuucagaaaauuaaguucuguucagugagacccagucucuuaaaaaaaaaaaaaauuggacuuggccaggugcuguggcucacgccuguaaucccaggccaaggcggguggaucaccugaggucaggaguucgagaccagccuggccaacauaguuaaaccccgucucuacuaaaaauaaaaaaucagcugggugugauggcacaugccuguagucccacuacucgggaggcugaggcaggagcauugcuugaacccaggaggcggagguugcagugagcagagauugcgccacugcacuccagccugggcgacagagugagacuccgucucagaaaaaaaaaaaaaauggacuuauuugauuauugagucugaguuucuuucuuggguauauuuagguuuucauuuuguaaauuaucaacacauaucuuuugcccauguuucuaaugaguugauauuuuucuuaauaauuuuuacauauuaaggauauaauccuuugccuauugcugcucuauacagccucucagaacuaaagagaagaauuuggaacugagaaauaacguaucaaaagucuuuguagcuuaccuaucuguuugacuaaauugggcauucaacaaaaggaaaauaaggccaggcacaguggcucaugucuauaaucccagcacuuugggaggcugagacagaaggauuauuugaacgcagguguuuaagaccagcccugucaagauagugagaccuuaucucuacacaaaauuaaaagauuaguggggcaugguggcacacaucuguaguuccagcuacuugggaggcugaggugggaggaucacuugagccccaggaggucaaggcugcagugagaucuguuugcaccacugcacuccagccugggcaacagagugagacugucuuaaaaaauaaaaauaaaauuuaaaugaaaauaacccgauuaauaccuagaguggaugaauaagaaaacaaaaggaaccaacaucaacagcuuaucucauaccuauucucucacuccaguacaaggcaagauauucuuaaggccugggcauuccuuaggaggaguguaacuugcaaugaauguaauauuaugccuccucuuagaucacuugaaaaccuggacucuaguuuucaauuguuuuuuccauggagaaugccguaagugguuguuuggauccuaacuagaucacaaaaugacuacuguuggacucuaguuuucaauuguuuguuccauggagaaugccauaaguaauuguuuggauccuaaacuaacuauuggcucuuuuuucagugaaacauucuccuuugucuugacuggugaagauggaagccggugguuugguuacuguaagaagcucuugguaaguaucagauuuguguuacagacaggguuggucaaggaauaauugagucagaguaggaacuucagaaacacuaucucuagaugaguuugagggaugcucaaugaucuguguauuaaggaagcuguauuagcuuuaaacagcaagaggaagguggggguuaaccauggaguguucuagaagagaagggguauggauuuauuuuauuuguuuauaauagaggaaguaacugaugacauaguggcugaaucucagucuggauauauuugaaauagaguacaaugagcuacucgaaggagcucugaguuacucaccaaccauauuagggcuuuuuucuugcuuggguggcuucacuaaaccuagaauaaaacaugcuaucauuuuuagcacuuuucacaucuuucaguguucacuaaagaugagagccuugguuacugcuccguacuaaagaguaguaaaagauaauuaauaguccaaauuaguauuaauaaaaauguaugcggcuugauuuuuuuguuguuguuguuuuuaucuuuuagccaguaggcaaaggaaagcgacucccugagguauacugcaugguuagucgccuaggcugcuucaaucuuuuuucaaaggugaguggagaaugagcuguaugaaaaaugguguccuuuuugagcucuuaauauuaaguggcauagaguuuaacauguuacuucagaaagguucccuauuaguaaacuaggaaccacgugccugaaggcuuaaacuuacaucucuaauccauuugcucuugcuauaucaucuucauuuugguuugcuagaacuuucagcuuaagggagaacauaguccaaagcuuaucuugucucgugucuuucuuagaccaaauugcaggauaucauugucacugucaccuucuuugccccucccuuagugagaugaaaaggggcuucuccuuuaaaaauaaguugauuuauguuaguaacuuuucuucaggguauaaugauaccucccaagagauaugaugcuuauuuaacuuuuauugauugcagaagcuuaucugucuuaaauuuuauuuggguuauuuuaaaguuuguacaccagguuuggcaguuccuguaauggcauucuuuuauauuuuuuaacuuaguccauaauaaaauaacacuuugcguauauagauucuggaugaaguagagaagagaagagaaaugucuccagcccuuguuuacccauucaugcgaagugucauggaagcuccuuucccagcuccuggacgcaccaucacaguuaagaguuaccucccuggggcuggagaugagguaaguuagcucauuuugaaaagauuugauagcacuaaaaagcaggacuuacacuaguaggcaguuuccagagcccaaggggauagauuucccuuuuccauaaacuguaaagaauauguuuuauuuccauaaagcacuggagaaauauccaguugaucugugacauaguucuuccuagacccaggacccagagauuuucuaccauacauagacugagucccuuuguaaugacaauuucaugugauaaaugaagacuguauauacuauugucagaaggaauacaggaucuugauuuacagcacaaaaauaagcuguuggguccuggcauuaguauaggaagcuucacagaccccguguagcagaccuuucuugaauuuaacuuauauaagaauaacaggauccauagcguuggcacuagggauuguuuuccaacauuagcucaccugauucaacuucuugcauuucaguccauugaacucugccgaccacuagauucccgauuggaacauguugauuuuaaaugucucuuuaagugccugagugugugucaucucauccgggucugugccucucuccuuuuggagcguaggguaaucuuuguugccaacagccuaagguaagaaauaagugaaauauguuacuucacacugguguuuuauuuguuccaaauuuuaaaauuggggcauuuuuuuuuauuuuacuauuauacuuuaaguucuaggguacaugugcacaacgugcagguucauuacauauguauacaugugccauguuggugugcugcacccauuaacucgucauuuacauuagguauuucuccuaaugcuagcccuccccccauccccccaccccacgacaggccccggugugugauguucccuacccuguguccaaguguucucauuguucaauucccaccuaugagugagaacaaaaauuugggcauauuuuugaaauguaggaucagucucucaguuaucuagugguauauaguggcauggauaauuuuaaaugguaaaucaucaaaaagccacuugcguuaggcuauaccaaugacuuuuguggguuguaauaaauuucccuuuuaaaugcauuuugcuuacccuauugucaaaaguugguaauacuuuucuaaguacacuaauuuuucgcaugagaaauuguggaaaugagcuggauuaagauugaacauuuucaguaaaguaaguuuaaauuuuaaguaaaauguuaaaaaauuaaugacuguuugcauaguuuuuaaucuaugaucacuaaccagcaucaauuuuuaauucuuuaacauaauaacugaaauguccuccuuauguuacucuauauaugacaccauuuguuuucuccucuggcuagcacccugucaaaauguggccaugcugugguagcuacacuguauccguucaccuggcagcauaccuauaucccaguccugccagcaucuaugauugacaucgugugcucaccuacaccauuccuuauuggaauccugucuugcuccuuaccacagcuccaggaccuacccauugaagaggugagauagaagaauggaaccuaauauuggagcauugagaaguaaaaauaagugaucuuaagagugguggaauuguuauuaauuuaguuauuacuauuuuaugcuauuuauaauauuucuauuaaauuauuauaauauugcuguuuauaauacuucuaguauuaagaugggaaaauucgauaguacacauaaauccaaagcuguaucuuauuuacaguaguaaccuugggcucauucuuguguuauucugaaggguacacuacucuggauuaacuuuaaaaauuauuucaaggccgggcaugguggcuuaugccuguaaucccagcacuuugggaggcugaggcagguggaucacuugaagucaaggaguuugaaaccagccuggccaacaugguaaaacuccaucucuacuaaaaagacaaaaauuagcgaggcauggugguacaugccuguaaucccagcuacuugggaggcugaggcaggagaauugcuugaaucugggagguggagguugcagugagccgagaucaugccacugcacuccaaccugggcgacagagggagacgcugucucaaaacaaaaacccaaaaaaccuuauuucaaauauaacacacauauagauaagugguuaaagcaaaauguacagauacauaaugagcauuagaauggaauggaaauauuaccacaaugggaucagugccagcccccuagaagaccccaucaugccucuuucuguuuccauccccaucccccaccaaagguacucauuaucuugacuuuuaugguauucauuuacuuguuuuugcuuuauaguuuuaccccuuggcauuccucccuaagcaauguaauucagcuuugucugguuuuaagcuugauauaaauagauucauaugguauauauauuuuugccuggcuucuuuuucucaacauuauaucuguaagauuaaucuauguugaugaggucaacaauagucugaucauucuaauuguauauaggauuccauugugugaauguaccacaauuuucuuauccauucuacaguugaacauuugaguuguuuccaguuugagguuguuaugaauaauguugcuauaaauauacaugacccucagugcauacacacaugcaguucaauggguauauacuuggaaauugaauugcugagucauaggguaaacauaucuccaacuuuaauaaauaaaguuaaauuguuuuccaaaguaguugugccaauuuaaauucccuucaacaguguaugagaguuccuguugcuccacgucuucaccaucacuuuuuaucaucaguuguauaauuuagccuaucuggugggugcguaguguuauucauauugugguuuaauuugcauuccuugauuccuguugagguugagcauccuucuauuuauuggucucuugaauaucaucuuuuauaaaaaucuuugucucuuuccacuacauuguuuacucucuuacuguuuuguuucguuuuugagauggagucucaaucuguugcccaggcuggagugcaguggcgugaucucagcucacugcaacuucugccucccagguucaagcaauuaucgugccucagccucccaaguagcugggacuacaggugcacaccaccaugcccagcuaauuuuuuguauuuuuaguagagacgggguuucacgauguuggccaggcuggucucaaacuacugaccucaagugaucugccuucuucggccucccaaagugcugggauuacaggugugagccacugcacccagccccuacucucuuauuguucaagaugccuuuuuuuccuuuucuucucuuuucuuuuugagaugaagucucacucuugucccccaggcuggagugcaguggugugaucucggcucacugcaaccuccgccuccuggauucaagcgauucuccugucucagccucccagguagcugggauuacaggugccugcuaccacgcccggcuaauuuuuguauuuuuaguagagacgggguuucaccauguuggccaggcuggucuugaacuccugaucccaggugauccgcccgccucagccucccaaagugcugggauuacuggagugagccacugcgccuggcguuaacaugucuuuuuauauucuggguacuggccccuuugucuguggcuugccuuuucauuuucaaaaaugauguuuuuuaaugcacagaaauucuuaauuuuaaugugguuaaaauuaucaaucuuuuucguuauagaugguguuuuuagugagcugcuuaaguuacuuuauauuaacuucaugaaaauauccuccuauaucaucucuugggccuuucauuauuuugccuuuaacuuuugauuaugaauccuccuggaacuugauuuuuguguguauaaugugaaguagggguugcuucauuuguuuuuauauggauaaccgucugugucgauaccacuuacugaaaagacuguuccccauuacuccgcugccuuguccuucuuuuaaaaaauaaaaaauuuaaaaaaaaacuuuuuauuuuggaaacuuuaaacauauguaaaaguaaacagaagagugaaaugaauccuuguguaccagucaccccacuucaguacuuaucaagucauggccugucuuuacucuuacccauuccucuuucccauaauauuuugaaggauauccugacacaauuucaucucuaaauauuacaaugugaaucucuauaacauaagggcauauuuaaacauaaacucaauaccauuaucacaccuaaaauauccaacaauuccuugauaucagcaaaauccaguguuuaaaucucuaguugucucauaaacuuuuaauaauuuguuuaaaucagguuccaaacagaguccacacauuguacuuauuuauuuauucauuuauuuguuuauuuagagacagggucucacucugucacccaggcuggagugcauuggcgcaaucacagucacugcagccuugaccucccagacucaaaugauccucucagaucagccucccgaguagcugggacuacagguguguacuacacgcccagcuaaauguguagagacagggucucacuguguugccagggcuggucuccaacuccugggcugaagagauccuccugccucggcuuuccaaagugcugggauuacaggugugagccaccgugccuggccccacacacuguauuuaguugacauauuuuuagucucuuuuaaucuauaggugugcaugucaucauucuuuuacuugcaauuuauuuuuuguuguguugauuggcuaacuuuuaaaugggcugaaacuuugaguaaauuuuguuuaaaacuauucucauugccuguauuugucugugaaugucucugguugaacuugccuggcuccuuuauuucauaggugcugauaguugaucucugugcagacaaguucuuacaggaggugagugccaaaggagguaauuacuuauguuuuaggauaaaugucuacuguagauaauuggacagacaauaugugaaaguacuuagagaauaugacucaggcaaaacuuuuaguuccuacacauacuugaauugacaccauggccaaucaugcaagauugaccugaaaaauuuggcuucaguuuauagcugccuaucccaaaggaggaaggaggaaacauaaaugucucauucucaaaagagguaaaaccacccuucaacuccaggugggucgacacauaagccucuaauuuaauuacauuuuaaaagcauuuauuaagcacugauuauuucuuuuuuuuuuuuuuuuugagauggagucucgcucugucgcccaggcuggagugcaguggcgcaaucucggcucacugcaagcuccgccgccuccuggguucacgccauucuccugccucagccucccgaguagcugggacuacaggugccugucaccacacccggcuaauuuuuuguauuuuuaguagagacaggguuucaccguguuagccaggauggucucgaucuccugaccucgugauccgcccgccucugccucccaaagugcugggauuacaggcgugagccaccaugcccggccaagcacugauuauuucuagauauucuguuagaauguaaaaaugaguaagacacaguuugaacccucaggucuuacagucuaauggggagaaacagacacacauaaaguuuuagaaauuguauaauagaaauuuguacaagguacagugggagcaaaaaugaagugaccauuuauucugaauauugaaguggaaaggaagaguucauaaagccuccucagagcagcccuccgcauauaaccuguauguaggagugugagcucugaaacacagggugaaaagaagaguguuucccaggacauuuucagaaucaauuagcucaucauguuugaaacacuauuuguggaugaucuucauaauauaacagaagacuuguagaugagagagaucugguggaaaagugccagaaaauuuuacaaaguauauauuuuuuuaauauaguuaaaauauacaccauaaacaugaaagauucuucauguagggaaggagacuucagacugacucuuuagccaaaauauauacagucacuuguggaauuuuggagaaauaacuagggcauauuugagacuuaaucccucaaaucucaaacaaagaaaaaucuccauuuuuuuuucuucuuaagguaucugaugaggaugaaauucuaccaccaaaacuucaagcugcccugaugcagauuuuggaagaacgaaaugaaaucuugacucaggagcagaauuuuucacaagguaugagacaagugagccaaggacuuaagguuaaggguuaagguaguaaauauuuacugaaugcccagcacuauguuaaaggauauaccaaaguagcauuagauugccugugcgcugaaaauccuauaaucagcuuccuugcuuauccucaguaugccagguccucuucuauuucaggaccuuugcacuugcucaguuacauuuauagaaugcuauucccgcagauauccacaugacuccugcccuuucuuccuguagguccaugcucacaucaucuucucacugaggcccuuccugacuguccuauauuaaauuguacccauuccucuagugcuccuuauccucuucccuuugcuuuaauuuuauucaaggcucuuagcacuaucucauauucuacagcauaaguuccgugagaacaguggcuuuauuuuguucucuaucucuaguacuuuaaacaguauucgguaaauagguacucaauaaauacuuguuaaauaaaugggcaaauaauauuuauuggguguuuauacuguaucaggcauaugcuaagcacuugacauacauuuuguuuuaucuuuaugaagcagguaucauuauuuaaucuucauuuuacagaugagaaaaggcuauguacugacagggaacauuagggaaggagcagcguuuuuuguuuguuuguuuuggguuuuuucuuuuucuguuuuuuguuucuugcucugucacccaggcuggagugcaauggugcaauuauagcucacugcagccucaaccuccugggcucaagcaauccuccugccucaacugggacuacaggcaugcaccaccacaccuagcuaaucuuuuuauuuuuuguagagacagggucucaccacguugccuagguugauuucaaacuccuggucucaagcaauccuuccgccuuagccucacaaagcacuggaauuacaguugugagccaccacaccuggccuagaaggagcagauuuagaggaguaauaaaaaguuuaguuuuggauguuacaguuugagauaccuauuagaaguuuaauacuuaagcagacauccaacuggaaauguuuuagaagaaagauuugggcuaaaagcaaacauuuagaaauugcuguuuuaaagcugugggaccagaugagaugaucguauagagugaguauuguuagaaaauaacaaagguuuaaggauugagcccuguguugguuguaaauggcgugguuagauuuccaacacuuggagguuggaaggaggagaacuauccagcaacagaggagcagccaguaaagaaggagaaaaaccaggaaaguauguguguaaacugccaggagugugggcagguacaguggcucacaccuguaaucccagcacuuugggaggccaaggcaggaggauugcuugaaccuaggaauuccaaacuagccugggcaacauaaugagaccucaucucuacaaaaagugaaaagaaaaauaaaaaacaaacaggagugugacauugcaaaaguugagcaaagagaauacuucaugaaaagaagaguaaucaauuaugccuacagcugcaaagagaccaaguauggcgacgauuaagauuugaccaguggauuugacaauaugaagaccuugauaacagcagauucaguggaaugaggggaagaaagugagaugggagaggguucaagacagaauuagaauuccauucagcaauugauuguaaaauuuauuauuuauuauuuuuauuuuuauuuuugagacagggucucgcuuugucacccagguuggagugcaguggugcgaucauagcucacugcagcuuugaccuccugagcacaagcaauccucccaccucagccagccauguagcugggccuacaggcgugcacccucacaccuggcugguuuuuuuguauuuuuuguagagacgggcuuucacgauguugcccaggcugaucuugaacuccugggcucaagcaauucacccaccucagccucucaaagccgugggauuacaugggugagccauugcgcccaaccauaaaauuuaauuguauguacaaagggccaagaauagccaaggcacucaaaaaagaacaagacuggaaggcuugcacuacuagacaucaaaaauuauuauaaagauaguaauuaagauaguuugguuuuggugcagaaauagagcaauagaaagaauacagagugcauauacauaaggaaacuugauuugugucagagccagcguuguguaucaguggaaaaaggauggaccauuuaauaaaugauacuagggccgggcacgguggcucacaucuauaaucccagcacuuugggaggcggaggugggcagaucacuugaggucagcaguuugagaccagccuggccaacauggugaaaccccaucucuacuaaaaauacaaaaauuagcuggguguggugguacgcgccuguaauuccagcuacucaguaugcugaggcaggagaaucgcuugaacccgggagguggagguugcagugagccaagauugugccacugcacuccugccugggugagagaguaagacccugucuaaaauaauaauaauaauaauaaaaauaauaauaauaauaauaaaugauacuaggacaauuggucucuauaugaaaaaaaugaauauggaucuacaccucacacuauacagaaaauuaauuccagugaauuuaaagacuuaaauguuaaaagcaaagcuuuugaaaauauuuuuaaaagaauagaagaaaauauuuuaugucaauaaaacaguggugggguucuuaaaaauacggcacaaagagcagagaccauaaaggaaaagacagguuaauuugacuguguuaaaucuuuacauuuucuuuucgucaagggacaccauggaaaagagauuuuaaaaacuaguuacagacuaggugaagauaucuugaauauauauaacuaucaaaugaauagugucuagaauuuauuuuuuuaaaaaacaccugcaaaucaguaagaaaaagauaaacaauccaauagaaaaaugaggaaaagauaggaacaaacauucaaagaagaagaaacaugauaagcccauaaauaauugaagagacaugcaaccucacuacaucauuuacauucagggaaguguaaauguaagccacaaugcaauaccauuuuuuauacccaccauauucacaaaaacuaaaaaaucuguccaggcacugugguucauaccuguaauccuagcacuucgggaggucaaggugggagaaucacuugagcccaggaguucaagacgagccuguguaacacagcaagacccaguuucuacaaacaaaauuaaaacauuagccaggaguguugaugugugccuguagucucacuacucaggaggcuuggguggaaggaucacuugcgcccaggaauuugaggcugcagugagcugugauggugccacugcacucuagccugggcaauagagcaagacccugucucaaaaaaaaaaauuaagucugacaauaucaaguguugguaagaaugugucaaguaguucaaccacuuugaaguuggcauuaucuaguaaaauuaaagguguacauauccuacaacccaacaguguaguuuguaaauacauacccuagugaaucucuugcacaugaucacuaggaaacaaguucaauaauuuuuuuuuuuuuuuuuuugagacggagucucgcucugucgcccaggcuggagugcaguggcgcaaucuuggcucacugcaggcuccacccuccgggguucacaccauucuccugccucagccuuccgcauagcugggauuacaggcgccugccaccucgcccggcuaauuuuuuguauuuuuaguagagaugggguuucaccauguuagccaggauggucucgaucuccugaccucgugauccgcccgccucagccucccaaagugcugggauuacaggcgugagccaccgcgcccggccaaguucaauaauuuuuauagugccauuauaugugauagcaaaaacuaaaagcagggugaauauccauuuucaggagaauaaagccuuaagaaugaauuuuuuuuuugagauaagguuucauucugucaaccaggcuggagugcaaguguugugaucauggcccacugcagccuuuauccccuaugcucaagcaauccuccuuccucagccucuugaguagcugggaccacacuucugugccaccacgcucagcuaauucuuuaauuuuuuguagagauggagucuauguugcccagccuuguccuaagcucuugggcucaggugagcugccugcuucagucuccugaaguguugggauuacaggcaugagccauuuuagcugcacccagcuaaaaaugaaucuuaaaaacauauauugaauaaaacaguaaguugcagaagaauacaauauuuuguauaccguucaaagacauacaaaaaccuacuaauaugcuauugggguuuuauguguguauagugaaacuauaaugcagggcaagggaauaacaaauacaaaauuccauggucacucuguuggaaaguagaagaagaaugccauuggagucgcauaggaaacuucaaagacauuaguaauguucuguuucuaagcuuuguuugugguagagaauuuauucauuucacuugugauguuauaaaauauucauacauaucaaagaauauguaaaguauauacauuaaaaaggaaagaauaaagaaauuauagaaaaacauaauuuuuaaaagaaagaaauuaagauguagcagugaggcaaaaguguugaagauaaaugcaguguuggggcugggugugguggcucauaccuaugaucucaagcacuuugggaggucaaggcaggauaaguucaauaccagccugagcaacauagcaagaccccaucucuacaaaaaaaaauuaauuaaaaaaaagaaaaaagauaaaugcagugaugaacauggauucucagcugcagaaggaaagagaugagaaggaaggguguuggacaaaauauaacaaaaaccuagauuacagucaaaauguaauucagaaagagaccuuggaaaucaccuggucagcccugcuagcugcauagauauggacaggccaacugagaaaagugagccacccacuauuaugcaacugcuuuaugguagaacucugacuaaauuuagguuccugauucccauccuguguggaucccugggaaaagagcaagagacagugugaagagggcggggggaaaaagacgauuuggauauggaagaaaaagagggaguguaagucgaaucugaaguuugagccugggaccuggaaggcaauauaauguaguauauuauagggauuaaaaaucaccugacuugugaguccagcaucuucacuuacuaggugggaugacccuggagaauuuauuuaaucauuuggcaucucaguuuccucuguaaaagaaaaauaaaaauaauagauuauuauguuuguagaagcacuuaauacaguacaacauaccuuuagcacucaaaucacuauuuuuauggaauaauuauagugcaguaugaaauggcaaugucagccaggcaugguggcucacaucuguaaugccagcacuuuggaaugcugaggugggagaauugcuugagcccaggaguuugagacaagugccugggcaacauagcaagaccuugucuguauuuuggggaaaaaaaaucuuuauuuaaaaaaaugggaauauugagagggaaacuuauuugguggggaaauauaauggguuuagcuuuagauauguauuguuuguuuaauugauucauaguccaaguuccaaaaagaaccugauauagugaccuuuagacagauggaacuuaugugcuaaugggacagccaaauaauaaccacccguagguagccugaaaauguagaagaugagauaacagggcuggaaaacuaagguuuggaauuacaguauuaucauagccagcucuaucucugugccaguuagcccuuuacggaagggaauguugaagaggagugucugagcaccaugcucaggaagagaaagaaaggacaagagaaaaauaacugcuuugucaucaagucaggaaaggaaucaggaaaucagaagagcauagaguuguaggggacaagagaaaugaggagguaguuagcacaaaugcagcauggagcuuaaaggagauaaaaauagaaaagcagauuaaauuuggcuggcucucaccaguggccuuugaaagugcaguuaaaaugaaaucaacagaugugcaagccagguugcaagauguagaaggaguauguaugggaagaaaaugaagggaaggguagaagcaauuagccuuuucuaggucgugcagaaagaaagugaagaaugaacacuccuagauuuauucucaguccuuuaaucuauaacuucuuaggcacgacuuccauaaccagagccaguguuuccagauacagauaacugaggagauuuuuuucuuuuuuucuuuuucauguugcagcagaugugacacucaacucucugguguccgaagcauuugucagguuuuuuguggaguugguaggacauuauucuuugaacaugacugucacugagcguggggagcguguuuuccaaagggaaccauuccguaagucccacaccucccgaaguguacgccacuuccuggaucucuucauggaaacucagauguuugcaggauucauccaggaccgagagcuucggaaaaguggaguuaaaggucaguuucauuauaaaguucucccucucuauuuagugaauaccuugaaagauuuuacuauauuaugaauaaaaaguauuguaaagcgacaagggcuuaaaaucugaguuguuuauuaugagaauuauuuuguaauauuguuuuagcccuggaaauaauacacugguuauaagcacagaauuuuauguaauucccagucuggaguguuacacaguuucaccaacaugaguuuuuccuuguagguuuguuugagauccgggccauccaguauuuggaaacaauuccugagucggagcccagugggaugaauagaauuuugcggagucuugguuaguugcuguguuuuccuguuagauaaauguggcugaagaccaggcgcgguggcucaugccuguaauuccagcacuuugcgaggucaaguaaggagguuugcuugaggccaggaguuugagaccagcgugggcaacauagugagaccccaucccuacacaaaauuuuaaaauuagcugggcaugguugggcaugguggcuuaugccuguaaucccagcacuuugggaggcugaggcagguugaucaccugagguuaggaguucgagacuagcuagccuguccaacauggugaaaccccaucucugcuaaaaauacaaaaauuagccugguuuaguggcaggcaccuguaaucccagcuacuugggaggcugaggcagaagaauugcuugaacccaggauauggagguuacggugagcagagaucacaccauugcacuccagccugggcaacaagagcaaaauucugucucaaaaaaaaaaaaaaaauuagcuaggcaugcuggcacauuccuguaguucuagcuacgcaggaggcugagaggcccgagggggaucgcuggagcccgggaguuugaggccucaguaagaugaucuugccacagaugacagagugagauucuugucucuaaaaaaauaaauaaauaaaaauuaaaaaaauaaauaaaaauaaauaaaaaauaaauaaaaauaaaaaauaaauguggcugaaaaagcuuugcaguaagugggccucaucacaaaagcuuuauaaucagaucagcaauauagccuuaaauaggcugaccauaaaccaugaugcuaguuucaaaguguuuuggagaaaaagcagcauuuuucucaaaauuugggaucccucaucagaguggucuguggggccauuucccagagaugaacuucccugauauaaguuuauuuauuucaugauauguuugcauaucaucauuauuaaucauuucuaggacacauuccuuggagaaucuuauaaaaaccaugguccuuuuucccagaaaaauguauuuacagcauauaaauaaauuuugcacauaauuuuaggcugcucauauaccccaugaagucuaucuuugguacuccagauuaaaaacacuugguuuagagggacuucugaggcaaaagaggauuucuuacaagucucuaauuuucuacuucauacagaaacacauuuaugauuuuucaguaauaguuaauuaguaugauacaagagaacagggguguggcuagccuaaaauaaugaauaaccuauaugcuacgauauuuauauuuugucuuugaaauauaugcccccuaauuaggcccuguccuucacuagcugacagaccauggacaaauuaggccuuaggcuguuauuucaucuuuauacaaugggguuagauuagaucagugguucccagcucugacuacauuuuauaauuuccagagaacuuaaaaaaaauuuuccccugggcuccaggaaaucucuggggagaagccaggugauuuuaaccuauagucaagguugaaaaccacuggauuacaugaugucugaguucuuuucugccgcuacaauuaacuagacauaugggguuugggguucauuuuuguuuuuguuuuggggguuaaacacaucaacugaguuugagaugucagcuuaacucuugggcuguucugaaugacugaccuguuaaucccuuaccucaaauaauguacaauaaauaaaaaugaauugagcauucacuguacuuuucuuucccuuuaggaagcaaaaugaaauuucugcaaaagaaaugaaaucucugauugucuccauccugaauauacaacagaaagugccaaagaaaauauuuuucuaagggucaggaucccaugaaguauucuacaaaauucuugaaauuuuaaaagguuaaagagcgagucaggcuguuagaggaggauucuccuguugcugcuguaguaaucacuggagaauuguugggaauggucuggcaccaugccaucuuuacucugucuccauuuuuuuuuuauagcagccuuuucuaugugauucuugggcucauucucuguuuugugcuuugucugugaaaguaguuguguuucacaaggaaaagccuuguuguuguuacauuuaaaaaauagcucaaagaugagaauaaugagagaaaugcugaguuuaagguaguagagagacaugauggaaauggagaacacuagccuuauacacauaauucucaucacugaacuaucauggccccuuuaaacccaugggcuguuugaccugggcuaaggaauagacucaucacauaucuccauuguuuugccuuauauuauaucuaggggaaucucacuuaggaggaagcccuacuuguaauauuauaagguacuguuauuaaguaccuuauaaaauuagacaucuugcaacuccuccuccaaauuauguggcauuugaguaguuugcuugugccucacaugucaacauuaaacuuuguggaggcuggaugcaguggcucacaccuguaaucuccaccacuuugggaggcuaaggcaggaguuugagggugggaguuugagacuagccugggcaacauagcaagaucccaucucuacaaaaacauuuuaaaaauaaguaaauaaauuuaaacuuugugaaauuauagcuaauaugaaaauguccuuucaagggcaugggagccaccuuuauuuuuuaguguccaccaugugccaugcacugugguauauguaugcauaucaucucaaccaauccuuaaaucaaccuuaugagauagauauuugcaucuccauuuuacuaauaaacugag

SEQ ID NO: 191324 - RNA, 14085 nt, Homo sapiens
auaacugaguuuacgcagacgcagaaaacgcaggcaaaccugagguccucagaauggcgggcacagguuugguggcuggagagguugugguggaugcgcugccguauuuugaucaagguuaugaagccccuggugugcgggaagcggugagugcggggugucuuuguagcugacucacugcuagcuggcucgguacugaaagaaacauguuacaauuugccacuucuacccuggucccuauucucuuucuuaggcugcagcgcugguggaggaggaaacucgcagauaccgaccuacuaagaacuaccugagcuaccugacagccccggauuauucugccuuugaaguaaguaugucuugagccuaggugugaacgagaauuccugugaaccuuuauuuuggauugagagcuuuaaauuccaguuuuaaccauugccugcauagcuacuacuuaccuacuguauaggugucagucuauugaaaacaacuagauagauaagucuucuccgagguucuuauucuaagauccauaggaagacuuucuggggcuccacaacucacuuaaugcaaaaauuuguggcuaccauucuuugagauaggauccaugcguaaauucucaaagggacccucuccugccaagauucacucuacagcaagugaucuaggguuuuuuaauauguauaagccuaauuaccuaagcucuuuagaaccacuggagaguggcauauuaaagucuaguuauuuaccaaauguaugugauacgacugaaaggacaaaccauauccaaguguauacuacuuuuuucucagccuucuccuuuuuucuguaaucuauccgauguuuuuauuaacacauuucugauuaauguaggcaauaauuuucacugauaugaauacuuuacaagugcuaggugccauucuagauucugagaucauagagauauaugggguuucuuuuuuaauauauuuuguuuucuuuuaauuuuucuuuucuuuauuuaagacaaacauccucuccaaaaaagauaggguuucugaauacagaaaaauacaauacagugaggagcuagauauauaaaacaaaaaguuuacaauaguauguauaaauguguaauaauauguaaaggaccuauagcggaggguauguauaaggacaagaggauuagagaagggaguguccaugauugccuaaggagucagaugcuguucuacuccacacauugaguaugauacuauuuuaaauguauaaccuugaaguacacccaggauucuaguuagggucuaguuagcuaaaugaaauguaagauaucauuucuaaauuauuggauucaaguauuucaguauguacagcuuggaggauuuuuucccauuauaccuaaucguuuauuuaugaaaggauuguauuauuaaaaggcaguauuuagcugggugugguggcucacaccuguaaucccagcacuuuaggaggcugaggugugaggaucacuugagaccagccugggcaacauagugagacccuuucucuacaaaagaaaaauuaaaaaguuagccaggcaugauggcaugcaccuguagccccagcuacucaggaggccaaggugggaggaucacuugagccugggaguucaagacugcuacagugagccaugauaaugccauugcacuccagccuggcaauagagugagacccugucucaaagggaaaaaaaaaaaaaaagauauuauuuacauuaaaguaacaugaaaaaauuguuaguuaaguuuguuguuguuuuuguuugagacggagucucauuacgucacccaggcuggagugcaguggugccaucucugcucacugcaaccuccaccuuccgggcucaagugauucuccugccucagccucccgaguagcugggauugcaggugccugccaccaugccuggguaauuuuuguauuuucaguagagacgggauuuuaccauguuggccaggcuggucuugaacuccuggccucaagugauccacccaccucagccucccaaaguguugggauacagguguaagccaccaugcccagccuuggcugaguuuuaaguagaagacguauguuccuaugaacguguuuuccuaugcuuuuucuaaauauuuguaccuagguguagauguuaaccacauuaagaacuaaguacaguaaugcuuccuuauuggacugauuucugaagguuucagauaacugcauucaaucacagacuuuuuaaaauacuuuugccaguuuuuuuccuucucucuuaaauaccuuuguaauuaguuuacugaugauuuaauuaguaaacucccagguucaagugauucuccuguaauuaguuuacugauuauuuaauccuuucuuuuuuugagacagagucuugcucuggugcccaggcuggagugcaacuccucggcucacugcaaccucugccuccuggguucaagccauucuucugccucagccucccaaguaguugggauuacaggcacgcacuaccaugcccaacuaauuuuuguauuuuuaguagaaacgugguuucaccauuguggccaggcuggucucgaacuccugaccucaagugaaucaccugccucggccucccaaagugcugagauuacaggugugagccaccacaccuggcauccuuucuuaguaauaguugguaauauuuacuggguucacugucuuacuuggugcacauaacagcucuauaaacuauauaacuauguuugcuauccccauuuuuuagcugggaaaacugcagcuuagagaggcuaauugacuaagaccuuaacuguucuucaaacugccucugaaauuacucuuucauuaauucauuuaacaacuauuuacgaaggucuguuccauucuggguauuggagaacaguaucggcaggguccauacucaugaaccuuaaaaucuagaguguugagacagacaauaaauagaucagaaaaauuguugauaaaugcugcacagagaaugauagugauaaagugacugggcgacuccagguugggugguugaggaaggccucucaaagcuaagaugagacuacuccaugagcagggauugcccuugccgcuccaugaacacuggcuuagucuuuggagagagaugagcuaaaauuccagauuuaucacuuacugagcaugugaguuaguuaaggguuccuccuaugcuacauggcucaagacuacuuauacugcauuuuuauacugccucguguuuaauuggcuguuuacuccuugucugucacugcagaauuuucuagcuagaaugcccugguuuuuuuuuuugcaggaaacuagguaacuacauuuucuuaagauuguguguaauuuagcaguagccccugcaaaauacuuucugcagaaagaaaugcuuaauacgaaauuuuuuguuuuuuguuuuuuguuuuuuuguuuuuuuguuuuuuuguuuuugagaugaagucucacucuguugccaggcuggagugcaguggugugaucucagcucacugcaaccuccaccucccagguucaagcaauucuccugccucagccuccgaguaucugggauuacaggcacgugccaucacgcccagcuaauuuuuguauuuuuaguagagaugagguuucaacuuguuggccaggauggucuugaucucuugaccucgugauccacccaccucggccucccgaagugcugggauuacaggcaugagccaccucgcccggccuaauaaaaacuuuuaaacauucaugcaggcuucuguaaggccuuugauacuuauuuagucuaauuguuaagauaguugaaacccucagaaaauuaaaauuacauggaauaaccgaaguauuacuacaaagaaauauuuuaagcaguucuuuauccucaggguaggaaaugugcagaauggaaauggguuaggacguuggcccuaaagaggaacagcuauacuacauuuacuugcgaacaguaaaauugcuagagaagauagugaauauaaagaaaagacacuuugggaggcugaggcaggccgaucaccucaggucaggaguucgagaccagccuggccaacauggugaaacccugucucuacuaaaaauacaaaaauuagccaggcauaguggcagaugccugucaucccagcuacucgggaggcugaggcaagagaaucgcuugaacccgggaggcagagaugagccaagaucgcgccauugcgcuccagccugggggacaagagcgagacuucgucucacaaaaaaaaaauaaauaaauaaauaaauuauuucuuggauuucuggaggcuggaaaguguacgguucacaggcugcaucuggugagggccuucuugcugguguggacuugguguacaguccugaagcagcacagggcauuacauggcaagguaggggcacacaagagaaagacaaacuggcuuuuauaacauacccacucuggugauaacuuauuaacccaugaauggauugagccuucauaacccaaucaccucuuaaagaccccaccucuuaauacuauuacauuggggauuaaguuucuguaugaauuucagaggggacaaacauucaaaccauagcacugucgaacugauucugauaugcuucuggaauuaagaaccacugguuuaggauuaauccuuuucucugugggcuccuuaauacaugccacuuuuccugaaugugaagugagugagugagugugugugugugugcuucagauucuagagagcauuuaacucagagaagaauuagggaaagguaaacaauucauuauaauggguaguguagcuuaaaucuguucuuuggugauuguuaauuuuuaguugucaacaugaucuuagaaaucuuuuuucugauuuacacaucagacugacauaaugagaaaugaauuugaaagacuggcugcucgacaaccaauugaauugcucaguaugaaacgguaagaauauuaaaauggaaauuaaaauuuaguuuguaguaacucaguaaugagcugagauuugugaagaauguauuugcuggcuaauauuggcaguguuggccgggugugguggcucacaccuguaauuccagcacuuugggaggccgaggcugguggauugcuugaauccaggaguuugagaccagccugggcaacauggcaaaaccccaucucuaccaaaaauaauuaauaauaauaauaauaauaauaauaaacguaccugggugugguggcacgcacccguggacccagcuacuuggaaagcugagguagguggaucgcuugacaccccccaggagauggagguugcagcaagccgagauugugccacugcacuccagcguuggggacagagggagacccagucuugaaaaaaaaacuauauauauauauauauagagagagagagagagagagagagaggcaguguugaaggacugacuggguaguaugaagagagaauagaaggagucauaucgcuucucauuuuuuucucuaccggcgcauggguauguuaguggaugggugggugugaguauuuuacaaaaaugguagcaaacuuuuuugucuacugcuuuuuccccuuaauauauuacugacaucuuaauauuauuaaauauucuucaguaacauuuaauagcuaauguaacaaucuuuuaugugaauguaauguugcuuauuuaaccaguucacauugaagugaacauaauggugcuaaaucauauuuguaaauugauuguuagcauauaucgguuucuuauuauugcaagguuuacauccuuagucuucuguaguuuuuauacuauauggagacucaugggacauucuacugagaagagauguaaaggcuuggcaguauagaugguuuuauuuuauuuuguuguuuaauuucagauaugagcuuccagcccccuccucuggucaaaaaaaugacauuacugcauggcaagaauguguaaacaauucuauggcccaguuagagcaucaagcaguuagaauugagaaucuggaacuaaugucacagcauggauguaaugccuggaaaguauacaaugaguaagaaccuuuuucuucaucuucuguuuuuuuuguuuuuucucuuuucuuuccaucucacccaaaguuuuaguacauuuuaaaaguaugggaggugcugggugcaguggcucaugccaguaaucccagcccuuugggaggcagagguggguggauugcuugaggucaggaguucgagaccagccuggccaacauggugaaaccccauuucuacaaaaaaaaaaaauacaaaaaauuagcugggcaugguaacgugugccuguaaucccagcuacucuggaggcugaggcaugacaauugcuucagccugggaggcagagguuguagugagccaagauuuugccacugcacuccagccuaggcgacagaaugagacucuaucucaaaaaaaaaaaaaaaaaaagaaaagaaaaagaaaagccgggcgcggugguuuacaccuguaaucccagcacuucaggaggccgaggcggguggaucaccugaggucaggaguuugaaaccagccuggccaacaugguaaaaccgcaucucuacuaaaaaaaaaaaaaaagauuagccggccaugguggcgcuucuguagucacagcuacucaggagacugggguaggagaauugcuugaaccugggaggcagagguugcaaugagcugagauugugccacugcacuccagccacagugacagagcgagacuccaucucaaaaaacaaacaaaaaaaccccacaaaguauggguaggggaagugugauaaaaauaauauagcuagacuuugucuugggauuauguucuagaacugcaacccauaugaaaggccacuauuuugaaacccaccucaaaguucaagaguacuaacaggaccuaaaccaaacuacgacauuuauuguauaauauuguaacaaaacuaguucugaggucccauuugcagagcaccacuugauagaauguuaucaagcguugcuuaaacaguugauucucauuagucauggguuauguucuuuaaguccuaugaacacugaauuagcaaauacuguaccauuucuccuaggggaaauauauacauauucaugugcacacauauacauaucucucaaauagauuauaaucuuaaauccuaaaauaaacucauccugguagacuucuuuauuuuauaaaagagaaaacaaaguugagaaauguaaaguaacuuucuugaaacugccccacuaacagaucccagacuuggaacuugaacuucauccucugguuauuucuguaugagagcuaaaacaagaaggcaaagcaccuccuuguucauccucagcugaaaaugugcaugcucagcugcucagauuuuucaccacugugcacauguccaugaaugacugcaaaacacuacaaguaguaauuuugggauuacaaauaaauuugagcaaguauuuguugucaaaacaagccacugacauccuguuucuguuccauguaacuagcucuagcuuuaguauuuauugucuaucuagaauucagauuccuugcuugcaaaauuccgugguuagauuaucugcauggccccuuugugcccuaaaauuuccugagugucuauucacaauuuaagagaaaaaggccacugaacuucauaacaguauguacaacuuucguuagaguauguuuccugaaacauagcuauauaaaauaaagcaaaaccaugaaaugauaauacuguuucucaaaucuucagaauuaugcauuuaauauuuguagccacauaaaaaugauccaguggacaaaauccagaauuugggaaacucuacaaagccaacaacuaacuuucuuuuauauaucuauauauugcaaggggggaaaaagaagaaagaaugggauuagggugauuaagaaauguaagcgacaucaauaaaucuguuucacaaaauggaaaaaugugauucuucucaagaagcuuuaucuaauggaagagauaauaaguuuuaugccaaguaaccaauaguccauuuuuggcaauaugggggcaagugcuacauugugugcuguggucuguaaacuaagcguuaagagauggggcauugccaggcgugguucacgcuuauaauccuagugcuuugggaggcugagacaggaggaucacuugaggccaagaguuugagaccagccugggcaacguaagugaaacccugucucuauagaaaacaauaaaaaaaauagccagguauggugguacacacuuguagucuguuucaaaaaaaagaaaaaaaaagauggggcauuaaguugaagguuguugaagaaaggugaaauugggauguuuagaaggaaacaaggaaaacauuccaggaauggagagcauagaugcagaggaaaaaauaugacauugaaaagaacacugcugucaacuuaccugaaaaccuuuaauaauucccuauuaccugcaagguagaggccaaguuuuuuuuuuuuuuuuuuuuuuuuuuuuuggaggugggggcggggggcgggacagaaucuugcucugucgcccaagcuagauugcagugccacaaucucagcucacugcaacccucccggguucaagcaacucuucugccucagccuccagaguaggugggauuauagacaccaccacgccuggcuaauuuuuguauuuuuuguggagacgggguuucaccauguuggccaggcuggucuugagcuccuggccucaagugauccuccagcaucaaccucucaaagugcugggauuacaggugugagcacccggcugggccaggcuuuuuaacgugguauucaagggcuuuuccuuacuaccucaacuguagacuuuuaacucaacccaaacuaguccuuucucuggugauuauugcaaauccugccucugggccuuuacuugcccuugucuuuaccuguuauacccaaauucagcuuguuuagggcucagcucuaguuugcuuacuugucuucuucccugauugaaauucugcuucuaguauugucucccucuucugaguaacuauacacagaauuauugugcacaucacuuguuuuccauuuaaucacaaagugcucuauagugcuucacauuccccuaagcauauuuugucuccuccaaauucaguggacacuucuccagaggagauguacuauauuuuaucaaaguauauuuaagaggaagggugggagaagggagaagacaaacuaaacuuucagggagagccaauucaaaggaaagcucccuguuaguggucagaagucuggaauagagcacuaaaaucaauagugcucagcauggagugauugucgaagucaaggaaagggggaugaccugagggaaagccuagagaggcacagcuguuuaaagacugaaucuugagagaauugcagcuaaugcaaggaaaccagucaguagagguaggagaauaacucaggugagcaacagaaaauuugagucacaaaagccaggaaacaauauuagauuuagagcaagaacacauuagggccagaugugguaaaaauggacccuguaggugauugauccacugccuuaagaggaaauugauaugauguggaauuauaucuuaauaaaguuguuauuuaaacuuaaaaaagagauuaaaaucuguuucauuacuucucuaaaauaauuauaugguacucuguauuauugaacuuuuccccugugcuaguuacagcugaccuggacugguaucuauuuuuuauuuugcuaugcauauguuacaugcaaauauggacugauaucucauucuacaacaguuuucuuuuucucaccucucucuaguuagcaguagacaggaggagagaaugacaaggugaauguauaugcagaaauauagagauaaaaggggguugagaaauaaaauaaguggguacucagauauauuccaucuuuucuaugacaagaagucaugacaguuuaagaagugacaaaaggccguguggcucacacauguaauuccaacacuuuggaggcugagguggggagauugcuugagcccaggaguucaagaccagccuggacaacguggugaaacccugucucuacaaaaaaguaaugaaaauuagccgggcaugguggcuuaugccuguaauccaagcuacuuugaaggccugaagugggaggaucaguugagcccaggagguugaggcugccaugauugcaccacuacacuccagcuugagcaacaggagagcaagacucugucccuccccuccgcaaaaaaaagcuggguacaguggcucacgccuguuaucucagcacuuugggaggccgaggcagauggaucacuugaggucaggaguucgagaccagccuggccgacauagugaaaccccaucucuacuaaaaaaaaaaauacaaaaauuagcaaggcauggcaguacaugccuguaaucccagcuacuugggaggcugaggcaggagaaucucuugaaccaggaagcagaggcugcagugagcugagaucucaccacuucgcuccagccugggcaacagaacgagacugucucaaaaaaaaaaaaguaaccuaaguacuccaagaucaggcagggcaugguaaucccagcaguuugggaggccaaggugggaggauugcagcuccuugggaggcugaggcaggaagauuacuugaucaugggaggugaaggcugcagugagccaugaucacaccacugcauuccagcaugagugacaguccucgauuauggaguguccaacauaguucuuggcacagagcuccauaaauaugauuuuuggcagaaaaacuugaaaaaguucacuuuuaauugguacuauuuuaauguauuuuaaucugauuuuccucuuuuccuucagaaaucuaguucauaugauugaacacgcacagaaggaacuucagaaguuaagguaaauuguuuuuuccuauuacagaaugaaguuuaagugaaccuuuaauaaauagaaaauaggaggaaaaagaaagcaaagagacugcagccagaugaaaguaaacaauugauccacucucuuuguucaacaucugacacuggguuugcccuaccuaaguagaggagaaauaggccugaggucugaaaacaucucugccacuugcagcuugcaagucugcaaacauagaaaggcacuuuuagagugggaaaaguugcagaauaacacauauaaucugauuuuuaaaaccaauuucuacacacacauauaggaaagccuggaaggacacccagcaaaaacucaacaggaguuaucaggaaaaaggagacaugcaugagaggggggacuugagacuuguaaucugugugugcuugugugugugugugugugugauuucucacaaugagcauguuuuaugaaacuuguaaucaaaaaauaauuagaagaaagguaauuucuacaguuagccuauaacuguacauaauauuguucucaugggauuaagauauucucuuguguuauagaguuuucuguugauuuaggucuuacauuaaaauguaauuggguuguauaaauaauuuuuuacagaaaacauauucaagauuuaaacuggcagagaaagaacaugcaacucacagcuggaucuaaauugagagaaauggagucaaagugaguaucuauaauuccaucaucuuuuaaauuguuuagcccuuucuaaggucgauucaauaauaugauucaaauagcauucaaaugggaugccacagguaacaaagaaaugcuauuuucugaauucacccuuccccgucucugccucuuuauaagguguuaaagagaacuauaaacgagaauugaaccauuggcgaaggauccuuugcuaaauugaaccauugcuaaaggauucuggucuuagaauacccuguuuuuagucuaguauuuuuggccuugaauagaacucuaccuuuauucuccuuuuaaacggaaaaaaaaaaaaaauaggcacgguggcacaugucuguagucccagcuacucuggaggcugaggcaggaggauugcuuaaccuggaagguugaagcugcagugagucauaaucacaccacugcacuccagccugggcaacagagcaagaccuagucuuuaaaaaaaaaaaaaggaaaaaaauuauuuuauaaaaucuuguagggagggagauuucauacuugguaauuuuuuuguaccucagguuuaugcauuuuuaaaaauguucuuuuacauacacacauguauaccuuuauacaauauaaucuugaauauuugugucauuucucucuuccuuuuugcuuggccauucccuuucucccuucauuacucaagucauucuuguuccaccgucuccauguacgucuuaccagucucguugguacccuuucacgcuuuuuccucaauuuaauaaacuauugccucuuuccuuuuuguugauuaaauacuaucuucaucacucuuuccucuuucuucugguuugcaaguucucucaucuguuucuaauuugcuuuuuuauuaaacuuuuauuuuuagauaauuauagauucacaugcaauuguaagaaauaauacagagagccagguguggugacucacauuguaauccuagugccuugguaggccaagguaggaggauugcuugaagccaggaguucaagccagccugggcaacauaacgagacccugucucuacaaaaaaaugcuuuuaaaugagccaggcaugauggcaugcaccuguagucuaagcucuucaggaggcugagguuggaggauugcuugagcucaggaguuccaggcuagugagcugugaucacaccacugcauuucagccuaggcaacagagcaagacccugucucuggaaaaaaaaaaaaaaaaaaaaaaaagaauacagagagauuccauguacccuuuaccuacuuuuccacaauugugccuugauuuuuuuuuaauggaaaguugaaagugaagguuaggccaggcaugguagcucaugccuguaaucccagcacauuaggagaccgagguggguggaucaccuggggucaggaguuugagaccagccuggccaacguggugaaaccccaucucuacuaaaaauacaaaaaaguagccagcugugguggcgugugccuguaauccagcuacucgggaggcugagucaggagaaucccuugaacccgggaggcggagguugcagugagcugagguugcgccauuguucuccagccugggcaacaagagcgagacuccgucucaaaaaaaaaaaaaaagugaagguuaguguuauagcucugggugaacauguguauacauuuaaaauaaaaucuucuaagagaaguuuuacauugaguaauuuuuuucuuuucuucccccccauucuaguuggguaucccuggucaguaagaauuaugagauugaacggacuauuguucagcuagaaaaugaaaucuaucaaauuaagcagcaacauggagaggcaaacaaagaaaacauccggcaagacuucugaaaagacaauuuagcagguagaagaaaaguugggcuuucacaaaaggcaucugaacuuuuaaugaacuuugaaggacaacagcaucuucccaaaaccauugauguuuaaguguuuagaaaucauagaagguguaggcugcugugguaauucuauuuguauaucucaacagaauuaaaaugucuagcuuggugguauuuuuauagccauaaaagaaaaucuuuaggcuuucaaaauaaggaugacuuuagaauaauauugugucauagaauuaauuuucagccauguggaccauauuuuguauccaaggauccuuauuuaaagcuuucaacauguacaggaaguuggaaauuuuugguuuaugacuuugucuaauaaagagauaguucuaaacacauucuugaucaccaaacaacuucagaaagacagugacuguacaguuaucauuaucaucaucaucgucaucaucauagguaacaguuauaucaagcuuaauaugugcugaacauuguucugaacacuuuagguagaugaacuagauguaugugaauaaaaauuauuugguccucacaa
